United States Patent 10,696,975 (GENES AND USES FOR PLANT ENHANCEMENT) - sequence listing, part 17

SEQ ID NO: 75522 - protein, 355 aa, Bordetella pertussis Tohama I
MAAKHRIAVIAGDGIGKEVMPEGLRVLEAAATRFGIDFQWDHFDWSCDYYARHGKMMPDDWAAQIGGHEAIFFGAIGWPDAVPDHEALWGSLFRFRRDFDQYINLRPVRLMPGVPTPLANRKPGDIDFFIVRENTEGEYSNSGGRLFAGTEREVVIQESVFTRVGADRVLKFAFELARKRGKHLTAATKSNGISISMPWWDERVAEMAASYPDVRWDKYHIDILCAHFVQHPDWFDVVVASNLFGDILSDLGPACTGTIGIAPSANLNPERKFPSLFEPVHGSAPDIYGKGIANPIGQIWSGALMLDFLGYPQAAAAVVAAIEQVLVDGPRTPDMQGKATTTEVGSAIAALVAAG

SEQ ID NO: 75523 - protein, 413 aa, Xanthomonas campestris pv. campestris str. ATCC 33913
MNASVAATPAPDWERVRSDFPLLMRQVHGKPLIYFDNANTGQKPLQVIAATDEFYRRQNANVSRAVHALGTEATDAFEGARSKLARFLNVRADELVLCSGTTFAINLVAYSWALPRLGPSDVILVSRMEHHANIVPWQLVAQRTGATIRVAEITPEGALDLDALRKAMTPEVKLLAITHVSNVLGTVNPVREICREARKRGIVTVVDGSQAAPHRRVDVAGIGCDFYAITGHKMCGPTGTGALWARREHLQAMPPFLGGGEMIKEVSFEGTVFNDGPHKFEAGTPNIAGFIGLGAAVDYLDAVGLAHVEARETELLAHFTEELQRIDGLRIFGTTPDKAAVVSFLIEGAHAHDLATLLDLEGVAVRSGQHCAHPLLQYYGVAATCRASLAFYNTHDEIERFVAALVKVRQLLG

SEQ ID NO: 75524 - protein, 132 aa, Oryza sativa
RGGPTPGTGRGRGLPKHVSRKDFPPSQNGVGKRSSDDIDILHTESLIKEVERVFSINNPDPLEVEKAKKVLKEQEQSLIDAIARLAEASDGESDEHNRVRRNAPYAGSQHQANYADAMAVDGGHMLGGADAV

SEQ ID NO: 75525 - protein, 231 aa, Triticum aestivum
VTLQNKFVQKSRLLPVRNSRDIVDPRVRCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDHFVKLVSWYDNEWGYSTRVVDLIRHMHSTK

SEQ ID NO: 75526 - protein, 218 aa, Thermosynechococcus elongatus BP-1
MPLPITAAQAAYYGDAYYRTPPPDLPSLLLKERIVYLGMPLVPAVTELIIAELLYLQYDDPEKPIRIYINSTGTSRYDGEPVGFETEAFAICDTMRYIKPPVHTICIGQAMGMAAMLLSAGTKGCRASLPHATIVLHQTKSYAQGQATDIQIRAKEVLANKAMMVEILAQNTGQPPERITRDMDRLLYMTPQMAKEYGIIDRILEPEAVTKKLPATLT

SEQ ID NO: 75527 - protein, 287 aa, Thermosynechococcus elongatus BP-1
MNQRLSSRLTSAVAAIAIVLLVLLLNAVVIINPGQAGVLSILGKAQDTPLLEGIHWKPPFIASVDVYDVTVQKFEVPAESATKDLQDITASFAINFRLDPMAIVDVRRTQGTLENIVAKIIAPQTQEAFKIAAARRTAEEAITKRDELKQDFDHALEERLSKYHILVLDTSVVNLDFSEEFSKAVEDKQIAEQRAQRAVYIAQEAAQQAQAEINRAQGKAEAQRLLAETLKAPGGQLVLQKEAIEAWREGGAQVPQVIVINGQEGLPPFLLNWSSEQSVRERSPKSP

SEQ ID NO: 75528 - protein, 91 aa, Glycine max
MSVKVNCVGGDTHNVFVYGSLLADEVVHTLLKRVPPTAPAILHDYHRFKIKGRVYPAILPVQNNKVYGRVLLGISRVELDILDEFEDVEYT

SEQ ID NO: 75529 - protein, 476 aa, Zea mays
MRSWARAALGVAELLVSAAIHLGYAFYIFGTAVAADVSASLVKGLMAGGGVAKDVAVDGEDEAAAVLDDGAVPPIVLVHGIFGFGKGRLGGLSYFAGAEKKDDRVLVPDLGSLTSVHDRARELFYYLKGGQVDYGEEHSREYGHSRFGRTYARGHYPAWDEEHPVHLVGHSAGAQVIRLLQQMLHDREFEGHGDTSERWVLSVTSLSGALNGTTRAYIDGMRAEKEGGGRWLRPVCLLQICRVGSVLYHWLDLPWLKRYYDFGFDHFGMSRRVVGVAGLAEILLDAGSGGGRRGPFATGDWILPDLTIQGAARINARVRTFPATFYFSYASRRTARSPPGSAGATVPSGVTRIHPLLFIRVLQMCRWRYPAGADPPYQGYRDEDWEDNDGALNTFSMTHPRIPVEHPSVQVEKDEDCRPLRPGIWYYKIVEADHMTFVINRRRGGVQFDLVYDSIFDNCRKHVFRTAPPPTLPVQS

SEQ ID NO: 75530 - protein, 313 aa, Streptococcus pyogenes M1 GAS
MTKIYKTITELVGQTPIIKLNRLIPNEAADVYVKLEAFNPGSSVKDRIALSMIEAAEAEGLISPGDVIIEPTSGNTGIGLAWVGAAKGYRVIIVMPETMSLERRQIIQAYGAELVLTPGAEGMKGAIAKAETLAIELGAWMPMQFNNPANPSIHEKTTAQEILEAFKEISLDAFVSGVGTGGTLSGVSHVLKKANPETVIYAVEAEESAVLSGQEPGPHKIQGISAGFIPNTLDTKAYDQIIRVKSKDALETARLTGAKEGFLVGISSGAALYAAIEVAKQLGKGKHVLTILPDNGERYLSTELYDVPVIKTK

SEQ ID NO: 75531 - protein, 297 aa, Prochlorococcus marinus subsp. marinus str. CCMP1375
MIEDVVKHSLSFPSNSKMLIFGGGFTGQHIAKVARQLGANVLCSRRELNKEGADFAFDSSKKVGIPDHILNHVTHVISCIPPTKEGEDPVLNNFSEKLKAIKPNWIGYLSTTGVYGDYKGEWVTEKSFTHPKQKRSIRRLSCEKKWEALGLPVQILRLPGIYGPGRSTLEAVKSQKNLVVNKPGQVFSRVHIDDIAGAVMHLIHLFSSKTSPKIINIADNVPATNVEVMSYAANLLKIPLPPIESFDIACKNMSPMALSFWQENRRVSNHVLCKTLGYQLIHSDYKSGLTDCLKCID

SEQ ID NO: 75532 - protein, 812 aa, Acidovorax sp. JS42
MRPIHRAYARREGSMMESKSYTAWFEDLGSGDVGQVGGKNASLGEMIRSLKAEGVRVPDGFATTAAAYREYLAGNGIEEAMRGHLQAMRDGRATLHEAGEALRRLFLDGEFPAPIAAAIAADYRELSRRAGAAEVAVAVRSSATAEDLPEASFAGQQETFLNVRGERELVDACRRCYASLFTDRAISYRETKGFDHMDVALSIGVQRMVRSDKAGSGVMFSIDTESGFPGTVVISAAWGLGENVVQGAVNPDKYLVFKPLLDQPRYRPIIEKTVGAKEKKLVYATGGSERTRNVETTRREREALVLDDDEILQLARWAATIERHYGRAMDMEWAKDGETGELAIVQARPETVQSVRAGSRLKTYRLRERGQRLLSGAAIGQAIAGGELCVIRNAREIDRFRPGAILVTEITDPDWVPIMKQAAGIITDHGGSTSHAAIVSRELGVPAIVGTQHATELLRDGQAVTLSCAEGDIGYVYDGILDYEVSDVDVESLPHTRTAMMVNVASPAAAFQWWRLPAGGVGLARMEFIINNVIKVHPMALVHPERVEDRQALREIRALTRGYEDPQEYFVDRLAQGIAKIAAPYHPHPVIVRLSDFKTNEYAHLIGGAGFEPGEENPMLGFRGASRYYSDRYREGFALECRALRRVREEIGLANVIVMVPFCRTPQEADRVLAVMAEHGLERGRNGLQIYVMAEIPANIILAEQFARRFDGFSIGSNDLTQLTLGVDRDSAELAALFDERNEAVTASIRDLIRRAHACGTKVGLCGQAPSNHPDFAEFLVEAGIDSISLNPDSFVETVRRVADAERRFAPR

SEQ ID NO: 75533 - protein, 423 aa, Clostridium tetani E88
MEKNNYSKEVKKTYTPLLAIEEASRCLLCYDAPCSKNCPVDTKPDEFIRSLRFKNLKGAAETIRKNNILGGVCSRLCPYDKYCQKNCTRGKIDKPIDIGSLQRYLIEFEKNIRLDTLNKVEINKEKVAIIGSGPGGLSAAASLAQKGYKVNIFEKKEKFGGWLTYGIPEYRLPQNLVDYEIDIIRKLGVEFKANCNVGKDITIDDLKEKGFEAILLACGQQQSKELNIEGIKLKGVLKGTEFLSEAKLSNGNLEVGQKVIVIGGGDVAIDSAVTAKLLGAEDVKIVYRRNIEKMPSNKNERIYAHNLNIPIFTGIKPYSLIGNNEKVISFKGVGMFDDSSLELEVDTVIFAIGQELEDLSYIDELKIENNEVLVDENLNTSIEGIFACGDIIKGNKTVVDAVATGKRVAIEIEEYIRRKGDVR

SEQ ID NO: 75534 - protein, 384 aa, Prochlorococcus marinus subsp. marinus str. CCMP1375
MKEKLTLMIPGPTPVPERVLKALSKHPIGHRSREFQDIVKSTTELLKWLHQTKGDVLTITGSGTAAMEAGIINTLSKGDKVICGENGKFGERWVKVAKAYGLEVITVKANWGEPLDPENFKNLLNDHQDIRAVIITHSETSTGVINDLEKISSYVKHHKNAITIADCVTSIGACEVKMDDWGVDVIASGSQKGYMMPPGLSFVAMSEKAWQANIRSDLPKFYLDLISYKKTVDKDSNPFTPGVNLYFALEEALIMMKEEGLESIFMRHQRHMKATQEAMKSIGLNLFAKNGFGSPSITSIMPEGIDAEKIRKTVKEDFDILLAGGQDNLKGKIFRIGHLGFINDRDIITAIASIEATLNKLGKSKYPIGTGVAIATKILNERSN

SEQ ID NO: 75535 - protein, 624 aa, Arabidopsis thaliana
RNYLRCSLSKRLMRRKLPFSMCCGYCLQASYSCLYFRKFLEAAPVLGYLAAGILIGPYGLSIIRNVHGTKAIAEFGVVFLLFNIGLELSVERLSSMKKYVFGLGSAQVLVTAAVIGLITHYVAGQAGPAAIVIGNGLALSSTAVVLQVLQERGESTSRHGRATFSVLLFQDLAVVVLLILIPLISPNSSKGGIGFQAIAEALGLAAIKAAVAITGIIAGGRLLLRPIYKQIAENRNAEIFSANTLLVILGTSLLTARAGLSMALGAFLAGLLLAETEFSLQVESDIAPYRGLLLGLFFMTVGMSIDPKLLLANFPLIMGTLGLLLVGKTILVVIIGKLFGISIISAVRVGLLLAPGGEFAFVAFGEAVNQGIMTPQLSSLLFLVVGISMALTPWLAAGGQLIASRFELQDVRSLLPVESETDDLQGHIIICGFGRIGQIIAQLLSERLIPFVALDVSSDRVAIGRSLDLPVYFGDAGSREVLHKIGADRACAAAIALDTPGANYRCVWALSKYFPNVKTFVRAHDVDHGLNLEKAGATAVVPETLEPSLQLAAAVLAQAKLPTSEIATTINEFRSRHLSELAELCEASGSSLGYGFSRSTSKPKPPSPSETSDDNQIIEGTLAI

SEQ ID NO: 75536 - protein, 495 aa, Rhodopseudomonas palustris CGA009
MADSVSAAITEPPQVPPAATGRVIDTDIPARLDGLLWSRFHTRVVAALGITWILDGLEVTLAGALAGALKDSPSLRFSNLDVGLANSAYLAGAVIGALGFGWLTDRIGRKKLFFITLALYLTATAATALSWSVTSYALFRLLTGAGIGGEYTAINSTIQELVPARYRGWTDLVINGSFWIGAAIGAVCAIVLLDPAVIDPDHGWRLAYLTGAVIGLVVFAMRWWIPESPRWLMIHGQPERAEAIVADIEQSARHAPDRPRVLPKIKLRMRTHTPLLEVAKTLFGTYRQRSLVGLVLMTAQAFFYNAIFFTYALILTDFFGISANHVGWYILPFAAGNFLGPLLLGRLFDTLGRRTMIGFTYGVSGLLLALSGYLFSIGALSAQSQTIAWMVIFFFASPAASAAYLTVSETFPLEVRALAIAIFYAIGTGIGGVAGPALFGALIDTGSRGSVFAGYLFGSVLMMAAAVIGWRYGIAAERRSLEHVARPLAATEDIR

SEQ ID NO: 75537 - protein, 142 aa, Wolbachia endosymbiont strain TRS of Brugia malayi
MSKILIVNSIYYTEIANLLLEGATDKLKGSNASYNVIEVPGAFEIPAAILFAVKSKHFNYDGYLALGCVIRGETDHYQYICKGVIKGLNEVVMHNTVPLGMGVITADSKDKALVRADKDKKNIGGRTASAVLHMIDLYNKLR

SEQ ID NO: 75538 - protein, 455 aa, Pseudomonas syringae pv. tomato str. DC3000
MSANNNPQTLEWQALSSEHHLAPFSDYKQLKEKGPRIITRAEGVYLWDSEGHKILDGMSGLWCVAIGYGREELADAASKQMRELPYYNLFFQTAHPPVLELAKAISEIAPQGMNHVFFTGSGSEGNDTMLRMVRHYWALKGQPNKKTIISRVNGYHGSTVAGASLGGMTYMHEQGDLPIPGIAHIPQPYWFGEGGDMTPDEFGVWAAEQLEKKILELGVENVAAFIAEPVQGAGGVIVPPESYWPKIKEILSRYDILFAADEVICGFGRTGEWFGSDFYGLKPDMMTIAKGLTSGYVPMGGLIVRDEIVAVLNEGGDFNHGFTYSGHPVAAAVALENIRILREERIVERVKSETAPYLQKRLRELNDHPLVGEVRGVGLLGAIELVKDKVTRERYTDKGAGMICRTFCFENGLIMRAVDDTMIIAPPLVISFAQIDELVEKARTCLDLTLAALQS

SEQ ID NO: 75539 - protein, 660 aa, Hordeum vulgare subsp. vulgare
MPRTVSDGGEDFDGDVCSQTASQRHTDSTHHHHGYKVGFPPAKGVFAEFAEGVKETFFADDPLREYKDQPRSKKLWLSLVHLFPVLDWSRSYTFGKFKGDLVAGLTIASLCIPQDIGYAKLANLQPHVGLYSSFVPPLIYALMGSSRDIAIGPVAVVSLLLGTLLQEEIDPVKNPLEYSRLAFTATFFAGITQAMLGFFRLGFIIEFLSHAAIVGFMAGAAITIALQQLKGLLGIAKFTKKSDIISVMESVWGNVQHGWNWQTILIGSSFLAFLLTTKYIAKKNKKLFWVSAIAPLISVVISTFCVYITRADKQGVAIVKNIKQGINPPSFDLIYWSGPYLAKGFRIGVVSGMVALTEAIAIGRTFAAMKDYQIDGNKEMVALGTMNIVGSMTSCYVATGSFSRSAVNYMAGCKTAVSNVVMAIVVMLTLLLITPLFKYTPNAILASIIINAVVNLVDYETAYLIWKVDKMDFVALLGAFFGVVFASVEYGLLIAVAISLGKILLQVTRPRTALLGNLPRTTIYRNVEQYPEATKVPGVMIVRVDSAIYFTNSNYVKERILRWLRDEEEQQQEQKLSKTEFLIVELSPVTDIDTSGIHALEELLKALEKRKIQLILANPGPAVIQKLRSAKFTDLIGDDKIFLSVGDAVKKFAPKSSLNV

SEQ ID NO: 75540 - protein, 458 aa, Pseudomonas syringae pv. tomato str. DC3000
MSVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHEIEGDPFFADPREVLRQVVAKFDEMGLTICAAFELEFYLIDQENVNGRPQPPRSPISGKRPHSTQVYLIDDLDEYVDCLQDILEGAKEQGIPADAIVKESAPAQFEVNLHHVADAIKACDYAVLLKRLIKNIAYDHEMDTTFMAKPYPGQAGNGLHVHISILDRDGKNIFTSEDPEQNAALRHAIGGVLETLPAQMAFLCPNVNSYRRFGAQFYVPNSPTWGLDNRTVAVRVPTGSADAVRIEHRVAGADANPYLVMASVLAGVHHGLVNKIEPGAPVEGNSYEQHEQSLPNNLRDALRELDDNPVMAKYIDPKYIDIFVACKESELEEFEHSISDLEYNWYLHTV

SEQ ID NO: 75541 - protein, 794 aa, Neisseria gonorrhoeae FA 1090
MADNYVIWFENLRMTDVERVGGKNASLGEMISQLTEKGVRVPGGFATTADAYRAFLAHNGLNERISAALAKLDVEDVSELARVGKEIRQWILDTPFPEQLDAEIEAAWNKMITDADGADISVAVRSSATAEDLPDASFAGQQETFLNINGLDNVKKAMRHVFASLYNDRAISYRVHKGFEHDIVALSAGVQRMVRSDSGASGVMFTLDTESGYNQVVFVTSSYGLGENVVQGAVNPDEFYVFKPTLKAGKPAILRKTMGSKHIKMIFTDKAEAGKSVTNVEVPEEDRNRFSITDEEITELAHYALTIEKHYGRPMDIEWGRDGLDGKLYILQARPETVKSQEEGSRNLRRYAINGEKTVLCEGRAIGQKVGQGKVRLIKDASEMDSVEAGDVLVTDMTDPDWEPVMKRASAIVTNRGGRTCHAAIIARELGIPAVVGCGNATELLENGQEVTVSCAEGDTGFIYAGLLDVQITDVALDNMPKAPVKVMMNVGNPELAFSFANLPSEGIGLARMEFIINRQIGIHPKALLEFDKQDDELKAEIIRRIAGYASPVDFYVDKIAEGVATLAASVYPRKTIVRMSDFKSNEYANLVGGSVYEPHEENPMLGFRGAARYVAESFKDCFALECKALKRVRDEMGLTNVEIMIPFVRTLGEAEAVVKALKENGLERGKNGLRLIMMCELPSNAVLAEQFLQYFDGFSIGSNDMTQLTLGLDRDSGLVSESFDERNPAVKVMLHLAISACRKQNKYVGICGQGPSDHPDFAKWLVGEGIESVSLNPDTVIETWLYLANELNK

SEQ ID NO: 75542 - protein, 464 aa, Oryza sativa Japonica Group
MAASPAAAAAAATVSSFVSPSSFSSVKASKPDRLRPARRAAAVNVRCVSSPPATETSFKTKVPRNANMAKLQAGYLFPEIARRRAAHLLKFPDAKIISLGIGDTTEPIPDVITNAMAERAHALSTVDGYSGYGAEQGEKKLRAAIAATYYADLGIEETDIFVSDGAKCDISRLQVLFGSNVKIAVQDPSYPAYVDSSVIMGQTGLYQEDVQKYGNIEYMKCSPENGFFPDLSSVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNISQAGGLGCLSPEGLKAMSDVVGFYKENTKIIVDTFTSLGFNVYGAKNAPYVWVHFPGRNSWDVFAEILEKAHVVTTPGSGFGPGGEGFVRVSAFGHRENIIEAARRLKQLYK

SEQ ID NO: 75543 - protein, 351 aa, Francisella tularensis subsp. tularensis SCHU S4
MKALAKLKKQPGIWIINDAPIPEYGYNDVLIKIKKTAICGTDLHIYNWDKWSQNTIPVPMITGHEFAGEVVAKGDGVTSVDIGDRVSGEGHLVCGQCRNCRAGKRHLCRKTIGIGVNVQGAFAEYLVMPAVNVFKIPDSISDDIASTFDPMGNAIHTALSFNLTGEDVLITGAGPIGLMAVKIARFCGARRIVITDINEYRLQMARDFGATVALNVAPFKNQDELVKQMRKVMSDIGMTEGFDVGLEMSGINSAISMMLDVMNHGGKLSLLGISAGDISVDWGAILFKGLTLKGIYGREMFETWYLMTSMLQAGMDMNPIITHRLHIDEFQKGFEIMKSGQCGKVILDWSS

SEQ ID NO: 75544 - protein, 424 aa, Bordetella pertussis Tohama I
MDNAELTRRKEAATPRGVGVMCNFYADRAENAELWDTEGRRYIDFAGGIAVLNTGHRHPQLMQALQAQMSRFTHTAYQIVPYASYIQLAERINQLAPGDFAKKTALFTTGAEAVENAVKIARTATGRPAVVAFGAAFHGRTLLGMALTGKVVPYKVGFGPFPADIYHVPYPNALHGVSTDDALAALGTLFKTDVDPRRVAAIIIEPVQGEGGFNICPPAFMQALRALCDDHGILLIADEVQTGFGRTGKLFAMEHYGVAADLTAMAKSLAGGMPLSAVCGRAEVMDAPPPGGLGGTYAGNPLAVAAALEVIRIIETEDLLARGTRLGHQLRDHLEAQRHDAPEIAEVRALGAMVAVEFRQPGSDAPSPEFARQVQARALEQGLLLLTCGSDGNVIRFLFPLTIPEAVMREALDILARTLRGQNA

SEQ ID NO: 75545 - protein, 635 aa, Rhodopirellula baltica SH 1
MNFSPVIGTFDETMRFWERFSRPLVFVCTTFSFRNLLRMAVLIQLRDAEKRFGDQVLLNGANVSLVDDVKVGFVGRNGAGKSTLLRILLGEEEVEKGEVIHHPNLRIGYLRQHDPFHEGESALDFLMRDSGEPDWRCGQVAGQFELKGDYLEGPVKALSGGWQTRVKLAALLLHDPNLLMLDEPTNFLDLRTQILLEHFLRDFGKAALIVSHDRAFLKATCSQTLELSRGQLTMFPGKIQEFLEYREERREHEKRVNATVVAKQKQLQRFIDKNRANASTASQARSKAKQLERLQTTEIVGDEPTVNIRAPRVQPRQGTAVRCEGLAIGYPGHVVAEDISLEIEHGQRAAIVGDNGQGKTTMLRTLVHSLEPIEGSMKWGHGIEIGTYAQHVYTTLDERQTILEHLEYASDPETTRQDVLAMAGALLFRDEHIQKKIKVLSGGERARVCMASLLLGTANVLVLDEPGNHLDVETVEALADALKLYKGTVIFTSHDRHFMAEVATNVIEVRDRRVRNYFGSYETYCEAVEKEIDEGERVRNANAKASGTAPKTGAAKGSGDSRQDQKDQRKREKEVKNLERKIAKLDDEKKDLNKKLLTETDPGEAVRLHDQMKEIESELSEAEERWMELSADQWE

SEQ ID NO: 75546 - protein, 497 aa, Bordetella pertussis Tohama I
MSTLPPLSHWESLAAGLTLRNQAFIDGRWHDGQAGPLAAINPATGQLLAEVTACSQADIDQAVAAARRAFESGVWSRMPRRERKQCMLRLAALIREHAEELALIETLNMGKPIGDTMAFDIPETAHTYAWYAETIDKQYDEIAPTDADALATITREPLGVVAAVVPWNYPLLMASWKVAPALAAGNSVILKPAEQSSLSALRLAELALQAGIPAGVLNVVPGAGPVAGRALGLHMDVDCLAFTGSTATGKRFMEYSGQSNLKQVWLECGGKSPHIIFDDCPDLDRAALAAAIGIFNNQGEVCIAGSRLYVQAGIYDTFVSKVEACARAMQPGNPLDPASPMGAMVDERQMARVLEYVESGRREGARLRMGGERVRADSGGYYIEPTIFECARPDLTIVREEIFGPVLAVTRFDGEDEVVAQANASAYGLGSGLWTADLSRAHRVSRRLRAGLVWVNCYFDGDVTVPFGGVKQSGFGRDKSLHALDKYTSLKTTWIRL

SEQ ID NO: 75547 - protein, 337 aa, Bifidobacterium longum NCC2705
MTVLVTGGCGYIGAHVVHALHQAGEKVVVVDDLSYGKPTRIEGSRLYGMDIATPGAGERLAEILDAEGVDSVIHFAARKQVGESVEKPLWYYQQNINGMLNVLTGMTQSKNAKKLVFSSSAATYGVPPVDVVPEDVVPMLPINPYGQTKLFGEWMARACEQPFGIRFCALRYFNVAGCGPVELEDPAILNLIPMLFNRLKQGKAPAIFGDDYPTPDGTCVRDYIHVSDLADAHIAALKYLDRDKRKYDAFNVGTGEGTSVRQIVDEVKKVTGLPFTEAVMARRAGDPPHLIGSPKRINEEMGWHAKYDVEDIVKSAWDAWQANPEHHIDVDTWKQAD

SEQ ID NO: 75548 - protein, 294 aa, Leptospira interrogans serovar Lai str. 56601
MKSRKGIILAGGSGTRLYPVTYVVSKQLLPVYDKPMIYYPLTTLMLAGIKEILLISTPQATPMYKELLGDGKQWGISIEYAVQPNPGGLAQAYWIGENFVNGHPSVLILGDNIYFGHNLASLLENASKKENGSTVFAYPVHDPERYGVVEFDSERRAVSIEEKPSKPKSNYAVTGLYFYDEEVVNIAKSIKPSARGELEITDVNRIYLERGILNVQVMGRGYAWLDTGTHESLLEASVFIETIEKRQGLKVACPEEIAFRKGFIDGSQLEKLISPLKKTGYGEYLVKVLNEKIY

SEQ ID NO: 75549 - protein, 429 aa, Bordetella pertussis Tohama I
MGPRIITHGEGVYVFDDQGNRYLEGMAGLWSVAVGFGEQRLVEAAARQFQELPYYHTFTHKSHPSVIALAERLIGYTDGRMAQAFFTNSGSEANDTVVKLVWYYNNALGRRDKKKIIARQRGYHGVTVASASLTGLPGNHKDFDLPLPQIRHTACPHYYRYGLPGETEEDFATRMAGELEAMILREGPDTVAAFIGEPVMGAGGVIVPPRTYWQKIQAVCRKYDILVIADEVITGFGRLGQRFGSQVFDIEPDIMVLSKQITSSYQPLGAVLLNTRVADVVAEHSGRLGTFGHGYTASGHPVATAVALENLRLIDERGLIEHAAEMGALLHQELQALSSHPLVGEVRGVGLIAGVELVADKATRQPFDPLGKAGGYAYERAHDHGLIVRGIQDTVAFCPPLIITAEQVRDMVARFARTLDDVAAHVAQG

SEQ ID NO: 75550 - protein, 528 aa, Prochlorococcus marinus subsp. marinus str. CCMP1375
MSDPKVTTQRNPSIVILDFGSQYSELIARRIRETEVYSMVLGYNSSVEELKKLSPQGIILSGGPSSVYEEKAPLCDPSIWDLDIPILGVCYGMQVMVKQLGGLVGEAIGKAEYGKALLQVDDPTALLTNVENGSTMWMSHGDSVKQLPAGFVRLAHTTNTPDAAIACHDRRFYGVQFHPEVVHSTDGMVIIRNFVHNICRSKPDWTTNTFIDEAINDVQEKVGKKRVLLALSGGVDSSTLAFLLKKAIGNQLTCMFIDQGFMRKGEPEFLMEFFDKKFHINVEYINARDRFLDKLQGVSDPEKKRKIIGTEFIRVFEEESLRLGPFDYLAQGTLYPDVIESSGTNIDPKTGERIAVKIKSHHNVGGLPKDLQFKLVEPLRTLFKDEVRKVGRSLGLPEEIVNRHPFPGPGLAIRILGEVTKEKLNCLRDADLIVREEIADAGLYHQIWQAFAVLLPVRSVGVMGDQRTYAWPIVLRCVSSEDGMTADWSRLPNSLLEKISNRIVNEVNGVNRVVLDITSKPPGTIEWE

SEQ ID NO: 75551 - protein, 434 aa, Brucella melitensis 16M
MLACIVDMQGRLIGKRFYGQFFVESGYDETHGCNYLLADDIDMEPVPGYEAAGWDKGYGDFVMKPDLSTLRLAPWLEKTAIVLCDVLDHHHDDLSHSPRAVLKKQVQRLHERGYRAYFASELEFYIFDETYKSARAKRWHEMETASPYVQGYVIHLTTREEPVLRAMRNHLADAGIPVENSKGEWGPGQQELNVRYCKALEMADRHVIMKNAMKEIAEAHGKCITFMAKYDYARAGSSSHVHNSIWSADGKEPLFFDPKAPYTMTPLMRSWVAGQIKYATDYTYFLAPYINSYKRFQAGTFAPTKIMWSQDNRTAGFRLCGEGTKGIRIECRIGGADINPYLAFAALIAAGLKGVDEKLELDEPFVGDAYSAVRLKEIPYTLREAAAALKGSAFLKEAFGEDVVNHYTHTAHWEQIEYDRRVTDWELYRGFERY

SEQ ID NO: 75552 - protein, 515 aa, Zea mays
MYKNQLQELAQRSCFNLPSYTCLREGPDHAPRFKAAVNFNGEQFESPGFFSTLRQAEHAAAEVALAALARRGPSYSLAARILDETGVYKNLLQEVAQRVGAPLPLYTTERSGVGHLPVFTCTVELAGITFTGDHAKNKKQAEKNAASAAWSALKQLVREEVNSSNETENSDEQEQIRIARALLNYRLKEKMAMANYPHVSPFPKKFPMQPERKPSFGQSSQSSYSKILPLFRPKSNSRSRPESPASTDGASQMPGRAMDIHTPSPRSRFPAAEAAPYVPVGHFRMPCHSMAPSVTIRTAVPVFSAPPLPPPSARPQQLPPLMSHPPPIRMASPVRMRPASPMFASSAPAQGPKLVRPVQLKDVQDQPRKETAPSVIPVQVKDVQYQSRKSSMSPVIPVVVKDAQRQPLPVQTKDVQTQTQAPKESLADPIPAIRPAVKIDLPAQGKKEASAGATSEAPSSATGNNGAMERGTSSDVLLARRSRAAVDGDGDKVEAKHEAEAQAVAEAAIRQLEIN

SEQ ID NO: 75553 - protein, 463 aa, Glycine max
  misc_feature (353)..(353): Xaa can be any naturally occurring amino acid
APPPIQTKLQTKLSLSLSLSLFLSMHRSLKVAVIGAGVSGLAAARELRHEGHNVVVLEKSNHVGGMWAYDPKTDSDPLGLDPTRETVHSSLYLSLRTNLPRQLMGFSDFPFVKNESGDPRTFPGHEEVLRFLEGFAGEFGINELTQFETEVVRVERKGNEWVVESRTSRDGDSVSREGFDAVVVCSGHFVEPKLAEVPGIDTWRGFQMHSHNYRVPQPFHNQVVILIGLGPSAFDISREIAQVAREVHVATRLNPDLAGMKLGDYGKIMFRTAVKCVFEDGLVAFEDGFSVYADAIIHCTGYKYHFPFLETNGLVTVDDNRVGPLYKHVFPPALSPWLSFIGLTFKNSVYQIXELQCKWVAKVLSGKVLLPTEKEMMESVKEYYQLMEENGLPKRYTHSLYPLQADYKHWLVAEIGLPPLEEWKENMLKQCFKNFVEMNEKYRDEWDDTYWDAIIHGAPASEK

SEQ ID NO: 75554 - protein, 139 aa, Francisella philomiragia
DQDVFKKLNKIIDTSVVPVVCIGESLEDRQGGRLEKVLITQLSLILENLSIEQLAKVVIAYEPVWAIGTGVVASLEQVQETHQFIRSLVAKVDQNLAKNMKIVYGGSLKAENAKDILSLPDVDGGLIGGASLKASEFNE

SEQ ID NO: 75555 - protein, 313 aa, Carboxydothermus hydrogenoformans Z-2901
MAKFLVTGGAGFIGSHIVERLVRDGAEVVVLDDLSSGKEENLSEVLDKITFIKGDVRDLDLIKGITKDVDYILHEAAMASVPASIDDPLKCHEVNVTGTINVLLSAKENGVKRVVYAASSAVYGNNETLPKKEDMYPEPLSPYAVSKYAGELYLQVFARIYGIEAVGLRYFNVFGPKQDPNSQYAAVIPKFIDALLKGMPPTIYGDGMQTRDFIFIDDVVEANMLALTARGASGKVFNIACGERISLNRLYKVIKEIIGVDIEPVYAEARVGDVRDSLADISLARNILGFEPKVSLEEGLKKTVEWHKRNLEV

SEQ ID NO: 75556 - protein, 482 aa, Escherichia coli
MSDVPLIAVVMAGGTGSRLWPLSREHYPKQFLQLSGESSLLQSTLLRLSTLSCETPLVITNEQHRFVVAEQLRQIDQLRDNIILEPCGRNTAPAIALSAFTALKRNEQQDPILLILAADHIISKADVFCDAIQKSKTVAEQGNIVTFGIIPEYAETGYGYIKKGDPFKILPNITHDKFYHVQQFIEKPNHSTAEEYVSTGEYLWNSGMFMFKASVYLEELKKHRPDIYEICEQTASLSYNDLDFIRLPKHIFQDCPSESIDFAVMEKTKNCIVRPVDIGWSDVGSWHSLWDISDKTQDGDVCKGDILTYNTKNNYIYSESALVAAVGVEDIVIVQTKDAILVSKKTEVQDVKKIVEMLKEQERSEYISHREEFRPWGKFDAIDQGERYKVKKIVVKPGEGVSLRMHHHRSEHWIVLSGTAKVTLNDKTVLLAANESIYIPLGATYSLENPGIIPLNLIEVSSGDYLGEDDIVRQKERYRIDD

SEQ ID NO: 75557 - protein, 396 aa, Dechloromonas aromatica RCB
MAQLILLPGKERSAFKHHPWLFAGSVGRLEGRARPGDTVEVLADNLRPLGRAAYSPKSQIRARFWTFDAEESIDDAFFKRRIAAAVALRQALPELRGQQGLRLIHAESDGLPGVIADQYGDTVVIQLTSAGADKWRNAIVAGLVKATGCARVYERSDSDVRGLEGLGPTTGWLHGEAPATPLSIDENGVRLAIDIAGGHKTGFYLDQRENRALLGQLSAGKDVLNCFCYTGGFSLQAMAGGAKSVLSIDSSGPALAQAKANLALNPQLPADRAEWQEADVFQALRDFRKAGKLFDLIVLDPPKFAPSAAHADRAAKAYKDINILGCRLLKPGGLLMTYSCSGGVGLEMFQKIIADSALDAERSARIVRRLSGAADHPVALNFPEGEYLKGLLVQVD

SEQ ID NO: 75558 - protein, 285 aa, Lactobacillus johnsonii NCC 533
MKFNSVEDTYTLNNGVKIPIIGFGTWQTPDGDVAKHVVEAALNSGYRHIDTAAAYGNEESVGEGIKNSGINRHDLFITTKLWNADHGYKEAKAAIDKSLQNLGTDYLDLYLIHWPNPLALRDHWAEANAESWRAMEEAVKAGKIRAIGVSNFRKHHLEELLKTAEIKPAVNQIMLNPSDLQSDVVKVNEELGLLSEAYSPLGTGGLLGNEVVNEIANEVGKSPAQVLIRWSLEHGFLPLPKSVHDKYIAANIDVFDFELNDEQMSKLDSLHGVSDLATDPDTANF

SEQ ID NO: 75559 - protein, 443 aa, Lactobacillus johnsonii NCC 533
METIKNIIIGFGKGGKTLAKFLAQKGEEVLVIEKSNKMYGGTCINIACLPSKRLIIEAANGVSYVDAVNGKNEMTAQLREKNYHMLADEKTVTVLDGEAHFIADHEIEVKLPNGKKVQYKGDRIFINTGAVPVMLPIPGLKESKYILDSTQAMDEKKMPKNLTIIGAGYIGLEFASMFAKYGSKVTVLDHNKEFLAREDEDISNAVRKDMEDAGIKFELGADIEKITDETSDAKITYQINEERKTINADRILVATGRKPNTENLGLENTAIETTDRGAIKVDDFLRTTVDNVWAIGDVKGGLQFTYISLDDFRIIKDQLFGTGARMVSDRKVVPYSVFISPALSQVGLNEKQANKLGKEYKLFKLPVTAIPKAKVAKDNRGLFKALVDPETEKILGATLYGIESYELINMISLAMKAHLSYTVLRDQIYTHPTMSEAFNDLFK

SEQ ID NO: 75560 - protein, 362 aa, Bradyrhizobium japonicum USDA 110
MKAAVLYEVNKPLVIEDVSLPKPGPREVLIRTSVAGLCHSDLHFMEGLYPHPLPAVLGHESAGVVEQVGSDVTYVKPGDHVVTCLSVFCGTCDNCTTGRTVLCTDTTVKLLPGVSDRMQWSRSEKLHQFLNLSSFAEQMLVHENAIVKIRKEMPLDLAALIGCGVITGYGAVVNTAKVTAGETVAVIGCGGVGMAAINGAQIAGAGRIIAIDTNPAKLQLATKLGATDIINPADGDVVKQVRDLTNGGVHHSFEVLGRKETAEQAFAMLASGGTATIVGMIPFGQKIELHGFDFLRERKIQGSSMGSNHFRVDMPRLVDFYLRGRLHLEDWISAKLKLSEINEGFANMKAGKTLRSVIVFDS

SEQ ID NO: 75561 - protein, 330 aa, Lactobacillus johnsonii NCC 533
MRVLVIGGAGYIGSHAVRKLIEEGNDVVVLDSLYTGHRKAVDKRAKFYQGDIEDTNLVSKILRDENIDAVMHFAAYSLVGESVKKPLKYYDNNVSGMISLLQAMEDAKVKYLVFSSSAATYGIPEKLPITEDTPLNPINPYGETKMMMEKIMHWADKANGIKSIALRYFNVAGASSDGSIGEDHGPETHLIPNILKSAIAGDGNFTIFGDDYNTKDGTNVRDYVQVEDLIDAHILALKHVMDTNKSDVFNLGTAQGYSNLEILEAAKKVTGIDIPYTIGARRGGDPDSLVADSSKARKVLGWKPKHEDVDDVIATAWNWHKSHPKGYEDK

SEQ ID NO: 75562 - protein, 176 aa, Neisseria gonorrhoeae FA 1090
MNAIRTFQNRTPEIHETCMIDEACVVIGEVSLAEDVSVWPCAVLRGDVNSITVGARSNIQDGSVLHVSHKTAAKPEGSPLVIGEDVTVGHKVMLHGCRIGNRVLVGMGSTVLDDAVIEDDVMIGAGSLVPPRKRLEGGYLYIGSPVRQVRLLTDEEKAFLKYSAAHYVKLSKQYGM

SEQ ID NO: 75563 - protein, 407 aa, Bacillus thuringiensis serovar konkukian str. 97-27
MDTLIFEVGTALVLVAFAAILAAKLKFSIIPFLIILGMLVGPHAPDLGLIDLRFIESGEVISFLGRVGVIFLLFYLGLEFSIKKLIKSGKSIAFGGTVHISLNFLLGLLYGYVMGFPLLETLIIAGIITISSSAIVAKVIVDLRRSGNKETELILGIIMFDDIFLAVYLSVVSGLVLGGATSFAGALTSVLIAVGYMLLFFVIARKATPFLNKVLDISSNEIFIIVIFAILFFVAGFSETIHVAEAIGALLLGLVFSETEHSDRIEKLVVPFRDFFGAIFFFSFGLSIDPFSLGGAVWLALGAVFITLIGNFTAGMIAGRKAGLSHKASTNIGLTLVSRGEFSIIVANIGIAGGLMAAIKPFSALYVLILASLGPLLTKESGRIYSLLDKLFKWSAKERAKREKEVG

SEQ ID NO: 75564 - protein, 500 aa, Neisseria gonorrhoeae FA 1090
MAKVLVVPVSAGLNTSAAAQAFAKALDAQVFQAVDATAETLLAQGKSDDWFDALVGKVAALDAANLVIEGIAPDADKIYLAGKNVELALSLDAAAVFAVRSDNTDADALAHQLNLAKQFFAAAPGVLEGFVVDGAAASVAEAAAEKTGLTFFGSSDALKDVSVLAGREAKRLSPAQFRYNLIDFARQAGKRIVLPEGAEPRTVQAAAICHEKGIARCVLLAKREEVEAVAKERGISLPDSLEIIDPASLVEQYVEPMCELRKSKGLTPEDARKQLQDTVVLGTMMMAQNDVDGLVSGAVHTTANTIRPALQLIKTAPGASLVSSVFFMLLPNQVLVFGDCAVNPNPTAQQLADIAIQSADSAKAFGIDPKVAMISYSTVNSGSGPDVDTVIEATKLAREKRPDLAIDGPLQYDAATVPGVGKSKAPGSPVAGQATVLVFPDLNTGNCTYKAVQRSANVLSVGPLLQGLRKPVNDLSRGALVEDIVFTIALTAVQAKQMEG

SEQ ID NO: 75565 - protein, 61 aa, Nicotiana benthamiana
DLPLDNGVRALLRGCYKLRRFALYVRPGGLTDVGLSYVGRYSPNVRWMLLGYVGESDEGLL

SEQ ID NO: 75566 - protein, 481 aa, Arabidopsis thaliana
MESTRSDPELDDDFSEIYKEYTGPASAVTNNNIQDKDKPVKQRSEERCDEEEEQLPDPNSVPTDFTSREAKVWEAKSKATERNWKKRKEEEMICKICGESGHFTQGCPSTLGANRKSQEFFERVPARDNNVRVLFTEKVMESIERETSCKIKLDEKFIIVSGKDRLILRKGVDAVHKVKEDGEMKSSSVSHRSRSRSPRRTSVGPSRARNSEPQRQQLPSHGSSSFPERSGRQDKFVDNRFREETRVRENQRNVPRGSPQAKAYGSDRARSRSTHSKSPGRPRYSGWDKPYDRQKPEVSGYRSERWDQERMGGSSDIQVSHQFERPPFPQTLEELELEYTRDALELEKKRDKEEDEENNKHRETIRELRESYMKKLAGLRGMNAKQWDDFLQLDAQRRQQQARQQNSGLSYGNYRQFPPYAEFDDGYSSNPPPYGGNNMPMDSKGRYPNHGDNYSSRHQDNNYGGFQRQRREEYGKAYNRY

SEQ ID NO: 75567 - protein, 510 aa, Pseudomonas syringae pv. tomato str. DC3000
MTATPKPLVLIILDGFGHSESHEGNAILAAKMPVMDRLYKTMPNGLISGSGMDVGLPDGQMGNSEVGHMNLGAGRVVYQDFTRVTKAIRDGEFFENPTICAAVDKAVSAGKAVHIMGLLSDGGVHSHQDHLVAMAELAVRRGADKIYLHAFLDGRDTPPRSAKKSLELMDETFARLGKGRIATIIGRYFAMDRDNRWDRVSTAYNLIVDSSAEFHAATGVAGLEAAYARDENDEFVKATRIGEPANVEDGDAVVFMNFRADRARELTRVFVEDDFKDFERARQPKVNYVMLTQYAASIPAPSAFAAGSLKNVLGEYLADNGKTQLRIAETEKYAHVTFFFSGGREEPFPGEERILIPSPKVATYDLQPEMSAPEVTDKIVDAIEHQRYDVIIVNYANGDMVGHSGIMEAAIKAVEYLDVCVGRITDALEKVGGEALITADHGNVEQMTDDATGQAHTAHTSEPVPFVYVGKRQLKVREGGVLADVAPTMLQLLGMEKPQEMTGHSILVEE

SEQ ID NO: 75568 - protein, 143 aa, Clostridium perfringens str. 13
MRLEKSLVLIKPDAVERNLIGKILEVYEGAGLKIKAMEMKQINKEFAEKHYEEHRDKQFFNSLIKYITRSPLVALILEGEDAINKIRSLNGATNPEKAEFGTIRRRFALSGTENSVHASDSIESAEKEIKLWFPKVFYEEICG

SEQ ID NO: 75569 - protein, 461 aa, Triticum aestivum
  misc_feature (139)..(139): Xaa can be any naturally occurring amino acid
  misc_feature (193)..(193): Xaa can be any naturally occurring amino acid
MDTHIGSVDGPSPAAVNGAVGCPASAPGCPIMSSHPVVSPGEASLGRHLARRLVQVGVSDVFAVPGDFNLTLLDHLVDEPGLRLVGCCNELNAGYAADGYARARGVGACAVTFTVGGLSVLNAIAGAYSENLPVICIAXGGPNSNDYGTNRILHHTIGIPGLLTGSYGCFQTVTCHQAVVTNLDDAHEQIDTXAIATALRESKPVYLSISCNLPGLPHPTFTRDPVPFFLAPRMSNKMGLEAAVEATVEFLNKAVKPVLVAGPKLRVAKAGKAFVDLVDASGYAYAIMPSAKGFVPETHPHFLGTYWGAVSTAFCAEIVESADAYLFAGPIFNDYSSVGYSFLLKKDKAIIVQPERVIVGNGPAFGCVMMKEYLSALAKRVQKNTTAYENYKRIFVPEGKCWTAKVKCEEELTAAIEMALGEKEDSLCFIEVIAHKDDTSKELLEWGSRVSAANSRPPNPQ

SEQ ID NO: 75570 - protein, 784 aa, Bacillus cereus E33L
MKGVILAGGKGRRLRPLTCNTPKPMLPLLEKPVLEYNIELLRQHGIREIAITVQYMSTAIKQYFGDGSKWGVNLYYFEDSPPLGTAGSIKQAEKFLDETFVVISGDALTDFQLSKGITFHEQQKRMVTMFVKEVENPLSFGLVVMNKEQEVTRYIEKPSWNEVVSNIVNTGIYIMEPEIFSYIPPREFFDFSQDVFPLLANKNALFAYLSEGYWLDIGTFDQYRQAQFDLLTKKLQVPIPYTEVLPMVWMGEGVTIGKGTKIHGPSFIGEGAKIGAGAVIEPYSIIGKNSIVSSYSHLQKSIVFANVHIGQYCELLETTIGEHTMVEDDVTLFQKSIVADHCHIGKSTVIKQKGKLWPYKAIDSYSVVGSAGVQESEKSAGWLQKSRIVGRGNVEITPQFIVKVAMAYGSLFTKGESILIGSQEHIETTSYKNLFLHAIHGIGIHTMECKEMNESLFQYSIQDLQCAGGVFIQVENEKEVIIKLYGQDGAQLTYKQQKAIEQVYMSESFYYVCEKEMGRNKLVHVSLHDYIEAVLERIDIEKIQKQKFHLLINKRNDMLQHLLMLFLQRLGCTVTWIYAGEQKNHVKALMKSSKANMALMFSEQGNYFELYDNHSNIYQGTDFEEVDIPDLLLESAGNIYPMSLKLGECYLLFYTQDEKKSFQARWKRDILYRIGKLFELIALQGKTFLSIVEQSPPLYLLCDEVVCSWNEKGKVMRKLLADMERKEEGIFEGVQFKYTEKEWSYIVSDTKQPKFLVYSHARNPVIARENMKNLIEKIRQYQKV

SEQ ID NO: 75571 - protein, 502 aa, Arabidopsis thaliana
MAISFLCVFLITFVSLIFFAKKIKRSKWNLPPSPPKFPVIGNLHQIGELPHRSLQHLAERYGPVMLLHFGFVPITVVSSREAAEEVLRTHDLDCCSRPKLVGTRLLSRDFKDIGFTPYGNEWKARRKFALRELFCLKKVQSFRHIREEECNFLVKQLSESAVDRSPVDLSKSLFWLTASILFRVALGQNFHESDFIDKEKIEELVFEAETALASFTCSDFFPVAGLGWLVDWFSGQHKRLNDVFYKLDALFQYVIDDHLNPGRSKEHEDIIDSMLDVIHKQGEDSSLELTIDHIKGFLANIFLAGIDTGAITMIWAVTELVKNPKLIKKVQGDIREQLGSNKERITEEDIEKVPYLKMVIKETFRLHPAAPLILPRETMAHIKVQGYDIPPKRRILVNVSAIGRDPKLWTNPKEFDPERFMDSFVDYRGQHYELLPFGSGRRICPGMPMGIAAVELGLLNLLYFFDWKLPDGMTHKDIDTEEAGTLTIVKKVPLKLVPVRVQ

SEQ ID NO: 75572 - protein, 278 aa, Brassica napus
  misc_feature (124)..(124): Xaa can be any naturally occurring amino acid
  misc_feature (259)..(259): Xaa can be any naturally occurring amino acid
MEGKEEDVRVGANKFPERQPIGTSAQSDKDYKEPPPAPLFEPGELASWSFWRAGIAEFIATFLFLYITVLTVMGVKRSPSMCASVGIQGIAWAFGGMIFALVYCTAGISGGHINPAVTFGLFLXARKLSLTRAVYYIVMQCLGAIWGAGVVKGFQPKQYQALGGGANTVAPGYTKGSGLGAEIIGTFVLVYTVFSATDAKRNARDSHVPILAPLPIGFAVFLVHLATIPITGTGINPARSLGAAIIFNKDNAWDDHWVXWGGQFIGAALAALYHVIVI

SEQ ID NO: 75573 - protein, 401 aa, Physcomitrella patens subsp. patens
MNPKPVPAWLNSAAWTSKPRSPIKPSYSFGERSNSATLMEPVGKSTGDQEDLLSSIAKLSRRRIHLAELQRLTSQGIPDSGGIRAITWKVLLGYLSRNRDDWATELEKKRAAYAVFREEMIINPSEVTRRKEEMEAMKAAELEALEGPLQRHEISHDDHPLSLGSKSVWHQFFQDTELAEQINRDVKRTHPDMQFFCGDNDFARENQEALKRILFIFAKLNPGIRYVQGMNEVLAPLYYVFKTDIDEFNSKHAEEDSFFCFVELLSDFRDHFCQQLDNSAVGIRSTISQMTQLLRKHDEELWRHLEITSKVNPQFYAFRWITLLLTQEFNFADSLRLWDSLLSNPDGPLEILLRVCCSMLLCLRSRLLAGDFTTNLKLLQHYPSVDINHLLKVADDLKELK

SEQ ID NO: 75574 - protein, 508 aa, Burkholderia vietnamiensis G4
MNAAVPQTTLALPTAKLLIDGAFVESRSAEWGDIVNPATQQTIGRVPYATPHEVDAAIAAAQRAFQTWKTTSIGTRLRIMLKFQELVRRNLERIAHTLTAEQGKTLPDAQGDIFRGLEVVEHACSIGTLQLGEFAENVAGGVDTYTLRQPIGVCAGITPFNFPAMIPLWMFPMAIVCGNTFVLKPSEQDPLSTMELVELAIEAGVPKGVLNVVHGGKDVVDRLCTHPDIKAISFVGSTRVGTHVYNLGSQHGKRVQSMMGAKNHAVVLPDAHREQTINALVGAGFGAAGQRCMATSVVVLVGSARDWLPELVEKAKTLKVNAGSEAGTDVGPVVSRSAKARILSLIDAGVKEGAKLELDGRDVTVRGYEQGNFVGPTLFSGVTTDMTIYREEIFGPVVVVMEVDTLDEAIALVNANPMGNGVGLFTQSGAAARKFQSEIDVGQVGINIPIPVPVPYFSFTGSRGSKLGDLGPYGKQVVQFYTQTKTVTARWFDDDATAGGVNTTIALR

SEQ ID NO: 75575 - protein, 355 aa, Thermosynechococcus elongatus BP-1
MKRLVSIVFLLFIPLSIAAEQLEWGALTVFILAALAIVPLAIWLSTATEEVALATGPTIGGLLNALFGNATELIIAIVALRAGLVDIVKASITGTLMANLLLVMGLSMLLGGIRYKEQSFAPVVARVNASSMTVAIAAMLLPAMVIYTSDRVPPGAISQMSVVAAIILILVYGLTLIFSLKTHSYLYDVSEVELGGEAGHHEKPNLPLWLTVLIIATIGVAFESEIFVGAVEEATAGLGLTPLFTGVILLPLVGGAAEYVTAVGVALKNNMDLSVSIALGSSLLVALLVAPILVLIGQFIGQPMDLNFSLFEVVTVIIAVVIANVISLDGRSNWLEGALLLATYGILGTAFFFHT

SEQ ID NO: 75576 - protein, 744 aa, Physcomitrella patens subsp. patens
MTVKADISIQDGHLLVYGEPLLRNIPSNVHFIGDPNLHGGFLGASFPESNSFHVVPLGVLQNIRFLCCFRFKLWWMTQRMGSCGREVPHETQFMLLEGPSENFTVLLPIIDGAFRACLLGNTENFLQLCVESGDPAVTTNCSLNAIYVNVGTNPFEVISEAVRAVEGHLETFVHRENKQMPGILDYFGWCTWDAFYTDVSAEGVKQGLSSLAGGGTPARFLIIDDGWQSIAEDNRSPEEAAAVTQGPQYASRLTHIRENHKFQKDGVPGLWPEDQSLGLQHTVLDAKTNFNLKYVYVWHALAGYWGGVQPGGLNTKNYNSSLVYPVHSPGVLDNQPDMSVDSLTVNGLGLVNPKEFFTFYDELHRYLAAAGVDGVKVDVQNIFETLSAGLGGRVQLVQQVHEALEASIARNFPENGCISCMSHSTDNLYYSKRTAVVRASDDFWPRDPASHTIHIASVAYNTLFLSEFMQPDWDMFHSLHPAAEYHAAARAIGGCAVYVSDKPGNHDFDLLKKLVLPDGTVLRALLPGRPTRDCLFSDPSRDGKSLLKIWNMNKCGGVIGIFNCQGAGWCKLDKKYMIHDVDPDPISGSVRSADIERLGDAAPDGWDGDCIVLSHRTCELIRIPRNAALPITLRKLEYELFTVTPVKNVDAQLCFAPLGLIKMFNSGGALRGLEYDTQGRTVTMQVHGCGTLGVYASQRPQSCILDDSIDIAISYDRSSGLISVSLPQSDEGHLWISGSGLFRI

SEQ ID NO: 75577 - protein, 124 aa, Zea mays
  misc_feature (20)..(20): Xaa can be any naturally occurring amino acid
  misc_feature (22)..(22): Xaa can be any naturally occurring amino acid
  misc_feature (35)..(35): Xaa can be any naturally occurring amino acid
  misc_feature (83)..(83): Xaa can be any naturally occurring amino acid
  misc_feature (105)..(105): Xaa can be any naturally occurring amino acid
MSAFTSKFADELIANAAYIXTXPGRGILAADESPXNIGRRLASINGENVETNRRGLRELLFTVPAALAGGRGVILFEETLYQXSSDGKLFVDILEERGVLPGIKXDRGTGELPGTRGETPTSGF

SEQ ID NO: 75578 - protein, 339 aa, Escherichia coli
MAILVTGGAGYIASHTILSLIEQGNEVIIIDNLSNSYYDSLLKIKEITGCDCLFYKGDILDKKLLLKIFDENNITAVMHFAGAKSVSESVIRPLQYYRNNVSGTFSLVEAMEESGVENLIFSSSATVYGEPKIIPVNESCAIGGTTNPYGTSKLFVENFLRDYSKASPNFKTIVLRYFNPIGAHSSGKIGEDPNGIPNNLMPFICQVAIGKQKTLKIYGNDYPTKDGTGIRDYIHVMDLAEGHVAALNNINQGANYRVYNLGTGIGYSVLELLEAFQKVTTRRVPYVFTKRRSGDIAECWSDPTKAYEELGWKARRGLEDMIRDAWNWQQKNPNGFKKV

SEQ ID NO: 75579 - protein, 232 aa, Wolbachia endosymbiont strain TRS of Brugia malayi
MNKSQLVKKVFDSVAYRYDIMNDIISLGIHRLWKDKMVNSVHFTKNSQVLDVAGGTGDIAIRIVRREPSVQVTVCDINQNMLSRGRNKAINSNQLNFNWVCANAESLPFEDSEFDCCTIAFGIRNVSDRKKALSEIHRVLKPNGQFICLEFAPMHYKNEIFTKLYDLYSLKVIPKIGNIVTKDESPYQYLVRSIREFPVQTDFKMEIEEVGFKKVKFHNMSYGIVALHTGTK

SEQ ID NO: 75580 - protein, 364 aa, Photobacterium leiognathi
MALSSAKEIIDDIRQGRMVILMDDESRENEGDLIIASEMVTPEAINFMATHGRGLICLTLSKARCKTLNLPLMVQGNNDNFSTPFTISIEAANDVTTGISASDRAKTVLAAVAPNAKSTDIVMPGHIFPLMAQDGGVLIRAGHTEAGCDVARLAGLEPSSVIVEILNEDGSMARRPQLEIFAEKHGLKLGTIADLIEYRTQQESHIERISEYELNTEYGIFTLVTYRDTIDNQAHFALCKGEIQAKAATLVRVHVKDTLKDILQVGLSQWSLEAAMQRIQTEDGVLVIISQQESTKTLFEKLDMYAKEQPNSPHSGIVQSRNIGLGSQILADLGVKKIRLLSNSNQGYRALSGFGLEVVEYIYD

SEQ ID NO: 75581 - protein, 388 aa, Escherichia coli
MKITISGTGYVGLSNGLLIAQNHEVVALDILPSRVAMLNDRISPIVDKEIQQFLQSDKIHFNATLDKNEAYRDADYVIIATPTDYDPNTNYFNTSSVESVIKDVVEINPYAVMVIKSTVPVGFTAAMHKKYRTENIIFSPEFLREGKALYDNLHPSRIVIGERSERAERFAALLQEGAIKQNIPTLFTDSTEAEAIKLFANTYLAMRVAYFNELDSYAESLGLNTRQIIEGVCLDPRIGNHYNNPSFGYGGYCLPKDTKQLLANYQSVPNNLISAIVDANRTRKDFIADAILSRKPHVVGIYRLIMKSGSDNFRASSIQGIMKRIKAKGVEVIIYEPVMKEDSFFNSRLERDLATFKQQADVIISNRMAEELRDVADKVYTRDLFGSD

SEQ ID NO: 75582 - protein, 156 aa, Photobacterium leiognathi
MKIIEGGLTAPHARIAIVIARFNSFINENLLSGAIDALQRKGQVKAENITVIRCPGAYELPLAAQQIAKQGNYDAIIAIGAVIRGGTPHFDFVAGECNKGLAQVALEYQTPVAFGVLTVDSIEQAIERAGTKMGNKGEEAALSALEMINMLIEITP

SEQ ID NO: 75583 - protein, 457 aa, Lactobacillus johnsonii NCC 533
MSKNSSESSEVKTMKRSLTNAHIQLIALGGTIGTGLFLGVGNSIELAGPAVIFIYCLVGFFLFLLMRALGELILSDIKKNTYIDFISEYLGKSIGTTTGYLYWFSWLTLAMAEITALGIYFQYWWPNLQSWIPGLITLLVLLGINLISARVFGNLEFSFAIIKIVTIIAFVILVFYLLITNSSTKYGHVSWNNMMIDGGIFAKGPKGFLLGFQMVIFSFIGVELIGLTAAEAKEPKKTITRAIDQLPVRIILFYVLAILSILLAIPWTKVSTSSSPFVQALGATGIKNAGSIINFVVISAAISSTNSFIYSAGRLLFSINYNGKNKISKHLGKLDHRQLPKNALVFSTVLIALAPLLNLFLKDAFTFISATATSMFLLIWSIMIVTHMTYRKKTPKNELPTFRMPLYPISDIAVLIFFIAMIIVLLIFPNYRIPMISAGIIFTVLVCLTHFIQKKSN

SEQ ID NO: 75584 - protein, 297 aa, Brassica napus
  misc_feature (282)..(282): Xaa can be any naturally occurring amino acid
MEGLIQPRGILSLPTKPIVAARTLLPPSPALKQRLFTRNLPPLSFSSNAPTKVQSFHRNPLTISISHKERINRGFICKAEASAAAAAAGEGDSPNIFGVEVTTLKKIIPLGLMFFCILFNYTILRDTKDVLVVTAKGSSAEIIPFLKTWVNLPMAIGFMLLYTKLSNVLSKKALFYTVIIPFIAYFGAFGFVMYPLSNMIHPEALADKLLATLGPRFMGPLAILRIWSFCLFYVMAELWGSVVVSVLFWGFANQITTVDEAKKFYPLVGLGANVPLIFSGRXVKYFSNMRKNLGPEV

SEQ ID NO: 75585 - protein, 249 aa, Triticum aestivum
  misc_feature (216)..(216): Xaa can be any naturally occurring amino acid
  misc_feature (224)..(224): Xaa can be any naturally occurring amino acid
AYLGDTTEQVCTKKQVGPGPEFPGYRRPTRPLLPRSLPSRRLRLPPPPTPRHPLRRLLFRGMASSATGEAAPAAGTSGAGEASARPRRALEELAWDETFVRELPGDPRSDNIPRQVLHACYTKVSPSAPVENPKLVAWSESVADLLDLDHKEFERPDFPRFFSGETPLVGSVPYAQCYGGHQFGSWAGQLGDGQAITLGEVLNSRGERGELHLKGXGKTPYSRXFANGLAVLPQQRPGNFLWQGSYALG

SEQ ID NO: 75586 - protein, 712 aa, Triticum aestivum
MALSSTFSLPRGFLGVLPQEHHFAPAVELQAKPLKTPRRRSSGISASLSEREAEYHSQRPPTPLLDTVNYPIHMKNLSLKELQQLSDELRSDVIFHVSKTGGHLGSSLGVVELTVALHYVFNTPQDKLLWDVGHQSYPHKILTGRRDKMPTMRQTNGLSGFVKRSESEYDSFGTGHSSTTISAALGMAVGRDLKGAKNNVVAVIGDGAMTAGQAYEAMNNAGYLDSDMIVILNDNKQVSLPTATLDGPAPPVGALSGALSKLQSSRPLRELREVAKGVTKQIGGSVHEIAAKVDEYARGMISGSGSSLFEELGLYYIGPVDGHNIDDLITILREVKGTKTTGPVLIHVITEKGRGYPYAERASDKYQRVAKFDPATGRQFKGPAKTLSYTNYFAEALIAQAGQDSKIVAIHAAMGGGTGLNYFLRRFPNRCFDVGIAEQHAVTFAAGLACEGLKPFCAIYSSFLQRGYDQVVHDVDLQKLPVRFAMDRAGLVGADGPTHCGAFDVAFMACLPNMVVMAPSDEAELLNMVATAAAIDDRPSCFRYPRGNGIGVPLPENYKGTAIEVGKGRIMIEGERVALLGYGSAVQYCMAASSIVAHHGLRVTVADARFCKPLDHALIRSLAKSHEVIITVEEGSIGGFGSHVAQFMALDGLLDGKLKWRPVVLPDKYIDHGSPADQLVEAGLTPSHIAATVFNILGQAREALAIMTVQNA

SEQ ID NO: 75587 - protein, 399 aa, Chlamydomonas reinhardtii
MQRLHDQCVVMLSQDSFYRTLTPTEMALAKENNYNFDHPDALDRKGMMECLQKLKEGRSVEVPVYDFALHARVEETRRMDPADVVIVEGILVLAMEEVRDQLNMKIYVDTDDDVRLARRIQRDVASRGRDVASVIEQYTKFVKPAFDTFIGPSRRHADIIVPWQSSENVVAIDLITEHIRLKLRQHDLIRIYSNLEVMPSNFQMRGMHTILRDRDTSPNDFVFYADRINRLLVEAGLGHLPFREKTVMTPTGHKYTGVEFARGLCGVSVIRSGEAMEAALRECCQGIKIGKILVHRHGKSEDIVYEKLPADISRRYVLLLDPVLGTGNTACKAIQVLLDKGVQESKILFLCIIAAPPGIHRVCQTYPQVKVITSEIDTGVDENWCVVPGVGEFGDRYYC

SEQ ID NO: 75588 - protein, 889 aa, Wolbachia endosymbiont strain TRS of Brugia malayi
MDTVYVKYVCQEKPETMEEKLIYYFSQDKCEGNAEMKSLLGGKGANLAEMCNIGIPVPPGFTISTSACKSYYQGNGLSDDLCSTIKEYMTMLENDIGCKFGDSNNPLLVSIRSGSVNSMPGMLDTILNAGLNDTTVIGLAKKSGERFAYDSYCRFIMMYSNVVLQLDHQLFQSIIDNERQKNGAKSLADLNVDVLKRIVCDFKKIVHEKTEKHFPQDIEEQLLSSVNAVFASWQNERAVSYRKIHNIPENLGTAVNVQAMVFGNLNNNSATGVIFTRNPSTGEKKCFGEFLVNAQGEDVVSGVYTPIPINGKQENTMEKLMLSVYQELCEVCKKLEVHYKDMQDIEFTVQGGKLWILQTRSGKRTAEATVRITVDMVNEGTITKEEGILKIDPKIFDNLLHPVLEARGDQKVIGKGLPASPGVASGYVVFSASDAEKAAEQGKKIILVRLETSSEDINGMNAASGIITARGGMTSHAAVVTRGMGKPCICSVNGLHIDKNGNFFSVGDTTVNKGEPITINGGTGEVMLGILPTILPELSQEFKTIINWIDETKMIKVRANADTPKDAKIAKEFGAEGIGLCRTEHMFFASNRIEFIQRLIIADDKTERASALSKLEEMQKSDFKEIFSIMGGREVTIRLLDPPLHEFLPDNQSTIEKIAKSLNKSVESVKNKIVQLSEKNPMLGHRGCRLAISHPEIYSMQTRAILSAVDELKKEKKAEVKPEIMIPFIMSEKEFILICELLKKEAKNFDVNYSIGTMIELPRAALIADKLAKYAEFFSFGTNDLTQTTMGLSRDDSVSFLNSYKENNIFENDPFEVLDVEGVGELIKIAIERGKKTRKEIKLGVCGEHGADPRSIEFLIKSGVSYISCSPYRVPIAKLVAAQKSKCVG

SEQ ID NO: 75589 - protein, 168 aa, Nicotiana benthamiana
ANGKNYLHKRNPPIVHRDLKSPNLVVDKKCTVKVCDFGLSHFKANTFLSSKTAAGTPEWMAPEVLRDEPSNEKSDVYSFGVILWELATLQQPWSDLNAPQVVAASGFRGKRLDIPSGLNPQVATIIEACWANEPWKRPSFSTIMDMLRPNLKSPLTPQSGHTDMQLLS

SEQ ID NO: 75590 - protein, 289 aa, Neisseria gonorrhoeae FA 1090
MKPIKKAVFPVAGMGTRFLPATKANPKEMLPIVDKPLIQYAVEEAVEAGCTEMVFVTGRNKRSIEDHFDKAYELETKLEMRHKDKLLEHVRNILPPNITCLYIRQAEALGLGHAVLCARAAIGDEPFAVILADDLIDAPKGALKQMVEVYGRSGNSILGVETVEPSQTGSYGIVETEQLKQFQRITGIVEKPKPEDAPSNLAVVGRYILTPRIFDLLTGLPRGAGNEIQLTDGIAKLLDHEFVLAHPFEGTRYDCGSKLGYLEATVAYGLKHPETGEPFRRLLEKYRTE

SEQ ID NO: 75591 - protein, 266 aa, Triticum aestivum
  misc_feature (104)..(104): Xaa can be any naturally occurring amino acid
  misc_feature (123)..(123): Xaa can be any naturally occurring amino acid
MAKDIEAAPPGGEYAAKDYSDPPPAPLFDAEELTKWSLYRAVIAEFVATLLFLYITVATVIGYKHQADPAGPNAADAACSGVGILGIAWAFGGMIFVLVYCTAXGVSGGHINPAVTFGLFLAXRKVSLVRALLYIIAQCLGAICGVGLVKGFQSAFYVRYGGGANELSSGFSKGTGLAGEIIGTFVLVYTVFSATDPKRSARDSHVPVLAPLPIGFAVFMVHLATIPITGTGINPARSLGAAVIYNNEKAWDDHVCTAFAPHASLC

SEQ ID NO: 75592 - protein, 269 aa, Chlamydomonas reinhardtii
MSAAASTAAEHALRRFGLVGRTCLVTGATRGIGKAIVEELGKLGAKIFVCARSADDLATQLEGWRAAGLDVQGIVCDVSDRAQRGELAAKVSEAFGGKLNILVNNVGTNIRKPTVEYSEEDYGFLMRTNLESAYHLCQVCQPLLAASGDGVIIFNSSVAGGPTAMRSGTIYGMTKAAMNQLTKNLACEWAGSGIRVNSVAPWYTATDLALQVLKDETIKEQVLSRTPMKRIGQPEEVAGLVAYLCSPAASYVTGQVVQVDGGYSVMGYY

SEQ ID NO: 75593 - protein, 177 aa, Neisseria gonorrhoeae FA 1090
MADFNQILTPGDVDGGIINVVNEIPAGSNHKIEWNRKLAAFQLDRIEPAIFAKPTNYGFIPQTLDEDGDELDVLLVTEQPLATGVFLEARVIGVMKFVDDGEVDDKIVCVPADDRNNGNAYKTLSDLPQQLIKQIEFHFNHYKDLKKAGTTKVESWGGAEEAKKVIKESIERWNKQA

SEQ ID NO: 75594 - protein, 140 aa, Chlamydomonas reinhardtii
MAANAAELGKDTPESTWKQVLSTEEYRVLREKGTERAGTGVYNKHFDDGVYRCAGCGTPLYTSETKFNSGCGWPAFYDEIPGAVERHVDVSHGMKRVEITCVKCGGHLGHVFEGEGFPTPTNQRHCVNSVSIKFEPKQKL

SEQ ID NO: 75595 - protein, 212 aa, Myxococcus xanthus DK 1622
MPEARIRMAYAAGCRELGENKVQEALGKAEAMADLTDLRWSVIGHLQTNKAKVVARFASEFQALDSLRVAEALDRRLQVEGRALDVLVQVNTSGEASKFGLPPDEVARFFRDLPAFSSLRVRGLMTLALLSADPARVRPCFTLLRELRARLREEAPAGVTMNELSMGMSGDFEWAVEEGATIVRVGQAIFGPRALPDSHYWPEPNATSDPTS

SEQ ID NO: 75596 - protein, 470 aa, Bifidobacterium longum NCC2705
MDTITLTGVHANGTHGVLAFEHERPQTFVVDVTLHLDLAAAGQSDDLNDTIDYGRVAKDIVAVIEGPHVDLIERLAQRIADKILADAPAVASIDVTVHKPHAPIVVAFADVSVSISRVRATDNGRTAEKHAIHNAVVALGGNVGEVESTLRAAVREIDALLGTQVTGISPLYRTAAWGMADGTPDFLNAVVELGTTMGRHELLAALQNIEANHGRIRENHWDSRPLDLDIIDFDGITSADPDLALPHPRAWQRAFVLAPWLALNPNAKLAGAHEGPVADLLAAAPDRNAVQLESEDWMLGGHAVKQKSASESAPVSRKAIISLDSTSQDAERLFRETIVSIDSVPGNQVQGISPLYHVSHFDSPDAMSAVIQIETKLPPADLIAVLGSIESVHDLAVDLDLVDMEGVTSDEPNCSIPWPSARNHASVLAPWLDMDPNASLGGDPVAFLLAMAPDAGQVGLLSDNWILSNS

SEQ ID NO: 75597 - protein, 331 aa, marine gamma proteobacterium HTCC2080
MSLAQLPTPLEFLPRASTAWGCGKRLWIKRDDLTGSTLTGNKVRKLEFIAGFAETHGFNTLITCGGLQSNHARATANVCAKLGWHCELVLRGRDPVGEGNTLLDQLFGAQVTAVEPRRYTEHLDSLLEQRAEHHRSQGRHPLIIPTGGSNGLGIWGYVSGAEELVADMAAADITNATIVTATGSGGTQAGLTLGMALFQPDCSVWGFAVCDDEQYFTDKVSADICEAQGMWSALACENIQINTNDAHVGPGYGRATEPVYERIAALASLEGIILDPVYTGKAFHGLCEELAQGAFPEATDIIFVHTGGIYGIFPHGQQLAAAASHPASWVN

SEQ ID NO: 75598 - protein, 169 aa, Zea mays
TRDSALWPGNTKHIHPPCNSSAAHCHCQQIELLRLTNPLACFAAPPASLQPRTEMSTVSRASLDQKLALAKRCSREATLAGAKAAAVATIASAIPTLASVRMLPWAKANINPTGQALIVSTVAGMAYFIAADKKILSLARRHSFEQAPDHLKNTSFQGTGRPHPAFFRP

SEQ ID NO: 75599 - protein, 580 aa, marine gamma proteobacterium HTCC2080
MTDKVKPENEQCSGDTAPPFATLSNPLRRRVPSSDSQSGRYEQTLARGMELQQRPYEAAGQRGIQRQHLKNRMTVWERVQFLADGAPQVLYQNWGPNLDGASLVTAIIQIDGRDVAIYGHDFTVRAGSMDATNGKKLARLFELAAKRGIPLVGLNDSAGAYIPAGVGGLDGYADAFTALRKVSGVVPSIMCMFGFNAGGGSYLPRQGSFLIQPKDTFFGLTGPGVVKSVLGEDITPEELGGPNVHSQTGVTDFVVDDEVSALQKVREILKYIPDSSAAAPQFKPTTDPAARSTVDIDILLRKAFNSPTGFNTPVDITILIQQLCDHGDFLEVQAERARNTITAFGRMAGNVVGFVANNSAVASGQIDIDAAYKNARFIRFCNLYNIPVMFLEDTTGFLPGREQEHRGIVQAGRAMLDAIVDLRTPRFLVLVRNAFGGAYASYNNYPTGADFVVALPTTRVAVMGPAGVEYVYKDELRKIRGEASARMSAEKSAQIQQGLSDDEAQAAAQELVGSWVRAEETELALRYEREIMNPEEALSLGSVSQIVMPADLRQVLTDHLSFCLRHYEPSALHDVQREFH

SEQ ID NO: 75600 - protein, 403 aa, Arabidopsis thaliana
MLSNKLGFFVKSKARPEAVKLVGSKGLVFIEGADWVRHRRILNPAFSIDRLKIMTTVMVDCTLKMLEEWRKESTKEETEHPKIKKEMNEEFQRLTADIIATSAFGSSYVEGIEVFRSQMELKRCYTTSLNQVSIPGTQYLPTPSNIRVWKLERKMDNSIKRIISSRLQSKSDYGDDLLGILLKAYNTEGKERKMSIEEIIHECRTFFFGGHETTSNLLAWTTMLLSLHQDWQEKLREEIFKECGKEKTPDSETFSKLKLMNMVIMESLRLYGPVSALAREASVNIKLGDLEIPKGTTVVIPLLKMHSDKTLWGSDADKFNPMRFANGVSRAANHPNALLAFSVGPRACIGQNFVMIEAKTVLTMILQRFRFISLCDEYKHTPVDNVTIQPQYGLPVMLQPLED

SEQ ID NO: 75601 - protein, 461 aa, Nocardioides sp. JS614
MATPSPGYSITVRMEVPSSARATGDVVAAVTGAGGSVTALDVAESLADRLVVDVSCDASDLEHADLITEALNRVDGATVRKVSDRTFLLHLGGKLEVVPKVPLKHRDDLSRAYTPGVARVCLAIAKNPEDARRLTIKRNTVAVVTDGSAVLGLGNLGPAAALPVMEGKAALFKQFAGVDAWPVCLDTQDTEEIIAIVKAIAPVYGGINLEDIAAPRCFEIEARLRAELDIPVFHDDQHGTAIVVLAALTNALRVVGKQLSEVRIVVSGVGAAGHAIIELLHAQGATDIVACGRSGSVHGGQENLDSARQWIADHTNRDRFAGSLRQAMVGADVFIGVSAPNLLTGDDVATMADDAIVFALANPDPEVDPVAAGQHAAVVATGRSDYPNQINNVLAFPGFFRGMLDAGTHDITQEVMLAAASAIADAVSPSELNASYIVPSVFDPRVATAVADAVREAATPA

SEQ ID NO: 75602 - protein, 149 aa, Carboxydothermus hydrogenoformans Z-2901
MERTFIMVKPDGVQRGLVGEIISRFEKRGFKLVGLKLMQISRELAETHYGEHKGKPFFEGLLNFITSGPVVAMVWEGKEVIATAREMMGATNPLKAQPGTIRGTYGIDVGRNVIHGSDSPESAAREIALFFKEEELLSYEKTLDTWIYE

SEQ ID NO: 75603 - protein, 275 aa, Nocardioides sp. JS614
MTPPLRSVPASIPRPEYVGKDAPTPFSGAEVKDAETVERMRAAGRLAARARDLVGSHVAPGVTTDELDRVGHEFLCDHGAYPSTLGYRGFPKSLCASVNEVVCHGIPDDRMVEDGDIVNIDVTAYLDGVHGDTNATFLAGDVDEESRLLVERTREALDRGIKAVRPGRRINVIGRVIESYAARFGYGVVREFTGHGIGSSFHSGLVVPHYDDPAYDTVIEVGMTFTIEPMLNLGTHEWDLAEDGWTVLTRDRRRSAQFEHTLLVTPTGAEVLTLP

SEQ ID NO: 75604 - protein, 543 aa, Oryza sativa Japonica Group
MAVTMPPMRAPALVAMLVVVLVALVRRRRHRSKGAGGRLESLPPGPVGLPVIGNMHQMLVNKPVFRWVHRLLADAGGEIVCVRLGPVHVVAVTSPEMAREVLRKNDAVFADRPTTFAAESFSVGYRSASISPHGDQWRKMRRVLTAEILSPATEHRLRGARGEEADHLVRYVLVRCGRDGAAVDVRHVARHFCGNVIRRLTLGRRHFREPRADDEDAAAPGRDEAEHVDALFATLNYLDAFCVSDYFPALVGLDLDGQEKVIKKVMRTLNRLHDPVVEERVEEWRLLRKAGERRDVADFLDVLASLDDAAGRPLLTVEEIKAQTIDIMIATVDNPSNAVEWALAEMMNKPEVMRKAMDELDTVVGRDRLVQESDVRDLNYLKACIREAFRLHPYHPFNPPRVAMADTTIAGYTIPKGSQVILSRVGLGRNPRVWDDPLEFRPERHLSPYPAGGRGDAGVVALTEAELRFVSFSTGRRGCPGVSLGTLITVTLFARLLQGFEWSKPAGVERVELREEAASLVLAQPLVLQATPRLAAHLYGAGK

SEQ ID NO: 75605 - protein, 503 aa, Burkholderia vietnamiensis G4
MKHVSERAPAKAGGAQPRDAERDAMFASHEAGYEQKLKPRHVQMIAMGGAIGTGLFLGAGGRLQSAGPALALVYLVCGAFAFLIMRALGELVMHRPTSGSFVSYAREFMGERASFVAGWMYYLNWATTGIVDITAVAIYMKYWAVFTDVPQWVFALGALGIVSVMNMIGVKVFGEMEFWFSIVKVGTLALFLAVGAVFLASGHPVAGQMPGLHLVADHGGIFPHGILPAVLIVQGVVFAYASIELVGVAAGETADARKVLPKAINSVMWRIALFYVGSVVLLTMLLPWTAYSAHESPFVTFFSKLGVPYVGTVMNVVVLTAALSSLNSGLYSTGRVLRSLAMGGSAPRFVSRMNARGVPYGGILVTVAVNALGVPLNYIVPAQAFEIVLNMASLGIITTWGFIVMCQILFRRAVDRGELSPVSFRMPGAPFTSWLTLGFLVSVLVLMAFDYPGGTWTVAMIPVVVLALVVGWKLAKRGAARDAAAAAAAQAASPIAADPAGSV

SEQ ID NO: 75606 - protein, 260 aa, Glycine max
MAINHETWAFVFGLLGNVISFMVFLAPLPTFYQIYKKKSTEEFQSLPYVVALFSSMLWIYYALVKKDASLLLITINSFGCVIETIYLAIFLIYAPSKTRLWTIKLLLMLNVFGFGAMLLSTLYLTTGSKRLTVIGWICLVFNISVFAAPLCIIKRVIKTKSVEFMPFSLSFFLTINAVMWFFYGLLLKDYYVALPNTLGFLFSIIQMVLYLIYRNAKTPDLPMKLQELNSHTIDVGKLSRMEPSEPNHVTKNGTLTEREI

SEQ ID NO: 75607 - protein, 107 aa, Vitis vinifera
MAKNVAGSPLERNGLASFDQKLAMAKRCSHEGVVAGAKAAVVASIATAIPTMASARWLPWAKANLNHTAQALIISTVAGAAYFIVADKTVLASARRNSLKKPCFSDV

SEQ ID NO: 75608 - protein, 225 aa, Brassica napus var. napus
QHQLIALLSNHHPVQKPPTPTYSPPIKPPPVQKPPTPTYSPPVKPPPVKPPTPIYSPPVMPPPVQQPPTPSYSPPVKPPPVQKPPTPTYSPPVKPPPVQKPPTPTYSPPIKPPPVQKPPTPTYSPPIKPPPVQKPPTPTYSPPVKPPPVQKPPTPTYSPPIKPPPVKPPTPIYSPPVKPPPVQKPPTPTYSPPIKPPPVKPPTPTYSPPVKPPPVQKPPTPTYSP

SEQ ID NO: 75609 - protein, 84 aa, Platanus x acerifolia
RGCPDDVYVLELAEECGIDIPFSCRSGSCSSCAGKMVQGKVDQADGSFLDDDQVEAGWVLTCIAYPLSDVVIETHKEEDLVADS

SEQ ID NO: 75610 - protein, 497 aa, Chromobacterium violaceum ATCC 12472
MSTGTINWQKKAEQLHFEGRAYIDGAYRKALSGKEFTTINPATGKVLASIEWCGKEDVELAVCAARRAFDGGAWSELATRSRMEILKRFASLIQDNIEELALLESLDVGKPIANSLSVDISNTAYCISWFAELIDKAPGEVVPVDPALLGMVTREPVGVVAAIVPWNFPLMMASWKFAPALAAGNAVILKPSEKSPLTAIRVAALAEAAGIPPGIFQVLPGAGDVGQALASHLDVDCVAFTGSTAVGKQIANYAAQSNLKRVWLELGGKSPNIILADCKDLKEAAKAAAGAICYNAGQMCTAGSRVLVAREIREAFLSELKVAMADYRPGDPLSPETNLGAVVDQRQFDKILSYITQGQNEGAKLLQGGAAVQTVHPNGLFIEPAIFDCPQPNLTICREEIFGPVLSVITFDDVDEAVRIANDSQYGLGAAVWTQNVSTAHKVARRLRAGTVWVNCYEEGGDMNLPFGGYKQSGNGRDKSLHALEKYTELKSTLIKL

SEQ ID NO: 75611 - protein, 404 aa, Blastocladiella emersonii
APAPASPSSPSTAAGAGSASSTASSTTTAAASGNLSIPSPLVAGSTTSSSISHAQKMATAAHTNSDYSPSPAATPSAPLDAVAERRRRKTTLADLELRQTLGTGSFGRVHLVRLRSTGKYYAMKVLKKAEVVKHKQVEHTLNEKGILEQIDHPFLVALHSSFQDSANLYMVMEYVTGGELFTYLRRSQRFSNNVAKFYAAEVVLAFEYLHSKDIIYRDLKPENLLLDAQGHVKITDFGFAKHVPDITWTLCGTPDYLAPEIIQSRGYGRAVDWYALGVLIFEMLAGYPPFYDEDHVRMYEKILQGKVKWPSHFDPAAKDLLKRLLTTDLTKRYGNLKGGSKDIKMHKWFAGLDWTKLFNKQIPPPYTPPNRGDGDTSNFDAYPEETEPYGKVQPDPYAQLFKDF

SEQ ID NO: 75612 - protein, 276 aa, Auxenochlorella protothecoides
CFAYSFSSILVEIQDTLRQPPKAAKTMSKATNVSVTASFAFYFVVAIGGYASLGNDVPSYILGGLQGPEWVIFVANLCVLLHMWSAYQIYAHPMFDTLESHVKAFKLRQAKAKGDAELPAKVEELKRMSLAARQGSAAGTKTMDDTAPAAPPAANPLCRLSRVSAMAGEKLQRLSQNAAMYRVSTGFADTSVPSNDDHFVLPWWQRLITRRMYVVRTTLIAAIMPFFGAMAGLVGALAFFPLTSSSPSAAGAPCTSPLGGSITCCTSSSSAWRWCA

SEQ ID NO: 75613 - protein, 112 aa, Triticum aestivum
NKFVQKSRLVPVRNSRDIVDPRVREPEEELGTEYLVQPLGRAEDEEHSSDFEPEENGDGAEDEEIEDDDAEDGEDSVKAQSSSKRKRSGAEDEDDDDGDDDGDDDEKPPSKR

SEQ ID NO: 75614 - protein, 248 aa, Geobacter sulfurreducens PCA
MIILKSPREIEKMRVSARIVAEVLEILKACIRPGVTTLELNELAELEAKKRKARPAFKGYNGFPYSLCCSVNEQVVHGMPNSRELVEGDIISLDFGVVVDGFYGDAAVTVPVGRVKPGVLDLLAVTEESLCRAVEASVVGNRLSDISHAVQSFVEERGYSVVREFVGHGIGKNLHESPQVPNFGEPGRGVKLKAGMVLAIEPMINEKGHQVKILSDGWTAVTCDKGMSAHFEHTVAITENGPDILSKL

SEQ ID NO: 75615 - protein, 413 aa, Burkholderia mallei ATCC 23344
MGDMLRSATMMASAFPALAQRVNGAPLAYLDNAATTHVPQPVLAAMRGFDERDRANIHRGVHTLSQRATDAYERARDTLARFVGANGEHLLVFTSGATDALNLVANGLSVAGHTQAVLQEGDEIIVSALEHHANLVPWQMAARRCGAKLRILHPDPQGSLHVRDLERLLGPRTRVFAVTACSNATGERPPYEALLAAARAGGALTVLDAAQAVGHDVPDLSALACDFAAFSGHKMYGPMGTGALVGRRDALERLVPLRFGGDMVSWVGETDATFDALPARLEGGTPNVAGAVGIAAAADYIDAIGRARIDAHVRALRDHAAAGLAALDGVTVLSPRTSSAIVSFVVDGVHPHDIGTLLDERGIAVRTGFHCAQPLLERLGCGPTTRASFALYNTHDEVERLVAGVAQALKVLR

SEQ ID NO: 75616 - protein, 100 aa, Borrelia lonestari
ILKQEGFFFDIAFSSLLVRANDTLNIILSELGQSYISVEKSWRLNERHYGALQGLNKSETAEKYGEDKVLIWRRSYDVPPMPLEESDNRHPVYDIRYGGI

SEQ ID NO: 75617 - protein, 482 aa, Escherichia fergusonii
MSDAPIIAVVMAGGTGSRLWPLSRELYPKQFLQLSGDNTLLQTTLLRLSGLSCQKPLVITNEQHRFVVAEQLREINKLNGNIILEPCGRNTAPAIAISAFHALKRNPQEDPLLLVLAADHVIAKESVFCDAIKNATPIANQGKIVTFGIIPEYAETGYGYIERGELSVPLQGHENTGFYYVNKFVEKPNRETAELYVTSGNHYWNSGIFMFKASVYLEELRKFRPDIYNVCEQVASSSYIDLDFIRLSKEQFQDCPAESIDFAVMEKTEKCVVCPVDIGWSDVGSWQSLWDISLKSKTGDVCKGDILTYDTKNNYIYSESALVAAIGIEDMVIVQTKDAVLVSKKSDVQHVKKIVEMLKLQQRTEYISHREVFRPWGKFDSIDQGERYKVKKIIVKPGEGLSLRMHHHRSEHWIVLSGTAKVTLGDKTKLVTANESIYIPLGAAYSLENPGIIPLNLIEVSSGDYLGEDDIIRQKERYKHED

SEQ ID NO: 75618 - protein, 252 aa, Oryza sativa Japonica Group
MKAAVRALFDLPDDAKRRNADIIPGSGYVPPGTANPLYEAFGLCDAAAPADVDAFCARLDAPPHVRETVKAYAERMHSLIVDVAGKVAASLGLHGASFQDWPCQFRMNRYNYTQDSVGSPGVQVHTDSGFLTVLQEDECVGGLEVLDPAAGEFVPVDPLPGSFVVNVGDVGQAWSNGRLHNVKHRVQCVAAVPRVSIAMFLLAPKDDTVSAPGELVDGEHPRRYREFKYDDYRRLRLSTGERAGEALARLAA

SEQ ID NO: 75619 - protein, 227 aa, Methanocaldococcus jannaschii
MNNVEKAIEALKKGEIILVYDSDEREGETDMVVASQFITPEHIRIMRKDAGGLICTALHPDICNKLGIPFMVDILEFASQKFKVLRELYPNDIPYDEKSSFSITINHRKTFTGITDNDRAFTIKKLAELVKEGRFNDFGKEFRSPGSVTLLRAAEGLVKNRQGHTEMTVALAELANLVPITTICEMMGDDGNAMSKNETKRYAEKHNLIYLSGEEIINYYLDKYLKD

SEQ ID NO: 75620 - protein, 576 aa, Xanthomonas campestris pv. campestris str. ATCC 33913
MSLRLRGHAASRGNALGRARVRQSHTLEVAEQRVPANQVETQLQRLHAAIAAARTEMQQLRDRLHGALAREVGEFLELHALLLDDPELLQGLDDLIRTHRYSADYALRVQRDRLAAVFDGMEDAYLRSRMDDLDHVIGRIHAFLHKRAPDLKGVAGEILVCDNVAPSELAQLQAQGVVGIVTTAGSALSHSAILARSLHLPLVVGVADAVQRVNDGDVLIVDAGSGQVIVDPTPEHLRDYRERLRTLAKEQRELGRLRSKPTRTRDNVDITLLANAESLEDVAKAHALGASGLGLYRTEFLFLQRNELPDEDEQFHTYRDTVLGMSGRPVTIRTLDLGADKADRTGLTLSDEDNPALGLRGVRLSLARPAVAQAQLRAILRASGYGPVRILVPMVSGREEILLVRKQLKKLTAQLRDEGHEIAEHIPLGAMIEVPAAALALDCFIDDIDFLSIGTNDLVQYLLAVDRNNEALGELYSPLHPAVLRLIAQVIATGRAHNKPVAVCGEIAGDPRFVAMLLALGLTEFSLHPATLLEVRRAVRDLHLGQLRVHGEKLLRARDRKSIEKWLASVAQGLLH

SEQ ID NO: 75621 - protein, 305 aa, Clostridium perfringens str. 13
MKNFLESLIENNRQYVEHGKLASYIPELEKANKEDLGIYIVTLDGKEVGAGEYDKKFTIQSISKVITLMLAILDNGKDRVFSRVGVEPTGDSFNSIVSLERKPSKKPFNPMVNSGAILTTSLIEGDSEEEKFERILEFTRKVTGNDDIQLNEDVYLSEKETGDRNRALAYFMKSNGVIEGNIDDILDLYFKQCSLEVNAKDLARFGAMLANDGVLPWNGERVISREICRIIKTIMVTCGMYDDSGKFAVHIGIPAKSGVGGGIMAAVPRRMGIGIFGPSLDDKGNSIAGTHVMKDLSEELDLSIF

SEQ ID NO: 75622 - protein, 501 aa, Oryza sativa Japonica Group
MPRRPSGGGGGAGPAAAAVRKVPLRKLLRAASVACGVQFGWALQLSLLTPYVQELGIPHAFASLVWLCGPLSGLLVQPLVGHLSDRIAPAASPLGRRRPFIAAGAASIAAAVLTVGFSADLGRIFGDSITPGSTRLGAIIVYLVGFWLLDVGNNATQGPCRAFLADLTENDPRRTRIANAYFSLFMALGNILGYATGAYSGWYKIFPFTVTPSCSISCANLKSAFLLDIIILVVTTCITVASVQEPQSFGSDEADHPSTEQEAFLWELFGSFRYFTLPVWMVLIVTALTWIGWFPFILFDTDWMGREIYRGSPDDPSITQSYHDGVRMGSFGLMLNSVLLGFTSIVLEKLCRKWGAGLVWGVSNILMALCFVAMLVITYVAKNMDYPPSGVPPTGIVIASLVVFTILGAPLAITYSIPYAMAASRVENLGLGQGLAMGILNLAIVIPQVIVSLGSGPWDQLFGGGNAPAFAVAAAASFIGGLVAILGLPRARIASRRRGHR

SEQ ID NO: 75623 - protein, 579 aa, Escherichia coli
MAQFVYTMHRVGKVVPPKRHILKNISLSFFPGAKIGVLGLNGAGKSTLLRIMAGIDKDIEGEARPQPDIKIGYLPQEPQLNPEHTVRESIEEAVSEVVNALKRLDEVYALYADPDADFDKLAAEQGRLEEIIQAHDGHNLNVQLERAADALRLPDWDAKIANLSGGERRRVALCRLLLEKPDMLLLDEPTNHLDAESVAWLERFLHDFEGTVVAITHDRYFLDNVAGWILELDRGEGIPWEGNYSSWLEQKDQRLAQEASQEAARRKSIEKELEWVRQGTKGRQSKGKARLARFEELNSTEYQKRNETNELFIPPGPRLGDKVLEVSNLRKSYGDRLLIDDLSFSIPKGAIVGIIGPNGAGKSTLFRMISGQEQPDSGTITLGETVKLASVDQFRDSMDNSKTVWEEVSGGLDIMKIGNTEMPSRAYVGRFNFKGVDQGKRVGELSGGERGRLHLAKLLQVGGNMLLLDEPTNDLDIETLRALENALLEFPGCAMVISHDRWFLDRIATHILDYQDEGKVEFFEGNFTEYEEYKKRTLGAARAGAEAYQVQAYCEVMRKMPDAARTPYPAYKTSNFNTL

SEQ ID NO: 75624 - protein, 126 aa, Arabidopsis thaliana
MGDSSVSTSSWAVIESANRFQETFGSVSSCELNRLQEVSSVMGESSGSSSSLAAINSSNIGFQLLKKHGWKEGTGLGIAEQGILVPLQAEPKHNKRGVGAKQPAKRKVAQPQAKVLFLKTLTCDSL

SEQ ID NO: 75625 - protein, 488 aa, Dechloromonas aromatica RCB
MGKPTGFMEFERLNESYDPVEQRLKHYKEFVHTLNDEDAKIQGARCMDCGIPFCNNGCPVNNIIPDWNDLVYRGNWKQALDVLHSTNNFPDFTGRICPAPCEAACTLGINAAPVGIKSIEHFIIDKGWESGWVVPQPPKAKTGKKVAVVGSGPAGLAAAQQLARVGHDVTVFEKSDRIGGLLGYGIPDFKLEKTVIDRRVAQMEAEGVTFKTKVVVGDKAVPAGINNDAIEFVSADQLKKDFDAVILAAGSEVPRDLPVPGRELKGIYAALEFLIPQNKEVQQGKANPINVKGKHVIVIGGGDTGSDCVGTSNRHGAASVTQFELMPMPPEEENKALTWPYWPYKLRTSSSHDEGCSRDFAVATKGFIDDGKGNVKALKAVRLDWKDGKMSEVAGSEFELPCDNAFLAMGFTNPVGGLLDAFGVEKDARQNAKATTDGEGCYKTNVDKVYAAGDVRRGQSLVVWAIREGRQAAREVDAFLMGSTTLPR

SEQ ID NO: 75626 - protein, 309 aa, Saccharomyces cerevisiae
MSAVFNNATLSGLVQASTYSQTLQNVAHYQPQLNFMEKYWAAWYSYMNNDVLATGLMFFLLHEFMYFFRCLPWFIIDQIPYFRRWKLQPTKIPSAKEQLYCLKSVLLSHFLVEAIPIWTFHPMCEKLGITVEVPFPSLKTMALEIGLFFVLEDTWHYWAHRLFHYGVFYKYIHKQHHRYAAPFGLSAEYAHPAETLSLGFGTVGMPILYVMYTGKLHLFTLCVWITLRLFQAVDSHSGYDFPWSLNKIMPFWAGAEHHDLHHHYFIGNYASSFRWWDYCLDTESGPEAKASREERMKKRAEKNAQKKTN

SEQ ID NO: 75627 - protein, 461 aa, Xanthomonas campestris pv. campestris str. ATCC 33913
MPLPTDPVAETASSAAPALRHALKPRQLMMMGLGTAIGAGLFLGSGVGIHAAGPAVLVSYLIAGALVIIVMNALGEMAAAKPASGAFSVYAADAMGPTAGATVGWLWWLQIVVVIAAEAVGAASLLATVWPALPVPMLASVFMATFTVINLLGVRNFGEFEFWFAILKVVAILIFLMIGGALLAGLLPGVASPGLSNFTQHGGFAPKGLAGIGTALLVVVFAFGGTEIVAVAAAETADPGRSLARTIRTVAWRILVFYIGSISVIVAVVPWTSDALSSPFAAVLEVARIPGAATGITLVAVVALLSALNANLYGASRMIFSLAQRGEAPRWLGNTSRQQVPLVAVIASVLFGFAAAVLELLYPGKVLPMLLNIVGATCLLVWTISLLSQLILRARADRAGIALPFRMRGYPVLTLLALAILAVIFVLLALSADTRAQFLSMVGLTAGIALVSELARRMRKR

SEQ ID NO: 75628 - protein, 287 aa, Arabidopsis thaliana
MAKDVEAVPGEGFQTRDYQDPPPAPFIDGAELKKWSFYRAVIAEFVATLLFLYITVLTVIGYKIQSDTDAGGVDCGGVGILGIAWAFGGMIFILVYCTAGISGGHINPAVTFGLFLARKVSLPRALLYIIAQCLGAICGVGFVKAFQSSYYTRYGGGANSLADGYSTGTGLAAEIIGTFVLVYTVFSATDPKRSARDSHVPVLAPLPIGFAVFMVHLATIPITGTGINPARSFGAAVIYNKSKPWDDHWIFWVGPFIGAAIAAFYHQFVLRASGSKSLGSFRSAANV

SEQ ID NO: 75629 - protein, 250 aa, Leptospira interrogans serovar Lai str. 56601
MRKTIIAGNWKMNLSLKEAVFLAHSIREKIPSISKDKVSMVFPSTLHLENVSKILEGSSVIVGAQNCYHSGLAAFTGETSPDQLKEIGVKVVMVGHSERRQFLGESNFFCNDKIRFLLKNEFTVLYCVGETLSERESGKTLEVLSSQIREGLKGIDSVFFSNLILAYEPVWAIGTGKVATPSQAQEVHSFIRKEISGLFVGASSISESISILYGGSVKPDNIQDLLKEKDIDGGLVGGASQKISSFAELF

SEQ ID NO: 75630 - protein, 387 aa, Oryza sativa Indica Group
MQRALAVVALLAAAAAIAAAQGESPELLPFAVGAAPEGCDVGEGEWVFDEAARPWYAEEECPYIQPDLTCQAHGRPDAAYQRWRWQPRDCSLPSFNATGMLEMLRGKRMLFVGDSLLRGQYTSLLCLLHRGAPGGGGGSRSFETVDSLSIFRAKDYDATIEFYWAPMLAESNSDGAAVPDDRLIRGAPMNKHSSFWKGADVLVFNSYLWWMTGDKIQILRGADEDMSKDIVEMEAAEAYRLVLHQVTRWLEGNVDPKSARVFFVTASPSHAGAGGECYDQTTPVGAADAASYRGSTSRRMVQVAGEVLGASRVPVGVVNVTRMSELRRDAHTQVYREQRWAKPTAEQLAADPRSYADCTHWCLPGVPDAWNELLYWKLFFPARDEAI

SEQ ID NO: 75631 - protein, 421 aa, Wolbachia endosymbiont strain TRS of Brugia malayi
MPEVTKLDNGLRIITEQMRDIDSVALNIRVGVGSRAESANQNGISHFLEHMAFKGTKTRTAFEIAKTFDDIGGVFNASTGRERTSYYAKVLKKDVKIGIDILIDILMNSTFPKDELEREKGVVIQEIFQINDSPSDIIFDKYFEAAYKDQPFGRSILGTQDTVKSFAQGDLNNYINEHYFGENIIFAVAGNVEHEEIAQLTKDFLSKVSSQKLKESQNANCTGGEYLEHRKLDQVHLLIGFPSVSCHDDRYHTFQVLDSILGSGMSSRLFQEVREKQGLAYSVYSFNSSYTDTGMLSIFAGTDSSNLDKLLKSITTELKKLSTNDLREEEVNRVKERIKSQILMSRESVSSCAEALEHYYGNYNRYISKDELIEKTSAVTTADVKRAVEELLSKHEKTTLAAIGEIKSLPGYDKVVSMLRA

SEQ ID NO: 75632 - protein, 214 aa, Serratia proteamaculans
GGNKPRKLEYLAADALRQGADTLVTAGAIQSNHVRQTAAVAAKLGLHCVALLENPIDTKEENYLTNGNRLLLGLFNAEVVMCDALHDPQQQLADLAIRLEVQGFRPYVVPVGGSNALGALGYVQCALEIAEQSRRSNVEFSSIVVASGSAGTHAGLAVGLQQLLPEAELIGVTVSRKVIDQLPKVELIQKALACSLDIDELSPIQLWDDYFAPQ

SEQ ID NO: 75633 - protein, 346 aa, Escherichia coli O157:H7 EDL933
MQNIIRKGGTMKAAVVTKDHHVDVTDKTLRSLKHGEALLKMECCGVCHTDLHVKNGDFGDKTGVILGHEGIGVVAEVGPGVTSLKPGDRASVAWFYEGCGHCEYCNSGNETLCRSVKNAGYSVDGGMAEECIVVADYAVKVPDGLDSAAASSITCAGVTTYKAVKLSKIRPGQWIAIYGLGGLGNLALQYAKNVFNAKVIAIDVNDEQLKLATEMGADLAINSRTEDAAKIVQEKTGGAHAAVVTAVAKAAFNSAVDAVRAGGRVVAVGLPPESMSLDIPRLVLDGIEVVGSLVGTRQDLTEAFQFAAEGKVVPKVALRPLADINTIFTEMEEGKIRGRMVIDFRR

SEQ ID NO: 75634 - protein, 444 aa, Burkholderia vietnamiensis G4
MTTVFHRAPRATLPVAVAGDGIEIIDSTGKRYIDACGGAAVSCLGHSNQRVIDAIKRQVQQLPYAHTSFFTTDVAEELADRLVEAAPAGLEHVYFVSGGSEAIEAALKLARQYFVEKGEPQRRHFIARRQSYHGNTLGALAIGGNAWRREPFLPLLIEAHHVSPCYAYRDQAAGETDEAYAQRLADELEQKIVALGAENVAAFVAETVVGATAGAVPPVRTYLKKIRAVCDKYGVLLILDEIMSGMGRTGYLFACDEDDVAPDLLTIAKGLGAGYQPIGATLVSDRIYRTIVDGSGFFQHGHTYLGHATACAAALEVQRVIADEKLLDSVKARGEQLRASLREHYAAHPHVGDVRGRGLFVGVELVRDRDSKAPFDPKLKLHAAVKREAMQRGLMVYPMGGTIDGVHGDHILVAPPFICTAQQIDTIVERLSGAIGAALASAGA

SEQ ID NO: 75635 - protein, 502 aa, Salmonella enterica subsp. enterica serovar Paratyphi A str.
METKDLIVIGGGINGAGIAADAAGRGLSVLMLEAQDLACATSSASSKLIHGGLRYLEHYEFRLVSEALAEREVLLKMAPHIAFPMRFRLPHRPHLRPAWMIRIGLFMYDHLGKRTSLPGSTGVRFGADSVLKPEIVRGFEYSDCWVDDARLVLANAQMVVRKGGEVLTRTRATAARRENGLWIVEAEDIDTGKKYVWQARGLVNATGPWVKQFFDEGMHLPSPYGIRLIKGSHIVVPRVHNQKQAYILQNEDKRIVFVIPWMEEFSIIGTTDVEYKGDPKAVKIEESEINYLLKVYNAHFQKQLGRDDIVWTYSGVRPLCDDESDSPQAITRDYTLDIHDENGKAPLLSVFGGKLTTYRKLAEHAMEKLASYYPGIGPAWTKTCVLPGGDIDGSREDYAAKLRRRYPFLMESLARHYSRTYGSNTEWILGEATSLLDLGEDFGHEFYEAELKYLVDHEWVRRTEDAIWRRTKEGMWLTAEQQSRITQWLAAYVEKHQLSMAS

SEQ ID NO: 75636 - protein, 120 aa, Oryza sativa
  misc_feature (43)..(43): Xaa can be any naturally occurring amino acid
  misc_feature (61)..(61): Xaa can be any naturally occurring amino acid
  misc_feature (72)..(72): Xaa can be any naturally occurring amino acid
  misc_feature (76)..(76): Xaa can be any naturally occurring amino acid
LMIDSDSDGFLDTVPCEADSHIRRGANKGQQTRSQPGDLDDGXGDIEYRTYVPDPGYDNLXPHGVLKGMYMXSVTXKSVIENMLMRYDPDVIGVERDLDEDEEAELTGHGGMTFLYGQLY

SEQ ID NO: 75637 - protein, 426 aa, Neisseria gonorrhoeae FA 1090
MENSLKEAALKFHELPVPGKISVTPTKSLATDKDLALAYSPGVAAPCMEIHADPQNAYKYTGKGNLVAVISNGTAVLGLGDIGALAGKPVMEGKGVLFKKFAGVDVFDIEIDEKDPQKLVDIIAALEPTFGGINLEDIKAPECFYIERELRKRCKIPVFHDDQHGTAIITAAAVLNALRYTGRKIEEATLVCSGAGAAAIACLNQLLDLGLKRENVTVCDSKGVIYQTREDKDRMDESKKFYAVEDNGRRVLADAVKGKDIFLGLSGANLLTPEMLNTMNEKPIVFAMANPNPEILPPLAKETRPDVVIGTGRSDFPNQVNNVLCFPFIFRGALDVGATTINEEMKRACVYALADLAMEEVTEEVVAAYGKKFEFGAEYLIPTPFDSRLLPRVATAAAKAAMESGVATRPIADLEAYAAKLGEWKL

SEQ ID NO: 75638 - protein, 287 aa, Francisella tularensis subsp. tularensis SCHU S4
MKIRKAVFPVAGWGTRFLPATKSCPKEMLTVVDKPLIQYAVEEAIEAGCKEIIFVTSSNKKSLEDHFDRNFELEYSLEKKQKYELLDLVKNIIPKDVSFFFVRQPEALGLGHAVLCAKPLVGIEDFAVILPDDLIYNHDCGTGTLKQMVKAVEGTDIRGCIATQQVKREKTNSYGIVAKDNDNLIKAIVEKPAPEKAPSTNAVVGRYLLPNKIFRCLESTSEGAGGEIQLTDAIAKLLDQDEKILSYEFKGTRYDCGSKLGFLIANYEIALQHQELGHKFKEYLQNR

SEQ ID NO: 75639 - protein, 476 aa, Chlamydomonas reinhardtii
MPDYVALQTETEEMGGPRRSVDTSESRSTLHALRRQAHRARDHVSNTWKVWKSQPNSSELVAIALVYLVQGVTDLAALAQKYLLKDELHASPAQVTFVISAGNVPWAIKPAIGLISDTLPLWGYRRKSYLIAAGLAGAVGWLLLALPAAWGGAGSMAGVLGLIVAVSGASAVSDVVVDSMVVERARREAQVGSAWFSGSLVERLGPRPVFALTALLPLLVVLVGVGRFDADVELQLGEVAGPVLFLFLSSATPAADDAMFFFMTAPAPTGLGFSATFLGVGVYHAFLRRLPLRRVLLWGSLLAAACQASSLVLATRANVALGLPDHLFALGDSVLVSVIQNVLFMPTMVLSARLCPPGLEATLFAGLMSVGNIATGLRYLGGALLTQLLGVTATDFRNLPLLLVLCSIALVLPLPLLLLVPASLDQDREEQGREQGGGGAAGGADSGGGGGLARMTPDSTQPEGFEDADKSTGEES

SEQ ID NO: 75640 - protein, 463 aa, Pseudomonas syringae pv. tomato str. DC3000
MSSTANSSELEQGLKPRHITMLSIAGVIGAGLFVGSGHAIAEAGPAVLLAYAAAGTLVVLVMRMLAEMAVASPDTGSFSTYADRAIGHWAGFTIGWLYWWFWVLVIPLEANAAATILHAWFPDIAIWMFTLVITLLLTATNLFSVKNYGEFEFWFALIKVVAIIAFVVLGVAAIFGLLPTSSVSGVSHLFDTGGFLPNGMGAVLAAMLTTMFSFMGTEIVTIAAAESRNPGKQITKATNSVIWRIFLFYLVSIFIVVSLVPWNDPRLAEVGSYQTVLDAMGIPNAKLIVDLVVLVAVTSCLNSALYTASRMLFSLGKRGDAPALSKRTSKGGTPYWAVIMSTAAAFLTVFANYVAPAAVFDFLLASSGAIALLVYLVIAVSQLRMRQKRIAAGETIDFKMWLFPWLTWAAIAFIVAVLTIMLIQQEHRVEIIATGVLSLLVIGAGLIVSRRRKAGPVGAAALG

SEQ ID NO: 75641 - protein, 446 aa, Coprinopsis cinerea
  misc_feature (191)..(191): Xaa can be any naturally occurring amino acid
LLSFALLAISVANAQIVNSVDTMTLTNANVSPDGFTRAGILVNGVHGPLIRGGKNDNFELNVVNDLDNPTMLRPTSIHWHGLFQRGTNWADGADGVNQCPISPGHAFLYKFTPAGHAGTFWYHSHFGTQYCDGLRGPMVVYDDNDPHAALYDEDDENTIITLADWYHIPAPSIQGAAQPDATLINGKGRYXGGPAAELSIVNVEQGKKYRMRLISLSCDPNWQFSIDGHELTIIEVDGRLTEPHTVDRLQIFTGQRYSFVLDANQPVDNYWIRAQPNKGRNGLAGTFANGVNSAILRYAGAANADPTTSANPNPVQLNEADLHALIDPAAPGIPTPGAADVNLRFQLGFSGGRFTINGTAYESPSVPTLLQIMSGAQSVNDLLPAGSVYELPRNQVVELVVPAGVLGGPHPFHLHGHAFSVVRSAGSSTYNFVNPVKRDVVSLGVT

SEQ ID NO: 75642 - protein, 417 aa, marine gamma proteobacterium HTCC2080
MSYKHIKVPESGDVITVNEDSSLSVPDKPIIPYIEGDGIGVDITPVMIDVVNAAVDKAYGGQKAISWMEIYTGEKAAELYEGDWFPEETLEAIKTYAVAIKGPLTTPVGGGFRSLNVALRQELDLYTCLRPVRWFEGVPSPVRRPEDCNMVIFRENSEDIYAGIEYQAGTPEAQKVVDFIINEMGATKIRFPTDVGIGIKPVSSAGTKRLVRKAIQYAIDQNLPSVTLVHKGNIMKFTEGAFRDWGYELAQEEFGGQLVDGGPWVEIKNPITGDPIIIKDVIADAMLQQVLTRPKEYSVVATLNLNGDYLSDALAAQVGGIGIAPGANLSDTVALFEATHGTAPKYAGQDKVNPGSLILSAEMMMRHLGWNEAADLIVDGVNGAIQAKTVTYDFERLMDGATLVSCSDFGKAIIKAM

SEQ ID NO: 75643 - protein, 326 aa, Clostridium perfringens str. 13
MDKRKVIIDCDPGIDDALAIILALKSKEIEVVGITTVSGNVESLQGAKNALKVLKLLGRLDIPVYLGEGKPVKRELVTAQDTHGEDGLGETFLEEVSSEYIRENGVDFILNTLKNHENVSIIALGPLTNLCRAIEKDSESFHRVKEIVSMGGAYKSHGNCSPVAEFNYWVDPHGAREFLKKFNGEFTMVGLDVTREIVLTPNLREMIHQFKDEIGDFIYDITRFYVDFHWEQERTLGCVINDPLAVEYFINRELCEGFKAYVDIACEDISMGQSVVDVADFYKKRKNVFVLDKVNSKEFMVSFLNKIFPIHKEDIKNVLNNPKYGI

SEQ ID NO: 75644 - protein, 339 aa, Salmonella enterica subsp. enterica serovar Paratyphi B str.
MKSIVIEKPNTLTIETRALPQPAPGEVRIKVKLAGICGSDSHIYRGHNPFAKYPRVIGHEFFGVIDAVGDNVNRDRIGERVSVDPVISCGHCYPCSVGKPNVCTSLVVLGVHRDGGFSEYAVAPARNAHRIPDSIADHHAVMVEPFTIAANVTGQVNPTEQDVALIYGAGPMGLTTVQALKGVYQVKTVIVVDRIEERLAMAKQSGADWTLNNGQHSLAEFLQQKALKPTLIVDAACHPAILQEAITLASSAARIVLMGFSSDPCEIVQQGITGKELAIYSSRLNANKFPVVIDWLNKGLIDPDKLITHTFDYQHVTDAIELFEKDQRQCCKVLLTFAK

SEQ ID NO: 75645 - protein, 365 aa, Yersinia pestis CO92
MRLAMKKTYRIAAIPGDGIGHEVMPEGINVLQAAALRWDLDISFENIEWASCEYYQHHGQMMPNDWQRQLQCFDAIYFGAVGWPATVPDHISLWGSLLKFRRDFQQYVNLRPVRLFPGIPCPLVGKQPGDIDFYVVRENTEGEYSSVGGRLFEGTEQEMVLQASIFTRRGVDRILKYAFELAQMRPRKRLTSATKSNGLAFSMPYWDERFEVMAAQYPQISADKQHIDILCARFVLNPERFDVVVASNLFGDILSDLGPACAGTIGIAPSANLNPERDFPSLFEPVHGSAPDIYKRNIANPIAMIWAGAMMLDFLGQGDERYHAAHNGILNAIEQVIAQGPKTPDMCGDASTQQVGSAIVQVLSH

SEQ ID NO: 75646 - protein, 343 aa, Acinetobacter calcoaceticus
LVVRLNDGGERVVAFDRCLVATGASPAVPPIPGLKESPYWTSTEALVSDTLPERLAVIGSSVVALELAQAFARLGSQVTILARNTLFFRDDPAIGEAVTAAFRAEGIEVLEHTQASQVAHMDGEFVLTTTHGELRADKLLVATGRTPNTRSLALDAAGVTVNAQGAIVIDQGMRTSNPNIYAAGDCTDQPQFVYVAAAAGTRAAINMTGGDAALDLTAMPAVVFTDPQVATVGYSEAEAHHDGIETDSRTLTLDNVPRALANFDTRGFIKLVIEEGSHRLIGVQAVAPEAGELIQTAALAIRNRMTVQELADQLFPYLTMVEGLKPAAQTFNKDVKQLSCCAG

SEQ ID NO: 75647 - protein, 516 aa, Coprinopsis cinerea
MQLLAFVLAALPLARAAIGPVGNLVIANANVSPDGFVRSAVLAGATGTSLEHPGPVIVGQKGDTFHINVIDDLTDPTMLRTTSIHWHGFLQEGTAWADGPAGVTQCPIAPGHSFLYKFQAKNQAGTFWYHSHHMSQYCDGLRGVMVVYDPLDPHRHLFDVDNEDTIITLADWYHDPAPSAGLVPTPWSTLINGKGRYPGGPVVPLAVIHVSRGKRYRFRLVSLSCDPNYVFSIDGHTMTVIEVDGVNHEPLVVDHIQIFAGQRYSFVLNANRPVNNYWVRANPNLGSVGFGGGINSAILRYVGAPAVDPTTSQLPFSNPLLETNLHPLVNPAAPGGPSPGDVDVAINLDILFDVSILKFTVNGATFDEPPVPVLLQILSGAHTASSLLPSGSVYTLPPNKVIELTIPGGGIGAPHPIHLHGHTFKVVRSAGSSTYNFVNPVERDVVNVGQAGDNVTIRFVTDNAGPWILHCHIDWHLVLGLSVVFAEDVPTIDSSVQPPAWHDLCPIYDALPPGTR

SEQ ID NO: 75648 - protein, 448 aa, Oryza sativa Indica Group
MAGHGGGRTRSPFLTSYALTLAFITFVSVLYFKDFSSTLHQPFLTRPPPHRRQIARPRAPSHHHGGGSSSGGGDVVPPFAVGAAAAAGCDVGVGEWVYDEAARPWYEEEECPYIQPQLTCQAHGRPDTAYQHWRWQPRGCSLPSLVLYMKAAVEPQPKCFNATLMLEMLRGKRMMFVGDSLNRGQYVSLVCLLHRSIPESSKSMETFDSLTVFRAKNYNATIEFYWAPFLAESNSDDAVVHRIADRIVRGTALEKHARFWKGADILVFNSYLWWMTGQKMKILQGSFEDKSKDIVEMETEEAYGMVLNAVVKWVENNMNPRNSRVFFVTMSPTHTRSKDWGDDSDGNCYNQTTPIRDLSYWGPGTSKGLMRVIGEVFSTSKVPVGIVNITQLSEYRKDAHTQIYKKQWNPLTPEQIANPKSYADCTHWCLPGLQDTWNELLYSKLFFP

SEQ ID NO: 75649 - protein, 332 aa, Saccharomyces cerevisiae
MVRVAINGFGRIGRLVMRIALSRPNVEVVALNDPFITNDYAAYMFKYDSTHGRYAGEVSHDDKHIIVDGKKIATYQERDPANLPWGSSNVDIAIDSTGVFKELDTAQKHIDAGAKKVVITAPSSTAPMFVMGVNEEKYTSDLKIVSNASCTTNCLAPLAKVINDAFGIEEGLMTTVHSLTATQKTVDGPSHKDWRGGRTASGNIIPSSTGAAKAVGKVLPELQGKLTGMAFRVPTVDVSVVDLTVKLNKETTYDEIKKVVKAAAEGKLKGVLGYTEDAVVSSDFLGGSHSSIFDASAGIQLSPKFVKLVSWYDNEYGYSTRVVDLVEHVAKA

SEQ ID NO: 75650 - protein, 159 aa, Klebsiella pneumoniae subsp. pneumoniae MGH 78578
MRIGHGFDVHAFGGEGPIIIGGVRIPYEKGLLAHSDGDVALHALTDALLGAAALGDIGKLFPDTDPAFKGADSRELLREAWRRIQAKGYTLGNVDVTIIAQAPKMLPHIPQMRVFIAEDLGCHMDDVNVKATTTEKLGFTGRGEGIACEAVALLRKADK

SEQ ID NO: 75651 - protein, 187 aa, Burkholderia vietnamiensis G4
MPIINTQIKPFKATAYHNGDFVPVTEENFKGKWSVVVFYPADFTFVCPTELGDLADRYAEFQKLGVEIYGVSTDTHFTHKAWHDTSETIGKIKYPMIGDPTLTLSRNFDVLIEEEGMALRGTFVINPEGEIKLCEIHDNGIGRDAGELLRKVQAAQYIAAHPGEVCPAKWTPGAETLTPSLDLIGKI

SEQ ID NO: 75652 - protein, 546 aa, Dechloromonas aromatica RCB
MLPKLSSFPGVQGPVVIIVMDGYGLPKTDVGSAIAAARKPTLDRLFASYPNVRLRAHGTAVGMPSDDDMGNSEVGHNAIGAGQVYSQGASLVSNAIASGAIWQGEAWQQIVAGAKAGRGVVHFMGLFSDGNVHSHIDHLKAMVVQAKAEGIKTVRIHALLDGRDVPETSALDYVVPFEAFLAEISSDGFDARIASGGGRQYITMDRYDANWAMVDKGWQTHVLGRGTQFANATAAVNGLREQNPGTIDQDLPEFVVAENGKAIGTIEDGDSVVFFNFRGDRAIEITRAFEEAAFDKFDRVRFPKVTYAGMLQYDGDLKLPARFLVAPPAIKDTTGEWFAKSGIAQFACSETQKFGHVTYFWNGNRSGKFDGETWQEVPSDVVPFEQRPWMKAAEIADAMIAALQSGQYRTLRCNFANGDMVGHTGNFSAATLAVEAVDLSLARVLQAIDAAGGVALITADHGNADEMFELDKKTKQPAMNKDGSFKAKTAHTLNPVPLILYDNVSGGKLGLKQTETAGLSNIAATVANLLGLEKHAAWDESLLEIR

SEQ ID NO: 75653 - protein, 144 aa, Vitis vinifera
MEFFCVVYHRCCCDVTGAGEAVNPKAYPLADAQLTITILDLIQQAANYKQLKKGANEATKTLNRGISEFVVMAADTEPLEILLHLPLLAEDKNVPYVFVPSKQALGRACGVTRPVIACSVTSNEGSQLKSQIQQLKDAIEKLLI

SEQ ID NO: 75654 - protein, 226 aa, Wolbachia endosymbiont strain TRS of Brugia malayi
MGIKIAPSILSANFAKLGEEVKRINNLGVDYIHIDVMDGNFVPNITIGPGVISTIRKYTNLFFDVHLMIKSPGDHVESFINAGADIITIHAEAEVHLERLIRKIKSYKNVNDAKKKVQVGVSIVPSTSPGIFEYIIHELDIVLIMTVNPGFGGQEFIYSQLGKISVVKKMIRERGLKTQISVDGGVSLSNAADIIKAGADILVAGSAIFRAKNMKKAVNDFKNLSL

SEQ ID NO: 75655 - protein, 274 aa, Lactobacillus johnsonii NCC 533
MEYFNLNDGNRIPKIGFGTYKLNGSRGVFAIQAALKNGYRLLDSAVNYENEGAVGRAIKNSGINRDDIFITSKLPGRHHKYQEAIEQIQESLYAANLDYYDLYLIHWPNPKENHYLEAWQAMLDAQRFGLIRSVGVSNFEPSHIEHLYRETGVMPAINQVELHPYWSSKTIREYDNKHNIITEAWSPLQRAGEAFQEKEIIDLAQKYHKSPAQIILRWETQLNVVPIPKASSYEHQISNLDIFDFKLTPEEVQKLINLDKISARRFDPNEHEEF

SEQ ID NO: 75656 - protein, 392 aa, Clostridium tetani E88
MVKWRNNMNINELKKEFIKIYGEGSMRNFFSPGRVNLIGEHIDYNGGHVFPCALNFGTLGCVRKRKDNKVNLASTNIPLKVSINLEDIKYEKKHGWGNYPKGVIKEIIDKGYKVGGMDILISGNIPNGSGLSSSASLELLIAIMINNIFNDGKLDKVELIKLSQKAENDFVGLNCGIMDQFAVAMGKKDMAILLDCNTLEYKYAPVDLGNYVITIMNTNKRRELSDSKYNERRLECEKALKLINKEKKINYLCELSLEEFESLKYLIKDNRVLNRATHVVYENERVKRAYYLLSKRNLKEFGKLLAESHFSLRDLYEVTGKELDAIVGEALNVSGCIGARMIGAGFGGCAIALVEKSKLDLFKKKVSNNYNKIIGYKPGFYTSEIGEGTYEI

SEQ ID NO: 75657 - protein, 247 aa, uncultured bacterium
MAQRIALVTGGMGGLGEAICMKLEKMGIKVVVTYSPGNTKHKDWLKEMEAQGHKFVAYPCDVADFDSCQKAIAEVVKGVGPIDILINNAGITRDMTFKKMTKVDWDAVMKTNLDSVFNVTKPVVDGMVERGWGRVINVSSVNGQKGAFGQTNYSAAKAGMHGFSKALALEVARKGVTVNTISPGYIGTKMVLAIPKDVLDSKIIPQIPMGRLGKPDEVAGLCAYLASDEAAFLTGANIAINGGQHMQ

SEQ ID NO: 75658 - protein, 332 aa, Clostridium tetani E88
MGGINLSILICGGAGYIGSHMVARLLEEKEDIIILDNFQKGHRKAILGGKVYKGDIRNKALLDKIFNENSIEGVIDFAASSLVRESVEKPLEYFDNNIGGTIVLLKSMIEHNVKNIVFSSTAATYGEPENIPIREEDKTNPTNPYGESKLAVEKILKWCDKAYGLKYTVLRYFNAAGAYDTGKIGEDHRPETHLIPIIIEVALGKRDKIQVFGNDYNTKDGTCIRDYVHVMDLTEAHLLAMNKLKNGGKSGIYNLGNGEGFSVKEVIDMVQKVTGRKIKWEVANRRKGDPRVLIASSEKAKTQLGWHPKYNSLEKIIETAWKWHKNNPDGYM

SEQ ID NO: 75659 - protein, 66 aa, Platanus x acerifolia
AGIVVGTPPKTPYCSLIEGLVDLEAAVCLCTAIKAKILGINLNVPVSLSLLLNYCGKKVPNGFQCV

SEQ ID NO: 75660 - protein, 246 aa, Clostridium tetani E88
MYFLEEHAFSRTELIIGEDNLSKLKNSTVVIFGIGGVGSFATEALTRSGIGNLILIDNDTVSISNLNRQIIANLNTIGMSKVEVMKKRIESINPNCNVITHEIFAKENNLLDIITPNADYVIDAIDTVSSKLSLISLCKDKNIPIISSMGTGNKLDPTRFKIADIYETKVCPLAKVMRYELRKRNIPNLKVLYSEEVPIKIKSNDESSTNSIKKTRKKIAPGSISFVPPVAGMIIASQVIKDILKV

SEQ ID NO: 75661 - protein, 494 aa, Arabidopsis thaliana
MVLTKTATNDESVCTMFGSRYVRTTLPKYEIGENSIPKDAAYQIIKDELMLDGNPRLNLASFVTTWMEPECDKLIMDSINKNYVDMDEYPVTTELQNRCVNIIARLFNAPLEESETAVGVGTVGSSEAIMLAGLAFKRKWQNKRKAEGKPYDKPNIVTGANVQVCWEKFARYFEVELKEVNLSEGYYVMDPDKAAEMVDENTICVAAILGSTLNGEFEDVKRLNDLLVKKNEETGWNTPIHVDAASGGFIAPFIYPELEWDFRLPLVKSINVSGHKYGLVYAGIGWVVWRAAEDLPEELIFHINYLGADQPTFTLNFSKGSSQIIAQYYQLIRLGFEGYKNVMENCIENMVVLKEGIEKTERFNIVSKDQGVPVVAFSLKDHSFHNEFEISEMLRRFGWIVPAYTMPADVQHITVLRVVIREDFSRTLAERLVADISKVLHELDTLPSKISKKMGIEGIAENVKEKKMEKEILMEVIVGWRKFVKERKKMNGVC

SEQ ID NO: 75662 - protein, 404 aa, Salmonella enterica subsp. enterica serovar Paratyphi A str.
MKFERHHRILKELSISGVVKVSNLAKSLKVTKETIRSDLNELAGQGYLTRCHGGAFITLDSLDNVAKNEIAYVLEKYESAQKIKKGLSAMKNNVCVIGSFNVDIISYLPRLPSTGESLLADKFIFSPGGKGCNQALAASYADSDVHFITKVGSDHFSDYAINFINSSKIHKSVIYQTKETQTGTATIMVNGDTGDNVIAIYPGANMTISPDEITIQKEAIVHSDIVLVQLETNYEALQQTIRLAQKNDIPVIINPAPYNDMVNTIINNIDYITPNETEAGLLANMAVNDIESAKCAAKIIHQKGVKNTIITLGSKGSLAYDGTQFIYSPAFPAVVKNTAGAGDAFNGALASGLAKGKSLASALCYASAFASLAVETPNASDMPENDSVLHRIQGSHYKQTISTH

SEQ ID NO: 75663 - protein, 500 aa, Beta vulgaris
MSMPIPSRQLFIDGEWREPIKKNRIPIINPSNEEIIGDIPAGSSEDIEVAVAAARRALKRNKGREWAATSGAHRARYLRAIAAKVTERKDHFVKLETIDSGKPFDEAVLDIDDVATCFEYFAGQAEAMDAKQKAPVTLPMERFKSHVLRQPIGVVGLITPWNYPLLMATWKIAPALAAGCTAVLKPSELASITCLEFGEVCNEVGLPPGVLNIVTGLGPDAGAPLAAHPDVDKVAFTGSSATGSKVMASAAQLVKPVTLELGGKSPIIVFEDVDIDQVVEWTMFGCFWTNGQICSATSRLLVHESIAAEFIDRLVKWTKNIKISDPFEEGCRLGPVISKGQYDKIMKFISTAKSEGATILCGGSRPEHLKKGYFIEPTIISDISTSMQIWREEVFGPVLCVKTFSSEDEALELANDTEYGLASAVFSKDLERCERVSKLLESGAVWVNCSQPCFVHAPWGGIKRSGFGRELGEWGIENYLNIKQVTSDISNEPWGWYKSP

SEQ ID NO: 75664 - protein, 304 aa, Arabidopsis thaliana
MLAEIIKSISDAPPTHYMVKIESFSLLTKHAIERYETESFEAGGYKWKLVLYPNGNKSKNTKDHVSVYLSLADSSSLSPGWEVYAVFRLYLLDQNKDNYLILQGNERRFHSVKREWGFDKFIPTGTFSDASNGYLMEDTCMFGADVFVSKERRSGRGECLSMIKDATSSKHVWKIENFSKLDKESYDSNAFFAGDRKWKIEFYPTGTKQGTGTHLSIYLTLVDPETISDGTKIFVEFTIRIFDQLQGRHIAGKVTKWFSRSSSEHGWVKYVSMVYFTQPNSGLLLKDVCLVEADVCVHGITSAI

SEQ ID NO: 75665 - protein, 497 aa, Spinacia oleracea
MAFPIPARQLFIDGEWREPIKKNRIPVINPSTEEIIGDIPAATAEDVEVAVVAARRAFRRNNWSATSGAHRATYLRAIAAKITEKKDHFVKLETIDSGKPFDEAVLDIDDVASCFEYFAGQAEALDGKQKAPVTLPMERFKSHVLRQPLGVVGLISPWNYPLLMATWKIAPALAAGCTAVLKPSELASVTCLEFGEVCNEVGLPPGVLNILTGLGPDAGAPLVSHPDVDKIAFTGSSATGSKVMASAAQLVKPVTLELGGKSPIVVFEDVDIDKVVEWTIFGCFWTNGQICSATSRLLVHESIAAEFVDKLVKWTKNIKISDPFEEGCRLGPVISKGQYDKIMKFISTAKSEGATILYGGSRPEHLKKGYYIEPTIVTDISTSMQIWKEEVFGPVLCVKTFSSEDEAIALANDTEYGLAAAVFSNDLERCERITKALEVGAVWVNCSQPCFVQAPWGGIKRSGFGRELGEWGIQNYLNIKQVTQDISDEPWGWYKSP

SEQ ID NO: 75666 - protein, 545 aa, Coprinopsis cinerea
MRDSALPVLFLLFGLFPGIQGKVLSSASTLVVHNQFVAPDGFNRSAVLVNGVHPSPLIKANKGETYYLNVVNKLHDSTMLRSTSVHWHGLLQHGTAWADGSQSVSQCPISPGHSFEYRFPGGDQAGTFWYHSHFGTQYCDGLRGPFVIYDENDPYKHLYDVDDENTIITVADWYHTPAPSLPIPAFADSTLINGKGRYPGGPKVDLAIVNVVKGKRYRFRLLSLACEPNYQFSIDGHRMTIIEADGYLTEPVVVDRIQIFTGQRYSFILEANRPVANYWIRALPNYGNNGLTLGFEGGINSAILRYAGAPKSEPIYSNWPLDRGVQLLESMLHPIYSPPAPGPPVPGAADVNIYLDMGFQPESLTYTVNGSVFEPPSVPVLLQIMSGAKNAAELLPKGTLYPLKRNQVVELTVPGGLIGGPHPFHLHGHSFSVVKSAGSQTYNFDNPVRRDVTNAGEEGEEVVIRFETDNSGPWLFHCHVEFHLQMGLAIVFAEDIEGMVDRNPVPGAWKELCPIYDALPEDEKTVTILEPTNNTEVSSDAPTTN

SEQ ID NO: 75667 - protein, 533 aa, Coprinopsis cinerea
MSFAWKALATLAVAIASRSAFAQSIIGNQDTMTISNINAGPDGFTRPVIAVNGEFPSPLVRANKGDDFRINVVNNLDDDTMLRQTSVHWHGVFQHQSAWADGPDGVTQCPIPQSGQEFEYAFNAGQEAGTFWYHSHYGTQYCDGLRGPLVIYDPEDPHQDLYDVDDENTIITLADWYHLQAPSIQGPAVSQATLINGKGRRPGSTEGDIAVVNVEKDSRYRFRIVSLSCDPDYTFSIDNHTMTIIEADGQNTKPLEVESIRVFAGQRYSVVVNADQAIGNYWIRAEPNIGDTGLVGTSGGGVNSAILRYATADEVEPDTPRLTNRPALQESNLRALTSGVPGGDGPADITFTFNLGLNFATGTFSMNPGESWVHPDTPVMVQIMNGVPAEDLVPAESLHTITRGQVVEVVIPPFGIAGPHPFHLHGHAFSVIKSAGGSPNFVDPVRRDVVAVGTEAGQGDTIIRFVADNPGPWFFHCHIEFHLVTGLAAVFMEAPDEIASSNPPPPSWDALCPAFSALPPSATSIRIVPTPTP

SEQ ID NO: 75668 - protein, 166 aa, Borrelia lonestari
MGFHIYEIKARQIIDSRGNPTVEADVILEDGSMGRAAVPSGASTGTNEAVELRDDNKSVYMGKGVLKAVENIINIISPELEGMNALNQVEIDRKMIELDGTPNKSKLGANAILAVSMATARAAAKHLGLKVYQYLGAYKSNILPTPMCNIINGGAHSDNSVDFQEF

SEQ ID NO: 75669 - protein, 532 aa, Coprinopsis cinerea
MTTRLLAYLQLGIALYHSGVRAQATLNPTDTMIISNAQVSPDGFARSAVVVNGVHPGPLLTGQKDDTFAINVVNELNDPTMLRSTSVHWHGLFQKGTNWADGAEGVNQCPISPASPENTENAFEYRFTPAGHAGTFWYHSHFGTQYCDGLRGPMVVYDPQDPYLGDYDVDNASTVITLADWFHTPAPSLRAPFRPDATLINGIGRTPGGEQVDLAVVNVEAGKKYRFRVVSLACDVNFQFSIDGHKLTIIEADGQLTDRLEVDRIQIFTGQRYSVILNANQEPGNYRIRAIPNAGVPGLVGTVDEGVNSAILRYAGAPIEEPSSDPPANPVDLREWELHAFSGPGFDPSAPGTPEIGAADVVLPLQFTFVGGKFQVNGVAYESPDVPTLLQIMSGRNPGELMPEGSVHYLPRNQVVEVQIPSGSISNSGPHPFHLHGHAFSVVRSAGNSTPNFVNPVKRDVVSIGGASDSVTIRFVTDNPGPWFFHCHIEPHLVDGLAIVFAEAMEDTVQANPLPEDREYCSVLHAFSGNLC

SEQ ID NO: 75670 - protein, 876 aa, Clostridium perfringens str. 13
MEKKQYVYLFNEGNASMKNLLGGKGANLSEMTILGIPVPQGFTVTTEACNKYYEDDKKISQDIIEEIENKMSELEKITGKKFGSLENPLLVSVRSGARVSMPGMMDTILNLGLNDESVEAMAKLTNNPRFAYDSYRRFIQMFADVVMGVEKRLFEDLLDEVKEEKGYKIDTDLTAEDLKDLVVKFKALYKKEKGEDFPSNPKEQLIEAVTAVFRSWNNPRAIVYRRLNDIPGEWGTAVNVQEMVFGNKGETSGTGVAFSRNPANGDNELYGEYLMNAQGEDVVAGIRTPEPISHLEAQNPTIYKQFTDIVNTLEKHYRDMQDMEFTIEDGKLYFLQTRNGKRTAQAALKIAVDLVEEGMLTKEEAILKVEPKQLDTLLHPAFASDGLKEAKIVAKGLPASPGAACGKIAFTAEEAKERKANGEKVVLVRLETSPEDIEGMIAAEGILTVRGGMTSHAAVVARGMGTCCVAGCGELKVNEEARTLEVNGQVLTFDDYISIDGSTGHIYAEQVKTVSPEITGHFATFMGWADEIRKLKVRTNADTPRDTKQAVEFGAEGIGLCRTEHMFFAEDRILAVREMILAKNEDSRRVALEKLLPMQREDFIGIYEALEERPATIRFLDPPLHEFLPSEEEDINALAKEIGVSPAEIKNVVAELHEFNPMMGHRGCRLAVSYPEIAEMQTRAVIEAAIEVKKNKGYNIVPEIMIPLIGEIKELKYVKNVVVETAKTVMEEKGVQLDYKVGTMIEIPRAALTADKIAEEAEFFSFGTNDLTQMTFGFSRDDAAKFLKDYYEKGIYEQDPFAKLDQEGVGELMRIACEKGKATRPDIKLGICGEHGGDPSSVEFCHNLGLNYVSCSPYRVPLARLAAAQAQVKNKR

SEQ ID NO: 75671 - protein, 184 aa, Triticum aestivum
  misc_feature (30)..(30): Xaa can be any naturally occurring amino acid
  misc_feature (42)..(42): Xaa can be any naturally occurring amino acid
GTNPNPNPPTSPLKPSPATDATQAPNPSEXERGGGGGNPVDXGEMVFFALLVGAELDGLTNLQPRGGCDDPSYPYYFKCKLCSRDGSVVMIPGQGTPLTAEQSQKGEMTCLMVFECRGYEPIEFAFGNGWKAESVHGTPFDIDLSEGEFDEYDEKGECPVALSKLQSTFKVVKKQGFHGKTRYV

SEQ ID NO: 75672 - protein, 549 aa, Coprinopsis cinerea
MTSRLLGYLQLAIVLYNSVARGQMILSPSDTMVISNANVSPDGVTRSAVVVNGVHPGPVLIGEKDDVFAINVVNELTDPTMLRSTSVHWHGLFQRGTNWADGAEGVNQCPISPERSFLYRFSPAGHAGTFWYHSHFGTQYCDGLRGPMVVYDPDDPYKNEYDVDDVNTIITLADWYHTPAPSIRGPFFPDSTLINGIGRTPGGPKVDLAVVNVEAGKKYRFRIVSLACDVNFQFSIDKHKLTIIEADGQLTDPLEVDRIQIFTGQRYSVILNANQTPDVYRIRAIPNAGVHGLTDTTAGGVNSAILRYANAEATELPQEDELPSNLVDLQEWMLHAYAGGDPAAPGRPEAGGADVRIPLRFTFSGGRFFVNGTAYSSPSVPTLLQIMSGANPGELLPENSIYYLPRNQVIEVEIPSAGISASGPHPFHIHGHAFSVIRSAGNTSYNYVNPVKRDVVNIGGDSDLVTIRFVTDNPGPWFFHCHIEPHLVGGLAIVFAEAMKDTMSANPDVPDEWKDLCDIYDKLEPSLTSLSIIRRAEPTDLSAKFRGLY

SEQ ID NO: 75673 - protein, 567 aa, Coprinopsis cinerea
MSPAVIAAGSTSFPFVGSVATLNIGNANLSPDGFERPSSVVNGVFPAPLIKANKGDHFSLNVVNDMTDDTQFRATSIHWHGIYQKHTNWADGVAGVNQCPIGPGDSFLYQFDVPNQAGTFWYHSHFRTQYCDGLRGPLVIYDPEDPYRDLYDVDDENTVITIGDWYHLQSPSITGVASNDATVINGKGRYVGGPLVDLAIINVVPGKRYRLRIMAISCDPNYIFSIDGHQLTVIEADAQSTQPLVVDSIQIFAGQRYSAILTADQPIGNYWIRALPNSGNNNLFTGFIDGTNSAILRYAGAPIADPTTSAPDAPVLLDETLLVPLDTTPVPGQPFPGGADVNLLLNLDFNVDAWRFYVNNETFNPPTVPVLLQVMSGAVAAQDLLPAGSVYTLPPNASVEISIPGGVISSPHPFHLHGHSFSVVKSAGIDTPYNYVNPVKRDVVSTGDVGSNTTIRFFTDNSGPWILHCHIDWHLDLGLAIVLAEDPVGTPALNPTPQDWDDLCPAYDALDPSMTEIAVVATPSPLDPQVVSVPESYLATSTEAEDVTVTVTVTVTEGDDAAATDSS

SEQ ID NO: 75674 - protein, 45 aa, Oryza sativa
CSSMVPPASSMMPTAPPLHPTSASAQRATYGTPLLQPFPPPTPPP

SEQ ID NO: 75675 - protein, 201 aa, Corynebacterium glutamicum
MTVFMSDIRMAAQGGPGFGNDVFDRLLSERIIFLGSQVDDEIANKLCAQILLLSAEDPTRDISLYINSPGGSVTAGMAIYDTMKYSPCDIATYGMGLAASMGQFLLSGGTKGKRFALPHARIMMHQPSAGVGGTAADIAIQAEQFAATKREMAQLIAEHTGQTFEQISKDSDRDRWFTAQEAKDYGLVDHVITLAEGPISN

SEQ ID NO: 75676 - protein, 1360 aa, Streptomyces verticillus
SARGEPSGAVTGRPVSGEPSGTLTGQSVPGEPSGTATDGPVPGEPSVTATGQLASGEPPMTATDIASAAASQVAALRADWRGHDYPRFVAALKMAASHCYAAALAAFLPRPDAPFTAADLLRVGTVPRHATFLSAVLPELRRHRLVGRDDSGGYRLLRTRFDDTKALRDLILRFPRYAPEGRLALHGLRVLRAAGDHRPVEHLLSDGGLADLEQLYDTGVIGRFHNRLAQALLRVVVERWPDDRPLRVLEVGAGTGGTTAALLPLLPPERTRYVFTDVSPAFLTRAEHRFAAYDFLTFRTLDLDADPAAQGLPEGGFDVVVAANALHTARSVEAAVRNVAALAAPNGLLLAVESHDPYVLAPLFGALDTFWDRTDHHERPHSPLLTADRWAALFTRCGFTDVVRTGDDTAPCRDDFSVLLATAPRRPTPHPYPYPHPSPPGPGRHWTVVAETRGELPLAREVAARLPGPGDGPAHSVEAVDDVPAHRPSTPSRGATGICLILGAHQLPEPAATVTLTTRRAALLRRITAACPRRPDGARTALTVVTRPSGALPPPERPLAPEDAAVWGVMRTLANEEPELDVRTISLDRTGRTETDARRLARELLTATGETEVALTRSGGRFAPRELPLPAGHITTTAEHATAYALEIRTPGLSYRPAWVECAPEPVGPGEVAIDVRAAALNYRDIMQAVGLLPAEADEGTFTEAGPGLECAGVVTAVGDGVTTVRPGDRVFALAPASLASRTRTVVQAVGRMPHTMSFAEAATLPVVYATVHYSLHDLARLRPGETVLVHGGAGGVGLAALRYAHLRGARVIATAGTPAKRELLRHLGADHVLDSRGLDFAAHVRDVTDGRGVDVVVNSLAGEAITRGLELLRPGGRFVELGKRDIYENQPLLLRPFRHNLAFFGVDLTSLAFDPDQGARLFAEVTRRVHDGSYRPLPHSAYPAARVAEAFRLLQHSRHVGKVVVTFDPLDEPAVVERPVTAPRFGSQGTYLVTGGTSGFGAAGARWLADRGVRRLALVSRRGPHAPEAAGLLADLAARGVTATAYAADAADPDGMRRVIRLIDATGHPVDGVLHCAMHLDDDPLADLTDERFAAVLTPKTTGAAVLERLLADRPLETFLLYSSDTTFLGNIRQAAYVAANLHLEALARQRRQRGLPAQTLAWGAIDETGYVARNDLARTLTAVGIEPLSPREALTTAGLLISQGATVAGVGRYNWARLRGVLPLLASPRCASLLPEDLQEADHTHEEILRILATMPYEEAARAVAATLARLMADVLHLDERNIDHDRRLDEYGLDSLMLAELLVSLRKRFDIDIPPLELLRSGGTITDISHLVLLRLGITADDPEPPARDAEQSVGER

SEQ ID NO: 75677 - protein, 570 aa, Klebsiella pneumoniae subsp. pneumoniae MGH 78578
MSEKHPGPLVVEGKLSDAERMKLESNYLRGTIAEDLNDGLTGGFKGDNFLLIRFHGMYQQDDRDIRAERAAQKLEPRHAMLLRCRLPGGVITTTQWKAIDKFAAENTIYGSIRLTNRQTFQFHGILKKNVKPVHQMLHSVGLDALATANDMNRNVLCTSNPYESQLHAEAYEWAKKISEHLLPRTRAYAEIWLDQKKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGVETFKAEVERRAGIKFEPIRPYEFTGRGDRIGWVKGIDDKWHLTLFIENGRILDYPGRPLKTGLLEIAKVHQGEFRITANQNLIVASVPEDQKARIEKLARDHGLMNAVTPQRENSMACVSFPTCPLAMAEAERFLPSFIDKVEGVMSKHGVSDEHIVTRVTGCPNGCGRAMLAEVGLVGKAPGRYNLHIGGNRNGTRIPRMYRENITESEILDSLDELVGRWAKEREAGEGFGDFTVRAGIIRPVLDPARDFWE

SEQ ID NO: 75678 - protein, 289 aa, Oryza sativa
  misc_feature (96)..(96): Xaa can be any naturally occurring amino acid
  misc_feature (123)..(123): Xaa can be any naturally occurring amino acid
  misc_feature (134)..(134): Xaa can be any naturally occurring amino acid
LSPSPFSSASDLQRLPPRRRASRAVDGSSPSRTRPLPSSPARPPRSLARPPDLRLRFASNFEIENYNEPFLSAVKEYDDGKDLTTYDFEADCFSSXYDDLNKRKLAYRHRAIGEKYTKGLEKXLDHHMIHVWTXIGIMAGIAATDKYTDGWLSSAHKLLEEAMGKSTAESTAKHSSINCIVTSGSLIPSLAKCLLYRLDDVVAFENVYSSWEVGKLQCFKWIKERYDGPNVRFCAIGDGHEECTAAQIMKWPFVKIEFHPDAPHRFPGLNLPTIHRIMDTVYDSSSNDG

SEQ ID NO: 75679 - protein, 296 aa, Thermosynechococcus elongatus BP-1
MPHLRRLRVEGVSRWQQLWDQFAAATGRRLHGGKALAVGGGSINTTYVWQHPEQTLFVKLNRPERQAMFAAEANALRAIAKVQAIRVPLPLLWGVVEDASFLVLEYLPLTSTGDWRQMGVELAQLHLKGTGDRYGWSENNTIGATPQINPWSDNWGEFFRDARLRYQFDLAQRRGGHFPKAEKLLAAIPELLNHQPTPTLVHGDLWSGNAAFCRTGEPVIFDPASYYGDREVDLAMSELFGGFPAAFYEGYNATYPLGAGYQQRKTIYHLYHILNHFNLFGGSYQTQAQYMIEQIL

SEQ ID NO: 75680 - protein, 270 aa, Pyrus communis subsp. caucasica
AHYKSEADVGEAFAEAFKTGLIKREELFITTKIWNSDHGHVVEACKNSLEKLQLDYLDLYLVHYPMPTRHNAIGKTASLLGEDKVLDIDVTISLQQTWEGMEKTVTLGLVRSIGLSNYDLFLTRDCLAYSKIKPAVSQFETHPYFQRDSLVKFCIKHGVLPTAHTPLGGAAANKDMFGSVSPLDDPILNDVAKKYGKSVAQICLRWGIQRKTAVIPKSSKIQRLKENLVVLEFQLSDEDMQLIYSIDRKYRTSLPSKTWGLRRVCKGEFV

SEQ ID NO: 75681 - protein, 239 aa, Picea sitchensis
MAMEACGEEGQVKLLGASISPFVLRVRIALALKGIHYEFIEENLLNKSQLLLQSNPVHKKIPVLIHNGKPVCESMIIVQYIEEAWDSKAPNLMPKDPYDRAIARFWAAFVDDKLLPCVRGVFTGQGEQQQKAVEESVANFLVLEEALRTSLCFSGKPYFGGDEIGFVDIALGGMLAFVKALEKATNSVLIDVEKMPLLSAWMDRFCKADEVKEVMPDPAKLLEFIIAMKVRFASPPAAN

SEQ ID NO: 75682 - protein, 228 aa, Triticum aestivum
  misc_feature (109)..(109): Xaa can be any naturally occurring amino acid
  misc_feature (212)..(212): Xaa can be any naturally occurring amino acid
MSSIAPSSSSIAVLRRQPVQFLGGSDVSKQAKGSVSYSFPTNSRNANMKSVGLKIAASLKKNSGFPADGCLENDDTLSLKSTSVRAQDHPTTNSVIPVDSPVAAEILSXDLSCVVDTLSNEEDDADLDLDSPTEGFSSISEALEDIRQGKLVMVVFHESRENEGDLILAASLVTPEAMAFIVRHSTGIVCVSMKQNDLEGLNLALMVSTKEXSEKLCTASHHYCGMLL

SEQ ID NO: 75683 - protein, 335 aa, Borrelia burgdorferi
MKLAINGFGRIGRNVFKIAFERGIDIVAINDLTDPKTLAHLLKYDSTFGVYNKKVESRDGAIVVDGREIKIIAERDPKNLPWAKLGIDVVIESTGVFSSATSDKGGYLDHVNHAGAKKVILTVPAKDEIKTIVLGVNDHDINSDLKAVSNASCTTNCLAPLAKVLHESFGIEQGLMTTVHAYTNDQRILDLPHSDLRRARAAALSIIPTSTGAPKAVGLVLPELKGKLNGTSMRVPVPTGSIVDLTVQLKKKDVTKEEINSVLRKASETPELKGILGYTEDPIVSSDIKGNSHPSIVDGLETMVLENGFAKILSWYDNEFGYSTRVVDLAQKLVK

SEQ ID NO: 75684 - protein, 244 aa, Enterobacter aerogenes
SIGGNKPRKLEFLAAGALREGADTLITAGAIQSNHVRQTAAVAAKLGLHCVALLENPIGTHAENYLTNGNRLLLDLFNVQVEMVDALTDPTAQLDELATRLEAQGFRPYVIPVGGSNALGALGYVESALEIAQQCEGAVNLSSVVVASGSAGTHAGLAVGLEQLLPDVELIGVTVSRSVADQKPKVVTLQQAVAEQLELKAKADILLWDDYFAPGYGTPNEEGMEAVKLLARLEGILLDPVYTG

SEQ ID NO: 75685 - protein, 434 aa, Bacillus anthracis str. Sterne
MVKFIFFRWIRSSIHLADCIRVILEERKCNRSACLHFSWSKLIYVHSSFLSKSVRYTYSCLPDLFCVYRLYLRKHGCCEEKQYRLDEKRSPYRTAFFRINLFFLFCNPVNIHKLITIEGMELRAMKKVLFLGDPGIDDSLAIMYGLLHPDIDIVGVVTGYGNVTQEKATSNAAYLLQLAGREDIPIINGAKIPLSGDITTYYPEIHGAEGLGPIRPPKNLSPNIRPFCEFFDILEKYKGELIIVDAGRSTTLATAFILEKPLMKYVKEYYIMGGAFLMPGNVTPVAEANFHGDPIASQLVMQNAKNVTLVPLNVTSEAIITPEMVKYITKHSKTSFNKLIEPIFTYYYKAYRKLNPKITGSPVHDVVTMMVAANPSILDYVYRRVDVDTVGIAKGESIADFRPQPDAKALKNWVRIGWSLHYKKFLEDFVKIMT

SEQ ID NO: 75686 - protein, 393 aa, Borrelia burgdorferi
MSIKTVKDFSSFAGKRALVRCDFNVPLKEGSISDDTRIRAALSTIEYLKERGARIVLVSHLGRPDGKKNPKYSLKPVANRLSELLGQDVKMLSDCIGSEVVNSTLQMKDGDVVLLENVRFYAEEEKNDKNFAKKLSENGDVFVNDAFGAAHRAHASTVGVADYSPSVGGFLMEKEDNSLGGILKNPERPSVSIIGGSKVSSKIAVLESLLSKSNVVVIGGGMAYTFLHSEGYSIGKSLLEDEYIGIASSFLKKAKELGVKVILPLDHIVADDFNKNSIPEYIDSFNIPENKIGMDIGANTLKEIENVVKTAKTIIWNGPLGVFEFDSFSKGTAKVAEMVASCSGLTVVGGGDSVAAVNKFNLSDKITHVSTGGGASLEYLEGRILPGIKVLEN

SEQ ID NO: 75687 - protein, 320 aa, Vitis vinifera
MANAWKRDRPPRLLSPRILLLLFSSSLLLLIFLFLSSRTPSPIPVSAFKTLIPSRTIQPFDCFKCPQSHPVIANIVEGVKYPFLYSLSDFGTLPDKPHKNIVRILKGKPFRKPDISLTVQEILEKMKDQGKNGFVVDVGANVGMATFAAAVMGFRVLAFEPVFENLQRICDGIFFNRVGESVTVFEAAASDRLGNITFHKLVGRLDNSAVSATGAKMAFKSNEEIELQVRSIPLDEVIPESEPVLLLKIDVQGWEYHVLKGATKLLSRKESEAPYLIYEEDERLLQASNSSAKEIREFLHSVGYHHCTQHGTDAHCTKKG

SEQ ID NO: 75688 - protein, 253 aa, Borrelia burgdorferi
MRKTFLAGNWKMHYTSAEASIVAKKIATEVKTLKDDVVIMITPPFTALSKVSECIKGSNILLGAQNMSYMESGARTSEISPSMLLEFGVEYVILGHSECRLYLAETDEIINKKILAGLKHPFKYLILCVGETLDERDSGKTLEVVLNQVKKGLNCVSESDIQRIILAYEPVWAIGTGKTATKEEAEEVHKAIRLEITKLYTKSASDNIIIQYGGSVNSNNVKELMNEPNIDGALIGGASLKAESFLSIINNVL

SEQ ID NO: 75689 - protein, 432 aa, Klebsiella pneumoniae subsp. pneumoniae MGH 78578
MSKIVKVIGREIIDSRGNPTVEAEVHLEGGFVGMAAAPSGASTGSREALELRDGDKSRFLGKGVTKAVAAVNGPIAQAILGKDAKDQAGIDKIMIDLDGTENKSNFGANAILAVSLANAKAAAASKGLPLYAHIAELNGTPGKYSMPVPMMNIINGGEHADNNVDIQEFMIQPVGAPTLKEAVRMGSEVFHHLAKVLKSKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWEGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEQAPFNGRKEIKGQA

SEQ ID NO: 75690 - protein, 187 aa, Glycine max
MTMTGRIDDEDVVKLLRSKVVSYPDFPKKGIEFLDFFPILRDPNAFEVMINHLINHIRKLIKVDGTVDRSKDDDGGLPLLIVGLDSRGFLIGPTLASRLGCGFVPIRKPGKLPGKTQSVDYQKEYGIDTFEIQSDSIKPNQPVIIIDDLIATGGSARAAEELVSKLGATVLESIFVIEIESLTGTSS

SEQ ID NO: 75691 - protein, 580 aa, Salmonella enterica subsp. enterica serovar Paratyphi A str.
MKPTFMRWVAIAALLAGGTFSAVANPPVAPPVSYGVEEDVFHPVRATQGMVASVDAMATQVGVDILKQGGNAVDAAVAVGYALAVTHPQAGNLGGGGFMLLRTKDGATTAIDFREMAPAGATRDMFLDDQGNADAKKSLTSHLASGTPGTVAGFSLALEKYGTMPLNKVVRPAIKLAEEGFVVNDALADDLKTYGSEVIPNHENSKAIFWKDGEPLKKGDKLVQKNLAKSLEMIAENGPAAFYKGAIADQIAGEMQKNGGLMTKEDLASYKAVERTPISGDYRGYQVFSMPPPSSGGIHIVQILNILENFDMKKYGFGSADAMQIMAEAEKYAYADRSEYLGDPDFVKVPWQALTNKAYAKTLADQIDINKAKPSSQIKPGKLAPYESNQTTHFSVVDKDGNAVAVTYTLNTTFGTGIVAGNTGILLNNQMDDFSAKPGVPNVYGLVGGDANAVEPKKRPLSSMSPTIVVKDGKTWLVTGSPGGSRIITTVLQMVVNSIDFGMNVAEATNAPRFHHQWLPDELRVEKGFSPDTIKLLEQKGQKVALKEAMGSTQSIMVGPDGALYGASDPRSVDDLTAGY

SEQ ID NO: 75692 - protein, 477 aa, Glycine max
MAWAKKPGDSNNVGFMRWLALVLVLVLLSGFWCVSGVKEGKRNAYATMMYVGTPRDYEFYIAIRVLLKSLATLDAQADLVVIASLDVPPRWIRALEKEDGAKVVRVENLDNPYKHQDNFDKRFKLSLNKLYAWSLVDYDRVVMLDADNLFLQNTDELFQCGQFCAVFINPCVFHTGLFVLQPSMTVFKDMVHELRNGRENPDGADQGFIASYFPELLDKPMFHPPPNGTKLDGTYRLPLGYQMDASYYYLKLRWSIPCGPNSVITFPGAPWLKPWYWWSWPVLPLGLQWHDKRRQTLGYGAEMAVILIQSAIYLGIIAMTRFARPSLSKLCYRRSDKSINLVQNILKLVALWSILAAYTTPFFIIPHTVHPLLGWPLYLLGVFALCSIAVNAFLLPMLPVLMPWLGITGALIVMAFPWYSDGVVRALCVFGYAFCAAPCVWASMTRIMAGLHQSLEREAFLPRLGESSPPSWFNKLY

SEQ ID NO: 75693 - protein, 944 aa, Rhodopseudomonas palustris CGA009
MSDVTGTVSSDVLRYQQARSTLESSKSELEELQNSEAVGVFQKQLALLQKRLVNDPASLRNMFIADGTQAIVWEFQQPELGEAFTTTLWNLLARGDDMSIILQRFIWALPLKFKRKFIKAIDVHLRGRYPMFENLSEGWPGEAFIPPYIRPAEERAIDFELVNQGYLGYQSIGYSVRECELFVWLEVMRDKQCDDKPCELGVLIQGKKEAKGGCPVKIHIPEMLDLLGNGKHREALELIESCNPLPNVTGRVCPQELQCQGVCTHTKRPIEIGQLEWYLPEHQKLTNPNANERFAGRISPWAAAVKPPIAVVGSGPSGLINAYLLAVEGFPVTIFEAFHDLGGVLRYGIPEFRLPNTLIDDVVEKIILLGGRFVKNFVVGKTATLEDLKAEGFWKIFVGTGAGLPTFMNVPGEHLLGVMSANEFLTRVNLMRGLDDRYETPLPEVKDKNVFVIGGGNTAMDAARTAKRLGGNVTIVYRRTKSEMPARVEELHHALEENINLAVLRAPREFIGDDHTHFVTHALLDVNELGEPDKSGRRSPKPTGQIERVPVDLVIMALGNTANPIMKDAEPGLKTNKWGTIEVEEGSQRTSIKNVYTGGDAARGGSTAIRAAGDGQAAAREIVGEIPFTPAEIKDRVERAAKYTELGQIEQTIVGKVPLAGGIVEFTVRAPMVARSAKAGQFVRVLPWEKGELIPLTLADWDAEKGTIDLVVQGMGTSSLEINRMAIGDAFSGIAGPLGRASELHRYEGNQTVVFCAGGVGLPPVYPIMREHLRLGNHVTLISGFRAKEFLFWTGDDERVGKLKKEFGDQLSLIYTTNDGSYGVKGFVTGPLEEMMKANQEGKGRSIAEVIAIGPPLMMRAVSDLTKPYGVKTVASLNSIMVDATGMCGACMVPVTIDGKMVRKHACIDGPEIDAHIIDWDKFLPRFNAFKAQELESKKKHGFA

SEQ ID NO: 75694 - protein, 443 aa, Chlamydomonas reinhardtii
AVVLGGGESDSRRLFPLTQYRTLPAVPFGGAYRIIDLLMSNMLNSGINKIHILTAFNSYSLNRHLQRTYDMSGGVPYGGDGYIEVVANSMSPDSQNWVTGTAGCVRQFMSYFDSNSKNRFIEDIMILPGDHVYSADYTPIIAYHRSTGADLTIVCRPVSGEQACRLGVVKLDAQNRIKTFSEKPSASELPELAMSDDEMRPFMMPTETETRPGTTGYVGSCGIYIFKRSVLSEALKRHFKMQDFGRQIIPELIREGVKVHAYRLPGYWADVGGSVGDFYAANMSLLSDPPSISFNAPINSPFFKFPLTIPASQMMHSRVSGALVSAGCIVNRSDIRNSVIGSRSIIGPNVTIEDSVVFGASHYDHEKPLPRPLGPTFPPMGIGEGSIVRNAILDLNVRVGKNVQLVNKEGVYESADRGVQGMYVRDGIIVLAREAVVPDGTIM

SEQ ID NO: 75695 - protein, 455 aa, Pseudoalteromonas tunicata D2
MSFARLGLSAPILDAVAEQGYDTPTPIQLAAIPAIIEGRDMMAAAQTGTGKTAGFTLPLLERLSKGKPAGNNQVRALVLTPTRELAAQVAESVELYGKNLKLTSFVVYGGVKVNPQMMRLRRGVDILVATPGRLLDLFNQRAVKFDQLEVLVLDEADRMLDMGFIHDIKKILKVLPAKRQNLMFSATFSDDIRNLAKGLINDPVEVSVAPANTTAATVEQRLHPVDKAKKPALLSHLILQNDWKQVLVFTRTKHGANRLVKQLEADKINAAAIHGNKSQSARMKALAGFKDGQVRVLVATDIVARGLDIDQLPQVVNFDLPNIAEDYVHRIGRTGRAGASGHAISFVTTEEAKELADIERLINATIAREVVPGFEPSNQVKETDLNIKAKKPKKAKKPREFSSTDGAAKVAQPRRSNANSPAKKPAIGQKPAGEQAANKPAKRRVWRNKPKPVAN

SEQ ID NO: 75696 - protein, 754 aa, Oryza sativa
  misc_feature (314)..(314): Xaa can be any naturally occurring amino acid
MEAQADAGGDDLAAMREQCRSLEEAIGFRRETQMGLVASLQRLVPDLVPSLDRSLRIIAAFNDRPFVPTPNPDGGHGKSPAALKPHHRRALPDPARSTRRKTSPGSSPASVAAAPGGLDAVRTMVAVCLLELVPFAEIDAAALARRLQAESSSASEAERTALADLAAELGGSAASAVVLALRRIAEDTGGVQIEEAMIGGKSMTMVWAIDRNKLLKELPESATLPLLQPPPAPQMPPSETDARSAMIPRTPQQQQPQPDMWPHSMPSIFPRPRGMTMQGMQRVPGVPPGLMPLQRPFMGPAGVITWVGGVGGPXPNQQKQKSEEDELKDLELLLNKKTYREKQNTKTGEELLDLIHRPTAKETAVAAKSHTVSPVVVNELAVADLGFEPRGLNVKTIAYKEMGDTRSKSSKIYSMFKTKGGSQLKEYCTNLTKEDCRRQSGSFVACDKVHFRRIIAPHTDTNLGDCSFLDTCRHTKTCKYVHYELDQTPDIPPMMAGALAPPRQIRLQRAEYCSEVELGEAQWINCDIRNFRMDILGQFGVIMADPPWDIHMELPYGTMADDEMRTLNVPALQTDGLIFLWVTGRAMELGRECLELWGYKRVEEIIWVKTNQLQRIIRTGRTGHWLNHSKEHCLVGIKGNPLVNRNIDTDVIVAEVRETSRKPDEMYPMLERISPRTRKLELFARMHNAHAGWLSLGNQLNGVRLVDEGLRARYKAAYPDSEVQPPSPPRASAPIDGDQGTSQKPTVSDGERPA

SEQ ID NO: 75697 - protein, 150 aa, Staphylococcus aureus
KLKEKYWKQAIAEYEKRLGPYTKIDIIEVPDEKAPENMSDKEIEQVKEKEGQRILAKIKPQSTVITLEIQGKMLSSEGLAQELNQRMTQGQSDFVFVIGGSNGLHKDVLQRSNYALSFSKMTFPHQMMRVVLIEQVYRAFKIMRGEAYHK

SEQ ID NO: 75698 - protein, 114 aa, Musa acuminata
VQFGAFIVATILKDRELYHEWTIELKAMADRIINMRQQLFDALRARGTPGDWSHIIKQIGMFTFTGLNTEQVTFMTKEYHIYMTSDGRISMAGLSSKTVPHLVDAIHAAVTSMK

SEQ ID NO: 75699 - protein, 212 aa, Glycine max
QLERKEAEQAGANKETRIVTPLMEFVRQRRAVDSGMQASSAVAKVSRRSRAALPGKPGSGNTKRGSEKKKYVQKDNAKGVARKESKDKSAFVVVPRRDNQSAESMHGIEGPFSGISLTSDSGKKKILLLKGKQREIPSAIEGTVKQQNIQSGNSPISAPAKQNQRREASGRLIRSILLNNESRQSLSTTGAQHKIQILSSENGKRPPRTFGS

SEQ ID NO: 75700 - protein, 156 aa, Staphylococcus aureus
TILAVGKLKEKYWKQAIAEYEKRLGPYTKIDIIEVPDEKAPENMSDKEIEQVKEKEGQRILAKIKPQSTVITLEIQGKMLSSEGLAQELNQRMTQGQSDFVFVIGGSNGLHKDVLQRSNYALSFSKMTFPHQMMRVVLIEQVYRAFKIMRGEAYHK

SEQ ID NO: 75701 - protein, 236 aa, Pyrococcus abyssi GE5
MSQEWKEYAKRVLDEWQPKTKLGMLVKEGQITDIHEIFRKGYQIKEPEIIDVLLPEVNARENQEILDIALTVRMTDSGRRVRFRVLAAVGNRDGYVGLGIGHGREVGIAIRKAINYAKLNIIEIKRGCGSWECRCRRPHSVPFTVEGKEGSVRVKLIPGPRGLGLVIGDVGKKILRLAGIQDVWSQTLGETRTTVNFAKAVFNALYNTNKVVVTPEMIERYGIVVGRAMPASFTLE

SEQ ID NO: 75702 - protein, 248 aa, Sinapis arvensis
ENQLCGDLMRKWVLEHPEASICTAEGVNQFSDIAIFQDYHGLPEFRQAVAKFMEKTRNNKVKFDPDRIVMSGGATGAHETVAFCLANPGEGFLVPTPYYPGFDRDLRWRTGVNLVPVTCHSSNGFKITVEALEAAYENARVSNIPVKGLLITNPSNPLGTTLDRDCLKSLVKFTNDKRIHLVADEIYAATTFGQSEFISVAEVIEEVPDCNPDLIHIVYSLSKDMGLPGLRVGIVYSYNDRVVQIARK

SEQ ID NO: 75703 - protein, 207 aa, Arabidopsis thaliana
  misc_feature (32)..(32): Xaa can be any naturally occurring amino acid
  misc_feature (161)..(161): Xaa can be any naturally occurring amino acid
VAEFVFSGQVNVRNHISNIVPPPSRLCLLVAXVRCLGYGASSEERTLAMIKPDGVSGNYTEEIKTIVVEAGFNIVKEMLTQLDKETASAFYEEHSSRSFFPHLVTYMTSGPVLVMVLEKRNAVSDWRDLIGPTDAEKAKISHPHRFDLLPNTILDFANSNXRALCGKNSQKNCVHGSDSTSSAEREIKIFFQGVVSRDNATQQHDEL

SEQ ID NO: 75704 - protein, 248 aa, Sinapis arvensis
ENQLSFDLIESWLDDHPEVLGLKKNEESVFKHLALFQDYYGLPAFKDAMAKFMEKIRGSKVKFNTNKMVLTAGSTSANETLMFCLANPGDAFLIPAPYYPGFDRDLKWRTGVEIVPIHCVSSNGYKITREALEDAYERAHKLNLKVKGVLITNPSNPLGTSTTRAELDLLLTFTSAKKIHMVSDEIYSGTVFDSPEFTSVLEVAKDKNMDFDDKIHVVYSLSKDLGLPGFRVGLIYSDNEKVVSAATK

SEQ ID NO: 75705 - protein, 152 aa, Staphylococcus aureus
VGKLKEKYWKQAIAEYEKRLGPYTKIDIIEVPDEKAPENMSDKEIEQVKEKEGQRILAKIKPQSTVITLEIQGKMLSSEGLAQELNQRMTQGQSDFVFVIGGSNGLHKDVLQRSNYALSFSKMTFPHQMMRVVLIEQVYRAFKIMRGEAYHK

SEQ ID NO: 75706 - protein, 251 aa, Sinapis arvensis
ENQLCFDLIETWLAKNPDAAELKKDGQSIFKELALFQDYHGLPEFKKALAEFMEEIRGNRVSFDPSKIVLAAGSTSANETLMFCLAEPGDAFLLPTPYYPGFDRDLKWRTGAEIVPIHCSSSNGFQITESALQQAYQQAQKLDLKVKGVLVTNPSNPLGTMLTRRELNLLVDFITSKNIHLISDEIYSGTVFGFEQFVSVMDVLKDKKLENSEVSKRVHVVYSLSKDLGLPGFRVGAIYSNDEMVVSAATK

SEQ ID NO: 75707 - protein, 149 aa, Staphylococcus aureus
LKEKYWKQAIAEYEKRLGPYTKIDIIEVPDEKAPENMSDKEIEQVKEKEGQRILAKIKPQSTVITLEIQGKMLSSEGLAQELNQRMTQGQSDFVFVIGGSNGLHKDVLQRSNYALSFSKMTFPHQMMRVVLIEQVYRAFKIMRGEAYHK

SEQ ID NO: 75708 - protein, 103 aa, Arabidopsis thaliana
  misc_feature (36)..(36): Xaa can be any naturally occurring amino acid
  misc_feature (83)..(83): Xaa can be any naturally occurring amino acid
RKANNDITSITSNGGRVNCMQVAPPIAKTMFETRSXLPDFIASELANEVDYLICNKWTPCIEFELLHGFVYREHGNSPGYYDXRFWTMSQLLLFRCTVSAHVF

SEQ ID NO: 75709 - protein, 280 aa, Ehrlichia ruminantium str. Welgevonden
MINPIRHYTVMHLFCFGYGYTASFLAQKLLPLKWKVSGTSFHKKKTQDKNVNILDYNFPLPESIFSDVTHVLISIPPEGDNILEKYHLLLKNIHWLGYLSATNVYGNHNGNWVNETSITNPSTSSGIHRLNKEKLWLNSNLPTHIFRLSGIYGPHRNVLRNLIQNNVRYIISDIMFSRIHVDDIANILFTSIHQPNPNSIYNCSDDLPDSYLNVIKYGAQLLNIDPPKPVTFEDLPDSMKRFYTENKLVSNLKIKHELDVSLKYPTYIQGLQSLINTEKF

SEQ ID NO: 75710 - protein, 489 aa, Pseudomonas aeruginosa UCBPP-PA14
MSDSRYTDLGLQPLAGEWRHGRAGRRLKVSNPFDGSLLLEIEQADRDDLDAAYAKAAEVQPAWAALGPSARAAVLYKAVEVFDRRHEEIVDWLIRESGSTRLKAEIEWGAARAITLESASFPARVHGRIVESDVPGKESRVYRSAIGVVGVISPWNFPLHLTQRSIAPALALGNAVVVKPASDTPVCGGLLLARIFEEAGLPAGLFSVVVGPGSEIGDAFVEHPVPGLVTFTGSTPVGRNIGRIASGGAHLKHVALELGGNSPFVVLGDADLEQAVNAAVFGKFLHQGQICMAINRIIVEDSLYDAFAARFVERVKGLRVGDPQRADTAVGPIVNARQLEGLLEKIRLARQEGAKPLYEGGVDGQLLAPHVFGEVSATMEIARDEIFGPLVGLLRARDEAHALELANASEYGLSSAVFSRDLERAVRFARQLRAGMTHVNDIPVNDEANAPFGGEKNSGLGRFNGDWAIEEFTTDHWISVQHAPRQYPF

SEQ ID NO: 75711 - protein, 249 aa, Vitis vinifera
MITYIKPLFNTVISPINFSGSCSKRLCYSSLSWRDHNRLNTHHLSHQVCSKKWLCRMHDSISSEDEYRSSRNIAISLFRRYRNVVDRGGGDNLKEFISAGVNAYALGCTDEGLRKELTEMKESGFEIETMQSYGGSTSLKSKIFSEEIDECILWLSIIFITILCTPQPTIVRWSSTPSVSDEIRLQWKGFCALIANAYYVKGMAWLPVKTLQLEQMAVVGNAEEPSVVASRMRLVFSTLEVVSPQWPRV

SEQ ID NO: 75712 - protein, 260 aa, Bifidobacterium longum NCC2705
MIELKTPREIEEMKPAGRFVGGILKELQETTKVGTNLLEIDEFVHKKIVDRKGAESCYVDYAPDFGTGPFAHYICTSVNDAVLHGVPYDYSLKDGDLVSLDLAISVDGWVADSAVSFVVGKDPDPEDLRIIKCTEEALAAAIDVAKPGNRLGDISNTIGDVAREYGYPINLEFGGHGVGHIMHGDPHVPNDGRAHHGYKLREGLVIAIEPWFLKTTDEIFQDPKDGWTLRASDGSRGAHSEHTIAITENGPIVFTDRTNL

SEQ ID NO: 75713 - protein, 114 aa, Oryza sativa Indica Group
MTPCVTPAARQVIWHVIAQVQDLPGHIARECTNEPVCNLCNVSGHLARNCRKTTISSEIQGGPFRDITCRLCGKPGHISRNCMTTMICGTCGGRGHMSYECPSARMFDRGLRRF

SEQ ID NO: 75714 - protein, 346 aa, Oryza sativa
DQLFCRGVAITQENSLLDNTARIEGWLARFPMFDWVGGRTSEMSAVGLLPAALQGIDIKEMLVGAAQMDEETRNTEIKENPAALLALCWYWASDGIGSKDMVVLPYKDSLLLLSRYLQQLVMESLGKEFDLDGNRVNQGLTVYGNKGSTDQHAYIQQLREGVHNFFVTFIEVLRDRPPGHEWELEPSVTCGDYLFGMLQGTRSALYANDRESISVTVQEVTPRAVGALVALYERAVGIYASLVNINAYHQPGVEAGKKAAGEVLALQKRVLTVLNEASCKDPAEPLTLDQIAERCHCPEDIEMIYKIIQHMAANDRALIAEGSCGSPRSIKVYLGECNVDEDMLAA

SEQ ID NO: 75715 - protein, 209 aa, Prochlorococcus marinus str. MIT 9313
MTQPNTQTTPNDVPAAAEGQQEQQQQQRRGGGRERRGGGRRGDRRGQERDSEWQERVVQIRRVSKTVKGGKKMSFRAIVVVGNERGQVGVGVGKAGDVIGAVRKGVADGKKHLVKVPLTRHNSIPTLSNGRDGAANVLIRPAAPGTGVIAGGSIRTVLELAGIKNVLAKRLGSKTPLNNARAAMVALASLRTHKETAKERGISLEQIYS

SEQ ID NO: 75716 - protein, 247 aa, Listeria monocytogenes EGD-e
MTLQGKVAVVTGGSRGIGRDIAINLAKEGANIFFNYNGSPEAAEETAKLVAEHGVEVEAMKANVAIAEDVDAFFKQAIERFGRVDILVNNAGITRDNLLMRMKEDEWDDVININLKGTFLCTKAVSRTMMKQRAGKIINMASVVGLIGNAGQANYVASKAGVIGLTKTTARELAPRGINVNAVAPGFITTDMTDKLDEKTKEAMLAQIPLGAYGTTEDIANAVLFLASDASKYITGQTLSVDGGMVM

SEQ ID NO: 75717 - protein, 188 aa, Triticum aestivum
MGSGSFLKVLVSNLDVLAGPIVSLAYPLYASVRAIETKSPIDDQQWLTYWVLYSFITLFELTFAAVIEWLPFWSYGKLFFNCWLVLPYFNGAAHVYEHFVRPMIVNQQVVNIWYLPKKEGSDKPDDVISAAQKYIEQNGSKAFETLVNKFKTTNARRSILEEVEVERRARAERELEARDVNPFFHPNY

SEQ ID NO: 75718 - protein, 295 aa, Haemophilus influenzae R2846
MKAIIPVAGLGTRMLPATKAIPKEMLTLVDKPLIQYVVNECVAAGIKEIVLVTHSSKNAIENHFDTSFELETMLEKRVKRQLLEEVRSICPKNVTIMHVRQGNAKGLGHAVLCGRPLVGNESFAVMLPDVLLAEFSADQKKENLAAMIQRFNETGASQIMVTPVPQENVSSYGVADCGGIELNGGESAKINSIVEKPSIEGAPSNLAVVGRYVFSAAIWDLLEKTPIGVGDEIQLTDAIDMLIEKETVEAFHMTGETFDCGDKIGYMEAFVEYGIRHEKLGKEFKSFIKNLAKTL

SEQ ID NO: 75719 - protein, 495 aa, Bradyrhizobium sp. ORS278
MISRKNVCVIGAGVSGLAAAKAFAARGHNVTIIERSADLGGVWEPARSYPDVQTQSPKDLYRYTDKAMPESYPEWPKGPQVYAYLSDYARSHDLTRLMRLNTTVRLMQRRADGKPGWTLDLMSGESESREDYDFVAVCTGQFNEPQTLSLPGEDAFKAAGGAIMHSSKYNDAGIARGRNVVVLGGSKSATDLAVNAVRSGARSVTIVLREPVWRIPYFIGGLINFKRILYIRAQEQMFASWGIGPLSRLAHLLAKPLVWANWRGLESLLKTQLKLAKCNMVPKERIEDGVNCSVPIATPDFYPMVSDGRIKAVLGTFDHYEPNTIVASTGERIAADVAVLAIGYKLGVPFLSETDRARLVDPDGQYRLYRLIANPDLPEMGFVGFNSSFCTVLCADMAAHWLVRYADRQLAHQPSEREMRDNIEMMLHFKRVERPAAGVYGGLCVAPYHFKHFDELLADIGATRRRRSPLAEMFTPPDADAYAGYLASAPAYQAG

SEQ ID NO: 75720 - protein, 599 aa, Thermosynechococcus elongatus BP-1
MGLIVQKYGGTSVGSVERIQAVARRVKATVAAGHQVVVVVSAMGKTTDSLVQLAYAISDRPSQREMDMLLSTGEQVSIALLTMALHALGEPAISLTGAQVGIVTEPAHTRARILHIETQRLERHLKAGQVVVVAGFQGITAATDFEVTTLGRGGSDTSAVALAAALRADCCEIYTDVPGILTADPRLVPNAQLMSEITCDEMLELASLGAKVLHPRAVEIARNYGVDLVVRSSWTDDPGTRVIAPARPPRPVENLELGKPVDGVALDTDQAKVALLRVADRPGVAAQLFGELARQNLDVDLIIQSIHEGQTNDIAFTVQKSVLKQAEAIAVAFYPRLSPRVEETDVLVDADIAKVSITGAGMIGRPGVAAQMFSALAAAGINLQMISTSEVNVSCTVAAADAGRAIAVLSQTFDVEAATTVPQNPPAAPPVRGVALDPKQARIAIRDVPDRPGMAAAIFQTLADAAISVDMIIQSQRSRSLGGVMTRDIAFTVASTDAEDATELLRKVQAQLGYGDVLVDTAIAKVSIVGVGMIHRPGIAAQMFAALARENINIQMIATSEIRVSCVVAESEGVRALRAVHRAFGLDGEAPVAIPDVGK

SEQ ID NO: 75721 - protein, 360 aa, Pseudomonas aeruginosa
MSKQILVLPGDGIGPEIMAEAVKVLELANDRFQLGFELAEDVIGGAAIDKHGVPLADQTLQRARQADAVLLGAVGGPKWDRIERDIRPERGLLKFRSQLGLFANLRPAILYPQLAAASSLKPEVVAGLDILIVRELTGGIYFGQPREQRVLENGERQAYDTLPYSESEIRRIARVGFDMARVRNNRLCSVDKANVLASSQLWREVVEEVAKDYPDVELSHMYVDNAAMQLVRAPKQFDVMVTDNMFGDILSDEASMLTGSIGMLPSASLDANNKGMYEPCHGSAPDIAGQGIANPLATILSVSMMLRYSFSQATAADAIEQAVSKVLDQGLRTGDIWSEGCRKVGTREMGDAVVAALKNL

SEQ ID NO: 75722 - protein, 186 aa, Platanus x acerifolia
MGEKPQSGGVWPTVKPFLNGGASGMLATCVIQPVDMIKVRIQLGQGSAASVTKTMLRNEGIGAFYNGLSAGLLRQATYTTARLGSFRALTNKAVAANDGKPLPLYQKALCGLTAGAIGACVGSPADLALIRMQADATLPAAQRRHYKNAFHALYRTVGDGGVLALWKGAGPTVVRAMALNMGMLAS

SEQ ID NO: 75723 - protein, 93 aa, Vitis vinifera
MSKSGEQLRKKTEEEERAEEKASKLRGLPMESSPYLKYTDLEDYKRQGYGTEGHLEPKPNQGGGGTDAPTLAGTDLSKGPASVVDAAHRVGIP

SEQ ID NO: 75724 - protein, 845 aa, Ralstonia solanacearum GMI1000
MNPSTAPKTMKFGFIAHPTSVALKRHVKIVDLLERTIAEQDRGYRDDRWQWRNLVPFADFGRIVSAQGAVCEGILHYMPLTAEEMLSQPRAIAQRVVDAVESLKDQGAQVVGLGGFTAIVGNRGLQTLERTGIPVTTGNSLTAYAAYRNVLESMDRLGVEPADTEVAVVGYPGSIALVIAKLLAGHGCRLCLVHRGSEAQGRQGLAYLPEPMHAQVRLSNDIEHCYEHVQFYVAATSTGGLIDPYRLRPGSVVVDAALPRDVKPYRKDRNDILIIDGGLVSASSALRFGAESMGLAPKKFLNGCLAETLILGLEGRAEAFSIGRELPEDKVLEIGRIAELHGFSPSPMASYGEPVKDRHFAALRPFHRPRTQSPAGLEGESLREHALRSFGEHINPILRDFYAFNHIERVFQHGRGCTLTDINGQAFLDFVAGYGCLNTGHNHPRIKAALLDYLQREHPTFVQYVSVPLQTSQLAQRLSELAPGRMERVFFSNSGTEAVEAALKLALAAMSKPRVLYCDNGYHGKTLGALSVTGRDKHRTPFKPLLPRCDAIPFGDADALEAALQTGDVGAFIVEPIQGEGGVIIPPDGYLAKVRQLCSAYDCILILDEIQTGLGRTGKMFACEWEGVEPDILILSKSLSGGAVPIGATLSRKAIWDRAYGNIDTFALHTSTFGGGNLAAAAGLATLDVLAEEDLAGNAARVGESLRHQLTAATRDYPFIREVRGRGLMIAIEFRHSYAGGIEAFIREFANRMPGDAAATYRMLSGKARQHIRAAIEEVEKSFEEMFVLRFVTKLSQEYGILTFVTANNNRVMRIQPPLVLNEDQAQSFVDAFARVCHDMSTFLD

SEQ ID NO: 75725 - protein, 415 aa, Pseudoalteromonas tunicata D2
MYHQIVPPSQGEKIQVLANGQWIIPNEPIIAFIEGDGVGSELTPLMRQLIDSAILKTYETARKIHWLEVYNGEKAAELYDGDWFPEETLNAIRDYHLVYKGPLTTAMGAGFRSLNVALRHEMDLFINLRPIKSLPNLNTPVKHPENIDMVIFRDNSEDLYSGIEFKAGSAQADSLLEFLQQQLGVNRFRFTEQCGLGIKHISEQGSKRLVRAAIAFALKEHKTSVTLVHKGDVMKFTDGAFLKWALEVAIEEFLAVRHPNGRWWQIIQGEHELIIKDELCDVMLQNCLLAPEQYDVIATTNLNGDLLVDSLTAQVGMIGMAAGANLSEALALFEPTHGTVESLVGQDVMNPVSSILAGVMMLRFMNWHDAADNIEQSLHKTLCNNQVTEDMQSLLPDPTVQGTQAFAQCIISHLI

SEQ ID NO: 75726 - protein, 479 aa, Synechococcus elongatus PCC 7942
MSSEFDYDVIVIGAGYGGFDAAKHACEKGLKTAIVEARDLGGTCVNRGCVPSKALLAASGRVREITDTDHLQNFGIQVQGVSFDRQAIADHAANLVDTVRTNLGNTLKRLGAEILMGRGRLAGSQRVTVTAADGTEKTYSARDVILATGSDPFVPPGIEIDGKTVFTSDDALKLETLPQWIAIIGSGYIGLEFSDVYTALGCEVTMIEALDRLLPTFDPDVAKVAQRSLLDGRDIETRTGVLARKITPGSPVVIELADFETKELVEVLEVDACLVATGRIPSTKNLGLETVAVEVDRRGFIPVDDGMRVLRDSKPVPHLFAVGDATGKLMLAHAAAAQGVVAIENITGHPRSVDYRSIPAATFTHPEISSVGLSEADAKALGGQEGFEVGSVRSYFKANSKALAEADADGFAKVLFRKDTGEVLGAHIFGLHAADLIQEVANAIARRQSVKELAFEVHTHPTLSEVIESAYKQAATAIA

SEQ ID NO: 75727 - protein, 615 aa, Oryza sativa
MPRPGDGNPRAVTLIPGDGIGPLVTGAVQQVMEVMHAPVYFETYEVRGDMPTVPPAVIESIRRNKVCLKGGLATPVGGGVSSLNMQLRKELDLYASLVNCSNFPGLPTRHQDVDIVVIRENTEGEYSGLEHEVVPGVVESLKVITKFCSERIAKYAFEYAYLNNRKKVTAVHKANIMKLADGLFLESCREVASKYPGIQYNEIIVDNCCMQLVAKPEQFDVMVTPNLYGNLVANTAAGIAGGTGVMPGGNVGQDHAVFEQGASAGNVGNENILEQKKANPIALLLSSAMMLRHLQFPSFADRLETAVKRVIAEGNIMAYHGQLDGRQASGLMRDGAFPAASLSGRQPLDRAATALEILEKKLAEQTAEAEKLIRENQRLASSHVVLRQDIVDTEKEMQMIRAHLGDVQTETDMHMRDLMERMRLMEADIQAGDAVKKELHQVHMEAKRLIAERQMLTVEMDKVTKELHKFSGDSKKLPELLTELDGLRKEHQSLRSAFEYEKNTNIKQVEQMRTMEMNLMTMTKEADKLRADVANAEKRAQGYTQAALPGYPSAYAAPQQPISSGVATDVASMYGAISSAGYPAGVVQSSSGAANAGQAPATYPVAYDPTRAGQR

SEQ ID NO: 75728 - protein, 288 aa, Platanus x acerifolia
DELLQITGEASVVKKALYQISTRLHDNPSRSQHLLTSAMSNAHQSGGSLTGPNAGAPIVGLAPLMGPYGGYKGDTGSEWPNAFYPAPRDSVSAKEFSLRLVCPTGNIGGVIGKGGSVIKQIRQESGAFIKVDSSAAEADDCIISISSKEFFEDPISPTIDAAVRLQPKCSEKSDRESGDSTFTTRLLVPTSRIGCLIGKGGSIISEMRKVTKANIRILSKENLPKVASEDDEMVQITGDLDVARNALIQVTTRLKTNFFEREGALSAFPPPLSYLPMSARCFRWFKIW

SEQ ID NO: 75729 - protein, 245 aa, Burkholderia mallei ATCC 23344
MSDLAARLASVHRRIDEAARAAGRAPGSVTLLAVSKTFPADAVRAAYAAGQRAFGENYVQESIDKISTLADLRAELEWHFIGPLQSNKTRPVAERFDWVHTIDRLKIAQRLSEQRPAHLPPLNVCVQVNISGEASKSGVAPADAAGLARAVAALPALRLRGLMAIPEPETDPEAKRAPHRALHALFEQLRAGGLALDTLSMGMSDDLEAAVAEGATIVRIGTAIFGARDYAHCPPSLLSRPSHSS

SEQ ID NO: 75730 - protein, 148 aa, Staphylococcus aureus
KEKYWKQAIAEYEKRLGPYTKIDIIEVPDEKAPENMSDKEIEQVKEKEGQRILAKIKPQSTVITLEIQGKMLSSEGLAQELNQRMTQGQSDFVFVIGGSNGLHKDVLQRSNYALSFSKMTFPHQMMRVVLIEQVYRAFKIMRGEAYHK

SEQ ID NO: 75731 - protein, 198 aa, Myxococcus xanthus DK 1622
MTGFVLGRAPTREGSMGLLDEARAGNDLYATFDTTQGQIVVKLFAKDAPKTVSSFVGLATGELPFQDPKTGEKTQRPYYDGIIFHRVIPGFMIQGGDPTGTGRGGPGFNVDDEYQSGRTFDKVGLLATANIGRPNTNGSQFFITTSKPTYLNNKHTIFGEVLSGYDVVEKIAGVPRDGDDRPRQPVVINKLTISTTQP

SEQ ID NO: 75732 - protein, 205 aa, Streptococcus pneumoniae TIGR4
MGWWRETIDIVKENDPAARTTLEVLLTYPGVKALAAHRLSHFLWKHGFKLLARMYSQFWRFWTQIEIHPGAQIDSGVFIDHGSGLVIGETAIVEKGVLLYHGVTLGGTGKDCGKRHPTVRKGALISAHAQVIGPVEIGENAKVGAAAVVVADVPSDVTVVGIPAKIVRLHGKKDEPVIHEVEEKREYYVNKLEQAKDASHRSSGL

SEQ ID NO: 75733 - protein, 270 aa, Burkholderia mallei ATCC 23344
MKIAFIGGGNMAAALIGGLVKRGVDASGLLAVDVNEDARQRAQAQFGVRTAAAVDATLAGYDAIVLAVKPQVLKDVALALAPHLTTQLVVSIAAGIRGADLSRWLGDYPRVVRTMPNTPALVGLGVTGLSALPGVDAAGRDLASKVLGAVGETVWSDDESQLDAVTAISGSGPAYVFYFIEALQEAARQLGMNDEQGRALAVATFAGAAQLAVQSGEPAGVLRERVTSKGGTTAAALASFDAQHVKDAIVRGVLAAQARAREMGDELGGA

SEQ ID NO: 75734 - protein, 438 aa, Zea mays
  misc_feature (124)..(124): Xaa can be any naturally occurring amino acid
EWLLAAGAGAAVGALSAAAVIDLLSRSKRRERYARDLLESNGMTTGNTRSSKHLGSLGSSALLSDEVVSEQLTRNIQFFGMDSQKKVTESYVVVIGLGGVGSHAASMLLRSGVGRLLLVDFDQXDDVGTSKALCLKKHFSMIYPECQIDAKVQLYDASSEEEILSGQPDFVLDCIDNIDTKVSLLAACVRRGLKVLSAMGAGARADPTRIRVADLRESSNDPLSRSVRYRLKKEHGIEGGIPVVFSLEKPKAKLLPFQASKEEETPSDYQIVPGFRVRIIPVLGTIPAIFGQVMASYVVTQLAGLDFQTEPVVNLDLDHYRILHQRLIEHEELMYGTAEQVLVDAEEVMYIVKELWRGRSARDQSQDTGRKMWRSVNELMLVRWDKSKAAGISNLILVKFSEADAHESTTLDRIKEQEPEFYSMVSRVLKRAEMEFAL

SEQ ID NO: 75735 - protein, 251 aa, Sinapis arvensis
ENQLCFDLIESWLAKNQDAASLKRNGQSIFRELALFQDYHGMPEFKKAMAEFMEEIRGNRVTFDPKKIVLAAGSTSANETLMFCLAEPGDAFLLPTPYYPGFDRDLKWRTGAEIVPIHCSSSNGFQITESALQQAYQRAHKLDLKVKGVLVTNPSNPLGTALTRRELNLLVDFVNSKNIHLISDEIYSGTMFGFEQFISVMDVLKDKKLEDTEVSKRVHIVYSLSKDLGLPGFRVGAIYSNDEMIISAATK

SEQ ID NO: 75736 - protein, 325 aa, Orobanche ramosa
MDNTKSINSLLTLTISSLILLSLSITPCQAQLSPTFYDSICPNALSTIRTSIRRAVAAERRMAASLIRLHFHDCFVQGCDASILLDDSPTIQSEKSAGPNVNSVRGYDVIETAKREVESICPRNVSCADIVALAARDASVAVGGPTWTVKLGRRDSTTANPNEANTDLPSPFASLQTLITAFDDKGLSETDMVALSGSHTIGQSRCFLFRSRIYSNGTDIDPNFASTRRRQCPQTGGDNNLAPLDLVTPNSFDNNYFRNLIQRKGLLESDQVLFNGGSTNALVTSYSNNPRLFATDFASAMVRMSEIQPLLGSNGIIRRVCNVIN

SEQ ID NO: 75737 - protein, 2172 aa, Streptomyces hygroscopicus
  misc_feature (1056)..(1056): Xaa can be any naturally occurring amino acid
  misc_feature (1067)..(1068): Xaa can be any naturally occurring amino acid
  misc_feature (1083)..(1083): Xaa can be any naturally occurring amino acid
  misc_feature (1404)..(1404): Xaa can be any naturally occurring amino acid
  misc_feature (1409)..(1409): Xaa can be any naturally occurring amino acid
  misc_feature (1416)..(1416): Xaa can be any naturally occurring amino acid
  misc_feature (1427)..(1427): Xaa can be any naturally occurring amino acid
  misc_feature (1429)..(1429): Xaa can be any naturally occurring amino acid
  misc_feature (1432)..(1435): Xaa can be any naturally occurring amino acid
  misc_feature (1470)..(1470): Xaa can be any naturally occurring amino acid
  misc_feature (1543)..(1543): Xaa can be any naturally occurring amino acid
  misc_feature (1594)..(1594): Xaa can be any naturally occurring amino acid
  misc_feature (1800)..(1800): Xaa can be any naturally occurring amino acid
  misc_feature (1804)..(1804): Xaa can be any naturally occurring amino acid
  misc_feature (1806)..(1806): Xaa can be any naturally occurring amino acid
  misc_feature (1811)..(1811): Xaa can be any naturally occurring amino acid
  misc_feature (1823)..(1823): Xaa can be any naturally occurring amino acid
MTAPDEQIVDALRASLKENMRLQQENQRLSESSAEPIAIVSMACRYAGGIRNPEDLWRVVNDGTDVYTSFPENRGWDLEGIYHPDPDNPGTTYVREGAFLHDANLFDAGLFGISPLEALAMEPQQRQLLEICWEALERAGIDPHSVRGADIGVYAGLVHQDYAPDLSGLEGYLSLERALGSAGGIASGRVAYTLGLEGPAVTVDTMCSSTLVAVHVATQALRRGECAMALAGGATVMSTPGGFIGFARQRALAFDGRCKSYGAAADGSSWAEGAGVVLLERLSDARRNGHRVLAVIRGSALNQDGASNGLTAPNGPAQRRVIRKALENAGLTTADIDMVEGHGTGTVLGDPIEAQALIATYGQDRPEGRPLWLGSVKSVIGHTQSGSGVAGLINAVQALRHGVMPATRHVDAPNPQVDWSAGAVELLTEARAWPELGRPRRAGVSSFGASGTNAHMILEQAPEEPAAESPSAPALDGVVPLVLSAATAASLTGQAERLGSFLEASGTVALADVAAALVTGRASLAQRAVVVTDSPEEALAGLGALARGEDVRGVVAGGGVRSGGDGKVVLVFPGQGSPWVGMGRELLECSEVFAARVGECAVALERWVDWSLVDVLRGDCPVEFFEREDVRQPASFAVMVGLAAVWESVGVVADAVVGHSGGEVAAACVSGALSLEDAVRVVAVRSKTISGVLSGRGGMASVGLSEEEAVARLQQWDGRVEIGAVNSPSSVAITADTEALDEAIETLEDQGVRVRRIAIDYASHSRHVGAVQEILNEAFADIRSQAPTVPFLSTATGEWIREAGALDGSYWYRNLRSQVRFGPAIADLLADGHTVFVESSAHPVLVQPISEVVAGAEAEAVVTGSLRRHEGGPRRLFTSMADLFVRGTHVDWSGVLAAGADARRVDLPTYAFDHKNYWMELAGTANDVASLGLSGADHPLLGAVVPVPETSGVLCTSRLSLRTHPWLADHAVGGVVLVPGTALVELVVRAGDEVGCGTLEELVIETPLVVPAQGSMRVQFAVGGPEENGARSVAVYSARDDDGRGTGIDGWTRHAXGTLTAAAVPAXXFDFTVWPPVGAERVXFDAAEFYEDLADRGYVYGPAFQGLRGVWRRGEEVFAEVSLPDEQRGEASGYGLHPALLDAALHSGFVQPAGPEAGIRVPFAWNGLRLHAAGASELRVRTVPSGPDAVSLQAADGAGGPVLSLQSLISRPVDVEQLDRMATDDGRDALFEVDWTELPAPAPGAEPLPSWTLVASTEDVTELAGATEVPAVAVLQALGGDGEHDALALTVRVLEIVQAWFAAADLAESRLVVLTQGAVPADGEEDVSDPAGAAVWGLVRAAQAENPDRIVLLDLAANSGLDLAGTGMGSVLTAVLAADEPQVAVRGTTLSVPRLVPAGKRALXIPEAXEWRLGVXTTGVGTLDSLXLXPEXXXXAPLAAGQVRVGLRALGLNFRDVLIALGMYPGAAEXGGEGAGVVLEVGEGVTGLAVGDRVMGLTGIGYGSMTVTDHRCLVRIPQGWSFQQAATVPVVFLTAYYGLRDLXGLRAGESVLIHAAAGGVGMAATQLARHLGARVFGTASPGKWGVLRELGFDXAGIASSRTAEFEEHFLTGTSGAGMDVVLDCLAGELVDASLRLLPRGGRFIEMGKTDIRDAGVVASEHPGVAYQAFDVFDAGLDRIQQMLLELARLFETGDLTPLPFAAWDVRRAPDAFRHMSQARHTGKMVLSVPEPLDLEGTVVLTGGTGSLGAVVARHLVGEHGVRHLVLASRRGPDAEGARELVAELGEAGATVTAVACDVTXRBAXAXLLAAXPAEHPLTGVVHXAGVLDDGVIGTLTPERVAAVFAPKVTAVRHLDELTRGMDLSMFAVFSSAAGVFGSAGQGNYGAANAFLDGWMARRRAEGLPGIAMAWGLWEQTTGMTANLSQADQARMSRGGLLPIGVAEGMRLFDTALRMPTALAVPIKLDLRGMRADAAAGGSVLALLRALVQTGRRQAQAGENGSGLTARLASLTPQEQEELLLDLVLTQAATVLGYTEISNVEAHKAFNEAGFDSLTSVELRNRLREATGLKLAATSVFDYPTPLALARHLHDGLKPAQSPTGTHPLLAELSKLEARLVETPVDDSIRAQVTTRLQVLLTTWSTANGTPTGDEALDFDATSDDDLFDLIDTTFSN

SEQ ID NO: 75738 - protein, 407 aa, Bifidobacterium longum NCC2705
MENEAAQQPQSPAASPVMSRRAREANPFRAMVFGEQADKMIAQGTSVIKLSLGEPDFGAPPAVRDAMREQYDGRALPYTAAMGLPELRQAIADFYRERHDLDIDPKRICVTAGGSAALLLATALTVDPGDDVIVADPSYPCNRELVRSFEGRVIDVPTSAATRFHLTADLCSQYWTSKTKAVMITSPSNPTGTTIDFNVLDEVCKLAASRGAWRIVDETYLDLADREPDGTEVKSVLACDPDAIVCNSFSKFFGMTGWRLGWAILPDEPTVLEAVDDLATNYYLCAHTPTQHAALACFTPESLAECEARRQELLARRRIVIDGLKRIGLPVEVEPNGAFYAYFDISRTGLDAWTFCERALDEAHVALTPGRDFGAATADTHVRLSYAASREALTEGLERLGTFVESL

SEQ ID NO: 75739 - protein, 183 aa, Aquifex aeolicus VF5
MKVKFLGSFFEEFPPPDYPEVVFVGRSNVGKSSLLNMVVGSKVAKVSKTPGRTRAVNYFLLDKKLYLVDVPGYGYAKVGREEMEKWRKMMERYFKERKDNIKMAFLLIDAVAGVQPLDEQMIEWFEYYGIPFTVVITKIDKASQSEIAKTLKQVKRYVGDGAIVLSSAKEGKGKKELLSRILN

SEQ ID NO: 75740 - protein, 54 aa, Zea mays
KVCSWIPIIFGAQSLANIKNFENDLNHLSMAFMFLFMGLLTNYFGPPCPASPKP

SEQ ID NO: 75741 - protein, 116 aa, Triticum aestivum
  misc_feature (39)..(39): Xaa can be any naturally occurring amino acid
GPEFLTPDKDKADGPDHLQLYKSMIGPDGWCTNYDKSNXTCNIYEDWPFFYRFEPKVFKEFFGVPCSKFDSEDCSGCVDNIKMVYGQDSPKLGHLMRVIREESSKHEASMNRVTGT

SEQ ID NO: 75742 - protein, 379 aa, Oryza sativa Indica Group
MAKDGGGPDWNGLLKWSLAHGDGTAKPRALSEEDKKWFMEAMQANTMDVVKRMKEITQVMKTPDDVLQSQGVTPENIEDMLDELQEHVESIDMANDLHSIGGLDPLLGYLKNSHAGIRAKAAEVVSTIVQNNPKSQQLVMESNGLEPLLTNFSSDASTNSRTKALGAISSLIRHNQPGVAAFRLGNGYSALRDALGSDDARLQRKALHLLQYLLHDNKADRSVATELGLPKLMMHLASSDDSGVREAALGGLLELARDNTSGAGNALPDQDKLKDVLKSRIEGISTMDADDLSAHREERQLVDSLWKECYNEPSSLREKGLVVLPGEDAPQQPPPDVVGSMFEPPLRAWAASRPPPKEDSESESAKKDPPLLLGPGPSS

SEQ ID NO: 75743 - protein, 63 aa, Glycine max
  misc_feature (45)..(45): Xaa can be any naturally occurring amino acid
MIIPVRCFTCGKVIGNKWDHYLDLLQADYTEGDALDALGLVRYCXRRMLMTHVDLIEKLLNYN

SEQ ID NO: 75744 - protein, 234 aa, Solanum commersonii
MAKEGPDWDGLLKWSLSHADGTNPPSRNLSEVDRRWFMEAMQAQTVDVIKRMKEITLVMQTPEQVLESQGVTSQDIEDMLDELQEHVESIDMANDLNSIGGLVPLLGYLKNSHANIRAKAAEVVSTIVQNNPRSQQLVMEANGLEPLLSNFTSDPDVTARTKALGAISSLIRHNKPAIAAFRLANGYAALRDALSSENVRFQRKALNVIHYLLQENHSDCNVVTELGFLRGART

SEQ ID NO: 75745 - protein, 204 aa, Glycine max
  misc_feature (78)..(78): Xaa can be any naturally occurring amino acid
  misc_feature (130)..(130): Xaa can be any naturally occurring amino acid
MGKTSWLIILVTCLCLLAFSDGRELKVRHKKPHYQYNHTLATILVEYASAVYLSDLTELFTWTCSRCNGLTKIFKMEXGFEMIELVVDVEHCLQAFVGVADDPCAIIIAFRGTNEHSLQNWIEDLYWKQXDINYPGMDDAMVHRGFYTAYHNTTIRPAILDAVERAKKFYGDIEIIATGHSMGGAMASFCGLDLTVIIVLAVLA

SEQ ID NO: 75746 - protein, 218 aa, Listeria monocytogenes EGD-e
MGKIAPSILSADFATLARDIKEVENCGADYIHIDVMDGHFVPNITFGPAVVQAIRPETKLPLDVHLMIENPDTYIPEFAKAGADYITVHVEACTHLHRTLQLIRSYGVKAGAVLNPATPIDVLQHVLNELDMVLFMTVNPGFGGQKFIPEVLEKISAFKEIVDKKGLDIEIEVDGGVDHETAKLCRDAGANVFVAGSYIYGNKNRQTPIDKLRAIVGE

SEQ ID NO: 75747 - protein, 354 aa, Burkholderia vietnamiensis G4
MLLLNPGPVTLSERVRRSLLQPDLCHRESEFFDLQDEARARLVAAYELDPAEWAAVLMTGSGTAAVESMIAALVPQDGKLLVIENGVYGERITQIATQYGIAHDVLKHEWMQAPDVAEVAARLDAGGYSHVAVIHHETTTGRLNDLGAIADVCRARGVRMLVDGVSSFGAEAIDFGGGVIDAVAATANKCLHGVPGAAFVIVRRSALTKAASRTYYLDLGRLAKLQDQRNTPFTPSVHAYYALVEALREFDEAGGWRARHARYKALADQVQAGLAARGMPLVLPDGESSVVLRAYRLPQGVAYEALHDGLKARGFVIYAGQGGLSKELFRISTMGAIEAADVERLLEGFTALTR

SEQ ID NO: 75748 - protein, 418 aa, Shigella boydii
KDHNEQVSFAQAVTQGLGKNQGLFFPHDLPEFSLTEIDEMLKLDFVTRSAKILSAFIGDEIPQEILEERVRAAFAFPAPVANVESDVGCLELFHGPTLAFKDFGGRFMAQMLTHIAGDKPVTILTATSGDTGAAVAHAFYGLPNVKVVILYPRGKISPLQEKLFCTLGGNIETVAIDGDFDACQALVKQAFDDEELKVALGLNSANSINNSRLLAQICYYFEAVAQLPQEARNQLVVSVPSGNFGDLTAGLLAKSLGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLNPGEYGLFLGTAHPAKFKESVEAILGETLDLPKELAERADLPLLSHNLPADFAALRKLM

SEQ ID NO: 75749 - protein, 197 aa, Pseudomonas syringae
GGNKPRKLEFLAADALREGADTLITAGAIQSNHVRQTAAVAAKLGLHCVALLENPIGTHAENYLTNGNRLLLDLFNVQVEMVEALTDPTAQLDELATRLEAQGFRPYVIPVGGSNALGALGYVESALEIAQQCEGAVSLSSVVVASGSAGTHAGLAVGLEQLLPDVELIGVTVSRSVADQKPKVVTLQQAVAEQLAL

SEQ ID NO: 75750 - protein, 245 aa, Arabidopsis thaliana
MARLPKLREFAAENNLKVVSIADLIRYRRKRDKLVERASAARIPTMWGPFTAYCYRSILDGIEHIAMVKGEIGDGQDILVRVHSECLTGDIFGSARCDCGNQLALSMQQIEATGRGVLVYLRGHEGRGIGLGHKLRAYNLQDAGRDTVEANEELGLPVDSREYGIGAQIIRDLGVRTMKLMTNNPAKYVGLKGYGLAIVGRVPLLSLITKENKRYLETKRTKMGHMYGLKFKGDVVEKIESESES

SEQ ID NO: 75751 - protein, 394 aa, Schizosaccharomyces pombe
MKTHLLANKLYQKGLRRQNYLQICKLICHARTVLSDVSNVGKNNADEKDTKKAKRSFDESNLSTNEEADKPVESKFVKKLKVYSKNADPSVETLQKDRALMLMNHLSSNPLMAEEYAPEIFEYIRKLDLKCLPNPKYMDQQKELTWKMREILNEWLVEIHSNFCLMPETLYLAVNIIDRFLSRRSCSLSKFQLTGITALLIASKYEEVMCPSIQNFVYMTDGAFTVEDVCVAERYMLNVLNFDLSYPSPLNFLRKISQAEGYDAQTRTLGKYLTEIYLFDHDLLRYPMSKIAAAMYLSRRLLRRGPWTAKLVESSGGYEEHELKEIAYIMLHYHNKPLEHKAFFQKYSSKRFLKASIFVHQLVRQRYSVNRTDDDDLQSEPSSSLTNDGQRTLL

SEQ ID NO: 75752 - protein, 362 aa, Geobacter sulfurreducens PCA
MAQVFKVAVLPGDGIGPEVMAEALRVLDAVEAKYDVKFERTHANVGGAGIDIEGKALPETTVNICKAADAILFGSVGGPKWESLPPDEQPERGALLPLRKIFGLYANLRPAIIFPSLTGASSLKEEVIAGGFNVLVIRELTGGIYFAQPKGIEGEGRDRVGFDTMRYSVPEIERITHVAFQAARKRGKKVCSIDKANVLSSSVLWREVVTGIAKEYPDVELSHMYVDNAAMQLVRWPKQFDVILCENMFGDILSDEAAMLTGSLGMLPSASLAEGTFGMYEPSGGSAPDIAGQGIANPIAQILSMGMMLKFSFGMVDAADAIDNAVATVLDQGFRTRDIYQQKDGEKLVNTKEMGDAIIAAL

SEQ ID NO: 75753 - protein, 437 aa, Zea mays
  misc_feature (325)..(325): Xaa can be any naturally occurring amino acid
MNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGIAGQRFVIQGFGNVGSWAAQLISEAGGKVIAISDVTGAVKNVDGLDIVQLVKHSAENKGIKGFKGGDAIAPDSLLTEECDVLIPAALGGVINKDNANDIKAKYIIEAANHPTDPEADEASPXLKTNRLLSAMFSDPLCIPFHPQILSKKGVLILPDILANSGGVTVSYFEWVQNIQGFMWDEEKVNAELRTYMTRAFGDVKQMCRSHSCDLRMGAFTLGVNRVARATVLRGWEA

SEQ ID NO: 75754 - protein, 379 aa, Myxococcus xanthus DK 1622
MTTLPDLDLIRTSIERIDEEILDALRRRMALADDVARAKLAAAAPFRDQRREDLLLRRIRTRAAEHGLDPHEVERIWRLFIDMSVARQHELVTRLDTTPLRVAYPGVEGSYSHLAARRRYGHRAGGVLLSGFDHAREAVEALRRGEQDLVLLPIENTTAGSMNETYDLLAEGGVVITAELVSQVDHRLLGLPGAKLEGLREVLSHPQALAQCETFLREKVPWARAVPDVDTGGAAQKVRERNDASVAAIASETAAQRFGLEVLAGDLQPAFDYTRFVEVGREASPLAPGVPCKTSLLVVLEHKPGTLGEMLQRLTLRGVNLSKLESRPIPGQPWQYRFYLDVEGHAASAAVTAALDDIRPLTSSLRVLGTYARAESPHA

SEQ ID NO: 75755 - protein, 381 aa, Vitis vinifera
  misc_feature (84)..(84): Xaa can be any naturally occurring amino acid
MKESSDGFVRADQIDLKSLDEQLEKHLNRVWTMDKNKKKEDDSSSAAAAIPTLAPSTTASTTAPTTARQDWEIDPSKLIIKTVXARGTFGTVHRGVYDGQDVAVKLLDWGEEGHRTEAEIASLRAAFTQEVAVWHKLDHPNVTKFIGATMGSAELNIQTENGHIGMPSNICCVVVEYLPGGALKSYLIKNRRRKLAFKVVIQLALDLARGLSYLHSQKIVHRDVKTENMLLDKTRTVKIADFGVARVEASNPNDMTGETGTLGYMAPEVLNGSPYNRKCDVYSFGICLWEIYCCDMPYPDLSFSEVTSAVVRQNLRPEIPRCCPNSLANVMKRCWDANPDKRPEMDEVVAMIEAIDTSRGGGMLPVDQPQGCFCFRKYRGP

SEQ ID NO: 75756 - protein, 567 aa, marine gamma proteobacterium HTCC2080
MTKLPCWNWLRLYNRQTLGSDLVAAMIVTIMLIPQSLAYALLAGLPPEMGLYASILPLIAYAIFGTSRTLSVGPVAVVSLMTATAVGNVAQQGTVDYATAAITLALLSGLILLFLGFIRFGFVTNFLSHPVVSGFITASGVLIALSQLSHILGVAASGKTLPELAFSLATVIGATNPYTLSVGLCCLLILHWSRGHLAKRLERLGLTPLLAGALAKCVPVAVIVMSTLIAYALELDARGVELVGAIPQGMPAFSQPHIEWTVIRELILPALLVALIGFVESVSVGRTLGAKRRERIDANQELIGLGAANLASAFSGGFPVTGGFSRSVVNFDAGAKTQGASALTAVGIALTALFLTPALYYLPKVTLAATIVIAVSTLIDWKIIKTAWDYDQADFMAIVITIVLTLTLGVEIGVMSGVGASISLHLYRTMRPHFAIVGTVPGTEHYRNIDRHKVLTHHNILSIRIDESLYFANAAFLEEIVDTELSQRDGIEHVILMCPAVNMIDLSAVEALQEVNSRLLERGVKLHLSEVKGPVMDALKRSALLLQLSGNVYLSHHAAVLELTQKS

SEQ ID NO: 75757 - protein, 376 aa, Burkholderia mallei ATCC 23344
MAKRDYYEVLGVAKNASDDEIKKAYRKLAMKYHPDRNPDSKDAEEHFKEAKEAYEMLSDGQKRAAYDQYGHAGVDPNVGAAGAQGFGGFADAFGDIFGDIFGQAAGGGRARGGPQVYRGADLRYSMEITLEQAAHGYDTQIRVPSWAACGVCHGSGAKPGTKPETCPTCHGQGTVRMSQGFFSIQQTCPKCHGTGTYIPEPCAHCHGSGKVKETKTLEVKIPAGIDDGMRIRSAGNGEPGINGGPSGDLYVEIHIKPHAVFERDGDDLHCQMPIPFTTAALGGEIEVPTLAGRASFTVPEGTQSGKTFRLRGKGIKGLHSSIAGDLYVHVQVETPVKLTDQQRDLLKQFEKSLAEGGPRHSPQSKSWFDRVKSFFE

SEQ ID NO: 75758 - protein, 346 aa, Coccidioides immitis RS
MAEIPAATLPPQATAKVSDVVKYYRPSKVFRGNARSEGQQLITSVDFDDQGDFLVAAGDDEMIQLFDVKEGKPTKTVPSKKYGVHLARFTHHSRQILHASTKVDGKAPGKFHSLRLLDLHNESYLRYFTGHTDKVTCLTLSPGADAFLSCSKDDSIALWDLNSRNAQGRLKLATPYLAAFDPSGTVVAIASQSTSSVLLYDFRNYDKPPFATFDMAPHEDRFTPTTRGRAWNKLEFSNDGKHLLIGTDYHGHFILDAFEGHVKAFLVGKSGVTGRAAPVSSTGKPLGQGDVCFTPDGRYVIGGAGEQSDALVWDVHQAPDSSRLLQPMVRLPHRGKVAIIQHVCQR

SEQ ID NO: 75759 - protein, 655 aa, Listeria monocytogenes EGD-e
MMIGKRLSDRYKILHAIGGGGMANVYLAHDIILDRDVAVKILRIDLADESNLIRRFQREAQSATSLVHPNIVSVYDVGEENDLHYIVMEHVDGMDLKQYIHENHPISYEKAVDIMLQIVSAVAIAHQHHIIHRDLKPQNILIDHDGVVKITDFGIAMALSETSITQTNSLLGSVHYLSPEQARGGMATQKSDIYSLGIVLYELLTGKVPFDGESAVSIAIKHLQADIPSAREQNPEIPQSLENIIIKATAKDPFLRYQNAEEMEKDLQTCLNKDRLNEPKYVFPTDDGDTKAIPIIATKDTMQNLDKTIVPEGKVAAAEVVPEEKKDKKKKKMSKKKKIALIVSSVIIIFIIGILLLWLLGKSPDEVAVPDVSGKTEDQAVALLQKEGFVIGKTAEKNSDEVDEGKVINTDPEAGEMKEKGTKINLFVSIGSKKITMDDYTGRSYTDTKALLEEQGFKNISSEEAYSSEIEKGLIISQTPTQGTEVVAKSTDVKFVVSKGAEPITLKDLRGYTKTAVEDYASPLGLKVSSKEENSSTVEKGQVISQSPSAGTAMNSGDTIEIVISAGPKEKQVKEVTKTFNIPYTPSDEENPQPQKIQIYIQDKDHSMTSAYREMSITQNTSVEITFQIEEGSSAGYKIISDDKVIDEGTVPYPN

SEQ ID NO: 75760 - protein, 264 aa, Zea mays
GWYLAQTRSKIGLAGYKPRTSRAVEGKYIWRGKQWRARRVRLKVLGLQVSPFVLRVCLALNMKGVSYEYVEEDVSNKSELLLKSNPVHKKVPVLIHNGKPICESPVIMQYVDELFAGRPILPTDPYERATARFWAAYADDKLFPAWYGMVKAQAEEERAEKAKETLAAIEHMEVAFAKCSGGNAFFGGDSIGYVDIVLGSFLFWFEAVRRVFDLEIINASKTPLLAAWAERFVGTVEAKEVLPLPTADMAVQYINKLHAPLPPP

SEQ ID NO: 75761 - protein, 142 aa, Xanthomonas campestris pv. campestris str. ATCC 33913
MQTVRQLLGMKQVEVFSVAADAAVIEAIRLMADKSIGAVLVMEGERLVGIVSERDYARKVVLRDRSSSSTSVAEIMSHAVVTVSPADSVEHCMQLMTDGRFRHLPVVDNGRVQGVISIGDLVKAVIEAQQHDIDQLQRYIAS

SEQ ID NO: 75762 - protein, 90 aa, Escherichia coli
DLMAVGRYVLSADIWAELEKTAPGAWGRIQLTDAIAELAKKQSVDAMLMTGDSYDCGKKMGYMQAFVKYGLRNLKEGAKFRKSIKKLLSE

SEQ ID NO: 75763 - protein, 63 aa, Actinobacillus pleuropneumoniae serovar 1 str. 4074
MELVFIRHGFSEWNAKNLFTGWRDVNLTERGIEEAKSAGQKLKAAGYEFDIAFTSVLTRAIKT

SEQ ID NO: 75764 - protein, 97 aa, Oryza sativa
  misc_feature (13)..(13): Xaa can be any naturally occurring amino acid
  misc_feature (53)..(53): Xaa can be any naturally occurring amino acid
  misc_feature (70)..(70): Xaa can be any naturally occurring amino acid
MEELAPKLTQMHXKECHAARFAAKPGCANHRAIMETNQKYVQPPVHHLEEPGXLSKKLFYTRLASLPGRXRYTGRKRHQVKNLRRNIKDLHLKYDAD

SEQ ID NO: 75765 - protein, 380 aa, Burkholderia sp. 383
MPSFTPALLALADGTVFRGYSIGAEGHTIGEVVFNTAITGYQEILTDPSYSRQIVTLTYPHIGNVGVNAEDVEATKVHAAGLIIRDLPSLASNFRMDRTLGDYLRDEGVVAIAGIDTRKLTRILRDKGAQNGCILTGSDDEAKAIELARSFPGLAGMDLAKVVSTTKPFEWKQTEWRLEGGYGMQEAPKYRVVAYDFGVKYNILRMLAERGCHVTVLPAQASAEDALALNPDGVFLSNGPGDPEPCDYAIAATKQFIERGVPTFGICLGHQIMGLAVGAKTLKMKTGHHGANHPVKDLGDGRVVITSQNHGFAVDADSLPANARVTHVSLFDGTLQGFELTDKPAFCFQGHPEASPGPHDIGYLFDRFTALMDAAKQRNA

SEQ ID NO: 75766 - protein, 313 aa, Vitis vinifera
MEAFEKLEKVGEGTYGKVYRARERATGKIVALKKTRLHEDDEGVPPTTLREVSLLRMLSRDPHVVRLMDVKQSLNKEGKTVLYLVFEYMDTDLKKYIRSFRQTGENIPTKTIKSLMYQLCKGVAFCHGHGVLHRDLKPHNLLMDRKTMMLKIADLGLARAFTLPIKKYTHEILTLWYRAPEVLLGSTHYSTAVDMWSVGCIFAELITKQALFPGDSELQQLLHIFKLLGTPNEEMWPGVTKLPNWHEFPQWSPNQNPKNSSSAFPNLSAAVPNLDEDGLDLLSKMLKYDPSERISAKKAMEHPYFDDLDKDYL

SEQ ID NO: 75767 - protein, 338 aa, Glycine max
  misc_feature (178)..(178): Xaa can be any naturally occurring amino acid
  misc_feature (312)..(312): Xaa can be any naturally occurring amino acid
NITEGSIWPMLAQESLKALGGLGLLSLGAKYILRRVFEVVADTRSSEAFVALCLLTVAGTSLVTQNLGFSDTLGAFLAGAILAETNFRTQIEADIRPFRGLLLGLFFLTTGTSIDMQLLLREWPNVLSLLGGLIVIKTLIITAIGPRVGLTLKESVRIGLLLSQGGEFGFVVFSLANXAWGVLPLELNKLLIIVVVLSMALTPFLNEAGRRAASFIEENFDPENKQNVSETVNFNISEPVVILGFGQMGQVLANFLSNPLASGGDSDEVGWPYVAFDLDPSVVKAARKIGFPVLYGDGSRPDVLHSAGVSSXKAFMIMYTGKKKTIEACQRLKLNFLQ

SEQ ID NO: 75768 - protein, 272 aa, Vitis vinifera
MAEHLASIFGTEKDRVNCPFYFKIGACRHGDRCSRLHNRPTISPTLLLSNMYQRPDMITPGVDAQGQPIDPRKIQEHFEDFYEDIFEELGKFGEIESLNVCDNLADHMIGNVYVQFKEEEQAAAALQALQGRFYSGRPIIADFSPVTDFREATCRQFEENNCNRGGYCNFMHVKLIGRDLRRKLFGRYSGYGRSRSRSRSLSPRYRRDSDRRRSGDRGDYRGNGRRSGDKHGSDGGRRRHGSPRRSRSPVREGSEERRARIELWNREREERQ

SEQ ID NO: 75769 - protein, 484 aa, Ralstonia solanacearum GMI1000
MFESQLLIGGKQRAAAGGATCERPNPATGDVASRAAAASLADADAAVQAAHAAFPAWAAMLPGERRRLLLKAADVMERRADDFIARGVAEAGGVPGWYGFNAALAAGMLREAAAMTTQVGGEVIPSDVPGSLAMGLRQPCGVVLGIAPWNAPLILGTRAIAMPLACGNTVVLKASEICPALHSLIGAVFEEAGFPAGVVNVITNAPADAPAIVERLIAHPAVRRVNFTGSTRVGRLIAEQAARHLKPVLLELGGKNPLVILDDADLDAAVQAAAFGAFFNQGQICMSTERIIVDRAIADRFVERLTDKAGALRAGRPGQDGAVLGGMVDASAAQRIRHLVDDAVGKGARLRTGALRIDGNIVQPAVVDGVTPAMALYGEESFGPVVAVLRAADDEDAIRLANDSEYGLSAAVFSRDIARAMQVARRIESGICHINGPTVHDEAQMPFGGVKASGYGRFGGKAAIDAFTELRWITVQAGARHYPI

SEQ ID NO: 75770 - protein, 370 aa, Brassica napus
MGHLLDPKNMNEINGDDETELGLRAVRLANYITFPMVFKAAIELGVIDALYLAARDDVNGSGSFLKPSEIATRLPTPPSNPEAPVLLDRMLRLLASYSMVKCQIVDGERVYKAEPICKYFLRYNIEEMGTLASQFILELDSVFLNTWAQLKDVVLEGGDAFARANGGLKLFDYMGTDERLSKLFNRTGFSVGVMQKFLEVYKGFEGINVLVDVGGGVGNTLGFVTSKYPNIKGINFDLTCALAQAPSYPNVEHVAGDMFVEIPRGDAIILKRMLHDWNDEDCAKILKNCWKALPENGKVIIMELVIPDEAESKDVQANIAFDMDLLMLTQLSGGKERTKAEYEAMAANSGFASCKFVCPAYHLWVIEFSK

SEQ ID NO: 75771 - protein, 139 aa, Glycine max
MATNHEPVLGYVVLYVKDVAESVAFYAKAFGYSVRRLDESHRWGELETGNTTIAFTPIHQHETDDLTGAVHNPGSCRERPPMEVCFVYSDVDAAYKHAVENGAVAVSEPELKEWGQKVGYVRDIDGNVVRMGSHVNPPK

SEQ ID NO: 75772 - protein, 384 aa, Burkholderia mallei ATCC 23344
MPTTPTLLSRLPEVGTTIFTVMSALAAEKGAVNLGQGFPDFDCDPRIVDAVAHAMRDGRNQYPPMAGVAPLREAIADKIERLYGRRYDAATEITVTAGATQALLTAILCAVHPGDEVIVIEPTYDSYLPSIELAGATPVFVTLNAPDYAIPFDKLAAAITPKTRAILINTPHNPTGTVWREADMRALEDIVRGTGLLIVSDEVYEHMVYDGARHESVARYPELAARSIIVSSFGKTFHVTGWKIGYVAAPAPLTAEFRKVHQFNVFTVNTPMQFGLADYLRDPEPYLTLPAFYQQKRNFFRAGLANTRFALLPCAGTYFQCVDYSAISDLPEAEFAKWLTTEIGVAAIPVSAFYHEPHESGVVRFCFAKREDTLATALERLARL

SEQ ID NO: 75773 - protein, 432 aa, Enterococcus faecalis
MSIITDIYAREVLDSRGNPTIEVEVYTESGAFGRGMVPSGASTGEYEAVELRDGDKARYLGKGVTKAVDNVNNIIAEAIIGYDVRDQMAIDKAMIDLDGTPNKGKLGANAILGVSIAVARAAADYLEVPLYHYLGGFNTKVLPTPMMNIINGGSHADNSIDFQEFMIMPVGAPTFKEALRMGAEVYHALASILKGRGLATSVGDEGGFAPNLGSNEEGFEVIIEAIEKAGYVPGKDVVLAMDAASSEFYDKEKGGYVLADSGEGENTTVDMIAFYVVLVSIYPIISIEDGLDENDWDGFKILTEVLGDKVQLVGDDLFVTNTTKLAEGIEKGIANSILIKVNQIGTLTETFEAIEMAKEAGYTAVVSHRSGETEDSTISDIAVATNAGQIKTGSLSRTDRIAKYNQLLRIEDQLGDVAEYKGLKSFYNLKNK

SEQ ID NO: 75774 - protein, 318 aa, Corynebacterium glutamicum ATCC 13032
MIGAPPDMGNVYNNITETIGHTPLVKLNKLTEGLDATVLVKLESFNPANSVKDRIGLAIVEDAEKSGALKPGGTIVEATSGNTGIALAMVGAARGYNVVLTMPETMSNERRVLLRAYGAEIVLTPGAAGMQGAKDKADEIVAERENAVLARQFENEANPRVHRDTTAKEILEDTDGNVDIFVASFGTGGTVTGVGQVLKENNADVQVYTVEPEASPLLTAGKAGPHKIQGIGANFIPEVLDRKVLDDVLTVSNEDAIAFSRKLATEEGILGGISTGANIKAALDLAAKPENAGKTIVTVVTDFGERYVSTVLYEDIRD

SEQ ID NO: 75775 - protein, 182 aa, Corynebacterium glutamicum ATCC 13032
MIREDLANAREHDPAARGDLENAVVYSGLHAIWAHRVANSWWKSGFRGPARVLAQFTRFLTGIEIHPGATIGRRFFIDHGMGIVIGETAEIGEGVMLYHGVTLGGQVLTQTKRHPTLCDNVTVGAGAKILGPITIGEGSAIGANAVVTKDVPAEHIAVGIPAVARPRGKTEKIKLVDPDYYI

SEQ ID NO: 75776 - protein, 260 aa, Vitis vinifera
MMEEYDRLALSGIGLKTARLRLFLFPSDDGSRASSISSLLDGSSKRENWFFDAINGGGLERGRSEASSIVSEVPDYLFGLDNSDDIQALPRESKLKTRTALAENVSVSDPGSPAPAITSPFCSTSSGPSVPAIPDLPPVKTKPDKSIPPVEVKDNPPEGFADVIEPAIPQSGGYAGNPMWHYNNPDSHYPGQPVHQIPVYYVPGPVPPGNMPVQSVPVRAQYVPQYPGPPGQIPVGFRHPGPGMGQVYGQWVQWRVTTCQ

SEQ ID NO: 75777 - protein, 464 aa, Escherichia coli
MSKQQIGVVGMAVMGRNLALNIESRGYTVSIFNRSREKTEEVVAENPDKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCITYIGADGAGHYVKMVHNGIEYGDMQLIAEAYSLLKGGLNLSNEELATTFTEWNEGELSSYLIDITKDIFTKKDEEGKYLVDVILDEAANKGTGKWTSQSSLDLGEPLSLITESVFARYISSLKDQRIAASKVLSGPQAKLAGDKAEFVEKVRRALYLGKIVSYAQGFSQLRAASDEYNWDLNYGEIAKIFRAGCIIRAQFLQKITDAYAENKGIANLLLAPYFKNIADEYQQALRDVVAYAVQNGIPVPTFSAAVAYYDSYRSAVLPANLIQAQRDYFGAHTYKRTDKEGVFHT

SEQ ID NO: 75778 - protein, 276 aa, Debaryomyces hansenii CBS767
MAIGESRTELLHWLNSTLDLLYGKVENCGTGAAYCQLMDSIVGGIPMTKVKFNAQTEYDYIHNFKILQASFTKHKVNKTIDVERLVKCRLQDNLLLLQWFKKFWHENKDVNGVYDAASKRKVSGLYSNGSGFSVTPQERSRTSSESSLGSRRTTLPSRVPSTGRTSITPNTPTNTTNKLAQLNKELADTTHELSTVNEELLEYKILAESLETERNFYFNKLREIEILTENLKHLDESEFSKLSVNEFIEKVQSILYSTEEGFQSSNDQVDIDGESF

SEQ ID NO: 75779 - protein, 363 aa, Listeria monocytogenes EGD-e
MTKRILMLEDGNYFIGDAIGSEKETIGEVVFNTGMTGYQETITDPSYYGQIITFTYPLVGNYGVNRDDFESINPAVKGVVVREAAEFASNWRNQITLNEFLKEKGIPGIAGIDTRKLTKLIRKEGTLKGILAAETADKEELLHHLRSVRLPVDQVHEVSSAKAFASPGDGKRVVLVDYGVKSSILRELNKRNCYVTVVPYNTSAEEILAMHPDGVMLSNGPGDPKDVPEALEMIRGIQGKLPLFGICLGHQLFALANGADTFKLKFGHRGANHPVKELATGRVDFTAQNHGYAVEKDSLIGTDLKVTHIELNDETVEGLAHKEYPAYTVQYHPEANPGPSDVNYLFDEFMEMMNGKEEGELHA

SEQ ID NO: 75780 - protein, 599 aa, Bradyrhizobium sp. ORS278
MRATDISAPDYFHKVVDCQWACPAHTPVPEYIRLIAEGRYSDAYMINWKSNVFPGILGRTCDRPCEPACRRGRVEESPVAICRLKRVAADFKDDVQQRMPRPVAKNGCRIALVGGGPASLTVARDLAPLGYHCTVFDADPKPGGMMRSQIPKFRLPDSVIDEETGYVLSLGVDYKAGHRIDSLKALLSDNYDAVFIGSGAPRGRELNIPGRKEAAGNIHLGIDWLSSVSFGHTDKIGKRVIVLGGGNTAMDCCRTARRLGGEDVKVIVRSGFEEMKASPWEKEDALHEDIPILNYLVPVAFKHDNGTLTGVTFQKVKAEYDDKGRRSLVPSGEPDVTYDCDDVLVAVGQENAFPWIEADCGITFDKWHMPVVDPKTFVSTNPKVFFGGDAAFGPKNIIWAVAQGHEAALSIHRLLSGEDVTERPLPEVHVSSQKMGIHEWSYDNDISPEKRFKVPHRDKVVALKDIRTEVELGYDVKLALGEAHRCLNCDVQTVFSNTLCIECDACADICPMDCITFTENGEEADLRSRLKAPSVHPDQSLYVSSDLKTGRVMVKDEDVCLHCGLCAERCPTGAWDMQKYFIETTHAGTACPSKRRSAA

SEQ ID NO: 75781 - protein, 401 aa, Klebsiella pneumoniae subsp. pneumoniae MGH 78578
MNAFNPAHFRAQFPALADAGVYLDSAATALKPLAVIDASDQFYRLSAGNVHRSQFAAAQRLTERYEAARDRVAAWLNAPSGKDIVWTRGTTEAINMVAQSYVRPRLQPGDEIIVSEAEHHANLVPWLMVAGQTGARVVKLPLGADRLPDIASLSALITPRSRVLAIGQMSNVTGGCPDLAQAIRLAHAAGMVVMVDGAQGAVHFPADVQALDIDFYAFSGHKLYGPTGIGALYGKSELLAAMSPWLGGGKMIAEVSFDGFTPQPAPYGLEAGTPNVSGVIGLSAALEWLAQSDIGQAENWSRSLASLAEEELAKRPGFRSFRCQQSSLLAFEFEGIHHSDLVTLLAESGIALRAGQHCAQPLLAALGVSGTLRASFAPYNTQDDVAALVHAVDRALEILVD

SEQ ID NO: 75782 - protein, 273 aa, Klebsiella pneumoniae subsp. pneumoniae MGH 78578
MSVVISDAWRQRFGGTARLYGEKALQCFADAHVCVVGIGGVGSWAAEALARTGIGAITLIDMDDVCVTNTNRQIHALSGNVGLAKAEVMAERIRLINPECRVTVVDDFVTPENVAEYLGVGFSYVIDAIDSVRPKAALIAWCRRYKVPLVTTGGAGGQIDPTQIQVADLAKTIQDPLAAKLRERLKSQFGVVKNSKGKLGVDCVFSTEALVYPQADGSVCAMKSTAEGPKRMDCASGFGAATMVTATFGFVAVSHALKKMLAKAQRDAAASGK

SEQ ID NO: 75783 - protein, 492 aa, Ralstonia solanacearum GMI1000
MNAPQAMRFLDDAQWDGLLFQGRWVPPLRRRTADVMEPATGRKLTRVGLADAQDVDAAVEAAAAAQPAWVAMPPRERANVFRRAAMLFEQHFDELALAIARETGAALFKGEHEVREAITLCHVAAGMPLEAQGQVLASPAGRLSYARRAPFGVVGVISPFNFPLFLTLRSVAPALAAGNAVVIKPDLRTPVSGGYVIARVFAEAGLPAGLLHVLPGGAEAGEALVVHPRVPMIAFTGSPGVGRRIGELAGRHLKKVSLELGGANALIILDDADLDLAVSNAAWGAWLHQGQICMAANRILVHASLADALTARLVEKAEHLPVGDGASGQVALGPLIDQKQLQRVHAIVQDSVAAGARLLAGGSYEQLFYRPTVLAGVRPGMRVFDEEVFGPVANIIVFRDDDEAVALANDSQGGLAAGVISASVGRAMALGQRLRVGMVHINDQTVNDDCVNPFGGPGIAGNGTSMGGPADWEEYTQWRWVTVKESAPRYPF

SEQ ID NO: 75784 - protein, 310 aa, Ralstonia solanacearum GMI1000
MLDIQMQSLLQGMQQAGVPDMADLPPPAARQVYSRIMAAAAEPVRAVSIAERTIAGPGGDLALRIYAPQRPDPRRGVALYLHGGGFVVGTPRDYDSVASALCERSGCVVVQVDYRLAPEHPFPAAVEDAWAAACWVAAHARELGAQPRIAVVGDSAGGNLAAVLARLARDCEGPAIVQQTLIYPMVAARPETTASYLRYGTGYTLTTRLTHYFHDLYLNGRPAEGDPRLVPLSAPDASGLPPALVMVAGYDVLRDEGIQYAHRLAQAGTPVTLVEYSGMVHGFIGMAGALEAARQALAQVADAVGRALAG

SEQ ID NO: 75785 - protein, 116 aa, Fagopyrum esculentum
MAEEAQVIACHTVQEWNEKFQKAKDSGKLIVIDFTASWCGPCRVITPYVSELAKKFPHVAFFKVDVDDLKDVAEEYKVEAMPSFVILKEGQEVERIVGARKDELLHKIAVHAPITA

SEQ ID NO: 75786 - protein, 254 aa, Phaseolus vulgaris var. nanus
  misc_feature (254)..(254): Xaa can be any naturally occurring amino acid
MGRKFFVGGNWKCNGTTEEVKKIVTTLNEAKVPGEDVVEVVVSPPFVFIPTVKTLLRPDFHVAAQNCWVRKGGAYTGEVSAEMLVNLGVPWVIIGHSERRQILQETNEFVGDKVAYALSQGLKVIACIGETLEQREAGTTAAVVAEQTKAIAAKVSNWDNVVLAYEPVWAIGTGKVATPAQAQEVHVDLRKWVHDNVSAEVAASVRIIYGGSVNGGNCKELAGQADVDGFLVGGASLKAEFVDIINSATVKKNX

SEQ ID NO: 75787 - protein, 336 aa, Mycoplasma bovis
MKRVAINGFGRIGRLALRYLLDTNNKEVEIVAVNDLTEPKMLAHLLKYDTAFGPLKADVVVKDNAFVVNGKEIKVLSEKDPALLPWKELNIDIVLECTGFFVKKDLAHKHIEAGAKKVIVSAPAGKDVKTIVYGVNHETLVAEDEIISGASCTTNCLAPVVKVLVDNFGIENGFMTTVHSFTGDQMLQDGPHRKGDLRRARAAGHNIVPSSTGAAKAIGLVVPEANGKLDGFALRVPTITGSFVDLSVQLTRQPTVEEVNAAFEKSASLALKYETDPIVSSDVIGSYYGSTFDSTLTKIKESNGHRIYKIFAWYDNEMSYTAQLIRTLTYFAKLTK

SEQ ID NO: 75788 - protein, 498 aa, Rheum australe
MASRKMLIDGDANQTNENDQADYDFDLFVIGAGSGGVRAARFSANFGAKVGICELPFHPISSEVIGGVGGTCVIRGCVPKKILVYGATLGGEIEDARNYGWELNEKIDFNWKKLLHKKTEEIVRLNGIYKRLLSGAGVKFFEGEGKVVGPNEVHVIQTDGTKLSYTAKHILVATGSRAQRPNIPGKELAITSDEALSLEEFPKRAVILGGGYIAVEFASIWCGMGATVDLFFRKELPLRGFDNEMRAVVARNLEGRGINLHAQTNLTEIVKTDGGLKVYTDHGEEFVADVVMFATGRIPNSSRLNLEAVGVELDKSGAVKVDEYSHTSVPSIWAIGDVTNRMNLTPVALMEGTCFAKTVFEGKPTKPDYSHIPCAVFSIPPLSIVGLSEEQAVDQANGDTLVFTSTFNPMKNTISGRQEKSVMKLVVDAETDKVLGASMCGPDAPEIMQGIAIALKCGATKAQFDSTVGIHPSAAEEFVTMRSVTRRVAPAKKVRTNL

SEQ ID NO: 75789 - protein, 283 aa, Oryza sativa Japonica Group
MVVRAGAYDDELIKTAGDLGDGRVERDVREEAGVDRNRQAYRTLLVTAPGLGQYISGAILFEETLYQSTVDGRRIVDVLAEQGIVPGINVDKGLVPLAGSDPESLEDGLVPIVEPEILLDGEHRVERTFEVAQKVWADTFFHMSENNVMLEGILLKPSMVTPGAESKDGAATPEQVAAASRRRCPASCSSPAASRRWRRRGNLNAMNQAAPSANPWRWRVSFSYARALQNTCLKTWGSRRENVAAAQGELAGAARQVHQRRRGRRGQRGHVRQELHLLKIIFD

SEQ ID NO: 75790 - protein, 192 aa, Aquifex aeolicus VF5
MADTLGKSELEVIKPQKREIRKGQVRKHIITVKVRNEMGVLARIATLIAGKGYNIEGLSVGETHEKGISRMTIEVIGDDIVIEQVVKQLRRLIDTLKVSDLTDVPHVERELALIKVYTPSSRARDEVLRITEIFRGKVVDVSPDTYTIEVTGDEDKINAMIELLKPFGIKEMARTGKVAMRREMSIKEEENE

SEQ ID NO: 75791 - protein, 954 aa, Oryza sativa Japonica Group
MEAEHPHQITYTTTTTTSTSSLCPRRRKRGDDEAAHHLVFPMDLDSAAAAAAAAAHHQQQQQQTTSQDKLKALAYEYGHEFRVFSSVTFESMTSNLPAADQEEDDDFYELQPADYFNLVSNRIGALSKTMKLTAEQSKVLKTRKMREAELAAQRAKIKKSQDKLKALAYEYGHEFRVFSSVTFESMTSNLPAADQEEDDDFYELQPADYFNLVSNRIGALSKTMKLTAEQSKVLKTRKMREAELAAQRAKIKKAVMRVRFPDGYILEADFHPSETVQSLMDFLKKVISRPDLPFYLYTVPPKKRIKDTSLDFYTIGFVPGANVYFSYDLPEGSELNTDSVKSGPYLREEIRMLDGLPIVQEPVHQPIDSTMNSSSAHQSDVSQSDFAPPANKKPAKPKWFKRVLEGDDERSSHRDQEKEVCKASLKSLISEDRLDCKMCADFAVIISEIRSIFRLSSFDVTRKEEGEERKLVGCTAICVLEPGNGEARTHQISPCICPAITLEFFTVGGTEHAGWKGILLKEEEHQPIYHVRRIFTKGFIQSGEVHIFGYARSNLSDDGLRERIRGYLKGASEEHLSDFLQHIKYVSGSYDSGEGFEKLNKEISEYEKSNKSESPRRLFYLALPPSVYPSVCKMIRTYCMNPSGWTRVIVEKPFGKDLDSAEELSAQLGELFDENQLYRIDHYLGKELVQNLLVLRFANRLFLPLWNRDNIDNIQVFCLVAMEKPVSLKPEHIRDEKVKVLQSVNPIKHDEVVLGQYEGYKDDPTVPDDSNTPTFASVVLRVHNERWEGVPFILKAGKALSSRKAEVRVQFKDVPGDIFKCKRQGRNEFVIRLQPSEAMYMKLTVKKPGLEMATEQSELDLSYGMRYQNVKIPEAYERLILDTIRGDQQHFVRRDELKAAWQIFTPLLHDIDEGKVKSIPYQPGSRGPKEADELSERVGYMQTHGYIWIPPTLA

SEQ ID NO: 75792 - protein, 354 aa, Oryza sativa Japonica Group
MENGGGDVPENANDHCPGTQSEAAGKADACAGCPNQQICATAPKGPDPGAITRAITHLLAIIERMNTVKHKILVLSGKGGVGKSTFSAQLSFALAEMDHQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQIAGIDGAIIVTTPQQVSLIDVKKEINFCKKVGVPVLGVVENMSGLRQAFSDMKFVKPSEAGETDATEWALNYIKEKAPELLSVVACSEVFDSSKGGAEKMCQEMEVPFLGKVPMDPQLCKAAEEGRSCFTDQKCSASAPALKSIIKKLVKTK

SEQ ID NO: 75793 - protein, 404 aa, Yersinia pestis CO92
MSPIEKSSKLDNVCYDIRGPVLKEAKRLEEEGNKVLKLNIGNPAPFGFDAPDEILVDVIRNLPTAQGYCDSKGLFSARKAIMQHYQARNIRDLTVEDIYIGNGVSELIVQSMQALLNLGDEMLVPAPDYPLWTAAVSLSSGKAIHYMCDEESGWFPDLDDIRSKITPRTRGIVIINPNNPTGAVYSKELLLEIVEIARQNDLIIFADEIYDKILYDDAQHHSIAALAPDLLTVTFNGLSKTYRVAGFRQGWMVLNGPKKHAKGYIEGLEMLASMRLCANVPMQHAIQTALGGYQSISEFIQPGGRLYEQRDRAWELINQIPGVSCVKPQGALYMFPRIDQKRFNLKDDQKLVLDLLLQEKVLLVQGSAFNWPYPDHVRIVTLPRVDELEMAVRKLGRFLETYHQ

SEQ ID NO: 75794 - protein, 1233 aa, Coccidioides immitis RS
MNTFTLPDISTLPALRPSDCNQILDTLFEPSKHLHSLTESLLLQQKCISYEALIDLVRARLISLASSKAPDDRTVLLDILGSHPRLGEKAPASRSAESEASKGQEERPLSEFSKAEQANLSMAGQHGTAQHLSLLNREYEEKFPGLRYVTFVNGRGRDMIMEEMRRRIERGDIELEILETIQSTCYDDPGLQQESGSGKAKKSGNSSTTLSRCSPWQQTIKNGISHSVDYGLFVTLTEVWIRNAFVRIIYGTQAAASAALSWNHYSCMMAAETYTRPANGVVAPLHPGPNRAASQSIANETNTPVSEKRRVKGGDANGSLAHGNQQPPVRQGSSDWPSNEHSLPATPVLTRNSTTKSASKGAIGSTALLQQRHHYSSSSTSIPTHATFQHTPIDPLSQQILKRTNTEKSISSKLRTQAAIDVEPGPSDAARALTQEESSSANRPDSNLIQKSSKEKKKGVSFLSRIIGNKKRTDISESNDDVSELGENRAAGMDAEVFAQPIGYIPRFPPPPKYIKVRAQHKKTKDFNRLFVAQELSGNAAQANGSSTNKHATINVFESDAAAQEGRAIWTTEFSKDGKYFAAAGQDRKVRVWAVIGTPEDRQAHEIEEEARNDQPLMRLSAPVFKTQPVQEYEGHTASIVDLSWSKNNFLLSTSLDKTVRLWHVTRRECLCCFNHSDVVTSIEFHPRDDRFFLAGSLDSKLRLWSIPDKNVAFTAVAPDLITAVAFTPDGKHSIAGCLNGQCVIFETDGLKVVSQIHVRSARGRNAKGSKITGIDTILQPPGNDSGIVKILITSNDSRIRLYNFRDRTLEAKFRGNENSASQIRASFSSDGRYIICGSEDRRVYIWPVVCNERFPEKRPVESFEAHSSMATTAVMAPLQTKQTLGSTGDLLYDLCNPPPVTLVGQTASAASRSVTENGGNEFRPGTPRVPPSSNPQKPEESPSHTTRSSHPGGNIIVAADYSGVIKVFRQDCGYHRRRHESWDSSSLFSKRLLGRNNSVSSARRSILSIGKDSLHKSPSERILSWRNSVIGARDNGSFDNVRTLGSRTRSVSPDRPLRKSNSAPKADTSQAIKNLTKRGVISKPAGLTKMTLNHPFTGAVSPEVISDKREIVASPEEYEDSDTKYAPADPLFMAGEQSYTFWNKSQFASLAANRRRSSISNDVEAQQDQANLTSEGSSDEKGFENGMDAEALGEEEEEELSCPQCRATNFRAVRTKTGEQRLKCVLCGAFAS

SEQ ID NO: 75795 - protein, 421 aa, Ehrlichia ruminantium str. Welgevonden
MLPNITQLSNSFTIITDTMPYVESVSINIWVNVGSRHENTNIAGISHFLEHMAFKGTKTRTALDIAQIFDNIGGNFNAHTDREHTVYHVKILKRDIKIAIEVLADIILNSQFPQEEIDREKGVVLQEIYQTNDSPTSIIFDKYIEAAYPNQVFGKSILGTPESVSNLSKENLHTYMQEHYHAGNMLLSVAGNITHNEVIDLATQYFSQIKKSTPQETNKSVYISGEYREERDLEQVHIVIGFPSSSYKDDQFYVIQILDSILGNGMSSRLFQKIREQLGLVYSISSFNSSYSDNGIFSIYTATDKNNLPQLLDAIAAEVQGIYINLEENEVIRAKDKLTSEILMSRESTTARAESLGYYYSHYNRYITKEELLKKISEITMEDILNCISRLLRSNNKITLAAIGQIETLPSYNDICQMFHI

SEQ ID NO: 75796 - protein, 280 aa, Prochlorococcus marinus str. MIT 9313
MPIRVAFLGPEGTYGQQAAQALAELEGLANFELVPCIGLRSVVEHVATKRSEMAVVPVENSVEGGVTASLDALWSHPQLCILRAVVLPIRHALLSSGGFKDISEVLSHPQALAQCSGWLADHLPDALQLPTSSTAEAASMVIDSRFRAAIASRPTGQGRGLKELAFPINDVAGNRTRFLLLRQGTPLQRGDVASFAFSLHANAPGSLLEALTCVARLGFNMSRIESRPSKRELGEYVFFVDVELRDGGIGASEQLIEALQPLCEHLVHFGSYLSSDLELD

SEQ ID NO: 75797 - protein, 366 aa, Brassica napus
STTRPERSSIQKWLDAGHKTCPKSQETLLHSGLTPNYVLKSLIALWCESNGIELPQNQGSSYRTTRPGGGSSSSDCDRAFVLALLEKLANGSTEHQRAAAGELRLLAKRNADNRVCIAEAGAIPLLVELLSSPDPRTQEHSVTALLNLSINEGNKGAIVDAGAITDIVEVLKNGSMEARENAAATLFSLSVVDENKVAIGAAGAIQALISLLEEGTRRGKKDAATAIFNLCIYQGNKSRAIKGGIVDPLTRLLKDAGGGMVDEALAILAILSTNQEGKAAIAEADTIPVLVEIIRTGSPRNRENAAAILWYLCIGNMERLNVAREVGADVALKELTENGTDRAKRKAASLLEIIQQLEGVAISTVP

SEQ ID NO: 75798 - protein, 507 aa, Bradyrhizobium sp. ORS278
MTPLHPHQPPHQKPDACAFVIFGVTGDLTHRLVLPSLYNLAAGNLLPDRFCIVGIARKGMSSDQLRVNLMEGLRKYATRPVEDEIAQRLLQCVTAIEADPKEPDSFDELKERLEKLETARETHGNRLFYLATPPAAFAPIAQQLGRVGLLKEDGKAWRRLVVEKPFGTDLASAKKLNDQLLELVTEHQIYRIDHYLGKETVQNILVLRFANGMFEPIWNRHHIDHVQITVEEKLGVGTRGSFYDATGALRDMVPNHLFQLLSLVAMEPPARFDAHTVRSEKAEVLSAIQPLTEKEALLNSVRGQYKAGIVGDTEVTGYRETKDVNPDSATETYAALKLTIDNWRWAGVPFYLRTGKALGAKRTEVAIKFRQAPFAMFSCTPIDTLAENYLVIGIEPTQSITLQFNTKIPGPTIRTDGVQMKFNYKDYFQAEPATGYETLIYDCMIGDNILFQRADSVEAGWKAVEPFIEAWKKAGRDGLHSYEAGSEGPKAAADLLARDGRSWRKLA

SEQ ID NO: 75799 - protein, 304 aa, Triticum aestivum
RGRSTALEQGGAPAAAAARAALAGPALLPALRFPASPASGRQRLARSLLCSVPPSWRRIPCSRCQNLFATALGMSSSSTIEGKDGEFTEVVVVRHGETSWNASRIIQGHLDAELNEIGRQQAVAVAHRLSKEAKPAAIYSSDLKRAAETARTIAKICNLPNVVFDPALRERHIGDVQGLTLQDAVKEKPEAYKAFMSHKRNQQIPGGGESLDQLSERCVSCLYKIVEKHRGERVILVSHGGTIRELYRHASPVPLRGKIYNTSVTVVLVSGDTGRCIVKMCGDVSHLEATGVLENAFGGDKSSA

SEQ ID NO: 75800 - protein, 130 aa, Prochlorococcus marinus str. MIT 9313
MKLGLPTICTMGERPTYIGAVPIVLAMAVNAPSPTPGGAAVLEKQTERIRKQSPHYKVLLHNDPVNSMEYVVVTLQQVVPQLSEQDAMAVMLEAHNTGVGLVIVCDLEPAEFYCETLKAKGLTSTLEQES

SEQ ID NO: 75801 - protein, 293 aa, Fulvimarina pelagi HTCC2506
MDNAETQARLLSEALPYMQAYENKSVVVKYGGHAMGDTELGRAFARDIALLKQSGVNPIVVHGGGPQIGRMLNQMGIESRFEGGLRVTDAETVRIVEMVLAGSINKEIVAMINAEGEWAIGLCGKDGNLVFAEKATKTMIDPDSNIEKVLDLGFVGEPVEVDRTLLDLLARSEMIPVIAPVAPGRDGATYNINADTFAGAIAGSLNASRLLFLTDVPGVLNKDKELIKELSVSEAKGLIRNGTISGGMIPKVETCIDALERGVEGVVILNGKTRHAVLLELLTEHGAGTLIVP

SEQ ID NO: 75802 - protein, 389 aa, Rhodospirillum rubrum ATCC 11170
MSTPSHTPKPPGATAVLALADGTLFWGRGVGALGEVVGEVCFNTAMTGYQEVMTDPSYAGQIVTFCFPHIGNVGTNAEDIESTVPAARGCVLRADITEPANWRATGALNGWLAARGLVGISGVDTRQLTRRIRDLGAPSGVIAHAADGVFDIPALVAKAQGWPGLEGMDLAAEVTCTQTYAWDETLWSLDGGYGRLSDPRFHVVAIDYGAKRNILRNLASLGCKVTVVPAQTTLDEVMAHQPDGIFLSNGPGDPAATGTYAVPVIKQLIETGKPLFGICLGHQMLALALGATTYKMATGHRGANHPVKDHTTGKVEITSMNHGFAVDRASLPAGVTETHTSLFDNVLEGLAVDGKPVFSVQYHPEASPGPEDSHYLFKRFVDLMDARRV

SEQ ID NO: 75803 - protein, 644 aa, Zea mays
MISARTAAASPASLWKQGGRSEGGGSCDGCRTYRNTLRRAAAAKVRALPSRAVEAVKMGSAAEMEQEEAEVAAAAAGVVVEDHYGEDSATEELPILPWAFSVASGYTLLRDPHHNKGLAFMEKERDAHHLRGLLPPAVVPQELQIKKIMHNLRQYQVPLQRYMAMMDLQERNERLFYKLLIDNVEELLPVVYTPTVGEACQKYGSIFRQPQGLYVSLRDKGKVLEVLRNWPHRNIQVICVTDGERILGLGDLGSQGMGIPVGKLALYTALGGVRPSACLPITIDVGTNNEKLLNDEFYIGLRQKRATGEEYHELMEEFMAAVKQIYGEKVLIQFEDFANHNAFNLLAKYSKSHLVFNDDIQGTASVVLAGLLAALKVVGGTLAEHTYLFLGAGEAGTGIAELIALEISKQTSAPIEECRKKIWLVDSKGLIVDSRKNSVQSFKKPWAHEHEPLTTLYDAVQSIKPTVLIGTSGVGRTFTKEVVEAMASFNERPIIFSLSNPTSHSECTAEEAYNWTQGRAIFASGSPFDPVEYDGKVFVPGQSNNAYIFPGFGLGLVISGAIRVHEDMLLAASEALAAQATQENFDKGSIFPPFTNIRKISARIAAAVAAKAYELGLATRLPPPRDLVKYAQSCMYTPVYRNYR

SEQ ID NO: 75804 - protein, 263 aa, Glycine max
MIPEHYSDSSLFHSSLLTLFLIAPPTFFSLTFLQAPYGKHHRPGWGPNLPPPLAWLLMESPTLWLTLLLFPLGLHSHNPKAQALITPFLIHYFNRTILYPLHLLLTPSKKTTPGFPLSVALMAFAFNVLNSYLQARTVSHYNNHYDDSGFFWFRFLCGLLVFLLGMGINVWADRVLLRLKSEGKGYVVPRGGLFELVACPNYFGEIVEWLGWAVMTWSWAGLGFFVYTFANLGPRARANRRWYLEKFGEDYPKERKAVIPYLY

SEQ ID NO: 75805 - protein, 132 aa, Triticum aestivum
MAAAALRPAILRHIRLSPATAAPLAAAAAAGRPLALAPWLARPMSSHDAHLTRDEVVGRVLDVLKCHPKVDPSKVTPEAHFEKDLGLDSLDTVEVVMAIEEEFKLEIPDLEADKINSLPLAIEYAANHPMAG

SEQ ID NO: 75806 - protein, 171 aa, Triticum aestivum
MANPKVFFDMTVGGAPAGRIVMELYKDAVPRTVENFRALCTGEKGVGKSGKPLHYKGSAFHRVIPDFMCQGGDFTRGNGTGGESIYGEKFADEKFVHKHTKPGILSMANAGPNTNGSQFFICTVPCNWLDGKHVVFGEVVEGMDVVKNIEKVGSRSGTTAKQVVIADCGQL

SEQ ID NO: 75807 - protein, 421 aa, Zea mays
  misc_feature (397)..(397): Xaa can be any naturally occurring amino acid
MTDGSDEYKRDESVILLVIVSLAALSLLSLIAAFAYYCYITRKVSRRLQSLHLPKRSSSPPPPPPPRALPPPQQQGKDSPFSSSASDGAAAAAAAMSVVVAGERGVQVFSYRQLHAAMGGFGRAHMVGQGSFGTVYRGVLPDGRKVAVKLMDRPGKQGEEEFEMEVELLSRLRSPYLLGLIGHCSEGGHRLLVYEFMANGGLHEHLYPTRGSCGGISKLDWDTRMRIALEAAKGLEYLHERVNPPVIHRDFKSSNILLDKDFHARVSDFGLAKLGSDRAGGHVSTRVLGTQGYVAPEYALTGHLTTKSDVYSYGVVLLELLTGRVPVDMKRPPGEGVLVNWALPMLTDREKVVRILDPALEGQYSLKDAVQVAAIAAMCVQPEADYRPLMADVVQSXVPLVKNRSNQKACNPNVQSSKPLD

SEQ ID NO: 75808 - protein, 187 aa, Ralstonia solanacearum GMI1000
MSLINTQVQPFKAQAFHNGKFVEVTEQNLKGKWSVLIFMPAAFTFNCPTEVEDAADNYAEFQKAGAEVYIVTTDTHFSHKVWHETSPAVGKAQFPLVGDPTHVLTNAFGVHIPEEGLALRGTFVINPEGVVKTSEVHDNAIARDVKETLRKLKAAQYVASNPGQVCPAKWNEGAKTLKPSLDLVGKI

SEQ ID NO: 75809 - protein, 308 aa, Oryza sativa Japonica Group
MSARAAAGGGDGDGGGRRKTLAKVSLSSLSAAAAEAATFPIDAVKTRLELHRGTGGSGGGGGGVMRVAGELVRDGGIYRGLSPAVLRHLFYTPLRIVGYEHLRSTFASGGRDAGLLEKALAGGVSGVVAQVVASPADLIKVRMQADSRLLSQGIQPRYTGIFDAFTKIVRAEGFRGLWKGVVPNAQRAFLVNMGELTCYDQAKHFIIRKQICGDNLYAHTLASVASGLSATTLSCPADVIKTRMMNQGKDAKVLYRNSYDCLVKTVKHEGLTALWKGFLPTWARLGPWQFVFWVSYEKLRQASGISSF

SEQ ID NO: 75810 - protein, 366 aa, Triticum aestivum
  misc_feature (154)..(154): Xaa can be any naturally occurring amino acid
  misc_feature (357)..(357): Xaa can be any naturally occurring amino acid
MAPLAFLLLFGQILLCTAIDTINSTTPLSGSQKIVSQGSKFTLGFYSPPQGKTTTFRYYIAIWYSTVPLVTTVWTATTDVVVSDPTTASLEIAGDGNLVLRHIATNRQLWSTNLSIASNSTMAIIRDSGSLELTDASNSSMVYWQSIDHPTNTXLPGSKLGLNKTTGLSQKLVPWKNNVDPSPGLFSLELDPNGSTQYFIRWNESVNYWTSGLWDGNRFSHMPEMTADYVYDFQFVNNAKESYFYYSMKNDLVVSRFIIDVTGQIKQLSWLDSRQQWVLFWAQPRTQCEVYALCGAYGCCSLDALPYCNCVKGFSQKVQSDWDLQDYSGGCKRNTPLQCQTNSTSAQTPSDKFHLMXDVRLPDNAQ

SEQ ID NO: 75811 - protein, 448 aa, Oryza sativa
  misc_feature (10)..(10): Xaa can be any naturally occurring amino acid
  misc_feature (37)..(37): Xaa can be any naturally occurring amino acid
  misc_feature (78)..(78): Xaa can be any naturally occurring amino acid
MAATIVSVKXARQIFDSRGNPTVEVDVCCSDGTFARXAAVPSGASTGVYEALELRDGGSDYLGKGVSKAVDNVNSVIXPALIGKDPTSQAELDNFMVQQLDGTKNEWGWCKQKLGANAILAVSLAICKAGAIIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIAELAVGLATGQIKTGAPCRSERLAKYNQLLRIEEELGAAAVYAGAKFRAPVEPY

SEQ ID NO: 75812 - protein, 290 aa, Triticum aestivum
HEDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 75813 - protein, 475 aa, Burkholderia mallei ATCC 23344
MNIHPVILCGGSGSRLWPMSRGGYPKQYLKLAGDRSLVQQTALRLRNIPDTTAPIVVTNNEQRFLVAEQLRQVDITPSSIVLEPVGRNTAPAIAIAALLAMHDSPEALLLVLPSDHVILNEPAFITAAREAAAIAADKHLVTFGITPTQAHTGFGYIRRGPLLADGGQAFKVDAFVEKPDASTAERFVRDSGYYWNSGMFMLKAATYMEELHRHAPEIARQAEFALASAKRDHDFLRLDADAFFACPNVSIDYAVMERTERAAVIATADLGWSDIGSWSALADIADTDAQGNALVGDVFTDSVKNSYIRAEHRMIAALGLDDIVIVETADAVLVAHRDKAQDVRKIVEWLNASGRHESVTHRRVVRPWGSYEGIDQGERFQVKRIVVNPGAQLSLQMHHHRAEHWIVVKGTALVTNDGKKIILTENQSTYIPLGATHRLTNPGKIPLELIEVQSGSYLGEDDIVRFEDTYGRTST

SEQ ID NO: 75814 - protein, 717 aa, Yersinia pestis CO92
MSRTIMLIPTGTSVGLTSVSLGVIRSMEQKGVSLSVFKPIAQPRAGNDAPDQTTTIIRANSSITAAEPLNMNYVETLLSSNQQDVLMEEIVARYHENTKDAEVVLVEGLVPTRKHQFANALNYEIAKTLNAEIVFVIALGNDSPDQLKERIELARSSFGGSKNKNITGVIINKLNAPVDEQGRTRPDLSEIFDDSTKASVANIDPSQLFANSPIPVLGCVPWSFELIATRAIDMAKHLNARIINEGDIKTRRVKSVTFCARSIPHMLEHFRPGSLLVTSADRPDVLVSACLAAMNGVEIGAILLTGGYAIDDRINNLCERAFQTGLPVFMVDTNTWQTSLSLQSFNLEVPADDHERVEKLQNYVASHISSEWIDSLTAASERPRRLSPPAFRYELTELARKAGKRIVLPEGDEPRTIKAASICAERGIATCVLLGNPEEIQRVATSQGVELGKGVEIIDPVAVREQYVPRLVELRKSKGMTEVVAREQLEDNVVLGTLMLEKGEVDGLVSGAVHTTANTIRPPLQLIKTAPGSSLVSSVFFMLLPDQVLVYGDCAINPDPTAEQLSEIAIQSADSAAAFGIEPRVAMISYSTGNSGAGSDVEKVREATRLAQEKRPDLIIDGPLQYDAAIMADVAKSKAPNSPVAGRATVFIFPDLNTGNTTYKAVQRSADLISIGPMLQGMRKPVNDLSRGALVDDIVYTVALTAIQSAQADSAAS

SEQ ID NO: 75815 - protein, 685 aa, Glycine max
QLLLSERAQTSHLTLIARSLLSQNKFDRCFTRPSTFLIQTYIFVVISFSAYPNSSQRFTKSFQTLCFSMATSPKETSAPGSPSVPSSPSSTKAPSNQERPEFNIQPIQMIPGQAPVPEKLVPKRQQGVKISENPSLATSPREVDTEMDKKIRTIVSNILKDVSVPDADKDVPTSSTPNVSVPDAEKDVPTSSTPNAEVLSSPSKEDSTEEEDQATEETPAPRAPEPAPGDLIDLEEVESDEEPIANKLAPGIAERLQSRKGKTPIKRSGRIKTMAQKKSTPITPTTSRRSKVAIPSKKRKEISSSDSDDDVELDVPDIKRAKTSGKKVPGNVPDAPLDNISFHSIDNVERWKFVYQRRLALERELGRDALDCKEIMDLIKAAGLLKTVTKLGDCYESLVREFIVNIPSDITNRKSDEYQKVFVRGKCVRFSPAVINKYLGRPTDGVVDITVSEHQIAKEITAKQVQHWPKKGKLSAGKLSVKYAILHRIGAANWVPTNHTSTVATGLGKFLYAVGTKSKFNFGNYIFDQTVKHSESFAVKLPIAFPTVLCGIMLSQHPNILNYTDSVMKRESPLSLHYKLFEGTHVPDIVSTSGKAAASGAVSKDALIAELKDTCKVLEATIKATTEKKMELERLIKRLSDSGIDDGEAAEEEEEAAEEEEEAAEEEEDAAEDTESDDDDSEATP

SEQ ID NO: 75816 - protein, 368 aa, Nitrosomonas europaea ATCC 19718
MKTRAAVAWQAGQPLTIEEVDLAGPRTGEVLVEIKATGICHTDYYTLSGADPEGLFPAILGHEGAGIVVEVGADVKSLRPGDHVIPLYTPECRECKFCLSRKTNLCQAIRATQGRGLMPDGTSRFSLDGKAIMHYMGTSTFSNYIVVPEIALAKIREDAPFDKACYIGCGVTTGIGAVLFTAKVEVGANVAVFGLGGIGLNVIQGARMAGADKIIGIDLNPEREALGRQFGMTHFIDPSQVENVVDAVIQLTDGGADYSFECIGNTTVMRQALECTHKGWGRSIIIGVAKAGAEISTRPFQLVTGRKWEGSAFGGARGRSDVPRIVDWYMDGKISIDPLITHILKLEEINEGFKLMEAGESIRSVVVF

SEQ ID NO: 75817 - protein, 452 aa, Amycolatopsis balhimycina
MLHTFAAAVAPVAPIAAHSLLVFLLQIGLLLLLAVVLGRLAGRFGMPAVVGELFVGVILGPSLLGWAAPGLHSWLFPAVAEQYHLLDAVGQVGVLLLVGLTGVQMDMGLARKRGLTAAGVSIGGLVLPLGLGIGAGYLLPKVLVPEGTDVTVFAMFLGVALCVSAIPVIAKTLIDMKLLHRNIGQLTLTAGMVDDVFGWFMLSVVSAMAVNAVSAGTVLTSLAYLVAILAFCFTLGRPLARGVLRVAAKSDGPGLTVATVVVLIFLAAAGTQALGLEAVFGAFLCGILLGTAGKVDPAKLAPLRTVVLSGLAPLFFATAGLRMDLTALTHPVVLLTGLVVLALAIAGKFAGAFAGARLSGLNKWEGLALGAGLNARGVIQVVVAMVGLRLGILSVEVYTIIILVAIVTSLMASPILRFAMSRVEQTAEEQVRENEHRAWNTHPAANPQEQSL

SEQ ID NO: 75818 - protein, 176 aa, Triticum aestivum
HYRTSLYKKAGWYRSGIPGISSTHASARDAILSGKFDQVRINLPNGDMVGHTGDIEATVVACKAADEAVKMVLDAVEQVGGIYLVTADHGNAEDMVKRNKAGEPMLDKSGSIQILTSHTLQPVPVAIGGPGLHPGVRFRSDIQTPGLANVAATVMNLHGFQAPADYETTLIEVVDK

SEQ ID NO: 75819 - protein, 540 aa, Gloeobacter violaceus PCC 7421
MKKTTTLHPLRVARCRQSIAVLSALLVSCSFLPAPLFAAESGSKSDIRTAQSTKSVKLAADAPVAEVPIAFAPKSALGELHVDGGTVVFNTSTGTYAINGSIQPGVARGVSLGVPVEGLEDGEAPGVMVFDFLSIHLGPGVVVSVEGDGALILTSGDSAYLGATVDLKGGSGEAGAVDAGGGGGGGGGFHIFAGGDLQFAGSIDVGGGDGGTGAQVAGIPFGGGGGLARGGGSRGGKGSYAFAGGNGGNGGDGNPVLNRLGRKVGNLRGGGGGGGGGYSGLGGNGAAAGGAAGGNGAAGKCPAAAAGGVGGQGGRLGVVFGGKGGNGGAAPNGGVGGNGGNGSPNGGGGGGGGGGGDRCVRLPFFGPVPIPAKGGQGGRGGGGGSTGEPGTPQPKKAAAPQVRMALSSDEPPAMVGGGGGGGSVVLGSQTGLLTLSGTIRTEGGAGAEEAGSSGALTLIAAEGRLLIEPNASFNGSEPLAGGAEVTAQFPYSEYLPTGGGGGGGAGGPGQVIFYEEEPCPPGTATDGLIPICIIEGPVEF

SEQ ID NO: 75820 - protein, 291 aa, Mesembryanthemum crystallinum
MAKDFETGGGEVRDVAKDYQDPPPSPLFDMEELTKWSFYRALIAEFIATLLFLYITVLTVIGYKHQSDPLVSGADAGCGGVGILGIAWAFGGMIFILVYCTAGISGGHINPAVTFGLFLARKLSLIRAIMYMVAQCLGAICGVGFVKAFQSAYYNKYGGGANELSVGYSKGTGLAAEIIGTFVLVYTVFSATDPKRSARDSHVPVLAPLPIGFAVFMVHLATIPITGTGINPARSLGAAVIYNNNKAWDDQWIFWVGPFIGAAIAAIYHQYILRAGFIKALGSFRSSTSNV

SEQ ID NO: 75821 - protein, 145 aa, Listeria monocytogenes EGD-e
MDESKKNERLQQLTDIQYNVTQKAGTERPFQNEFYDNEVKGIYVDIVSGKPLFSSNDQYDAGCGWPSFTKPIDEAEVIEHRDLTHGMIRTEVKSADADSHLGHVFPDGPQDKGGLRYCINSAALRFIPVDKLEEEGYQAYKKIFE

SEQ ID NO: 75822 - protein, 248 aa, Mesembryanthemum crystallinum
MAGLAFGRFDDSFSWASIKAYIAEFISTLLFVFAGVGSCIAFNKLTADAALSPSGLVAVAVCHAFALFVAVSVGANISGGHVNPAVTFGLAVGGQITILTGVLYWIAQLAGSVAGCFLLKAATGGLTTPIHSVASGVGAIEAVVMEIIITFALVYTVYATAVDPKRGSVGTIAPIAIGFIVGANILAAGPFSGGSMNPARSFGPALASGDFHDHWVYWVGPLIGGGLAGLTYSNVFMHHEHAPLSSEY

SEQ ID NO: 75823 - protein, 204 aa, Rhodospirillum rubrum ATCC 11170
MTESVGTLTGRPVPDFTAPAVLADNSIVEDFCLKDYLAGFYGLIFFYPLDFTFVCPSEILAHDHRLPAFAAKEAKVVAISVDSQYSHLAWKKTPIAEGGLGPIGFPMVADISKAIARSFGVLLETGVALRASFLVDRGGIVRHQTVNDLPLGRNVDETLRMIDALRFHDAHGQVCPAGWKTGDPGMTASPEGVAAYLSANAERL

SEQ ID NO: 75824 - protein, 471 aa, Symbiobacterium thermophilum IAM 14863
MAKVDRVLEMIAEKDIRLLDLKFVDVLGMLHHLTVPVEVVDAEQLSQGFFFDGSSIRGFRGIAESDMILRPDPATVVCDPFVEGPALSLMADVLEPGLREYGRDPRGVARRAEEYLRQTGIADTSYWGVEIEFFVFDNVRFQTGPDASFYYVDSAEAHWNSGRVPNGGYKVKHQQGYLRALPIDEQTDLRTAMTRQMQALGLVVERHHHEVASAGQNEINFRFSTLTDTADKAMLYKYAVKNVARAHGKTATFMPKPLYRNSGNGMHCNQSLAKDGVNLFYDPNGYANLSQIALWYIGGLLTHADALLAITNPTTNSYKRLVPGYEAPTNLAFSRANRSAAIRIPVSLSPKTTRIEFRTPDPTANPYLALAAQLMAGLDGIRRRIDPTAAGFGPVDIDIYHHAGSAAVQLKHVPSSLRQAVEALKADHEFLLEGDVFSEDLIETFIALKEDEIRNLETHPHPVEFEMYFDN

SEQ ID NO: 75825 - protein, 244 aa, Herminiimonas arsenicoxydans
MTNSTHFGYQTVAEEEKVHKVAEVFHSVAAKYDVMNDVMSAGLHRVWKAFTIAQAGIRPGFKVLDIAGGTGDLAKAFAKKAGPGGEVWLTDINESMLRVGRDRLLNNGLIVPTSLCDAEKLPFPDNYFDRVSVAFGLRNMTHKDAALAEMRRVLKPGGKLLVLEFSKVWEPLKKPYDVYSFSVLPWLGQRIAGDADSYRYLAESIRMHPDQETLKKMMQDAGLARVEYFNLTAGVAALHTGIKL

SEQ ID NO: 75826 - protein, 282 aa, Mycobacterium sp. JLS
MSTVPTVTLNDGASIPQLGFGVYQVKPDETANAVKTALDIGYRHIDTAEMYQNERGVGEGVRDAGIDRAEVFVTSKLNNGFHRPDDARRAFDKTLSELGFEYVDLFLIHWPLPTLYDGDFVSTWQTLEEFKKDGRARSIGVSNFQVDHLGRLARETETVPAVNQIEVHPYFTNDAVRAYGREHGIATEAWSPIAQGQVLDDPTVTRIAEASGKSPAQVVLRWHVQRGDIIFPKSVTPERIEENFNLFDFELSEADVDALSGLDKSEQGRIGPNPDTFDYIPD

SEQ ID NO: 75827 - protein, 271 aa, Arabidopsis thaliana
MYHLLIIITTLSFSSINITFAVDEAFPSIPTTFSVATKQHYDVKPIHHEVYDGERKIYDISHQYTPELPVWESSEGLGNFLRLAVSMKNGSDANISKMELSVHSGTHVDAPGHFHDHYYESGFDTDSLDLQILNGPALLVDVPRDKNISAEVMKSLHIPRGIRRVLFKTLNTDRRLMFKKEFDSSFVGFMVDGAKWLVENTDIKLVGLDYLSFAAYDEAPATHRFILERRDIIPVEALKLDDVEVGMYTLHCLPLRLVGAEGAPTRCILIK

SEQ ID NO: 75828 - protein, 310 aa, Arabidopsis thaliana
MEGFSPPINTAQVDAKTKLDEKVDYSNLPCPVLYEELNREATMALKPELFEGFRLDYNKSLNQKFFLSHSILMGPTEVPNPTPSSEIIKIPTANYDFGAGFIDPKLYLIGRITTDGRLNARAKFDLTDNFSVKANALLTDEEDKSQGHLVIDYKGSDYRTQLQLGNNSVYAANYIQHVTPHLSLGGEAFWLGQQLMSGVGYAARYETDKTVASGQIASTGVAVMNYVHKVSEKLSFATDFIYNYLSRDVTASVGYDLITRQSRLRGKVDSNGVVAAYLEEQLPIGLRFLLSAEVDHVKKDYKFGFGVNAF

SEQ ID NO: 75829 - protein, 417 aa, Zea mays
MRARQMIARSALDEVTYTGDFDRSPSTFRSSVSRDGRFPTVAGRYHLYVSYACPWASRCLAFLKLKGLDHAIGVTVMKPIFERTKESDEHLGWVFPAVADEEPGAEPNPLNGAWSVRELYEIASSNYAGKPTIPVLWDKQLKTVVNNESSEIIRMLNAEFNGIARNPRAGRVLISVPIVCSGRYMNERTQDDHYLDLKGLDPTLLNTEAPDLYIRQNPVPNAYTLAINSKKPFIVVHTSLVELLTPRELHTVVYSKQTHRLAVLAHELGHLKCDHGVWLTFANILTMGAYTVPGFGMVTGFLEEQLYRWLRAAELTCDRAALLVVQDPKVVISVLMKLAGGCPSLADKLNVDAFLEQARSYDKAASNPVGWYIRNAQTRELSHPLPVMRAREIDEWSRSQEYKTVMQKMFQMGLNRV

SEQ ID NO: 75830 - protein, 575 aa, Nitrosomonas europaea ATCC 19718
MSFILYGTGVSDGIAIGHAHLASSATLNVPHYLLPKNQINAELTRLRNAFSTVRLELETLKTSAAQVSGLAEFNAFLELHQMILDDPTLSHAALETVEQAQCNAEWAITQQMEVLVARFEEIEDAYLRERKTDVVQVVERVLKVLLGHPGYTPPPSKHDGSSILVAHDLSPADVMQYKQHQFSAFLTDMGGPTSHTAIVARSLNIPSIVAMQHAQQLIYENDNLIVDGNQGIVIVNPDKYILAEYRLKQSQLELEKRKLWRIRSVKAVTLDGTTVDLLANIELPQEVEQARECGAMGIGLFRSEFLFLNRDDLPDEEEQFEAYSTVVKGMHGQPVVIRTFDLGADKNLRSAYRTAPNPALGLRAIRLSLAEPGMFLVQLRAILRASVLGKTRILIPMLCSSREVDQTLQMIEFAKQSLRDENKPFDENVRIGCMVEIPATALSLELFMRKLDFLSIGTNDLIQYTLAIDRTDETVAHLFDPLHPAIIRLLVQIIQNAGKAGIPVSICGEMAGDSEYTRLLLGMGLRQFSMYPAQLLTVKREILGSHLPEISRLMQKILKADEPEKISELLQKLNS

SEQ ID NO: 75831 - protein, 563 aa, Oryza sativa
MERENSWLRRTKFSHTVYTRLDHQRAPIAPLGRDVEQKLQRFISMGKSVSMPVNRDEDAAAAFKHSVSLPTARSLLQIDKEKANKQKADFDIPSSPPVNSVNSKGLKARSLVKSPSSAMLLSYLNKAHPNRDSNLKKTDRPQHKLRSKSPLPNVAPSDVFREARASSRRFTSPPPKRRGSERSIYGKSFDRQLSDMSQSPDLCSTPVSSDKHKSLKDSSWTRRYFDNGGRRRVSAVDATEVRRNRGVSMAQAVQTTVDWTLDPSKLLVGHKFASGAYSRLYKGLYDDKPVAIKFIRQPDDDDNGKMAAKLEKQYNSEVNALSHLYHKNVIKLVAAYKCPPVFYIITEFLPGGSLRSYLNSTEHHPIPLEKIIARGLDVARGLEYIHSQGVVHRDIKPENILFDENFCVKIADFGIACEESMCDVLVEDEGTYRWMAPEMIKRKAYNRKVDVYSFGLLLWEMISGRIPFDDLTPLQAAYAVATRHARPVIPPECPMALRPLIEQCCSLQPEKRPDFWQIVKILEEFHSVLSQGGCLDSLKSSNSQDQKKRLLHWIQKLKPSHST

SEQ ID NO: 75832 - protein, 534 aa, Arabidopsis thaliana
MEAYTHSYTKENLLKPFFSRSIDQQQFTSNRSRAFRSRRSQLTWLPTALLRSFSLLISRIVDATENSLDKIKRQLASGSGRNLLQGPLFKRSETLRKWNERWVILDPTTGKMEYKTRRNEPTIKGTILFDENSTISISPVNFQGLPKYNGCCICILGFSKIATQLVLKAHKEAVESLSGSGSATLGTVATVVAAANSTALECSREIQAAMQISLRNALKITPNKPIDGPLDDLTIMKETLRVKDEELHNLARELRSRDSMIKEIADKLSETAEAAVAAASAAHTMDEQRKIVCVEFERLTTDSQRQQEATKLKLKELEEKTFTLSKEKDQLVKERDAALQEAHMWRSELGKARERVVILEGAVVRAEEKVRVAEASGEAKSKEASQREATAWTEKQELLAYVNMLQTQLQRQQLETKQVCEEKTESTNGEASLPMTKETEKNVDKACLSISRTASIPGENVVHMSEEQVVNAQPPVGENEWNDIQATEARVSDVREISAETERDRRNSLDIPVVSPEPNVPRNDPPSESFHHQP

SEQ ID NO: 75833 - protein, 409 aa, Arabidopsis thaliana
MASSKGSQSVRNLMYPGKHALLPPKIPFPSVSASYSEYIPTGLIGSRHGQKLSNEKTHHQRTSSESHLVEELPFWLDDLLNEQPESPARKCGHRRSSSDSYAYLDVANATNISLTLQNDFSYRNTVLSTQRGVQELDRNKNAQDAAFYSGASFLKQKSRQRDSLVATGACPSWLPFARENGGGKNLGALYMSQDATVISSERKNYAEPFSHDPKMLSSEENNSNPSPVTYEADNTKRAKQQFAQRSRVRKLQYISELERNVQTLQAEGSKVSAELDFLNQRNLILSMENKALKKRLESIAQEKLIKQSSYQDSTVLKIVYLMSSVYYPVEQEVLEKEIGRLRALYQQQQQTQKPSASRGRATSKDLDSQFSSLSLNTKDSNCRRDSVSVMGPGDSTRSDPYLPPHHRRF

SEQ ID NO: 75834 - protein, 267 aa, Zea mays
MGGKRSVDPPTLSSPQPLQPSPHPVVSPAPKTEGKRGRGGGGKGGGPGDAALAGVRFWILMAPCLHAPGSDSRGGKACKNKKRNKIRKDQAKNPTKAYSGPVNKLWPKTGIFLAAAVTDWLDGYIARKMQLGTPFGAFLDPVADKLMVAATLVLLCTKPLESSLLNDGPWLLTVPSIAIIGREALPSSGKEAIELLDILLRWIVLRFCESNTTCLLKVLDFLLELFDILKDQSYMLTEAEAAIYLPCLIMKSRFVARNQKITLMVMR

SEQ ID NO: 75835 - protein, 508 aa, Yersinia pestis CO92
METVANFINGKCVFSCGNSVTSGSPRAQAIFNSATGEPIRQVMMSTAQETEQAITAAQQAFASWSRQAPLKRARVMFRFKSLLEQHLDALAQLISEEHGKVYSDAVGELTRGLEVVEFACGIPHLQKGEHSANVGTGVDNHSLMQPLGVCVGITPFNFPAMVPMWMFPIALATGNTFVLKPSEKDPSLAVRLAQLLTEAGLPDGVFNVVQGDKTAVDVLLTDPRVQAVSFVGSTPIAEYIYQTASAHGKRCQALGGAKNHCILMPDADMDMAASAIMGAAYGAAGERCMALSVVLAVGDETADNLCARLEQQISTLRVGPGLAQEPENDMGPLISAPHRAKVLGYIDSGVAQKATLRIDGRGLKVAGHEQGYFVGPTLFDHVTPAMTIYQEEIFGPVLSVVRIADYRSAVDLINRHEYGNGTAIFTRDGGTARRFCEEVQVGMVGVNVPIPVPVAFHSFGGWKRSIFGPLNVHGNDGVRFYTRMKTITARWPEAQHDQGAAFSMPTLG

SEQ ID NO: 75836 - protein, 284 aa, Oryza sativa Indica Group
MVVSIITRALILILGYAYPAYDCYKTVELNRPEVEQLRFWCQYWILLAVLTVFERVGDNFVSWLPMYSEAKLAFIVYLWYPKTQHFQGTSYVYESFFKPYIGKHEAEIDRNLLELRTRAGDMAVHYFQKIADYSHTRFYEILQYIASQSEAQRSRPQAQQHQQRPPPPRTRQVNPAPPPVPSPSAPPLPPQPPPPRNQAQADKAPIPVAPPGAAVPPAQPQPQPPQAGAEAVTTESTEATQAANPPATTASNPHQAPVIPDEETLIQEAIRMTRSRLRRRMGGA

SEQ ID NO: 75837 - protein, 656 aa, Yersinia pestis CO92
MSVEKQFSVSAEKTCNTENKCNTEKKFDVICMGRIAVDLYGQQIGARLEDVASFAKYLGGSSGNVAYGSARQGLRSSMLARVGDEHMGRFLREELHQVGCDTSHLTTDKKRLTALVLLSIKDRDTFPLIFYRDNCADMAITAQDFSEQYIASARSLAITGTHLSHPNTREAVLTALRYARRNGVRTVLDIDYRPVLWGLTSLGDGETRFIESHQVTAELLAVFNLFDVIVGTEEEFHIAGGSTNTLDALRGVREVSDAALVCKRGALGCSVYTEAIPQTLDEGLTVSGVRVKVLNVLGAGDAFMSGLLRGYLNDEGWPQACRYANACGALVVSRHGCAPAMPSKIELDNYLARADAVVRPDLDVHLNHLHRVTTRRRQWPELCVMAFDHRSQLEEMALQCGADLCHISTLKTLILQASREAVHTAGLQGKAGLLCDGTFGQDALNAITGAGWWIGRPIELPGSRPLAMEHGNIGSQLIGWPQEHIVKCLVFFHPEDAYSLRLEQEQKIIEVYRACCQSGHELLLEVILPAGMPRSDELYLRAISRFYNLGVYPDWWKLPPLASEGWAALNKLIERRDPHCRGVVILGLDASLEALRTGFNAAAGYPIVKGFAVGRTLFGDASLAWLKRDIDDTQLIARIRDNYLQLITLWRERGQK

SEQ ID NO: 75838 - protein, 591 aa, Neisseria meningitidis Z2491
MSIVLHGVAAGKGIAVGCAHLIARGTEEVPQYDVAEADTDAEAERFDAAVKATRKELEQLRSAIPENAPTELGAFISLHLMLLTDVTLSREPVDILREQKINAEWALKQQSDKLAAQFDNMDDAYLRERKQDMLQVVRRIHNNLIGQGNELEVADNLFDETVLIANDLSPADTVLFKEQRIAAFVTDAGGPTGHTAILGRSLDIPSVVGLHNARKLITEGETVIVDGINGVLIIAPDESVLNEYRRRAREYRSHKRDLNKLKKTAAATADGVCIELVGNIESAEDVKPLHNLGADGIGLFRSEFLYLNRDTMPSEDEQYEVYSAIVKKMKGKSVTIRTVDLGVDKNPRWFGKNSTPNGSLNPALGMTGIRLCLAEPVMFRTQMRAILRAAAHGPVRMMWPMITSVSEVRQCLIHLDTAQRQLAERGDAFGKVGIGCMIEIPSAALTVGSILKLVDFISVGTNDLIQYILSVDRGDDSVSHLYQPGHPAVLKMLQHVIRTANRMDKDVSVCGEMAGDTAFTRVLLGMGLRRFSMNPNNILPVKNIILHSNVGQLESDIVKVIRCEDEEKSEKLIKQMNSVSVEEEADFKGRK

SEQ ID NO: 75839 - protein, 470 aa, Frankia sp. EAN1pec
MTPEPDHTRADGTRADHTQADDTPEHPGLATLLGDVDEVIVAVPDLQGRLVGTGLSPEYFREEVLGGDGLGACAYLHAVDVEMETGPGYAYDPWEGGFGDLRLVPDLSTLGHAPWHPESAIVIADAVWPDGTPVDVAPRTVLRRQLDRLAALGLRALAGTELEFLVFEEAYRKAAGRDYARLTPASSYNVDYALAGTERMDDLVRSIRRAMAAAGAPVESARAEVHPGQYEIVFRYDEALRTCDRHALYKTTAKKIAGTAGRALTFMAKYDQGEGNSCHVHLSLRAADGGFVLSAGAEEGMSELMRWFVAGQLACMAELTLLYAPTVNSYKRLAPGGFAPTGISWGLDNRTCAIRVVGRGRSLRIEHRVPGGDANPYLAIAGMLAAGLHGIENRLPLPPPRAGNVFAAPDVPRLPASLRDAARAWRESATARAAFGERVVDHLAHAADVELAGYERTVTDWERRRGFERY

SEQ ID NO: 75840 - protein, 180 aa, Oryza meyeriana
FGSVYRGRLKGKELAVKQLDRNGMQGTREFLVEVLMLSLLEHPNLVTLLGYCTDADHRILVYEYMPRGSLEDHLLDLPPGASSLDWTTRMRVAQGAARGLEHLHDAARPPVIYRDFKASNILLDRSFQARLSDFGLAKVGPVGDKTHVSTRVMGTYGYCAPEYALTGKLTTCSDVYSFGI

SEQ ID NO: 75841 - protein, 467 aa, Fulvimarina pelagi HTCC2506
MSNATAALNAPILPTEQTRPFRAPAPVPHSEPLGFFGFLQTASRNPIEIWGTRAFKEPYIEGRWLGVPNIVVNDPQAVRHLLVENAKNYVMQPLRQRILRPLLRDGLLTAEGQLWRRTRKAIAPVFTPRHIAGFTESMAARSENARERLSGMTGKTIDISHETTLLTFDILQATLFSDDIASEPDEFARSTSDFLGSMGRVDPLDLLGAPQFLPRIRRLRGRKSMAYFRQLIGDTIEKRRAQLERDPEGVPADLLTLLLKADGLSRDEIEDNIITFIGAGHETTARSLAWTLYLLSQAPDEREKVETEIDAVVPSLEHPSQYLDALPRTRAAFEESMRLYPPAPSLNRTALQPDQVGDLKIPAGATVLVMPWLIHRHEMLWDRPDHFIPERFMPDRREAIDRYQYLPFGVGPRVCIGASFALQEAVIALAILMRSLRFDYTGAKQPSVVQRITVQPENGLPMSVRRR

SEQ ID NO: 75842 - protein, 103 aa, Magnetospirillum magnetotacticum MS-1
MVRDFCGHGLGRVYHDAPTILHYVEASYDVPLKPGQFFTIEPMINLGRPAVKVLSDGWTAVTRDRSLSAQFEHTVAVTEEGCEIFTLSPKGLDQPKPHGPQAD

SEQ ID NO: 75843 - protein, 462 aa, Frankia sp. EAN1pec
MTTISPADVGVGPDGADPAVAPAILARQEARESAARTYARSLPIVPVEAAGCWIVGADGRRYLDFLAGAGTLAVGHNHPVVVEEIERVLRSGAPLHALDIATPEKDAFAAELVGDLPPGLREDPKLLFCGPTGADAVEAALKLAQTVTGHHNVLAFTGAYHGMTSGALAVTGKVAAKEPLPVAGAVVRLPFPYPYRCPFGVGGAASAEISASYIERLLDDSCGGITSPAAMILEPVQGEGGVIPAPDTWLRAMRELTTRRGIPLILDEVQTGVGRTGTFWACERAGVVPDMLVMSKAIGGGLPLAVVAYRAELDTWAPGAHAGTFRGNQLAMAAGRATLELVRTQALAERAAAAGKRLLTGLESITRGKPFIGDVRGRGLMLGLEVVSAEAAPDEIGARPADPRLAAAIRSECLARGLIIELGGRDDAVLRLLPPLTVTDEEADLALEILAESVSAATEQAG

SEQ ID NO: 75844 - protein, 507 aa, Herminiimonas arsenicoxydans
MTTDYLKKILTARVYDVAVESPLELAPTLSQRFGNQIYFKREDIQSVFSFKLRGAYNKMAHLPPAQMKRGVICASAGNHAQGVALSAARLGCRAVIVMPTTTPSVKIEAVKARGGEVVLFGDSYSDAYQHALTLEKKLKLTFVHPFDDPDVIAGQGTIGMEILRQHSGPIHAIFVPIGGGGLIAGIGAYVKAVRPDIKIIGVQTVDSDAMARSLQSNRRVTMTDVGLFADGTAVKLVGEETFRLAKLYVDDIILVSTDEVCSAIKDVFQDTRSILEPSGALSVAGAKAYIERAHADKKPIKNETLITIASGANMNFDRLRFVAEMADVGAAREGVFAVTIPEERGSFKRFCELVGPRNVTEFNYRLSDAKQAHIFVGLQIADRDEAGKIARRFEKHGFKTLDLTHDELAKGHIRHLVGGKSDLTHDELLYRFEFPERPGALMRFLDSVAPHWNISLFHYRNEGGDVSRILVGIQVPKKEMKTFRASLAGLGYRHWDETDNPVYKLFL

SEQ ID NO: 75845 - protein, 648 aa, Arabidopsis thaliana
  misc_feature (275)..(275): Xaa can be any naturally occurring amino acid
MYYLPSSCLVLFLFFSLFYHLPCASSKQTLGWCESQFQCGNITAGFPFWGGNRPEVCGHPLLELHCLDNITSLTISDHLYHVLSINHTYNTLRVARTDFLQSICLSPFPFANATLPPEIFDILPTYKSVTLYRCYPVIPDLARYGCPAIGSVSVSDNLENPVSCEARFTVNIPTSFVPNEKRLNITSLVRDVRNGFEVRLRIDENSCQECSSSHKYCGFTGTLPLETKCRPLNLPTRLSSEAKIGVLPSPILSNKLNLVMNTVFDLFNQTILWFXATIAGVSLLPFLVLTLVVHIIRKQKTSNDKGQQDLKEHIPKPRIKALIQLKQYSYEQVKRITNSFAEVVGRGGFGIVYRGTLSDGRMVAVKVLKDLKGNNGEDFINEVASMSQTSHVNIVTLLGFCSEGYKRAIIYEFMENGSLDKFISSKKSSTMDWRELYGIALGVARGLEYLHHGCRTRIVHFDIKPQNVLLDDNLSPKVSDFGLAKLCERKESILSLMDTRGTIGYIAPEVFSRVYGSVSHKSDVYSYGMLVLDIIGARNKTSTEDTTSSTSSMYFPEWIYKDLEKGDNGRLIVNRSEEDEIAKKMTLVGLWCIQPWPLDRPAMNRVVEMMEGNLDALEVPPRPVLQCSVVPHLDSSWISEENSISSEI

SEQ ID NO: 75846 - protein, 373 aa, Zea mays
MGNLEGDLQAGAAAGYQLLWLLLWATIMGALMQLLSARLGVATGKHLAELCRQEYPPWATRALWVMTELALVGADIQEVIGSAIAIKILSGGAIPLWGGVVITALDCFIFLFLENYGVRKLEAFFAVLIATMAVSFAVMFGETKPSGKELLIGLVVPKLSSKTIKQAVGIVGCIIMPHNVFLHSALVQSRKIDTNKKSRVLEAVYYYNIESILALIVSFFINICVTTVFAKGFYGSKQADSIGLENAGQYLQEKYGTAFFPILYIWAVGLLASGQSSTITGTYAGQFVMGGFLNLRLKKWLRAMITRSFAIIPTMIVALFFDTEDPTMDILNEALNVLQSIQIPFALIPLITLVSKEQIMGSFVIGPITKRVK

SEQ ID NO: 75847 - protein, 366 aa, Escherichia coli
  misc_feature (26)..(26): Xaa can be any naturally occurring amino acid
  misc_feature (75)..(75): Xaa can be any naturally occurring amino acid
  misc_feature (92)..(92): Xaa can be any naturally occurring amino acid
  misc_feature (101)..(101): Xaa can be any naturally occurring amino acid
  misc_feature (140)..(140): Xaa can be any naturally occurring amino acid
  misc_feature (209)..(209): Xaa can be any naturally occurring amino acid
  misc_feature (231)..(231): Xaa can be any naturally occurring amino acid
  misc_feature (266)..(266): Xaa can be any naturally occurring amino acid
  misc_feature (288)..(288): Xaa can be any naturally occurring amino acid
  misc_feature (299)..(299): Xaa can be any naturally occurring amino acid
  misc_feature (302)..(302): Xaa can be any naturally occurring amino acid
AAPPAPPVSYGVEEDVFHPVRAKQGXVASVDATATQVGVDILKEGGNAVDAAVAVGYALAVTHPQAGNLGGGGFXLIRSKNGNTTAIDFREXAPAKATRDXFLDDQGNPDSKKSLTSHLASGTPGTVAGFSLALDKYGTXPLNKVVQPAFKLARDGFIVNDALADDLKTYGSEVLPNHENSKAIFWKEGEPLKKGDTLVQANLAKSLEXIAENGPDEFYKGTIAEQIAQEXQKNGGLITKEDLAAYKAVERTPISGDYRGYQVYSXPPPSSGGIHIVQILNILENFDXKKYGFGSADAXQIXAEAEKYAYADRSEYLGDPDFVKVPWQALTNKAYAKSIADQIDINKAKPSSEIRPGKLAPYESNQ

SEQ ID NO: 75848 - protein, 575 aa, Vitis vinifera
  misc_feature (336)..(336): Xaa can be any naturally occurring amino acid
  misc_feature (472)..(472): Xaa can be any naturally occurring amino acid
MTSVLDAPVDMKCYESLLFVAAGSSVSIIDLRTMQRVITTSCGTEDGLVWFRDFTDATCPVSSSHEDKSSSKFWDPVSERGIGTSGLSGLRDSSEQQLNQAVTINQSVSLNGASLLPNDVTLEQLQPPMIPDSLKALSYSTSLSLTTESKYNEKTEIKDAGTVESKLGVVAADDGRCSGIVATAWRVGIFNPMASGIGGGAFMIVQSSSTSKSEGFGGRETAPLVAPQNMYENNPRAQYLGTLAMGVLKEIAGLRDAGLKHGRLEYRGVISVDPDHQGTLELHSRVNNAHIFQTHHAYIFTPRNLHEEFMEASAIGTDVGTIIQFGVGFYPAYLMXGKVIITIEHNAKMTDAAPAFKIEKWLAKMRSEWSAYLVTDAMSSSFGIIYVTVMTVYYRFSGKDDIDEFDASAEVSSSPPTGVLLLVFKCPSAICGAGMEKGFQREDFEMLGGGINAVASGHPKLAGLGAEIVGTXILVYPVLSTIEAKGNVRDSHVSILAPLSIEFAVLLVHPATISITGTGINPARSLGAAIIYNKGNAWNDMWISWVGPFIGVTLAILQPRVSCRMFGVVDSKSNL

SEQ ID NO: 75849 - protein, 190 aa, Escherichia coli
  misc_feature (41)..(41): Xaa can be any naturally occurring amino acid
  misc_feature (74)..(74): Xaa can be any naturally occurring amino acid
  misc_feature (104)..(104): Xaa can be any naturally occurring amino acid
  misc_feature (160)..(160): Xaa can be any naturally occurring amino acid
  misc_feature (167)..(167): Xaa can be any naturally occurring amino acid
TTHYSVVDKDGNAVAVTYTLNTTFGTGIVAGESGILLNNQXDDFSAKPGVPNVYGLVGGDANAVGPNKRPLSSXSPTIVVKDGKTWLVTGSPGGSRIITTVLQXVVNSIDYGLNVAEATNAPRFHHQWLPDELRVEKGFSPDTLKLLEAKGQKVALKEAXGSTQSIXVGPDGELYGASDPRSVDDLTAGY

SEQ ID NO: 75850 - protein, 295 aa, Oryza sativa Japonica Group
MPRPEVQAPPEIFYNESEARKYTTSSRIIEIQSRITERALELLALPNDGVPKLLLDIGCGSGLSGETLTEQGHHWIGYDISKSMLDVALEREAEGDLLLADMGQGLGLRPGVIDGAISISAVQWLCNADKSCHNPRLRLKAFFGSLYRCLARGARAVLQFYADNVKQSEMIVTAAMRAGFAGGVVVDWPHSSKAKKSYLVLTCGPPSLNSSLPKGKGQDGAMCSDDDESDDGSGDEDGAQTVGIYERNRPKKRQKTKKNGKGKAWLLNKKEQLRRRGREVPADTKYTGRKRKSYF

SEQ ID NO: 75851 - protein, 396 aa, Arabidopsis thaliana
MQFQLSKPANNKQRRNMETQGKVITCKAAVAWGAGEPLVMEDVKVDPPQRLEVRIRILFTSICHTDLSAWKGENEAQRAYPRILGHEAAGIVESVGEGVEEMMAGDHVLPIFTGECGDCRVCKRDGANLCERFRVDPMKKVMVTDGKTRFFTSKDNKPIYHFLNTSTFSEYTVIDSACVLKVDPLFPLEKISLLSCGVSTGVGAAWNVADIQPASTVAIFGLGAVGLAVAEGARARGASKIIGIDINPDKFQLGREAGISEFINPKESDKAVHERVMEITEGGVEYSFECAGSIEALREAFLSTNSGVGVTVMLGVHASPQLLPIHPMELFQGRSITASVFGGFKPKTQLPFFITQCLQGLLNLDLFISHQLPFHDINEAMQLLHQGKALRCLLHL

SEQ ID NO: 75852 - protein, 417 aa, Azospirillum brasilense
MERILGGMSLPDLGTFALVNDRLDRLSDYPFTRLAALLSGVTPRANAEPIMMSVGEPQHQPPAIIDETLRANAHLWGKYPPVGGTPEFREAVGAWLARRYALPDGLFDAEKSVLPVSGTREALFLLALLAVPPSKAGRQPAVLMPNPFYAPYEGAALLAGAESVFLPSTRETGFLPDLDALTPELLERTALFYLCTPANPQGAAADAAYLERAIGLARRYGFILAVDECYAEIYLDKPPVGALQVASGLAHDGKPWANILVFHSLSKRSSAAGLRSGFVAGDPELMSRFTRLRSYSNAGMPLPVLAASAALWRDEAHVEENRALYRAKFDAAEASLKGRYGYYRPDGGFFLWLEVGDGEEATRRLWAEGGIRVLPGAYLTRCNPGEANPGAPFIRIALVNDAETVAHACGTIARILG

SEQ ID NO: 75853 - protein, 185 aa, Ehrlichia ruminantium str. Welgevonden
MFIQIEDTPNPNTLKFMPGIPVNNGKIGEFTDSITAESSPFAKALFEIEHIVSVFFGGDFISVTKSSDIEWDVLKPEILTVIMDFLTLNPNDSVENNDEEDLQEFFDAKDEEIVSKIKELIDDYIKPAVAQDGGDIKFKGYSNGIVFVKLRGACSGCPSASITLKEGIYNMLTYYLPDIQSVESV

SEQ ID NO: 75854 - protein, 491 aa, Oryza sativa Japonica Group
MADAWAASPPSPTAPSPFAADDLVDARLAPWPPFAPWPAPGQLHHNRRGGGHPNPLFTILPASALAIGVVLLVAVVVILVMTRRWKPGTVDGAGGASCNGDKPGGAPASSCGSSVRGYNNSRYYAAAAAGCIYGGRLGFSVQPRNRGAQVFTYRELESATDGFSECNVVGRGAYGVVFRGRLGDGTTAAIKRLKMDGRREGEREFRIEVDLLSRMHSPYLVGLLGYCADQSHRLLVFEFMPNGSLKSHLHRRALAPAEQPPPLDWQTRLGIALDCARALEFLHEHSSPAVIHRDFKCSNILLDHNYRARVSDFGMAKLGSNKANGQVTTRVLGTTGYLAPEYASTGKLTTKSDVYSYGVVLLELLTGRVPVDTKRPPGQHVLVSWALPRLTNREKLVQMVDPALIGQFSLKDLVQVAAITAMCIQTKADYRPLMTDVVQSLIPIVKSPLMSCTSTPLRPAHGHHHVVYMSPSRGSSNGGALETRCVMHGLD

SEQ ID NO: 75855 - protein, 515 aa, Candida albicans
MLEEISFESWYLYLIICGVLYFCTNYLYIQYLNKKLGAKSPGSCKSDGCFGFRSGFEMLKAKKIGRQVDLLHERFNDLSNPEVNDTFTSYNFGFPMIITKDPENIKALLATQFNDFSLGRRYDFFKPLLGKGIFTLDGEGWKHSRSMLRPQFAREQIAHVKALEPHFQLLKKHITKNKGQFFDIQELFFRFTVDSATEFLFGESVSSLKDESIGYNQDEFDFAGRKDFPEAFNKSQIYLSTRSLLQNLYWLVNPKDFQNCNAIVHKFSDYYVNKALNATPEELEKNSGYVFLYELVKQTRDPQVLRDQALNILLAGRDTTAGLLSFAVFELARNPQVWKKLREEIIERYADGVTEISFETLKQCEYLKAVINETLRLYPSVPRNGRFANKNTTLPRGGGPDGMSTILIKQGQAVMYSIYSTQRDPKYYGKDADVFRPERWFEPETRKLGWAFLPFNGGPRICLGQQFALTEASYVLVRLAQCCENLQLTEGIEYPPAKLTHLTMCMFDGVPIKVD

SEQ ID NO: 75856 - protein, 346 aa, Magnetospirillum magnetotacticum MS-1
SVGMSIDGGLLTNHWAVLIATTVAAIAVKIALIAGLFRLFGSPWLDALRGAAVLAPAGEFAFVILPAAGDLHILGSDVTRFCVALAALTMLVGPIAAKGLDSVIARRPKGAEPPSDVGEALESGETRVLVVGFGRFGQILAQVLLAEGINITVIDKDVEQIRAATSFGFRIYYGDGTRLDVLRASGLAKAELICVCIDDPQAALKIVDIVHEEFPNVRSYVRAYDRTHAIELMHRDVDFQLRETVESALGFGRATLEGLGLPAEAAARRVEDVRKRDVARLVLQQAGAMPDGSGWLRGAPEVRPEPLTAPKSPSRALSAETRGLIESQPHESAARALEPEDAEPDA

SEQ ID NO: 75857 - protein, 667 aa, Debaryomyces hansenii CBS767
MNLQDICIPKDSKYGEHQAPLLYSTTESFDNILSSSVLPHKQSSSSNVNGESSLRVNGHNNQIQGDSVEDVREINTVTQASQSEGKVSVVTPFLVKHISDQSMIPKDNFHRYCYRHNPDVTCNKQTDEVKMKNIQKQMEKLPSRDQEAINHVWSIFSAAPDPHRSLILQGLLSQCCFPQLSFISQEVSSLIKIDFISTLPMEISLKILCYLDCASLCNAAQVSRKWKCLADDDRVWHHMCEQHIDRKCPNCGWGLPLMHMQRARHMNNDEHNSKKRKLETVEPSNGSNSSEVELEIKKMKVTQDEQDKQRKLLKKRPWKSVYSERFKLEKNWRKGIYKIKTFEGHTDGVTCLQFNRKYLMTGSYDNTVKIWKVETGECLRTLTGHTKPIRSLVFDSQKLITGGLDSTIKVWNYHTGECISTYRGHDAAVVSVDFLKKTIVSGSADHTVKVWHVDSRTCYTLRGHTDWVNSVKIHPLSNTAFSASDDTTIRMWDLQNNQCLRIFGGVDNNGHLGHVQCVIPLIYKDKLIQDNNESDGENNEGITHNNLNANQEDLNEEINNTQLADNKNYPTHLLTSSLDNTIKLWDVKTGKCIRTQFGHIEGVWSISADTFRIISGAHDRLIKVWDLQNGKCLHTFGNNSIVSCVGLSDSRFAAALENGCVKMYCFD

SEQ ID NO: 75858 - protein, 230 aa, Ehrlichia ruminantium str. Welgevonden
MKEKSKFVHQVFTSVASRYDIMNDIMSFGLHRLWKDQVVQSIHKGSLLDVACGTGDIAVKVANYKKDVDIVVCDININMLNRGRNNAVNANILNLKWVCGNAEQLPFYDNTFDYYTISFGIRNVSNRQLALNEAYRILKPGGKFICLEFSPLKKNHCLYTLYNFYSFKVIPNIGQLVAKDRASYQYLVDSIQAFPYQDDFIQEIQNSNFVQARYRNLCFGIVTLYTAWKV

SEQ ID NO: 75859 - protein, 415 aa, Ehrlichia ruminantium str. Welgevonden
MTKILVKKFGGTSLQNIKCINQVTEIIKQDVCSNHKVVVIVSAMGKFTDNIISQIKEISDVKSYNELSEYDLIISSGEQISCGMLSLALQKLGIKAQSWLGWQLPIVTTDDHTKARIMEINTSALQDFLVNNDVAIIAGFQGMHKENRVTTLGRGGSDTSAVAIAAALGIDLCYIYTDVDGIYTSDPNIVPKARKLDYIAYDEMIEMASLGAKVLQVRSVELAMKYNIKLHVLSTFNSIKGTILCKKGEIEMESQLITGITYNSNTASITLKKVRALFGITTLFSIIADNGINVDMIIQNMDNNANDITFTIPEEDLSITETLLIKIKDKLMYEELIINPDVAKVSVIGVGMISHPGIAYKMFDTLTSNNITILAVTTSEIKISVLVLRKDGQLATQYLHSSFKLDSQSNLHTTS

SEQ ID NO: 75860 - protein, 137 aa, Glycine max
MSASTGSSKIRRIVRVRQMLLRWRRKAAADVPAGHVAVCVGPSRRRFIVRATHLNHPIFKMLLVKAEEEYGFCNHGPLAIPCDESLFEELLRVVSRPVPVPGFSTLEDFQRRCHMDVSTGFDVVGESWPLLRDEPIC

SEQ ID NO: 75861 - protein, 325 aa, Fulvimarina pelagi HTCC2506
MTKAIRIYETGAPEVMKWEEIDLPAPGEGQIRVRQTAIGVNFIDTYFRDGTYPAPSFPFTPGKEGAGIVDAVGAGVSDLKEGDRVAYAAADGSYAEELIIEAAKVVPIPDGVSDETAAGMMLKGMTAEYLLNRTFKVARDTTLLFHAAAGGVGLIAGQWARHLGATVIGTAGSPEKCELAKANGYDHVINYREEDFVERVADLTDGKKCDVVYDSVGKDTFEGSLDCVKRLGMIVTFGQSSGVVPPVSTGVLNKKGSLFLTRPSLFNYTATREELLDCAKNLFSMVKSGAVKIEIGQTYPLSEAVQAHRDLQGRKTTGTTILTIG

SEQ ID NO: 75862 - protein, 641 aa, Rhodobacter capsulatus
MSATPSRTPHLDRVTGPADLKAMSIADLTALASEVRREIVEVVSQTGGHLGSSLGVVELTVALHAVFNSPGDKLIWDVGHQCYPHKILTGRRSRMLTLRQAGGISGFPKRSESPHDAFGAGHSSTSISAALGFAVGRELGQPVGDTIAIIGDGSITAGMAYEALNHAGHLKSRMFVILNDNDMSIAPPVGALQHYLNTIARQAPFAALKAAAEGIEMHLPGPVRDGARRARQMVTAMPGGATLFEELGFDYIGPVDGHDMAELVETLRVTRARASGPVLIHVCTTKGKGYAPAEGAEDKLHGVSKFDIETGKQKKSIPNAPNYTAVFGERLTEEAARDQAIVAVTAAMPTGTGLDIMQKRFPRRVFDVGIAEQHAVTFAAGMAAAGLKPFLALYSSFVQRGYDQLVHDVALQNLPVRLMIDRAGLVGQDGATHAGAFDVSMLANLPNFTVMAAADEAELCHMVVTAAAHDSGPIALRYPRGEGRGVEMPERGEVLEIGKGRVMTEGTEVAILSFGAHLAQALKAAEMLEAEGVSTTVADARFCRPLDTDLIDRLIEGHAALITLEQGAMGGFGAMVLHYLARTGQLEKGRAIRTMTLPDCYIDHGSPEEMYAWAGLTANDIRDTALAAARPSKSVRIVHSA

SEQ ID NO: 75863 - protein, 259 aa, Echinochloa crus-galli var. formosensis
AGPIFNDYSSVGYSFLLKKDKAIIVQPERVIVGNGPAFGCVMMKEFLSELAKRLKKNTTAYENYKRIFVPEGSPLESEPNEPLRVNVLFKHIQKMLTGDSAVIAETGDSWFNCQKLKLPEGCGYEFQMQYGSIGWSVGALLGYAQGANDKRVIACIGDGSFQVTAQDVSTMLRCAQNSIIFLINNGGYTIEVEIHDGPYNVIKNWNYTGLVDAIHNGEGKCWTSKVKCEEELTAAIETALGEKKDCLCFIEVIVHKDDT

SEQ ID NO: 75864 - protein, 263 aa, Synechococcus elongatus PCC 7942
MGEVRRHLKLVNGLARSEQSAVRRIIIAGNWKMYKTQAEALEFLQAFLPQLSETPESRKVVLCAPFTTLSSLSKTLHGSRVRVGAQNIHWAKEGAFTGEISGAMLTEIGVRYVVVGHSERRQYFGETDETVNQRLLAAQSFGLLPILCVGESKQQRDAGETEAVISRQLERGLVGADQTNLVIAYEPIWAIGTGDTCAAEEANRVIGLIRSQLKDTDVPIQYGGSVKPENIDEIMAQPEIDGALVGGASLEAESFARIVNYQS

SEQ ID NO: 75865 - protein, 379 aa, Cucumis melo
MSTAGQVIKCKAAVAREAGKPLVIEKVEVAPPQANEVRLKILFTSLCHTDVYFWEAKGQTPLFPRIFGHKAGGIVESVGEGVKDLQPGDHVLPIFTGECGDCSHCQSEESNMCDLLRINTDRGVMINDGKTRFSKNGQPIHHFVGTSTFSEYTVVHVGCLAKINPAAPLDKVCVLSCGISTGLGATLNVAKPKKGQSVAIFGLGVVGLAAAEGARIAGASRIIGVDLNPARFEEAKKFGCNEFVNPKDHNKPVQEVIAEMTNGGVDRSVECTGSIQAMIAAFECVHDGWGVAVLVGVPNKDDAFKTHPMNFLNERTLKGTFFGNYKPRTDIPGVVEKYLSKELELEKFITHTVSFSEINKAFDYMLKGESIRCIIRMDN

SEQ ID NO: 75866 - protein, 470 aa, Vibrio fischeri ES114
MKKTKIVCTIGPKTESVEKLTELANAGMNVMRLNFSHGDFAEHGQRIDNVRQVMKNTGKQLAILLDTKGPEIRTIKLENGDDVALVAGQDFTFTTDTSVVGNKDVVAVTYPGFANDLEVGNTILVDDGLIEMEVVATTETEVKCKVLNNGDLGENKGVNLPGVSVQLPALSEKDKADLKFGCEQGVDFVAASFIRKEEDVKEIRELLVANGGENIQIISKIENQEGVDNFDSILEASDGIMVARGDLGVEIPVEEVIFAQKMMIEKCNRARKVVITATQMLDSMIKNPRPTRAEAGDVANAIMDGTDAVMLSGESAKGKYPVEAVTIMAQICARTDAALKAELGSRLDSPRLRITEAVCKGAVDTAEKLNAPVIVVATEAGKSARSIRKYFPTAKIIAVTTNTKTAAQLCLSKGITPMIVDSIDSTDAFYLRGKELALESGIGAKGDIVVMVSGALVPSGTTNTASVHVL

SEQ ID NO: 75867 - protein, 177 aa, Echinochloa crus-galli var. formosensis
YYEAGARLAKWRAVLNIGPNEPSQLAIDQNAQGLARYAIICQENGLVPIVEPEILVDGPHDIERCAYVTEKVLAACYKALNEHHVLLEGSLLKPNMVTPGSDAKKVANEVIAEYTVRALQRTVPAAVPAIVFLSGGQSEEEATLNLNAMNKLNTKKPWSLSFSFGRALQASTLKAWS

SEQ ID NO: 75868 - protein, 547 aa, Synechococcus elongatus PCC 7942
MSHTRGRSLPLLPVLPFLLADLSLAAVTAKPEPSADLATTLTICLLGATLVALISRRFRIPYVTGLVLAGLTITNLLPRRLGIDSGLILNLFLPILVFQAAINTDISRLRSSFAPISVLAGPGILLATGVTASVLKFGLNLDWIPALLVGSILAITDTVSVIAVFREIAVPSRLTTIVEGESLFNDGVALVIFGLIVELQAGEQVTAISAVQSFFLVVLGGGLLGLATGYLASGLFRTLADDSLSGILLTVAVAFGTFQLGEALNVSGVVAVVVAGLTVGNLALDRAQSPSSRLTLINFWEYAAFCVNTFIFLFIGVEVDPRSLLQTLPAVLLAIVAYQLARLVTVYPLMALVNRFDRPIPFRWQHVLFLGNIKGSLSMVLALSLPATLGNRSELVNLVFGVVLLSLVVQGLSLPWFVKRLKVATRSTRSQEAEQLQAQLIAGKAVQSELLNLYDAGVLPKAVHEELRARYQLAIAGAEQSLRGLYNRRSTNLRNSAAPAFSSLQRRLLLVEKNALLDSARKGILTEEAIADRLQVIDAELLRAEAD

SEQ ID NO: 75869 - protein, 164 aa, Vibrio fischeri ES114
MRHIISLLLENEPGSLSRVVGLFSQRGYNIESLTVSPTEDQTLSRLNITTASDAMELEQIQKQLHKLIDVIKVQEVTEADYVERELLLVKVKASGFARAEVKRTADIFRGQIVDVTSSLYTIQLAGTSEKLDAFISAVSEVTDVVEVARSGVVGIARGDKALKV

SEQ ID NO: 75870 - protein, 615 aa, Arabidopsis thaliana
  misc_feature (259)..(259): Xaa can be any naturally occurring amino acid
MAILSIKLPIHIHPLSLSFRFHDRCEGCSFRNQGEYYGGYRCNDSDCNRVLFHKECAESPLEINHPSHPEHPLRLTERPPRYECDICGIHHLADVPYFYHCSICDFNVDTSCARKPPPPPTHDFQDLPFVFPKISGIYNCCGVCGHSVVAGKYYYSLPSRDQYAHLECIYHEKKVNLPFHPNHPLELTISKSLPDDAEKACVLCGVRSEIVMYYCLICDFSMCLNCVRSPPPLTAKSLIYVFNVMLWSIEVVLAYRMSXIINRHVHRITLTNHIGPGYNVWDGIELEGIPEEAEDLPFKVVGDNLINHFSHEKHNLRLTNEDIIYDESSRCEACIFPRNSGSIYCCDQCTFFLHEKCAHLPMKRRHLIYNRPFTLHARGKDLQIDWFSCDACGKQSTGFSSVSEPFVHDGHVHPLYYKEEASTKCDSCHKLSYNMLGCDVCDFSLDFCCANLPKTLKHKYDRHPLSLCYGEKASGKYCCDICETEMDPSKWFYTCDDCVVTFHIDCVFGDFSRFIAGSIFETIIYTFEVVPTKDTTRQLCSQCHSRCKTPFILKALSQTEDYCICSFKFDWSGGSGGCVVRLNLTCGCGVEDGGGGYIDDGRGNIDLVGVRVVDD

SEQ ID NO: 75871 - protein, 578 aa, Ralstonia solanacearum GMI1000
MNPKPGLRWGAAIASLWLTTSFVPSSYAASVAPVAAENGMVVAAQHLATRVGVDVLKRGGNAVDAAVAVGYALAVVYPAAGNLGGGGFMTIQLADGRKTFLDFREVAPKGATANMYLDKDGNVIKGLSTKGHLAVGVPGTVSGMEYAREKYGTRSRTELIAPAIRLADKGFALDQGDIDMLLTSTKDFQEDPASGAIFLNKGQPYQVGQKLVQRDLARTLHAISVKGTDGFYKGWVGKAIVASSQAGKGLITQEDLDGYKTRELAPVECDYRGYHVVSAPPPSSGGVVICEMLNILEGYPLKDLGYHSAQAVHYQIEAMRHAYVDRNSYLGDPDFVKNPLDRLLDKNYAAKIRAVIDPKKAGVSKDIKPGVEPHEGSNTTHYSIADRYGNAVSVTYTLNDWFGAKVTAAKTGVILNDEMDDFTAKVGVPNLYGLVQGEANAIAPGKRPLSSMSPTIVTRDGKPVMVVGTPGGSRIITAVLQTMLNAIDYGMNVQEAVDMPRFHQQWLPDLTNVENYTLSPDTRQILEGMGHKFGPPQPANHLAAIIVGAPSLEGKPVGRNRFYGANDPRRNTGLAAGY

SEQ ID NO: 75872 - protein, 183 aa, Cryptococcus neoformans var. neoformans B-3501A
MGVTFSSLWSRLFARKETKVLLIGLDNAGKSTILYRITTGAVVASAPTVGSNHEIYDYKGVRFGLIDIGGQTSLRSSWSQYFNGTEAVILVIDSCDGPRLGLVKQELMKIVADESLSTALLLVLANKQDLPVSQGRLTPAQISEALSLTDLRQREWQIMGCSALTGAGLMEGMDWLVTKLAAR

SEQ ID NO: 75873 - protein, 324 aa, Ralstonia solanacearum GMI1000
MAIRDGFSGSIGNTPLIRLARLSEETGCEILGKAEFLNPGGSVKDRAALYIIRDAERRGTLRAGGTVVEGTAGNTGIGLAHLCAARGYRCVIVIPETQSPEKMDLLRALGAEVRPVPAVPYKDPNNYQKIAGRLAQETANAIWANQFDNLVNRQAHYETTGPEIWRDTAGRVDAFVCATGTGGTLAGVARYLKEQNPAVRTVLADPHGSGLYSFVKTGSIQAEGSSITEGIGSTRVTANLEGTPIDDAVRIDDQTCVTMVYRLLREEGLFVGGSTGINVAAAVQLARELGPGHTIVTLLCDRGNLYFARLFNGAWLAQKGLVAG

SEQ ID NO: 75874 - protein, 884 aa, Oryza sativa Japonica Group
MKRVSSHVSIASEAEINLDLSRLLIDKPRLTLERKRSFDEQSWSELSHRQNDGFDSIMHSPAFPSGFDSPFSLGTLGDPHPLVNEAWEALRKSVVYFRGQPVGTIAAVDHASEEVLNYDQVFVRDFFPSALAFLMNNETDIVKNFLLKTLHLQSSEKMVDRFKLGAGAMPASFKVDRNRNRNTETLVADFGESAIGRVAPVDSGFWWIILLRAYTKYTADTSLAESPECQNCMRLILNLCLSEGFDTFPTLLCTDGCSMIDRRMGIYGYPIEIQALFYMALRCALQMLKPDGEGKDFIEKIGQRLHALTYHMRNYFWLDFPHLNNIYRYKTEEYSHTAVNKFNVIPDSIPDWVFDFMPCRGGYFLGNVSPAMMDFRWFALGNCIAIISSLATPEQSVAIMDLIEERWEELVGEMPLKICYPAIENHEWRIITGCDPKNTRWSYHNGGSWPVLLWLLTAACIKTGRPQMAKRAIELAESRLLKDGWPEYYDGKLGRFIGKQARKFQTWSIAGYLVARMMLEDPSTLMMISMEEDRPVKPTMRRQDHRGGLPLLVRPSRPRLPPPRVATGGVGAKLPLLTVRRLRIRSSSLPALDVRRRCPRRLRAPRDALPEGRVPTIRDRLLLLQCRRRRRGPTTAAAVVVALPTYQGTNTKPPRLRGGSTGLLVRRCGDDDDDELVVAALLTEEYRRRDTLEGAELVVLRSGEWSATPIAPIVHDDGKGEELSYWETDMAVPVGDRLLCYVDLYRGVILCGDDLFDEIPPRLQYVSLPVEAPAGAFDEEHFDRQGDNYRRCLLNTRTVVCAIDGGGAALKFVDISSRCCCGSLGKHTTCDRSSRAFVIRTWTLRIDGDGDDDMAWTMDAMIDAAELGPSTPTPPSHGAFHYTP

SEQ ID NO: 75875 - protein, 279 aa, Triticum aestivum
  misc_feature (164)..(174): Xaa can be any naturally occurring amino acid
AYLGDTIEQVCTKKLAGTGPEFPGYRRPTRPALQGRFYSGRPIIVEYSPVTDFREATCRQFEENSCNRGGYCNFMHVKQIGRELRRKLYGGRSRRSHGRSRSPSPQHRRDNRDRGGDFRRDGRDEYRGGGGGGGGGYRGGDGGDGGGYRGGGGGGGYRGGDGGXXXXXXXXXXXWCVWGWWLVCVFFFVGFSLPSSFFPPSFSFLFSFFFPFSPLFLSLLSLSPSPPSSLLSLLSLSLVFSLSVLPPPPFSPPLPLLLSLSYLSLLRPFSSLLSSPSLL

SEQ ID NO: 75876 - protein, 188 aa, Prochlorococcus marinus str. MIT 9313
MTGSSPSSTLGQGQRLILLFTALGLAVVLFLLRGGLNAEAPLEQLARRSLDPDVALTNGRPTVIEFYADWCQACREMAPAMLKTERDREDQLDVVLVNVDNPRWQDLVDRYDVNGIPQLNFFDNKGKLQGLSLGARTQEQLQQLTDALIQNQPLPNFAGVGAISNLNASQERTEKQNDLEAIRPMSHG

SEQ ID NO: 75877 - protein, 230 aa, Oryza sativa Japonica Group
MPAVKWLMHWHPNQGATLNSQILAEACACAESLGGSKDGRWKTSIIFYRAMARDGASAAAAGGGGPPQQHPDVPRELLGVALHERPGLYFSILRAHRLVLQADSAFPQVMEKLQSYKARVTLNFEGFQYQLGDFCLRIGKCVPNNSETLRGIMMEVEYYPLSSIEKSRAVMEDFFDIWQETVAKKSLPGHFIHVESNFSEYGLSDHYSFQHTAVQYATCLQQLMAAVRPQ

SEQ ID NO: 75878 - protein, 486 aa, Bradyrhizobium sp. ORS278
MNANVKLPAAKGVFIDNKWQPAQSGRTIAMLAPATGQVIASIAAGDKADVDLAVAAARRALEGPWGRLTAVERGRLLSRLGRLVEDNAEALAKLEAADTGKPMKQAKADVVAVARYFEYYGGAADKVHGDTIPFLDGFFVTTVYEPLGVTGHIIPWNYPGQMFGRTVAPALAMGNATVIKPAEEACLVPLRLAELAAEAGFPAGAVNVVPGLGEEAGAALSAHDGIDFISFTGSPEVGTLVQTAAARNHIGCTLELGGKSPQIVFADADLDAALTSVAAAIVQNAGQTCSAGSRVLVERSMWDRFLSELKLRFEKVTAGTPEMDLDLGPVISAVQKKRIEGMLARAESGGATRVASGRIADGVPSEGFYVAPALYQHVDRNSELAREEVFGPVLAAMPFDDEADAIRLANGTDFGLVAGVWSGDGSRAMRVARKVKVGQMFVNGYGAGGGIELPFGGMKKSGHGREKGFEALYEFGAMKTLIVKHG

SEQ ID NO: 75879 - protein, 329 aa, Nitrosomonas europaea ATCC 19718
MNIAVLGAGAWGTALAICLSARHRVTLWTRNVEHLAELAALRTNQRYLPRQPLPDSIHLVSALSEALERAELVFVVVPVAGLRTTLQQMVALNPSLPLILACKGFETGSAKLPCQVVEEVYPASITCGVLSGPSFAREVAQGLPAALTLASHDEIFARSVAGEIRTASLRVYSGNDVIGVEVGGALKNVIAIAAGISDGIAFGNNARAALITRGLAEITRLGMALGGCRETFTGLTGIGDLILTCTGNLSRNRRVGMMLAAGRQLAEILPEIGHVTEGVYTVREAYGLGQRLQIDMPVTQAVYSILYEQVPVEIAIQDMLDREPGAETD

SEQ ID NO: 75880 - protein, 415 aa, Vibrio fischeri ES114
MSEEFRKQALDYHAYPTPGKIEVALTKPADTVEDLALAYSPGVAEPVREIAKNPDDVYKYTSKGNMVAVISNGTAILGLGNLGPLASKPVMEGKSLLFKRFAGLDSIDIEVKHRTIDEFVDTVANIADTFGGINLEDIKAPDCFEIERRLIEICDVPVFHDDQHGTAIVTAAGMLNAIELQGKKLEDAIIVCLGAGAAAVACMELLIKCGAMREKIYMLDRKGVIHTRRDDINEYKQRFANNTDKRTLQDVIEGADLFLGVSGPNLLDAEDLKLMADKPVVFACSNPDPEIKPELAHEVRSDLIMGTGRSDYPNQVNNVLCFPFIFRGALDVRASEINDEMKLAAVEAIRQLAKEEVPVEVLKAAGVESLTFGSDYIIPKPMDPRLLPRVAKAVAQAAVDSGVARIEMPKGYMEA

SEQ ID NO: 75881 - protein, 408 aa, Oryza sativa Japonica Group
MVSGGGVAAENGEMVGNGEGRKGAGASVLVTGGAGYIGTHTVLRLLEKGFAVTVVDNFHNSVPEALDRVRLIAGAALSARLDFIAVRDSPKQHACSSSCTVELNRAGEVEIEIHVCVRFQGDLKSKDDMEKVFAAKRYDAVIHFAGLKAVGESVAHPQMYYENNVAGTMNLYSAMTKYGCKKIVFSSSATVYGQPEKTPCVEDSKLSALNPYGTTKLVLENYFRQVQAADPEMRVILLRYFNPIGAHRSGDIGEDPRGIPNNLLPYIQQVAVGRRPELNVYGVDYPTRDGTAIRDYIHVVDLADGHIAALEKLFATPDIGCVAYNLGTGCGTTVLEVVKAFEEASGKKIPIKICPRRPGDCTEVYASTDKAKKELGWSARFGIEDMCRDQWNWAKKNPYGYSANAEQN

SEQ ID NO: 75882 - protein, 396 aa, Oryza sativa Japonica Group
MPLSYSAAAAAAPSPLAARSRGLLRRPPRSSPVVVRCKKIDQLRAVNGIPPYAPVSNRSLLSPVTLPIIRDANIKNDTRLRIFSGTANPSLSQEIASYLGLELGKINIKRFADGEIYVQLQESVRGCDVFLVQPTCPPANENLMELLIMIDACRRASAKNITAVIPYFGYARADRKSQGRESIAAKLVANMITEAGANRVLVCDLHSSQAMGYFDIPVDHVYGQPVILDYLASKTICSDDLVVVSPDVGGVARARAFAKKLSDAPLAIVDKRRHGHNVAEVMNLIGDVRGKVAVMMDDMIDTAGTIAKGAELLHQEGAREVYACCTHAVFSPPAIERLSSGLFQEVIITNTIPLKEDKSFPQLTILSVANLLGETIWRVHDDCSVGHEPYSSLDID

SEQ ID NO: 75883 - protein, 527 aa, Arabidopsis thaliana
MGQAPSSTAESNGRELDLRLWSPVIVAGGESMAVGNVVDRDFTGDLPDECLAHVFQFLGAGDRKRCSLVCKRWLLVDGQSRHRLSLDAKDEISSFLTSMFNRFDSVTKLALRCDRKSVSLSDEALAMISVRCLNLTRVKLRGCREITDLGMEDFAKNCKNLKKLSVGSCNFGAKGVNAMLEHCKLLEELSVKRLRGIHEAAELIHLPDDASSSSLRSICLKELVNGQVFEPLLATTRTLKTLKIIRCLGDWDKVLQMIANGKSSLSEIHLERLQVSDIGLSAISKCSNVETLHIVKTPECSNFGLIYVAERCKLLRKLHIDGWRTNRIGDEGLLSVAKHCLNLQELVLIGVNATHMSLAAIASNCEKLERLALCGSGTIGDTEIACIARKCGALRKFCIKGCPVSDRGIEALAVGCPNLVKLKVKKCKVVTGEIGDWLREQRRTLVVSMDGDETEAVVVVDGEVETVVEEPRVAQAGGIVAEIGSSNGGGGSRLAMIRSKLGFLAGRNLVTCTFRRWSHNDNASSST

SEQ ID NO: 75884 - protein, 460 aa, Pseudomonas fluorescens Pf-5
MSPRRLFFAGKPAPTRPAYTLNSRHCCLELLMREELNQGLIDFLKASPTPFHATASLVQRLEAAGYQRLDEREPWTTEANGRYYVTRNDSSIVAFKLGRHSPLQGGIRLVGAHTDSPCLRVKPQPELQRQGFWQLGVEVYGGALLAPWFDRDLSLAGRVTFRRDGKVESQLIDFKAPIAIIPNLAIHLNREANQGWAINAQNELPPILAQFAGDERVDFRAVLTDQLAREHGLNADVVLDYELSFYDTQSAAVIGLHGDFIAGARLDNLLSCYAGLQALLTADSEETCVLVCNDHEEVGSCSACGADGPMLEQTLRRLLPEGDEFVRTIQRSLLISADNAHGVHPNYADKHDANHGPKLNAGPVIKVNSNQRYATNSETAGFFRHLCMAEEVPVQSFVVRSDMGCGSTIGPITASHLGVRTVDIGLPTFAMHSIRELCGSHDLAHLVKVLSAFYASHELP

SEQ ID NO: 75885 - protein, 134 aa, Oryza sativa
  misc_feature (101)..(101): Xaa can be any naturally occurring amino acid
GYEFQMQYGSIGWSVGALLGYAQGAKDKRVIACIGDGSFQVTAQDVSTMIRCAQNSIIFLINNGGYTIEVEIHDGPYNVIKNWNYTGLVDAIHNGEGKCWXFIEVIAHKDDTSKELLEWGSRVSAANSRPPNPQ

SEQ ID NO: 75886 - protein, 212 aa, Glycine max
MITTAILIEENGTGTNNYKRYEVTMGNYTIQTLVTASPSQVGSWLSSNIRNNADDLMIVGLDVEWKPNTRPNMQPPNPVATLQLCIGHNCLIFQILYAPLIPRALSSFLNNPDVIFVGVGIQEDADKLLRDYNLRVTNVGELRSLAAEELQVFQLQWAGLAALGHYVLGFEIDKPENVTMSRWDNRYLTDEQVAYAAIDAFVSGEIGRALID

SEQ ID NO: 75887 - protein, 212 aa, Glycine max
MSDENGEEPRENRPVPRLNERILSSLSRRSVAAHPWHDLEIGPGAPMIFNCVVEITKGSKVKYELDKKTGLIKVDRILYSSVVYPHNYGFIPRTLCEDNDPIDVLVLMQEPVLPGCFLRARAIGLMPMIDQGEKDDKIIAVCADDPEFKHYTDLTELPPHRLMEIRRFFEDYKKNENKEVAVNDFLPASTAVESIQYSMDLYAEYILHTLRR

SEQ ID NO: 75888 - protein, 334 aa, Frankia sp. EAN1pec
MPVTKAVIPAAGLGTRFLPATKSVPKEMLPVVDRPAIEYVVEEASRAGLRDVLLVTSRTKKAIEDHFDREGDVEAALERKGDKVRLERVRASAELAEVHSVRQPSPRGLGHAVLCASAHVGDEPFAVLLGDDLIDERDPLLVEMLAVQERHGGAVVALMEVPEEAVSMYGVATIAPTAAAPASAAPASAVSAVSAASVERVSAGGSGGRYRTVRITDLVEKPPVDEAPSNLAVIGRYVLPAEIFDVLRATPPGRGDEIQLTDALRTLAERAGADPGAEIPVHGVVFTGRRYDTGDRVDYLKAVVRLACERPDLGPEFYPWLEEYVASGGPKAEC

SEQ ID NO: 75889 - protein, 340 aa, Fulvimarina pelagi HTCC2506
MSGFADRAVSADQASIASTDTPFVRYRTKRDNPRRLLMIRNFTAEDVTDQSGRTFFVTGANSGIGLETARVLAAKGARVLLGCRTEAKALSAMADIRLEHPNADLGFVPLDLADLGSVRGAAAKVKAEERIDVLVNNAGVMVPPLGRTKDGFELQFGVNHLGTFALTGLLLDQLFARPYARIVITSSIAHRSGEIDFDDIDAQADYNRLKRYRMSKLANLLHMYELDRRLRDAKADAIALACHPGVAATNLMRFLPGPAKLLMMPGRLLLNSAAEGAWPTLAAATSPKLDGGAYVGPSKRGETAGPAAIAKSAERARNSEIAERLWAVSEEKTGVEYRFA

SEQ ID NO: 75890 - protein, 316 aa, Herminiimonas arsenicoxydans
MALENLMVFTGNANPDLALGVAKHLGIPLGKAVVSKFSDGEIVVEINENVRGKDVFVLQSTCAPTNDNLMEIMLMVDALKRASAGRITAAIPYYGYARQDRRPRSARVAISAKVVANMLQEAGVERVLIMDLHADQIQGFFDIPVDNIYASPILLSDLVAKNYDDLLVVSPDVGGVVRARALAKRMNCDLAIIDKRRPKANVSEVMNIIGEVEGRNCVIMDDMVDTAGTLTKAAEVLKERGAKKVVAYCTHPVLSGPAIERITNSPLDELVVTDTIPLTDAAKACPKIRVLSCASLLAETFKRISTGDSVMSMFAE

SEQ ID NO: 75891 - protein, 264 aa, Vibrio fischeri ES114
MNNVNTLFSSLWQDYITRLSPSADQVHQLLSSGGDIVNDHIALRTFNLPKVGLSTLAAPFLAIGYKPCDEYEFIAKKLKAQHFEHPDPNAPLVFISELLVEKLSDDAQTIIKSLVEQVPAHYFATRDFLSSGRPWSLSFDQYKVLAKESEYASWLAAHGYGANHFTVYVNQLDGFDEVVDVNQHLRNAGFSINEVGGEVKGSPEVCLEQSSTMADKVIVKFSDGEFEIPGGFYEFAKRYELPNGELYKGFVAASADKIFESTDG

SEQ ID NO: 75892 - protein, 112 aa, Zea mays
  misc_feature (106)..(106): Xaa can be any naturally occurring amino acid
LGRLVKDMKIKSLEEIYLFSLPIKASEIIDFFLGASLKDEVFKIMPVQKQTRAGQRTRFKAFVAIADYNGHVGLGVKCSKEVATAIRGAIILAKLSIVRVRTGYWXGNKIGK

SEQ ID NO: 75893 - protein, 363 aa, Herminiimonas arsenicoxydans
MSLKCGIVGLPNVGKSTLFNALTKAGIPAENYPFCTIEPNVGMVEVPDPRLQALAEIVKPERILPATVEFVDIAGLVAGASKGEGLGNQFLAHIRETDAIVNVVRCFEDDNVIHVAGKINPLDDIEVIQTELALADMGTVEKAIHRENKKARSGDKDAGKLVALLERIMPHLDEAKPVRAMGLDKEEMELIKPLCLITAKPAMYVGNVSDSGFTNNPLLDQLTEYAKSQNAPVVAICAAIESEIAELDEADKKEFLADMGMEEPGLDRLIRAGFKLLGLQSYFTAGVKEVRAWTIHVGDTGPQAAGVIHTDFERGYIRAQTIAYEDFIKFKGEQGAKEAGKMRAEGKEYIVKDGDVLNFLFNV

SEQ ID NO: 75894 - protein, 283 aa, Herminiimonas arsenicoxydans
MPILTELNLYPIKSCAGISLREATLTPAGLMSQHIYDREWMIVDVNGQALTQREFPRMALIEPRIKADTMELRSPGMLRFEVLLDLPDPADEKIIRVKVWDDEVDAYDCDETTALWFSNALGTACRLVRFHPNAQRSANKEWTDGRDVPALFSDGFPMLVIGTGSLADLNEKLVAQGRSALPMNRFRPSMVFSDIAPFEEDFARQYKLGEASLKPVKPCPRCPIPSIDQATGEIGPDPLDILRTYRVDPKVDDSITFGMNTILLNGAGQVVRVGQHVDMELDF

SEQ ID NO: 75895 - protein, 357 aa, Desulfotalea psychrophila LSv54
MKKIAVLAGDGIGPEVMEQALKVLVAVQKKFGFELSFQHADVGGAAIDSHGVALPESTLTLCAESDAILFGSVGGPKWEHLPPAEQPERAALLPLRKHFDLFCNYRPARVFKSLTAACPLRADIIGDGFDILCVRELTSGIYFGTPKGREGAGEDEYAYDTMGYKRSEVRRIAHMAFAAARQRSGKVTSVDKANVLTTMVLWREVVLEVAKEYPDVKLNHIYVDNATMQLVRDPHQFDVMLCGNMFGDIISDEAAMLTGSMGLLASASLNTENFGLFEPAGGSAPDIAGQGIANPIAEILSAAMMLRYSLGYGEAADAIEAAVEKTLDRGICTADIAVDRSQAVNTAEMGDAIVAAL

SEQ ID NO: 75896 - protein, 467 aa, Mycobacterium leprae TN
MSILLFGVSHRSAPVSVLEQLSLDRSDQIKIVDRVLQSPLVTEAMVLSTCNRVEVYAVVEAFHAGLSVIGQVLSEYSAMSIGDLTKYAYVRYSEAAVEHLFTVASGLDSAVVGEQQVLGQVRRAYAAAEANRTVGQVLHEVAQRALSVGKRVHSETAIDAAGVSVVSVALGIAGRTLGGLAGRIAVVIGAGAMGALSSSYLTQANVGRIHVLNRSLSRARRLAGKIGESGVPADVWTLNHLDEALADADLVVSCTGAVSPVVSLADVHHALAAMRRDETTRPLVICDLGMPRDVDPAVAKLPGVWVVDVEGVQREPSARASAADVDAARRIVAAEVATYLTRQRMAEVAPTVTALRQRAADVVEAELLRLDHRLPGLESAQREEVARTVRRVVDKLLHAPTVRIKQLASAPGGDSYTEALRELFELDQTAVDAVATAGELPVMVSGFSDTTRYGTSPAQSSSKYHAE

SEQ ID NO: 75897 - protein, 515 aa, Glycine max
MASMAAIGSLNVPRSASSRSSFVGRKSVPRSLSFSASQLCGDKIPTDSVLLAPKIGRSPVIVTPKAVSDSQNSQTCLDPDASRSVLGIILGGGAGTRLYPLTKKRAKPAVPLGANYRLIDIPVSNCLNSNVSKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEARATAFGLMKIDEEGRIIEFAEKPKGEQLKAMKVDTTILGLDDERAKEMPYIASMGIYVVSKNVMLDLLREKFPGANDFGSEVIPGATSIGMRVQAYLYDGYWEDIGTIEAFYNANLGITKKPVPDFSFYDRSSPIYTQPRYLPPSKMLDADVTDSVIGEGCVIKNCKIHHSVVGLRSCISEGAIIEDTLLMGADYYETEADKRFLAAKGSVPIGIGRNSHIKRAIIDKNARIGENVKIINSDNVQEAARETDGYFIKSGIVTVIKDALIPSGTVI

SEQ ID NO: 75898 - protein, 372 aa, Medicago sativa
  misc_feature (1)..(1): Xaa can be any naturally occurring amino acid
  misc_feature (29)..(29): Xaa can be any naturally occurring amino acid
  misc_feature (63)..(63): Xaa can be any naturally occurring amino acid
  misc_feature (88)..(88): Xaa can be any naturally occurring amino acid
  misc_feature (118)..(118): Xaa can be any naturally occurring amino acid
  misc_feature (149)..(149): Xaa can be any naturally occurring amino acid
  misc_feature (175)..(175): Xaa can be any naturally occurring amino acid
  misc_feature (181)..(181): Xaa can be any naturally occurring amino acid
  misc_feature (189)..(189): Xaa can be any naturally occurring amino acid
  misc_feature (197)..(197): Xaa can be any naturally occurring amino acid
  misc_feature (200)..(200): Xaa can be any naturally occurring amino acid
  misc_feature (261)..(261): Xaa can be any naturally occurring amino acid
  misc_feature (271)..(271): Xaa can be any naturally occurring amino acid
  misc_feature (329)..(329): Xaa can be any naturally occurring amino acid
  misc_feature (368)..(368): Xaa can be any naturally occurring amino acid
XGNSYITKEDNQISATSEQTEDSACLSAXVLTTNLVYPAVLNAAIDLNLFEIIAKATPPGAFXSPSEIASKLPASTQHSDLPNRLDRXLRLLASYSVLTSTTRTIEDGGAERVYGLSXVGKYLVPDESRGYLASFTTFLCYPALLQVWXNFKEAVVDEDIDLFKNVHGVTKYEFXGKDKKXNQIFNKSXVDVCATEXKRXLEIYTGFEGISTLVDVGGGSGRNLELIISKYPLIKGINFDLPQVIENAPPLSGIEHVGGDXFASVPQGDAXILKAVCHNWSDEKCIEFLSNCHKALSPNGKVIIVEFILPEEPNTSEESKLVSTLDNLXFITVGGRERTEKQYEKLSKLSGFSKFQVACRAFNSLGVXEFYK

SEQ ID NO: 75899 - protein, 257 aa, Thiomicrospira crunogena XCL-2
MLMNTLKTELNDEELSRYSRQILLSEIDYAGQLKLAQSHAVIFGLGGLGSPASLYLASAGVGTLTLVDFDEVDDSNLQRQVIHREANIGQPKVLSAKENLQALNHHIDIHTVNHKLDETELEALIQSADIVLDCTDNFESRFALNRVCLKQKKPLVSGAAIRWEGQLTTYDFRQEDSPCYQCLYKEGQGQELTCSQNGVVAPMVGMVGSMQAMEAIKALIGLPTLVGKLMIMDGVTMQIRTLKLSKDPDCKTCHPPH

SEQ ID NO: 75900 - protein, 434 aa, Thiomicrospira crunogena XCL-2
MKLLVLGVNHETAPVDIREKVSFSPAQVQNALSELKSQGLANESVILSTCNRTEIYTTLKSQSPEKIRAWLHEYFELEEDSINSFLYEYADIEAIKHMMRVSSGLNSLVLGEPQILGQIKEAFHLAHKSDSVHQTLHALFQYIFKTAKQVRTDTAIGSSPVSVAFSAVALSKQFFGKLENQTALLLGAGETVELVARHLKESHIGNLIIANRTLSKAHQLTESLGGYAISLHEIDDHLHEADIVIASTASPTPILKTEMVANALKKRRNKPMFMIDIAVPRDIEPAIGNFSDTYLYTVDDLQEIIEENKRSRKDAALEAEEIVELQAENFMAQYQATQQISPIIQRYRQQAYTLKEHALQDALHHLENGGDPQELLTKLANQLTNKILHTPTTNLHHAGLNGQKEVIQAAEQILLTQQSDASDSSENENTHATS

SEQ ID NO: 75901 - protein, 336 aa, Debaryomyces hansenii CBS767
MSSVIQFVKSSQDFEAYLSKNKYVVANFTATWCGPCQQVKPIIDALYTDETNERIEIVRVDLDSHGDLASQYQVTSIPTFVFLESGKEVNRVTGANVPEFMKQFHSMKEKAASDEVATKRVGNGASSASVSTSAWKDIADKIPKGFEILNGSIYFGQFEALNALPLYKGENDSDVKNLFRLDYTKENSTVLSDADSQLLFYIPFTNISKVSSIVLKLRKDNKIASDVELELDEDDLKNECQNPSLIKVWLNQHSIMSFDDASADINAPHIEKIAESNDEIWYECKLKFVRFQNVQSLNILIDGDDEDYHTLLDKVIFIGVNGESKEQAKILKLDDE

SEQ ID NO: 75902 - protein, 321 aa, Thiomicrospira crunogena XCL-2
MAYKNVRLFAGNANVSLAESISSSIEIPLGKADVGRFSDGEIMVQINESVRGKDVYVLQPTCTPEPAVNLMELLVMIDALKRASAKRITAVVPYYGFARQDRRPHSARVPITARLAADMITVAGADRVITVDLHADQIQGFFDIPVDNIYGSPTLVADMRASGHIAEDNMMVVSPDMGGVVRARAVAKALGCEMAIIDKRRPKANVAQIMNIIGDVSGRDCILVDDMVDTAGTLCKAAEALKEHGANSVTAYVVHAVLSGPAVDNINKSCLTELVVTDTIPLSEAGLASEKIRRVSVASVLGETIRRVHQEESVSELMPIR

SEQ ID NO: 75903 - protein, 6148 aa, Streptomyces nanchangensis
MAGGSESEAAEFTARSAQPIAVVGMACRLPGAAGPAEFRAILRSGTEAVGAAAPDRPYAPPRGGFLDSVDRFDAGFFGVSPREAAVMDPQQRLMLELCWEALEDSGIVPARLDGSDAGVFVGAITDDYAVLSRAAGVDAATPETSTGLNRGMIANRVSYRLGLRGPSFTVDSGQSSSLVAVHLATESLRRGECSLALAGGVNLILAEDSTAAVERFGALSPDGRCYTFDARANGYVRGEGGGVVVLKRLTDAVADGDDILCVLAGSAVNNDGGGEGLTVPDRQGQEAVLTAAYEQAGISPNAVGYVELHGTGTPAGDPVEAAAVGAVLGAGRSAEQPLLVGSVKTNIGHLEGAAGIAGLLKAVLTVRHREIHASLNFTTPSTRIPMTELGLSVNTALRPWLSEAGPLIVGVSSFGMGGTNCHVVLTEWHGVAPVTAPGIRPNGTAVPLLITGRDEQALRDQAHHLGRHLDEHGPLRLKDVAHTLAAGRTAFEHRAVLLVREPQDMTDGLARLADGTPGPDLVRATATCSSLAFLFTGQGSQRPGMTAELYQSSSEYAAALDEVCAHLDPQLRVPLREVLFAAEGTAEAVLLDRTEFTQPALFAVEVALFRFAEHCGLVPRLLLGHSVGELAAAHVAGVLSLADACSLVAARGRLMQAQPATGAMAAIQATEKELAPFLDESVAAAALNGPASTVLAGDEEAVLAIAAHWAAKGRRTKRLRVSHAFHSPHMDGMLEEFHRVAGQLTFEAPRVPIVSNETGALLTEAEACSPEYWVRQARVTVRFLDGVRLLEEQGVTTLLELGPDGTLSSLARDCLRGVDAVSVPLLRGRTEPEEVVAALATLQVRGVPMHWERLATEEGARRVPLPTYPFQRRRHWLPDLVAQDSVPAPGRAAGQRSRPVNEPAPSAHAPRGDRTMRETVRAAVALVLGHDSPDDIPAHTTFRELGLSSLMLAEVGERLTEATGRRVPTTLLFDHPTPDALVRELTSGGAERPAALTTAPSAAHADDPVVVVGMACRLPGGIRSPEEFWQFMAADGDAISPLPTDRGWAVSGDFPAEGGFLADVAGFDAAFFGISPREALAMDPQQRLLLETSWEALERAGVDALSLRGSRTGVFVGASPSEYGPRLHEPSQADGHVLTGTAPSVLSGRVAYVLGLEGPALTVDTACSSSLVALHLAAQALRGGECDLALAGGVAVMATAGMFAEFARQGGLARDGRCKAFADGADGTGWGEGVGVLVLSRLSEARRCGYTVLAVVSGSAVNSDGASNGLTAPNGPSQQRVIRQALASAGLSPGDVDVVEAHGTGTALGDPIEAQALLATYGQERGAGRPLYVGSVKSNIGHVQAAAGVAGVIKSVLALRYGVLPRTLHVDVPSREVDWSAGAVELLTEAVEWLAGGRPRRVGVSAFGISGTNAHVILEEAPEGVEESAAGEVAGVVPWVVSARSEEGLRAQAARLVEHVVGGSGLGPVDVGWSLARSRAVLEHRAVVLGGDGEELVAGLRALCDGVLGPGVVRGVAGDGGTALLFTGQGAQRVGMGRELYEAFPVFAAAFDAVCAGFEGMLPGSLRGVVFGDGGGVVDRTEWAQPALFALEVALFELVVSWGVRADVLVGHSVGELVAAHVAGVWSLADACRVVAARGRLMQALPVGGAMVAVRVGEGELPVLPEGVSVAAVNGPRSLVLSGDEGPVLELAARLAGEGRDTRRLRVSHAFHSARMEPMLAEFAQVLAAVEFRAPRIPVISNVTGEVAGEELTTPEYWVRQVREAVRFADGVNTAHGSGVRRYLELGPDGVLTSLAHDILAEQGIDRDVAVVPALRHDQPESRTLLTALGQLHTTGMDVGWAAFLAPYGARTVELPTYAFEHHRYWLDPVAPASAPADPLRYRAEWASVPDCATPSLSGVQAVVVPAGGGHLDVLPDVTAALREHGARTVLVEVDPERADRAEIADALRAALGEEGGGVVSLLALDRGPFAGVAATAVLLQALTGLDGGGRLWSLTRGAVSVSRSDALTDPGQAQVWGMGRVAALEHPERWGGLVDLPTELDDRARARLCAVLSGSTGEDQVAVRAAGLYARRLHRVAPRVPTTEDAGAASGQGVGDRRAYTYGTVLVTGGTGALGAHIANWLARSGTRHVLLTSRRGPDAEGAADLTARLRELGTEVTVAACDVADRQRLADLIAALSADRPLTGVVHAAGVLDDGVLDSLTPDRFDAVARPKVIGARHLHELTRDLDLSLFVMFSSVVGTVGLAGQGNYAAANAYLDALAVHRAQHGLPATAVAWGSWSGAGMAGDTRAARDRLARAGLAPLDPAAALAVLDRVIADGETAVTVADVDWERFAAGFAPGRPHPLLAGIPELWHARPQETGQVTDGPADRLAGLAGDELRQALDDMVTVEVAAVLGFRAKDRVPTDRTFKSLGFDSLIGVEFRNRLAAALGRRLPPSLIYDHPTPGRLVEHLAAGVDGGDQPSTVGGRPVAPTRTHDDPVVIVSAACRFPGGVRTPEDLWQLVLDGGDAIGPFPVDRGWDLDRLYDPDPGASGTSYVREGGFLTGVADFDAVFFGISPREALAMDPQQRLLLETSWEALERAGIVPGSLAGSRTGVFVGSNGQDYANLLHSSDVEGHVLTGTASSVLSGRIAYTLGLEGPALTVDTACSSSLVALHLAVQALSSGECDLALAGGVTVMSGSDIFVEFSRQRGLSADGRCKAFGPDADGTGWAEGVGTVVLERLSDARRLGHEVLGVVRGTAVNQDGASNGLSAPSGRAQQRVIRQALADAGCAPSDVDAVEAHGTGTRLGDPIEAQALLTTYGQDRPADRPLYLGSIKSNIGHAQAAAGLAGVLKMLFALRHGQLPKTLHAPRPTPEVDWSEGAVALLTEDRPWPAVDRPRRAGVSAFGVSGTNAHVILEQAPPSAASDPAPTVRPPAVDSSVQPWVLTARSGEALGALADRLREAAPGAVPADVARSLVTTRTIWAERAVLLADGRDEYASGLAALATGEGDARVVRGTADTRGRVVFVFPGQGAQWAGMAARLWESSPEFARWMDRCDKALGDLTDWSLAEVIHQADGAPGLDRVDVLQPASWAVSVSLAALWRSCGVEPAAVVGHSQGEIAAACVAGALSLEDGAMLVTLRSRLIREELSGHGGMMSVALSPAGTADRIACWEGRICVAAHNSRRSTVVAGEPAALAELLAACEADGIRARRIPVDYASHSPQVERIERKLTELAAGIVSRSSEIPFHSTVTGTRLHTTGLDAGYWYRNLRKPVLFGPVTEELLTQGHDVFLEMSPHPVLVPAVQEASDAVTATAAAVGSLRRGDGGPERFLLSLAEAFVRGAHVDWAAVLGGTGTRLVELPTYPFQRTRFWPEPVTPATATGGQDDAPLWQAVERGDVAAVAAELAVPDGRSLRDLVPALSGWRRRRRDSATLDIWRYRVTWTQVNLPVSAAVTGDWLLVTDDPDTAVPRWVSAALGEGLATVVRPADVPAWSRTPQGTGWTGVVSLLGLTDHSHPCHPALSTGVAATVTLLTALREAGIEAPLWCLTSGAVGTGGLDQVTAPNQAQLWGLGRVAGLETPATWGGLVDLPAEPDERTAALLRAALTADGIEQEYALRPSGPYVRRLVRAPLAGVAAPRSWRPRPDGTVVVTGGTGALGARVARWLARAGAGHLLLTSRRGPAADGAVELSEELRALGAEVTITACDVADRAQLADVLAAVPTAFPVSAVIHTAGVSGNAPLAGTTLAELAEVVAAKAAGARNLDELLAGQDLDAFVLFSSGAAVWGSAGQGGYAAANAYADALAADRRRRGLVATSVAWGSWAGGGMVDDDLARELARGGVRSMDPDRAIAALQQALDHDETALTVSDMDWARFAETFTAARPRPLIDGIPEAAPASAEPAGDIPGLAARLAQLPDGERDRELLDLVRNAAALALGHTGTEPITPSKPFKELGFDSLTAVDLRNRLTAATGLRLPATLVFDYPTPRAAADALRAVLFAADMPVDTAAPARSASARPADDDPVVVVAMACRYPGGATTPEKFWDLIAAGEDGIGGFPTDRGWEIGPGAAFSRTGGFLADVAGFDAAFFGISPREALAMDPQQRLLLETSWEALERAGVDALSLRGSRTGVFVGASPSEYGTLVASLEGGQDYALTGAVGSVLSGRVAYVLGLEGPALTVDTACSSSLVALHLAAQALRGGECDLALAGGVAVMATPNAFDAFARQGGLARDGRCKAFADGADGTGWGEGVGVLVLSRLSEARRCGYTVLAVVSGSAVNSDGASNGLTAPNGPSQQRVIRQALASAGLSPGDVDVVEAHGTGTALGDPIEAQALLATYGQERGAGRPLYVGSVKSNIGHVQAAAGVAGVIKSVLALRYGVLPRTLHVDVPSREVDWSAGAVELLTEAVEWPAGGRPRRVGVSAFGISGTNAHVILEEAPEGVEESAAGEVAGVVPWVVSARSEEGLRAQAARLVEHVVGGSGLGPVDVGWSLARSRAVLEHRAVVLGGDGEELVAGLRALCDGVLGPGVVRGVAGDGGTALLFTGQGAQRVGMGRELYEAFPVFAAAFDAVCAGFEGMLPGSLRGVVFGDGGGVVDRTEWAQPALFALEVALFELVVSWGVRADVLVGHSVGELVAAHVAGVWSLADACRVVAARGRLMQALPVGGAMVAVRVGEGELPVLPEGVSVAAVNGPRSLVLSGDEGPVLELAARLAGEGRDTRRLRVSHAFHSARMEPMLAEFAQVLAAVEFRAPRIPVISNVTGEVAGEELTTPEYWVRQVREAVRFADGVNTALGRGVDKFLELGPSGPLTAMAEEVIEHTGTRAVCVPVLRAGRPEDATLLHALAAVFVTGATVGWTAPLAGTGARAVDLPTYAFQHKRYWPQPATVGRDLAAAGLAEAGHPLLTAWLPSPEGEDVLCTGRISLATHPWLADHAVLGTVLVPGTAFVDLACWAGHRVGCGALRELTLATPLALAQDMAVRLRLVLGAPDDTGCRPVALYSQQEGADEGTDGTGWTRHAEGLLAPGGDASVQPPTDFETWPVTGCEPIPLDGFYEELADAGFSYGPVFRGLRAAWRRGGQVFAEVSLPADETGGFGVHPALLDAALHALGPVSRDTDEPGSARLPFSWGEVRVHAAGADRLRVCLVRAEDGTVTLHGADAAGRPVVTVGSLVLRPISPERLHGGAAAFDDALFTTRWMPLSVADGIAYPTADCVLLGDPLERAWRHHPDLDSFAEALAAGKEKPGTVLARCPRDIAAGVDPAEAARRCAEWALDLLKRWLDDDRLTDCHLVIGTRHAVTTGAEDQTAGRTDDPAVLAQSTLLGLVRSAQTENPGRVTLADFDGTAPDPAHLILAVRQAEPEVAVRAGRLYARRLTRPDTGRALAVPPGAGSWRLESTGRGTLDNLALVPCAQAEEPLGEGMVRIAVRAAGVNFRDVLIVLDMYPGRADLGTECAGVVVETGHGVTGLVPGDRVMGMVAGAFAPTAVVDQRFLVRIPDGWSYETAAAIPVAFLTAYYGLVDLAGLSAGESVLVHAAAGGVGMAAVQLARHLGAEMYGTASEPKWDTLLDSGLDRAHIASSRTTVFADSVMEATGGAGVDVVLNSLAGEFVDASLRALPRGGRFVEMGKTDLRDPERVAAEHPGVRYRPFDLGEAGADRIAEVLAHLAELFASGELTPLPVTVWDIRDAPAAFRALSQAALTGKGVLTVPAPSFEAGETVLITGGTGTLGTLLARHLVTEHGLRHVILAGRRGTETAEVRHLRGDVAELGARIEVVACDAGDERALRQVLDALTAEHRLAGVVHAAGVTDDGVVSALDRGRLSAVLHPKVRGAWNLHRLTAGSELRMFVLFSSASATLGAAGQGNYAAANAFLDALAEHRHALGLPATSLAWGLWEQASGMTGRLLDRDRQRMSRSGIVPLSSAHGLALFDAARLAGLPTLTPARLDLAALRVRYAHEQVPAVLRELVRVRPSAAEDPTTAPDTTTAPGPSGAMTLADRLAGLSAPERQRHVLDLVRRHTAAVLGHGSADDVDPDQAFKALGFDSLTAVELRNHLRTATSLAVPATLVFDHPTPAALAAHLLELAAPPERDPALRVMGGLDRLEADVEALASGGAGHQEEVATRLRRVLRRLESGPGAAHSGTEETSLDTASATEVLAFIDSEFGDLA

SEQ ID NO: 75904 - protein, 219 aa, Clostridium perfringens ATCC 13124
MDIKENLTKFTEKIPSNVQLIAVSKTRTIEEMEEAYEFGIRKFGENKVQEIIRKFDEFHQDVEWHLIGHLQTNKVKYIVDKVHLIQSLDSIKLLKEIEKVYGKHNKIANTLIQVNIGREEQKYGILEEELDELIEAIEACNNVNVLGIMTIIPKGTEEECRKYFSKTHKLFCELKEKKFKNIKMDILSMGMSGDYEIAIEEGSNMVRIGQGIFGKRLYK

SEQ ID NO: 75905 - protein, 238 aa, Nitrosomonas europaea ATCC 19718
MTTIASRLQNVKNRIIEAAKKAGRDPESVQLLAASKTNTPDKLREAWEAGQTVFGENYLQEGLVKIRALSDLPIEWHFIGPIQSNKTKLIAENFSWVHGIDREKIATRLSAARPESLPPLQVCVQVNVSGEITKSGVDPEKAAELAAFVSEQPRLQLRGIMAVPELTAVTALQREQFQMMREVYEQLQQQGFNLDTLSMGMSEDLENAIAEGATMVRIGTAIFGPRRYAIPEELGSRQ

SEQ ID NO: 75906 - protein, 653 aa, Chlamydomonas reinhardtii
MAKDGSKDRQFKVLKFLGKGSYGSVFLVQRLADSQTYALKEMDVRSMSQAEREDSINEIRLLASVNHPNVVCYNEAFLDGNRLCIIMEYAADGDLAKVIKKQQMMKRPLPEDMIWKYFIQVVMGLQALHSMKILHRDIKPGNIMVFDNGVAKIGDLGIAKLLTKTAAAKTQIGTPHYMGPEIWKNRPYSYTSDTWAIGCLLYELAALAVPFEARSMSELRYKVLRGTYPPIPNTFSRDLQQMVRECLDPNPDKRPTMDQILASAAVASRAKLVPHESRHPPATAGSNLVETIKVPRGNIAAIRNKLPPAQYATDMLNIGNGPGGHAQMATIEEGSEDGTTGRLPPPHQPQYQQQLPVRAPPAAAVNRVPGGMPPMPPMPKPNYPPPMKAAAAYPPPAPSAAAGGKLPQLPGINGGGMQDVNAAAAAYNARLAAAGLRPPALNAVPPPAPPSHGGASAWSYAQAPGAGRGVSESHANYGAFYHNNQNGGYTPSSAAAARAQQQQPSPWQAGNKWPPQQGQGQGQQQQQQQQQQQQQQGPQSQYQSPYISPYGGQQQQQQQQQQRQYGGGGGGGGLHLPQLAQQRPQVAANSRPPPWNYGGQARRQQSNARAAAGIAGAGARPGGHYAGDLGGGGDARVPAYPPPQWAPRPARGW

SEQ ID NO: 75907 - protein, 145 aa, Triticum aestivum
  misc_feature (124)..(124): Xaa can be any naturally occurring amino acid
MASSADPWVREYGEAARLADDVAAMVADRAALPQSGPEVMRRTSAIRRKITILGTRLDSLEGMLARLPPKSITDKELNKHRDTLFNLKSRAKQMAESFNMSTFANREDLLGQSKKAADDMNRVXGLDNQGELLALQRAIHEKKPE

SEQ ID NO: 75908 - protein, 404 aa, Vibrio fischeri ES114
MTTNSQVERKDFNDVMVPCYNPMEVIPVKGEGARVWDQTGKDYIDFAGGIAVSCLGHCHPIMVNALQEQSQKLWHLSNVMTNEPAIRLAKKLTEVSFAEKVFFANSGAEANEAALKLARRWAVDVHSEEKSEIIAFKQGFHGRTFFTVTVGGQAAYSDGFGPKPGDITHLEYNNLAELEAHMSDKTCAVMMEPLQGEGGIVSPTSEFVKGVKALCEKYNALLIFDEVQTGNGRTGDFYAYQGLGVTPDILSTAKSLGGGFPIGAMLTTTELAQHLKVGTHGSTYGGNPLACAIAEAVVEEVSKPEVLNGVKEREQWFRSGLEALNAKYHMFSEIRGKGLLLGAALNEEWQGRARDILVAAGEQGLMVLVAGVNVVRFTPSLVITKEEVELGFERLDKALASLTK

SEQ ID NO: 75909 - protein, 392 aa, Symbiobacterium thermophilum IAM 14863
MALMTVRDIDVKGKRVFVRVDFNVPLEDGRITDDTRIRAAVPTIRYLVEEGAVAVLASHLGRPKGQRNEKYSLAPCARRLSELLGREVVFAPDCIGEEVERLVAEQPPGSVVLLENVRFYAEEEKNDPEFAAKLARLGEIFVNDAFGTAHRAHASTRGVADHMPVRVAGFLMQKEVDIMGKALSDPDRPFVAIIGGAKVSDKIMVIENLLTKVDRLIIGGGMANTFLRARGFATGKSLVEEDRVDTARELLAKGGDKILLPTDLVVASEFKADAEQKVVPVDAIPEGWMALDIGPETARAFADVIRGAHTVVWNGPMGVFEMEPFARGTFAVAQAMADCEGVTIVGGGDSVAAVEAAGLADRMTHVSTGGGASLEFLEGKELPGVACLAVKP

SEQ ID NO: 75910 - protein, 841 aa, Oryza sativa Japonica Group
MDDHQTQDLVKELVHRLISAESGGGGRDAGGALRFAHRLLSSRLAPAVLPDEHALAESVKRRLAASGRPDDALAFADLHAKLSARSRPASLWPLLYLLDSLSSHRRAAAAASCLPNLPTAAPPRAAGSGAAAAAAAAGGKPASRAPGAPPGGVVLVSKDPDNIREIALREYTELVLDETEVSEAALVRDVLYACQGIDGRYVRFDKGSDAYDLPDGVRVPRSTRTLVRKLCELGWLFRKVRGFISDNISRSPSDAATEVGTVAQAFCSALQEELSDYYKLLAVLESYSLNPIPTPGSDSGVSGNYLSLRRLAVWLAEPAVRMRLMAVLVDGCRGLRGGAMAGAIHGHAQHGDPTFQDFMGRLLRRVCSPLFEMVRSWVLEGELEDVFAEFFIVGQPVKAESLWQEGYLLQSDMLPAFISPVLAQRILRTGKSINFLKVCCDDNGWADAATEAAVCVGTTTSRGGLGYGQIDALEALVVEAAKRIDRHLMDVIHKRYRFKDHCLAIKRYLLLGQGDFVQYLMDVVGPELSEPANRISSFHLAGLLETAIRASNAQYDDRDILDRIKVKMMDHGDGDRGWDVFSLEYDARVPLDTVFTASVMKRYLKIFNFLWKLKRVDHSLTGIWKTMKPNCIVSSPFYKEGTNIRSQFVSVLRKCQVLFNEMNHFVTNFQYYIMFEVLEVSWARFSEEMDSAKDLDDLLLAHDKYLTSIVEKSLLGERSHGILRNLFALFDIILQFRSHADRWFERIYELQLRGKGKPKSKAKAKSKEVDSWVDGGRKAMIQLAGELFRKMGEDLDSIAKDYTSSLDAFIAQLPMQQHVDLKFLLFRLDFTEYYSRVSSNK

SEQ ID NO: 75911 - protein, 256 aa, Symbiobacterium thermophilum IAM 14863
MRTPIVAANWKMHKTQPEARQFLADFLPREAGMSGVEIVICPPFTALAAVAGGLTGTRVGLGAQNMSDKPSGAFTGEVSGAMLVDAGCRYVILGHSERRRLFGESDEVVGAKVRAALQHGLIPILCIGETLEEQQAGEADAVNRRQLLAGLEGLTPEQVANLVIAYEPVWAIGTGRNCDPGDAQARIAAVRAVVAEAFGPEAAARVRIQYGGSVKPENMAAYMAQPDIDGALVGGASLDPTSFAAICAAAAEARAR

SEQ ID NO: 75912 - protein, 547 aa, Rhodospirillum rubrum ATCC 11170
MPDPTTLSAWAALAAHAPTLSDQPLRVLFDADPDRFARFHLRFEDLVLDYSKNRITGETMALLADLARQSGVEARRDAMFAGEPINTTEGRAVLHVALRDPTPTPVLVDGADVKPAIAAVLAHMEAFSEAVRSGAWTGATGKAITDVVNIGIGGSDLGPVMVVEALKAYAKPGLRVHFVSNVDGTHIAETLKGLSPETTLFLVASKTFTTQETLTNAHTARDWLVGALGEPAVARHFAALSTNAKAVSAFGIDTANMFEFWDWVGGRYSLWSAIGLPIAISVGFANFRALLDGAHAMDTHFREAPIERNLPVILGLLGVWYGDFLGARAQAVLPYDQYLHRLAAYLQQADMESNGKRTTLDGKTVAYATGAVLFGEPGTNGQHSFYQLIHQGTSLIPCDFIAPAISHNPLGRHHAILLSNFLAQTEALMRGKTEAEARAELAAQGLAGEALEALLPHKVFPGNRPTNAILVKRLDPRTLGMLIALYEHKIHVQATVWNINAYDQWGVELGKQLAKAILPELEDATISPAHDSSTNGLIALYREFSAG

SEQ ID NO: 75913 - protein, 225 aa, Vibrio fischeri ES114
MKDFLIAPSILSADFARLGEDVEKVLASGADVVHFDVMDNHYVPNLTFGAPICKALRDYGITAPIDVHLMVKPVDSIVPEFAKAGATMITFHVEASEHIDRTLQLIKEHGCQAGVVLNPATPLSCLEYIMDKVDMILLMSVNPGFGGQSFIPNTLDKLRAVRKMIDESGRDIRLEIDGGVKVDNIREIAEAGADMFVAGSAIFNQPNYKEVIDEMRAELAKVKGN

SEQ ID NO: 75914 - protein, 517 aa, Symbiobacterium thermophilum IAM 14863
MSAYRRPVALIVLDGWGLNPDPRANAVAMARHPNFDRLMARYPHTTLTASGEAVGLLPGQMGDSNVGHLNLGAGRIVYQTLVRIWRSIQDGSFYTLPVWRPVLDRAKQPGKALHLMGLVSDGGVHSHIDHLLALIDLAKRENVERVYVHAFLDGRDVPPQSALPYLERVEAKLKETGIGAIATISGRYYAMDRDKRWDRTEKAFLAITQGIGHTAGSVAEAVERAYARGETDEFVQPTVIEGVDGRVREGDGVIFFNFRPDRARQLVRALHETAFDGFKRPEGYRPVELVTMTQYDQTFTDIPVAFGPQFVDVPMGQVVAEAGLRQLRIAETEKYAHVTYFFNGGEERVFPGEERVLVPSPKVATYDLKPEMSAYEVAREAVKWIEEDRTDFIVLNFANPDMVGHTGVLEAAIRAVEAVDECLGQVVDALLAKGGAAVIIADHGNCDQMVDYETGAPHTNHTLNPVPCILVDDQRLDAKLKPGVLANVAPTLLEIIGLPKPPQMDADSLLVSNAEGA

SEQ ID NO: 75915 - protein, 430 aa, Symbiobacterium thermophilum IAM 14863
MTTIVNVHAREVLDSRGNPTVEVEVILASGTTGRAIVPSGASTGQFEAVELRDGDKQRYLGKGVLTAVRNVNEVIAEAVVGMDATEQVEVDQAMLALDGTPNKSKLGANAILGVSLATARAAAAELGIPLYRHVGGLTARTLPVPMMNIINGGKHADNNVDMQEFMIFPAGAPSFAESLRMGTEVFHALKSVLKSKGYNTAVGDEGGFAPDLKSNEEAILVILEAIEKAGYKPGQDVFLCMDVASSELFQDGKYVLAGEGNKVLSTEQLIDLWDSWTRQYPIVSIEDGVAEDEWEAWVELTRRIGDRVQLVGDDFFVTNTERLARGIGMNAANAILVKVNQIGTLTETLEAVALAHRNGYSSVMSHRSGETEDTTIADLAVALNCGQIKTGAPSRTDRVAKYNQLLRIEEELGDAAIFAGTSVIRGRKQG

SEQ ID NO: 75916 - protein, 220 aa, Rickettsiella grylli
MYLRSLSKEKTNSLLVPMVVEQTGRGERAYDIYSRLLKDRIIFVVGPIEDHMANLIIAQMLFLESENPDKDISLYINSPGGVVTSGLAIYDTMQFIKPDVSTMCIGQAASAAALLLCGGTKGKRHCLPHARMMIHQPLGGYQGQATDIEIHTREMLLVRERINSIMSKHTGKNTEQILRDTDRDNFMGAQQAIDYGLIDAVLTMRSEERARESLVASSAD

SEQ ID NO: 75917 - protein, 481 aa, Populus tremula x Populus tremuloides
MVKICCIGAGYVGGPTMAVIALKCPSIEVVVVDIWEPRIAAWNSDQLPIYEPGLYDVVKECRGRNLFFSKDVEKHVAEADIVFVSVNTPTKTQGLGAGKAADLTYWESAARTIADVSKSDKIVVEKSTVPVKTAEAIEKILTHNSKGIKFQILSNPEFLAEGTAIGDLFQPDRVLIGGRETPEGQKAIQALKDVYAHWVPEDRILTTNLWSAELSKLAANAFLAQRISSVNAMSALCEATGADVAEVSYAVGKDSRIGPKFLNASVGFGGSCFQKDILNLVYICECNGLPEVAEYWKQVIKINDYQKSRFVNRVVSSMFNTVSQKKIAILGFAFKKDTGDTRETPAIDVCQGLLGDKALLSIYDPQVQKEHIQRDLIMKKFDWDHPLHLQPKSASSAVEQVTVTSDAYEATKEAHGVCILTEWDEFKTLDYNKIYDNMQKPAFVFDGRNVVNADKLREIGFIVYSIGKPLDAWLKDMPAIA

SEQ ID NO: 75918 - protein, 294 aa, Mycobacterium leprae TN
MLSSMARIAIIGGGSIGEALLSGLLRAGRQVKDLVVAERMPDRARYLADTYSVLVTSVTDAVENAMFVVVAVKPTDVESVMGDLVQAAAVANDSAEQVLVTVAAGVTITYLESKLPAGTPVVRAMPNAAALVGAGVTVLAKGRFVTGQQFEDVLAMFDAVGGVLTVPESQMDAVTAVSGSGPAYFFLLVEALVDAGVAVGLTRQVATELAAQTMAGSAAMLLERMDQDRHSAEVAPLGAQVDVPAAQLRATITSPGGTTAAALRELERGGLRMVVDAAVQAAKIRSEQLRITSE

SEQ ID NO: 75919 - protein, 423 aa, Rickettsiella grylli
MGKQRVLTDELLLSENHNLTNNFIEREQQYGATNYDPLPVVLSRGLGAELWDVSGKRYIDMMSAYSAVSHGHSHPRLVNVLTQQAQRLAICSRAFYSDKLGAFLKRICALTQMDCALPMNTGVEAVETAIKAARKWAYTVKKVAENQAEIIVCRGNFHGRTTTVVGMSSKPQYQYGFGPFASGFKLIEYGSATALSSAITPNTAAFLVEPIQGERGIIVPPHAYLKAVEKICRENNVLLILDEIQTGLGRTGRFLACEHENVKPDGLILGKALGGGLLPVSLFLSRRDVMQVFAPGDHGSTFGGNPLAATVALEALNVLIDENLIQRSKELGEYLLQNLLKITSPVIKEVRGQGLFIGLELDSRYAKGRDIVLKLLDQGLLSYETHDTVIRLAPPLVISKDQLDEALTLLKQVVSTYTIQISR

SEQ ID NO: 75920 - protein, 940 aa, Cryptococcus neoformans var. neoformans JEC21
MQTPAHHGHRLHGHGAVIREDFCSFCGGTDAINKQGVQETMVSCAACGRSGHPTCLNMLTPKLRKRVMMYDWHCIECKTCEQCAIKGDDSRLMFCDTCDRGWHSYCLNPPLAKPPKGSWHCPKCLSPPAVSSGSISNPRSATRPSKLHPRPSKPGKARPANTPNTSNNRRRPKQSLAGDDALFTSHRIKVKVPNPNYQYRDSEEGRGTPMIVRLKVPKRPVEEEPEEKKIPYGGVITGDDADTTRTKITEADKEAYQMAKNAAEKQLGGPVPTRETPGPGSPLPMASPSGKTTPSSKFPATSRPLRDRLLHQTLPDAYPFPSTPGTTQEVVPWTGSARLEKIKTIRFGPYDINTWYSAPYPEEYAYVPDGRLWLCEFCLKYMKSGFAATRHRLKCKSRHPPGDEIYREGAVSVFEVDGRKNKIYCQNLCLLAKMFLDHKTLYYDVEPFLFYVMTEVDELGARFVGYFSKEKRSMDNNVSCIMTLPVRQRKGWGQLLIDFSYLLSKKEGRTGSPEKPLSGLGAVSYKSYWRLTVFKYLLNAISPSFNHTLELPPVPDATPGPTSELDFNSNTETKPTPPRITSKDISKATSMTLEDIFTTLSAEGMINVLDDLTVDAIGKTPNSARTRGRSRGRPNVNRRKADLNGSGTLDPQIHQDEDDHVKLPKRYEILLDKAYLQAVVEKHEKKGYLKLAPERLKYHPFLVARQTEEPESGGKKEDENEENGNEKDKEREDESENGVVRFVDSIAEAAHIIAQSHAHFHTVPSSTISRTSHHPVYPTPTPNHNSIPNRNTTSPARNLRKRKSDVVLETPVRKLRSRDNIREGMGTSPRTLRMRNAVALGEGIAEGEEENQGLSKLNQLPVKPVTQFADGEIPIDPALLEESVTLDPSMYGSVGEEVYDNDAEGEEYIGEDDDAEGEEYIGEEEDAEGEADEEYIDYDV

SEQ ID NO: 75921 - protein, 373 aa, Solanum peruvianum
MVDANMGAAQFPDFPKIVTHAGQYVQYDIFGNLFEITNKYQPPIMPIGRGAYGIVCSVFNAELNEMVAVKKIANAFDNYMDAKRTLREIKLLRHLDHENVIGLRDVIPPPLRREFSDVYIATELMDTDLHQIIRSNQGLSEDHCQYFMYQLLRGLKYIHSAHVIHRDLKPSNLLLNANCDLKICDFGLARPNVENENMTEYVVTRWYRAPELLLNSSDYTAAIDVWSVGCIFMELMNRKPLFAGKDHVHQIRLLTELLGTPTESDLSFLRNEDAKRYVRQLPQHPRQQLATVFPHVNPLAIDLVDKMLTLDPTRRITVEEALAHPYLAKLHDAADEPVCPIPFSFDFEQQGIGEEQIKYMIYQEALALNPEYA

SEQ ID NO: 75922 - protein, 321 aa, Pseudomonas fluorescens Pf-5
MRALAALSRFVGNTFAYWVLIFAILAFFQPGWFVGLKGAIVPLLGLVMFGMGLTLKLEDFAEVARHPWRVALGVVAHFVIMPGVAWVLCQAFHLPPEIAVGVILVGCCPSGTSSNVMTWLARGDLALSVAIAAVTTLLAPLLTPALIWLLASAWLPVSFMELFWSILQVVLLPIVLGVLAQRLLGQRVQHAVEVLPLVSVVSIVIIVTAVVAASQAKIAESGLLIMAVVMLHNSFGYLLGYFTGRLFKLPLAQRKSLALEVGMQNSGLGAALASAHFSPLAAVPSALFSVWHNISGALLSTYFRRMEDPAEQKLEIQRGHD

SEQ ID NO: 75923 - protein, 481 aa, Rickettsiella grylli
MKLKNPSLFQQQCYINGKWITTPKNITVNNPATLEIIGTVPDLESTHLQHAVTAAEAALPRWMSKTAKERSELLHQWYTLILENSDDLALLLTIEQGKPFSEAQEEIRYGASFIQWFAEEAKRIYGDIIPAGLPQQHLFVNKQAIGVVAAITPWNFPNAMITRKCAPALAAGCTLVLKPSTLTPFSALALGVLAEKAGIPPGVLNIVTGDSELIGNHFTDNPVIRKLSFTGSTAIGRLLMQKAAHSIKKISLELGGNAPFIVFEDADSDQAIQGAVASKFRNSGQTCICTNRFYIHEKMYESFTKKLTHAIQQLNVGNGQEPQVQIGPLINSAAIKKVEKHIADALDKGAELMCGGKKHALGGNFFQPTLLKNCSKDMLIAQEETFGPVAALFRFSKEKEVIEWANDTLYGLAAYFYTKNVDRIIRVTQALDYGIVGVNTGRTSNEVAPFGGFKQSGMGREGSKYGIEDYLEIKYICLNTD

SEQ ID NO: 75924 - protein, 247 aa, Mycobacterium leprae TN
MQQGNTATLILLRHGESDWNARNLFTGWVDVGLTDKGRAEAVRSGELLAEHNLLPDVLYTSLLRRAITTAHLALDTADWLWIPVRRSWRLNERHYGALQGLDKAVTKARYGEERFMAWRRSYDTPPPPIEKGSEFSQDADPRYTDIGGGPLTECLADVVTRFLPYFTDVIVPDLRTGRTVLIVAHGNSLRALVKHLDEMSDDEVVGLNVPTGIPLRYDLDADLRPVVPGGTYLDPEAAAAVISQARP

SEQ ID NO: 75925 - protein, 511 aa, Debaryomyces hansenii CBS767
MVFKVDSIAIIGAGPSGLAALYEFLHTSKQGVSSFGSKEPEEKAFEEIVVFEQKSNPGGVWAVPDEEKVSYLKDLYQYDSLQNILDSKEKSLQSAIRSYNSRIPLEVNKSDDSVSWKGTPLYKNLFTNIPKRFTRFSTSAYKAIGNGRPIDPFLRDFELRSHIQNYVSEHDLEKHIKFNTEVVKAVKKGDKWLLTLKYEDKDTDKKEFYLKEFDAIVVANGSYTLPYIPQIEGLKEYEEAHPGSILHSKFFRDYEDYRNQKIIILGSSVSGLALSQYLKPLAKEFILSRKNRKEILDWMNDIIYSKEVTVKSPIKRFIPSSKEIWFDDGTRAKDFDKILLATGYYPYYPFFEKGFLSLSVPPEKKGPANNSRIKNLYYNIFKIDDPTLAFVGLIKTSQLFTGFESQSAAVAGIWSNAKQLPSLKEQYDWELKKLEETPDTSRFYVFSNEDVETKYFDRIKDFFPFARKYPLDENYYEHFEDFKIGEQKLADLSLSIIRKKVVFENGEYIVK

SEQ ID NO: 75926 - protein, 324 aa, Nostoc sp. PCC 7120
MDIKNGFIGTVGNTPLIRLNSFSEETGCEILAKAEFLNPGGSVKDRAALYIIQDAEEKGLLKAGGTVVEGTAGNTGIGLAHICNAKGYKCLIIIPNTQSQEKIDALTALGAEVRPVPAVPYKDPNNYVKLSGRIAAELDNAIWANQFDNLANRRAHYETTGPEIWTQTDGKVDAWVASTGTGGTFAGVAMYLKNQNPAIKCVVADPLGSGLYSYIKTGDIKIEGNSITEGIGNSRVTANMEGAPTDDAIQIDDHEALRVVYQLLRKDGLFMGGSTGINVAGAVALAKQLGPGHRIVTILCDSGSRYQSRIFNRDWLASKGLTVD

SEQ ID NO: 75927 - protein, 363 aa, Thiomicrospira crunogena XCL-2
MGIKCGIVGLPNVGKSTLFNALTNAGIESANYPFCTIEPNVGVVPVPDPREQALADIVKPERILSATVDFMDIAGLVEGASKGEGLGNKFLANIRETDAIVQVVRCFENDDIVHVAGKVDPLSDIEIINMELILADMESLEKAVQKVIRVAKSGDKEALAKQALYEKVLKEVEGGKLVRLVELTDDERKMLQDLHLLTIKPMMYIANVNEDGFENNPYLDAVQKVAEEQGAIVVPISAEIEEQVAELDEEDKAEFLAEMGQEEPGLNRLIRAAYELLGLQTYFTAGVKEVRAWTVKKGATAPQAAGVIHTDFEKGFIRAEVTAYDDFIEYKGDAGAKAAGKQRLEGKEYIVKDGDVMHFRFNV

SEQ ID NO: 75928 - protein, 507 aa, Zea mays
LFPWNFELWKMPRRTGNAASTKSVELVKQDQMEFDHPDEVDEEEEVEYEEIEEEVEYEEVEVEEEEEEEEEEDDEIEGVREVDANHDSKIVDDDPKDGNEKEKHAELLALPPHGAEVYVGGLSSDVSSEDLKQLFESVGEVAEVRMRGKGDNKTYAFINFRTKEMALKAIQKLSNKDLKGKKIKVSSSQAKNRLFIGNVPHDWTPDDFKTAVEEVGPGVLKVDLMKAPGSGRNKGYGFIEYYNQACAEYAKQKMSTPEFKLDTNAPTVSWADHKNASEATSTSQVKSLYVKNLPKTVTQEQLKKLFEHVGEITKVVIPPAKSGHENRYGFVHFKERSMVMKALKNTERYELDGQLLDCSPAKPPADKKDDTGSSPTAKGRPLPPSYAPLGYGLAGAYNPLGKGLAGAYNSPGNGLAGAYGVLSAHAAQPMLYAPGASPGSTMIPMVLPDGRLVYVPQTAGQQPVHVTSPLPQQGGRRFGGGGGSSSGGKRQRGDDRGSSRRGWHRPY

SEQ ID NO: 75929 - protein, 692 aa, Oryza sativa Indica Group
MAAAAGEGEAEVTREVISVSTEKAFEGKALPAWSEQITVRSLVVSAVLGMFLSFIVMKLNLTSGIVPSLNVSAGLLAFFLMKTWTSALERCGVFPKPFTRQENTVVQTCVISCSSIAFSGGFGTYILGMSKKIAEGFDEAEAKTSINVEEPSLGRLIAFLFLVSFVGLFSIVPLRKIMIISYKLTYPSGSATAHLINSFHTPQGAIQAKHQVSILFKSFVGSFLWSLFQWFYAAGPGCGFSSFPTFGMVAYSRRFYFDFSATYVGVGMICPYIINFSLLVGSVVSWGIMWPYIESKKGSWYDAGLPKSSLHGLNGYQVFISIAMIVGDGLFNFFSIVLRTAYDLYLKRRGGASKQPQETPFAGATGTERQVLSFDDRRRTQVFLKDQIPTTIAAAAYVLLAAISVVAIPHIFRQLRPKHVVWAYVVAPLFAFCNAYGTGLTDWSLSSSYGKLAIFIFGANIGAKDGGVVAGLAACGLMMGIVSTASDLVQDFKTGYLTLTSPRSMFVSQVLGTGMGCIISPMVFWMFYKANNIGMEEGFPAPYAKIYRGIALLGVNGWDQLPRYCLRFCLAFFLLAIAICALKEVAKQRGWWIQDFIPSALGMAVPFFLGSFFTIDMCVGSLVLFLWSRSDPVRAHTFAPAVASGLICGDGIWSLPSSILSLANVTRPCAWRLLHRHQRQGPALPQDAAHAA

SEQ ID NO: 75930 - protein, 283 aa, Pyrus pyrifolia
QLSSDCSDVPIIQALHRGVRVIELDIWPNSNKDDVDVLHGGTLTTPVELIKCLKSIKEHAFVASEYPVVITLEDHLTPDLQTKVAKMVTETFGEVLFSPGPECLKEFPSPASLKKRIIISTKPPQEYREAKDALQSESDPKSGKTPADEEAWGKEVPDAKVAIAVDDKHNELDEEDSNEEEDVDNGGSKSVAPEYKRLIAIHAGKPKGGLVECLKVDPNKVRRLSLSEQQLEKAVVTYGKEIVRFTQRNILRVYPKGIRVDSSNYNPMIGWSHGAQMVAFNMQ

SEQ ID NO: 75931 - protein, 400 aa, Oryza sativa Indica Group
MAGGDLRQRRAAAAADGEGDGKMGSGGEEAEVKGKGLGRKEALGWLEWGRGWMGIVGEFLFQRIAASNLSNPLELPPLDGVSFVVTGATSGIGLEIARQLALAGGHVVMAVRRTKLAQELIQKWQNDNSEIGKPLNAEVMELDLLSLDSVVKFADAWNARMAPLHVLINNAGIFSIGEPQRFSKDGYEEHMQVNHLAPALLAVLLLPSLLRGSPSRIVNVNSVMHTVGFVDAEDMNLTSGKRKFTSLMGYSNSKLAQIKFSSMLHRRIPAEAEINVICASPGIVHTNVARDLPKLVVAAYHLIPYFIFDAQEGSRSTLFAASDPQVPDYCEMLKSEDWPVCACISYDCNPMNASEESHNLETSQLVWEKTLEMIGLPPDAVDKFIEGESVQCRYGQQKAE

SEQ ID NO: 75932 - protein, 254 aa, Thiomicrospira crunogena XCL-2
MTTEHSQSKKTIDFGFSEVPLEEKVKKVKGVFDSVAGNYDIMNDVMSFGIHRLWKRHAIELSGIRPGNVVLDLAGGTGDLTKAFAKRVGKTGRVVLADINESMVRVGRDRLTNEGIIGNVDYTITNAEALTYPDNTFDLVTISFGLRNVTNKDKALEEIYRVLKPGGQLMVLEFSKVTQPLLAKAYDFYSFNILPKMGKLIADDEASYQYLAESIRMHPDQETLKKMMLEAGFDKAEYLNMSEGIVALHRGWKY

SEQ ID NO: 75933 - protein, 314 aa, Gluconobacter oxydans 621H
MTLRTPLILSFGSINIDLTARSQRLPRPGETVHAESYAIGLGGKGSNQAAAAARLAQAFDVDVALAGRVGCDAFGAQARASLAGFGVDLSPLRDDADNPTGIALIGIDAAAENCITVAGGANMAVDETDIMAAAPWLDRAKVLLLQLEIPQSAVLAAARRTRSAGGLVVLDPAPAPEHGLPEALWSEIDILTPNESETFSLTGIRPATVKEACRAAEILLAKGVRAVLVKMGAKGVFWHDGTGSGHLPPFRVVPIDTVAAGDCFNAGLAVALACGESLPDAARIGSACGALATTRHGAADAAPGWNEVEALIRV

SEQ ID NO: 75934 - protein, 380 aa, Phanerochaete chrysosporium
MSKRTFKIVILPGDGIGPEVVAEATRVLEVVSASSSDVEIKLETHDFGGCSIDKHGEPLTAATLEACKLADAILLGAIGGPKWGVNSKVRPEQALLALRKALGLYANIRPANFASDSLLAYSPLKPSVARGVDIIVIRELIGGAYFGERKELGARAQEDAAWDTMIYSVPEVQRITRSRRQVASPDPPLPVHSIDKANVLASSRLWRKVATETIQNEFPQLKLDHHLVDSASMLIVANPKKLNGVILTENLFGDILSDESSVIPGSLGLLPSASLAARPLWPNTAHRRSSPRRVYEPIHGSAPDIAGQGIANPIGTILSAAMLCGTRSVWRSPAKAIEAAVEGARRQGDRREGLRTADLGGSSKTKDIGHKVVEILKATL

SEQ ID NO: 75935 - protein, 526 aa, Gluconobacter oxydans 621H
MSSIHEVSSPAGASAPYDLLVVGGGINGCGIARDAAGRGASVLLVEQDDLASHTSSASTKLIHGGLRYLEYYEFRLVREALMERERLLKIAPHIIWPMRFVLPHSKMLRPAWLLRTGLFLYDHLCPNMTLPRTKALNLRTAPAGKPLRSDYVRGFEYSDGWVQDSRLVVLNAMDAVRVGAKIETRTRLVKAVRGPQGWTATLENTRTGEQSTVQAKALVNAAGPWVAELLKDRLNVPSRNRVRLVKGSHIVVPRVFEGSQAYIFQNPDKRIVFAIPYEQDFTLIGTTDVPWEQDPGHVEISPDEITYLCESVNRYFTKTLRPEDVVWTYAGVRPLYDDNSGNASAVTRDYVLDVDATAAPILSVFGGKITTFRKLAEHAVEKLAPHLPVLRKPGWTDGTPLPGGEFAPKDFDAQLSRFRAHAPHLSERTSWRLMRNYGLRAYIIATSTPEGMGQMFGDTLSAREVDYLIDNEWARTAEDILWRRSRLGLFVSDADRAALQTYVEGRLQGDVTPLSNPGQVARQNVA

SEQ ID NO: 75936 - protein, 639 aa, Fulvimarina pelagi HTCC2506
MLQINDLSARVAGRLLIDHASLTLPTGTKAGLVGRNGAGKSTLFRVITGDLASESGSVSMPSNMTIGQVAQEAPGTEDSLIEIVLAADTERARLMAAAETETDPTKIADIHTRLFDIDAHSAEARAASILAGLGFDDAAQARPASSFSGGWRMRVALAAVLFSSPDLLLLDEPTNYLDLEGTLWLENFVSRYPHTVLLISHDRDVLNNAVSSIVHLDQKKLVFYRGDFDSFARQRAEKIELLQKQTAKQAEKRKHMEAFVARFRAKASKAKQAQSRLKALEKLEPLQAIVEESVTPIGFPAPEKQPASPIIAMEDVSVGYTPGQPILSSLDLRIDTDDRIALLGQNGNGKSTFAKLLAERLGAEDGTLTKAPGLKVAYFAQHQIDDLRPQENAIEHVRRLMPDAPEPKVRARVAQMGLPREKMETVADKLSGGEKARLLLGLATLHAPHLLILDEPTNHLDIEARDSLIHALNDYPGAVVLISHDRHIVEATVDRLWLVEGGSVQRFEGDLSEYKRLVLSGKKQGKGPKKEAAKTTEPTPVPTVEPAAPKAEMRRQSAEKRDRLKPMKRKIDKLEADMAKLQKGLAEAEGKLADPALYQSDPAKVTELNRKRADAERSLQAAEEEWLTLSGEYETALAS

SEQ ID NO: 75937 - protein, 894 aa, Rhodospirillum rubrum ATCC 11170
MSKWVYSFGNGKAEGRADMKNLLGGKGANLAEMSNLGIAVPAGFTITTEVCTAFYDNDHAYPAGLTDQVVTALARVEEIMGARFGDANNPLLVSVRSGARASMPGMMDTVLNLGLNDQTVQGLIKQSGDARFAYDSYRRFIQMFSDVVLGVEHYHFEEILENHKEDKGLSLDTELGADDWKLLVERFKAKVQQELGKPFPENPEEQLWAAVGAVFGSWMNQRAITYRRLNDIPQEWGTAVTVQSMVFGNMGDDCATGVCFSRDPSTGENTFYGEYLVNAQGEDVVAGIRTPQQISIAGKEKNASALPAMEEVMPGLYKELVATRDVLEAHYRDMQDMEFTIQGGKLWMLQTRTGKRTAGAALRIAVEMAREGIITSDEAILRIDPEALDQLLHPTLDPKAAKIVLTKGLPASPGAASGKVVFSAEVAEDWVQRGEKVILVRIETSPEDIGGMHVSQGILTTRGGMTSHAAVVARGMGTPCVAGAGEIRVDYKAGLFTVGGKTVREGDIITLDGAAGTVMLGAVPTIQPELTGDFGVLMDWADAKRTMKVRANAETPVDAEAAKRFGCEGIGLCRTEHMFFDPRRIINIRRMILASDEAGRRAALAELLPYQRGDFVELFRIMAGLPVTIRLLDPPLHEFLPHTDGEIAEVAAIAGVDESLVRHRASVLSESNPMLGHRGCRLGVTYPEIYEMQARAIFEAALEIAQEVGEAPVPEIMIPLVATKRELDLMKAVVDAAAKAVFAEKGGEVTYSVGTMIELPRAALQAGSIAQTAQFFSFGTNDLTQTTLGLSRDDSASFLETYRVKGIYERDPFASLDVEGVGELVKIAAERGRATRPGLKLGICGEHGGDPQSIAFCQSVGLDYVSCSPYRVPIARLAAAQAALRSVVKQPAMV

SEQ ID NO: 75938 - protein, 159 aa, Zea mays
  misc_feature (137)..(137): Xaa can be any naturally occurring amino acid
MRKRERENPCSLCGHYHKYEEGEVCGICGHRKPDSSDVAAPQVQLSAFPTEILPEFLYLGSYDNASRSEVLKTQGISRVLNTVPMCQNLYRNSFTYHCLSDEKVLQFDDAIQFLDQCEKDKARVLVHCMSGKSRSPXVVVAYLMKRKGVRLAESHQWVS

SEQ ID NO: 75939 - protein, 316 aa, Lupinus albus
MLTKEDTVKDKEEEEEEEEKPRFNFNLYMVEKSRSVNQALNDAVSLREPHKIHEAMRYSLLAGGKRVRPVLCIAACEVVGGNESTAMAAACSIEMIHTMSLIHDDLPCMDNDDLRRGKPTNHKVFGENIAVLAGDALLAFAFEHIAVSTSGVSPERIIGAIGELAKSIGTEGLVAGQVVDINSEGLCDIGLEKLEFIHLHKTAALLEGSVVVGAILGGGCNEEVEKLRMFARYIGLMFQVVDDVLDVTKSSKELGKTAGKDLVADKVTYPKLLGIEKSNEFAQKLNRDAQEQLSGFDPVKVAPLIALANYIAYSPN

SEQ ID NO: 75940 - protein, 448 aa, Rickettsiella grylli
MNLINRDLQCIWHPCSQMKDYETFPPLIIKKAYGSYIELKEGRKIIDAISSWWCKSLGHNHPRLKSALKAQCDDFEHVIFANSTYEIIIQLSEKLSQICQGLNKVFYANEGSSAVEIALKMSLHAQRLCGQTQRIQFTALQNGYHGETFMALGLSDLGLYRSAYEAHLIQPKFIQNLPYVHSTTDPLWRDCSSVWPSIEEQLEKQAKNLAAIIVEPIVQGAGGMKIYSQDFLYRLRKWTKAHGIYLIADEIMTGLGRTGRILACEYAKIKPDFICLSKGLTSGWLPMSVVLTHDRIYNLFYDDYNTGKSFLHSHTFSGNALAAAIALECFAILEDEKIIKQVNEKEIILRKFMEEVNQKTHRLVNIRGIGAIVAADLALKENEKNQRIGYRIFQHALDLGAWLRPLGNTIYWLPPLNITLSTLEELRDITTLSIKRVFNKKIDLKIKN

SEQ ID NO: 75941 - protein, 476 aa, Triticum aestivum
  misc_feature (55)..(55): Xaa can be any naturally occurring amino acid
MAHHLLLPSKPLLPAAAAATPRRGCGRPVVSVRASVVASSKAAGAEAVRSIRARXIVDSRGNPTVEVDLVAGDGSLHRSAVPSGASTGIYEALELRDGDKSVYGGKGVLTAVRNINEVIAPKLVGVDVRNQKDVDAIMLDIDGTENKSQLGANAILGVSLSVCRAGASAKGVPLYKHIQELSGTKELVMPVPAFNVINGGSHAGNNLAMQEFMLLPVGATSFAEALRMGSEVYHVLKGIIKAKYGQDACNVGDEGGFAPNVQDNREGLVLLMDAIERAGYTGKIKFGMDVAASEFLMKDGSYDLNFKNQPNNGAHVLSAQSLCDLYKEFVKDFPIVSIEDPFDQDDWSSWASLQSSVDIQIVGDDLLVTNPKRIVEAIDKKACNALLLKVNQIGTVTESIQAALDSKAAGWGVMVSHRSGETEDNFIADLAVGLASGQIKTGAPCRSERLAKYNQLVRIEEELGNVRYAGEAFRSP

SEQ ID NO: 75942 - protein, 84 aa, Oryza sativa Japonica Group
MDSFSSSSGSPPNTEALMDQIKAQLAQAYAQEFLETVGNKCFAKCVTKPGSSLSGSESSCISRCVDRYIEATGIVSRALFSSTR

SEQ ID NO: 75943 - protein, 330 aa, Picea sitchensis
MAKPPKPVDVELTILSARELKNVNWRYGDLRPYAVAWVDPDYKVSTRVDQEGDTNPSWDEKLTIPVGNRPLEDAELTIEIVHEKPSELTKPLVGTARIPLVQVLDEVGFEERLERTLKLKRPSGRPQGKLEILIRLKEKRWPEPQYAQPYGSRGYNPNYPAYPSPQYPYANPPAGYANPPAGYANPPAGYANPPAGYANPPAGYPYPYQQPNPYAQPNPYAQPNPYPGSSPNPYGGSYYNEVPPVGSSAGAYSAATAPPAPYYGQPEKPKSSKFGMGTGLAVGAVAGALGGLALGEVINYEEDKIEDRVAERVEDNLGYDDDYGGGDDDY

SEQ ID NO: 75944 - protein, 548 aa, Zea mays
  misc_feature (202)..(202): Xaa can be any naturally occurring amino acid
  misc_feature (206)..(206): Xaa can be any naturally occurring amino acid
MAEAAAAGSLSRRQMQDEEGAAAIEADAGHRRRSEAEEAEDDVESSDYMSEDEGTEDYRRGGYHAVRVGDSFKQGTYVVQSKLGWGHFSTVWLAWDKAHSRYVALKVQKSAQHYTEAAMDEIKILKEIADGDPDDSKCVVKLLDHFKHSGPNGNHVCMVFEFLGDNLLTLIKYTDYRGIPLSMVKEICRHVLMKRDYRQCTXSLEXMDKTRFVWVAVTLVFSGPLRTYSFVPLLLPSTRTDEPPPKVPAQSGNGGLTKNQKKKIRRKAKRAAAATSDGTSAVASADTDGSDDRGDLGTTNEGSPRQDGAKKRVTRDRRGSKGAKKMMAMKADLKCKLVDFGNACWTYKQFTNDIQTRQYRCPEVILGSKYSTSADMWSFACICFELATGDVLFDPHSGDNFDRDEDHLALMMELLGMMPRKIALGGRYSRDFFNRYGDLRHIRRLRFWPLNKVLMEKYEFTEINANGMADFLVPILDFVPEKRPTAAQLLQHPWLDVGPLRQQPKTRPESARSPGDGVSEKQKKKKKKKKGGRSRVSLEGPKLTRTQL

SEQ ID NO: 75945 - protein, 497 aa, Mesorhizobium loti
MKGDDGLTVTQSLTRRLKNPELFDDLAGVPGRKAEQSTRRFSVFNPSTGELLAELPDMDVRDVSKAIDKAEAAQEHWAALTARERSDILWEWHQLILDHSEDLAAILTAEMGKPLAEAKSEIAHAAAYLQWYAEEANRIYGETISPPSNDRRMLVIKQPIGVVGAITPWNFPASMVARKISPALAAGCAIVLKPAEQTPLVAGAMFTLARMAGFPDGVLNLIYASEGDAVGRELCSNPKVRKISFTGSTEVGRLLMRECSDQIKRTSFELGGNAPFIVFDDADVDAAVDGALQAKFRNAGQTCVSANRLYVQSSVYNEFCDKFTKRVSALRVGDGFEPEVAIGPLIDKCALAKIEDHIRDAVRQGGKIRCGGNRIGESGTFFEPTVITDVERTMRVAQEETFGPLAPIIRFNDPDQVVREANDTIYGLAAYFYASNLKRVWRVAETLEYGMVGINTGRMSSEAAPFGGMKQSGIGREGSRHGLEDYLEMKYLCMGGL

SEQ ID NO: 75946 - protein, 345 aa, Triticum aestivum
MALSSLFVSLPLPIPKPPSTSKSSRFLPIRASAAAATASPSFDLRRYWTSLISEVEGELDAAMPIRPPESIHNAMRHAVLPGAGKEGAAKRAPPVLCVAACELLGAPRAAALPTAAALEMLHAASLVHDDLPCFDAAPTRRGRPSTHAAYGTDMAVLAGDALFPLAYTHVISRTPSPDPVSHAVLLRVLAELARTVGSTGMAAGQFLDLAGASALGEAEVMQVLTKKFGEMAECSAACGAMLGGAGPDEEAALRRYGRTIGVLYELVDDMRSASGNGKMRSNASVLRSLGMDRALGIVEELKAQAKTEADRFGDKYGDRVLPLYSFVDYAVERGFELQDAATAKL

SEQ ID NO: 75947 - protein, 343 aa, Zea mays
MSWAAIENDPGVFTELLQQMQLKGLQVSNQLSSLYESMFLLKVDELYSLDLDALNDLQPIYGLILLYKWRPPEKDEGPVIKDAIPNLFFANQIINKACATQAIVSVLLNSPGITLSDELKKLKEFAKDLPPELKGLAIVNCASIRMLNNSFARSEASEEQKPPSGDDDVYHFINYVPVDGVLYELDGLKEGPISLGKCPGGVGDAGWWLRLAQPVIKEHIDLFSQNEIRFSVMAILKNRKEMFTVEIKELQRKREGLLQQMGDPNASRHVEQSLAEVAAQIESVTEKIIMEEEKVKKWKAENLRRKHNYVPFLFNFLKILEEKQQLKPLIEKAKAKQKSHGPS

SEQ ID NO: 75948 - protein, 527 aa, Debaryomyces hansenii CBS767
MGLEDNALIRKYVNVGEKRAGSASMGIFVGAFAAFGGVLFGYDTGTISGIMAMNYVKGEFPANKESFTSKESSLIVSILSAGTFFGALLAPFMSDTLGRRWSLIISTFIVFNLGVILQTVSTGIPLLCAGRAIAGFGVGLISAVIPLYQSEATPKWIRGAVVSCYQWAITIGLLLAACVNQGTHNRNDSGSYRIPIAVQLLWSLILGTGMIFLPDTPRFWIHKGNESEAKKSLKILRKLPLDHPDLIEEYEDIKAAYDFECSFGKSSWMDLFTTRNRQLKRLFTGVALQAFQQLTGVNFIFYFGTSFFKSAGIENEFLISLATSIVNVGMTVPGIFLIELVGRRSMLLWGAVGMSVSQFIVAIVGIATDSADANKVLIAFTCFFIAFFASTWGPIAWVVVGEIFPLRTRAKSVALSAASNWLWNWAIAYATPYLVEDGKGNANLGTNVFFIWGGCNFLCILFTYVFIYETKGYSLEQIDELYEKVPHAWKSRGFIPSAHAFREDAPESISSMGKDMEKVTEIETTSV

SEQ ID NO: 75949 - protein, 289 aa, Thiomicrospira crunogena XCL-2
MTADLLTQVILPLALFLIMFGMGLSLRPVDFKNVLAAPKAVGIGLIGQMVLLPLVAFFIALALKLPPEIAVGLMIIALAPGGATSNMFTYLSKGDVSLSISLTAVVSLIAPFSIPIITALSMTYFMGNTTEFSLPIVKTIMQLLVITVIPVALGMLVLARWSHMAAKIEQILKWFSIAFLFLIIVLIVLKNADNMMSFFMQAGLATFVLNIAVLVLGVYLAKWAKLSDAQSISIGFEVGIQNGTLALVVAGTLIGNSTMMIPAVTYSLLMFITGAAFAMLITRRKNSAA

SEQ ID NO: 75950 - protein, 526 aa, Triticum aestivum
MSAIKPPPPDRPPQAARLPSPSSSSSAAAAAKQGGTGSRGLLMGRYELGRVLGKGTFAKVYHARHVQTGESVAIKVLDREKAVRSGLVSHIKREIAVLRRVRHPNIVHLFEVMATKTKIYFVMELLVRGGELFSRVSKGRLKEDIARRYFQHLISAVGFCHTRGVFHRDLKPENLLVDEAGNLKVSDFGLSAVAEPFQPEGLLHTFCGTPAYVAPEVLARRGYEGAKADIWSCGVILFVLMAGYLPFHDQNLMAMYRKVYKGEFRCPRWFSKDLTSLIMRFLDTNPSTRITLPEVMESRWFKKGFRPVKFYIEDDQLYNVIDAENDMLDLGLPDPLPQPLPPPPPSPSPQQVDGDDSGSESDASVVSCPATSSFEERHRLRGPLPRPASLNAFDIISFSRGFNLSGLFEEKGDEVRFISGEPMPDIITKLEEIANVKSFAVRKKDWRVSLEGTREGVKGPLTICAEIFELTPSLVVVEVKKKAGDKEEYDDFCNKELKPGMQHLVHQMVPVPNTPTISELAERPSR

SEQ ID NO: 75951 - protein, 222 aa, Synechococcus sp. RS9916
MSTKPLVISPSILSADFARLGEEVKAVDQAGADWIHVDVMDGRFVPNITIGPLIVEALRPVTQKPLDVHLMIVEPEKYVPDFAKAGADIISVQVEACPHLHRNLAQIKDLGKMAGAVLNPSTPIDTLEYCLELCDLVLIMSVNPGFGGQSFIENQVQKIRDLRRMCDEKGLDPWIEVDGGIKGANAWKVIEAGANAIVSGSGVFNQPDYAAAIQGIRDSKRS

SEQ ID NO: 75952 - protein, 326 aa, Escherichia coli
LPNITILATGGTIAGGGDSATKSNFTVGKVGVENLVNAVPQLKDIANVKGEQVVNIGSQDMNDNVWLTLAKKINTDCDKTDGFVITHGTDTMEETAYFLDLTVKCDKPVVMVGAMRPSTSMSADGPFNLYNAVVTAADKASANRGVLVVMNDTVLDGRDVTKTNTTDVATFKSVNYGPLGYIHNGKIDYQRTPARKHTSDTPFDVSKLNELPKVGIVYNYANASDLPAKALVDAGYDGIVSAGVGNGNLYKSVFDTLATAAKTGTAVVRSSRVPTGATTQDAEVDDAKYGFVASGTLNPQKARVLLQLALTQTKDPQQIQQIFNQY

SEQ ID NO: 75953 - protein, 436 aa, Synechococcus sp. RS9916
MHIAVVGLSHRTAPVEVREKLSIPEQSMETSLQALRGHEQVLEASILSTCNRLEIYTLVRHPDLGISAVRDFLSGHSGLATDDLSPHLFAFHHHEAVDHLLKVSAGLDSLVLGEGQILSQVKKMMRIGQEHKSIGPILNRLLTQAVSTGKRVRSETNLSTGAVSVSSAAVELAQLKLGQSRGLDELVSLESEQVAVVGAGRMSRLLLQHLQAKGCSGVVLLNRTRERALGLAADFPGLPVQCRTLEDLDHCLSTCSLVFTSTAAEDPIIDAARLNQLNRRSSLRLIDIGVPRNIAADVKGISGVEAHDVDDLQEVVARNQEARQKVAREAQGLLDEESRLFLEWWDSLEAVPTINRLRASLEQIRTEELQKALSRMGPDFSARERKVVEALTKGMLNKILHTPVTQLRSPQPRPQRQEALRVVERVFQLESDSAAS

SEQ ID NO: 75954 - protein, 315 aa, Magnaporthe grisea 70-15
MTAFGSETTAEEVVSAFSSNVKGRTFLITGASANGLGAYMATSLARASPQALILIARSEVKVAPVIEEIASIDPAIRAIFVPVDLTDQESVRAAAATILDDRDMTKIDVVINCAGIMYVEEFTTDAKGNELQFSANHVGHFLLTNLLMPKILAAGEGARIVNITSHGHQLSDVWWSDPTFNKGKDYHGWSGYGQSKTANILFSVELARRLKDRGVVSLAGTGLFQHVPMERLDEGDMISRKNTGLPFGLDLPWKTSSQGSSSGLAAALDPELAAHSGSYIQNCQVGTPRQYALDGEKAKKLWIMTEELVGQKFDL

SEQ ID NO: 75955 - protein, 431 aa, Synechococcus sp. RS9916
MKRVLAIILGGGAGTRLYPLTKMRAKPAVPLAGKYRLIDIPISNCINSSITKMYVLTQFNSASLNRHLSQTYDLSAGFGQGFVEVLAAQQTPESPSWFEGTADAVRKYQWLFQEWDVDEYLILSGDQLYRMDYSLFVEHHRKSGADLTVAALPVDPQQAEAFGLMRTDEHGTIQEFREKPKGDSLKEMAVDTSRFGLSPESAQSKPYLASMGIYVFSRKALFDLLNDHPTYKDFGKEVIPEALSKGMSLKSYVFDDYWEDIGTIGAFYEANLALTQQPKPPFSFYDEDFPIYTRPRYLPPSKVGDSQIIDSIIGEGSIIKSCSVNHCVLGIRSRIENSVVVQDSLVMGSDFYESTQEREELRRNGGIPLGVGEGSTVKRAILDKNTRIGRNVTIINKDNVEEADRPELGFYIRNGIVVVCKNATIPDGMVI

SEQ ID NO: 75956 - protein, 437 aa, Silicibacter pomeroyi DSS-3
MPTEILMPALSPTMEEGTLAKWLVKEGDSVSSGDLLAEIETDKATMEFEAVDEGIVGKILVPEGTEGVKVNTPIAVLLDEGESAGDIASASSGATAPSSAPAAASAEKAPQGAAEAPAAAPAAPKAADGARVFASPLARRIAADKGLDLSQIAGSGPHGRIVKADVIGATAPAAAPASAAPAPAAAAAPAAAPSGPGADMVARMYEGREYEEVKLDGMRKTIAARLSEAKQTIPHFYLRRDIKLDALMKFRAQLNKQLEGRGVKLSVNDFIIKAVANALQQVPDCNAVWAGDRVLKLKPSDVAVAVAIEGGLFTPVLKDADMKSLSALSTEMKDLATRARDRKLAPHEYQGGSFAISNLGMFGIDNFDAIVNPPHAGILAVGSGVKKPVVGADGELTVATVMSVTMSVDHRVIDGALGAQLLQAIVDNLENPMVMLA

SEQ ID NO: 75957 - protein, 472 aa, Synechococcus sp. RS9916
MSKAHFGLIGLGVMGENLVLNAERNGFSSVVYNRTYAKTEEFLAGAGAGKDIQGATDLQDFVNKLQHPRRILMMVKAGAPVDAVIQQISPYLEKGDLLIDGGNSEYHDTERRVAELESKSFGFIGMGVSGGAKGALEGPSMMPGGTKASYDAIESLVTKMAAQVEDGPCVTYIGPGGSGHFVKTVHNGIEYGIEQILAEGYDLMKRVGGMNGTQMADVFKHWNSTEELASYLVEITEVCLRTKDPETGSDLVELIQDKAGQKGTGLWTVVSALQMGASVPTIYAALNGRVMSSMKDQRVKAETILKGPAIAPFAMGTPADGMGPLMDAMVLACMASYAQGMELLRIASAEHNYNLHMPSIAQIWKGGCIIRARLLKRIQDAFNADPQLPNLLIDPWFADQVNRRLPGLAQVVAGAAQAGIPVPCLSSTLDYINSYRTSRLPQNLVQAMRDCFGSHTYERIDKDGIFHTEWLD

SEQ ID NO: 75958 - protein, 434 aa, Schizosaccharomyces pombe 972h-
MTAENATLLEPVLGKDEIGWMFVQEYYTYLNKEPNRLHCFYTKKSTLIHGDEGESISLCHGQQEIHNKILDLDFQNCKVLISNVDSLASSNGGIVIQVLGEMSNKGKLSRKFAQTFFLAEQPNGYFVLNDIFRFLREDVEEEEESPDAVEKEKKDVASEPYVNGVQSQEHLPSAKEEGHYQDPAATENNFATAALISNETDSLNQATLAVPEEPVIQVTEASVPSFVSQQENQLQDEALTSNSKNADAIGASDANVATAPKSWADLIARNHPDVKSQASVSSTASTTGQTVKGVNADQTQQPTAPYTQSNELLETSVFVKNIPPETSDVSLKSAMSIFGPVKAIEFARRKGTAYVDFVNHECVQLALNKKTLQINNATLNIEERRRLFSGKFNKSGDKKSNDNYNGMKRNFRKGNRGAFDGRSKEVTTSKKQNN

SEQ ID NO: 75959 - protein, 599 aa, Vibrio parahaemolyticus RIMD 2210633
MQVGNEALVLSAVGVIGLGCQWLAWRLRLPAILFLLLAGLIVGPFMQWLKPDEILGNLLFPLVSLAVAVILFEGSLTLNFKEIRGVSGSVWSIVSIGAIISWAATSVATHYFLGFTWELAMLFGSLTVVTGPTVIVPLLRTVRPNSTLANILRWEGILIDPLGALFVVMVYEFIVSHSAVNSMEVFGTIIAVGVILGVTSGAAVATVLRRAWLPEYLQPFAVLMVVLGVFSVSNHIESEAGLLTVTVMGMWLANAKDINIQQILHFKEHLTILLITGLFIFLAARISLDDFAALGSGALLLFVFMQLVSRPLSIFLSTMRSNLNLKDKLFLSWVAPRGIVAASISSLFAIKLTEYGVDGASLLVPMTFMVIIGTVVLQSATARPMAIALGVAEPAPRGFLLIGANRVAREIGQALARYDRRVLMTDSNWEYISQVRMMGLDYYYGNPISSHADDNLNMIGIGQVVALTPDQHFNIMACMQFVDEFGEDKVHCLQKVKTNGNGSEKHSVAQEYHGKLLMGGNVSYTQLASLLSRGAEIKHTKLSENFTYQDYLEHHKTNLVIPLFNVEDKGKIQFCDDPDQFAPSTTSTIVSLILPESAQ

SEQ ID NO: 75960 - protein, 547 aa, Phaseolus vulgaris
MMEEEQKLVKGGTNLEGSEAKLELTVDEVVEEYVGSLGFSQLVHVLLVSLAWIFDAQSTLVTIFSDAQPSAWRCKSGFCNNSSSSSSTGSVCELVPGTWEWVGGHTSSIIAEWNLICDRRFLAAVPASVYFLGSLIGSGVYGHLSDTWLGRKRSVQLSCILTSITAFATSLSPNIWTYAFFRFTNGFARSGIGICCLVLTTESVGRKWRGQVGQYGFFFFTIGFLTLPLVAYPTRTHWRSLYKLLSLLPLAYSVLILPLVSESPRWLLIRGRTKEALQVLDRFARLNGKQKLPTNLTLTNPSGSSNVAPCTTSEGGERTPNNKENLWTTKWAAIRMVTVMLAGFGVGFVYYGVQLNVENLNFNLYVSVALNALMEIPAVVIGTFLLGFTNRRLLLSVSSYIAAVSSILCTFFSHRGKTSKVHSNHGGSWAQLIIEAIGFMGASTTFDILYIYCVELFPTNVRNFAVSMLRQAIMLGASVAPLLVVLGRLSPSLSFFVFGAFSISSGVLSLWLPETRNAPLYETLKQQEEEEKHNWVSHNDCALELGQ

SEQ ID NO: 75961 - protein, 354 aa, Silicibacter pomeroyi DSS-3
MIFTTTGRGRLYGSILETVGNTPVIRLNTIAPGHVTMYVKFEAFNPAGSVKDRLALNIIEAAEREGRLQPGQTVVEATSGNTGIGLAMVCAAKGYPLVITMHDGFSVERRRLMRMLGAKVVLTRKEDKAVGMVVKAKELAEANGWFLAHQFETKDNADIHEATTAQEILGDFDGERLDHVVLGYGTGGTVAGLGRVLKAARPGLKITLSEPANAALVQSGEAQQRNAEGEPAATHPAFNPHPIQGWTPDFIPLVLQEALDQGYFDALEPVSGPESIAWSKRLAAEEGILTGISGGASLAAAMKVAETAPEGSVLLVMLPDTGERYLSTPLFEDIAAEMDEAEQALSASTPGYQY

SEQ ID NO: 75962 - protein, 328 aa, Prochlorococcus marinus str. MIT 9515
MAKIYEDNSFAIGNTPLVKLKSVTKNAKATVLAKIEGRNPAYSVKCRIGANMIWDAEKSGKLTKDKTIVEPTSGNTGIALAFTASARGYKLILTMPESMSIERRRVMAVLGAEIVLTEASKGMPGAIAKAKEIAESNPSQYFMPGQFDNPANPEIHFKTTGPEIWDDCDGAIDVLVAGVGTGGTITGVSRYIKQEKGKNITSVAVEPSHSPVITQTLNGEEVKSGPHKIQGIGAGFIPKNLDLSIVDKVEQVTNDESIEMALRLAKEEGLLVGISCGAAAAAAVKLAEQDEYAGKTIVVVLPDLAERYLSSIMFTEVPSGIIEEPINA

SEQ ID NO: 75963 - protein, 253 aa, Xylella fastidiosa Temecula1
MSESSEKTSTTHFGFRQVAAKDKKTLVAEVFTSVSRRYDLMNDLMSLGIHRAWKRYFVATAQVKSGDRVLDLAGGTGDIAMLLKNRVGAEGSIVLGDINASMLSVGRDRLIDRGVVARLDYVQCNAEALPFQDKCFDLVTMSFGLRNVTDKDAALREMFRVLKVGGQARVLEFSAVTAEWFKPIYDFHSFQVLPRLGRLFARDAASYRYLAESIRKHPPQEELQAMMGSAGFERCGYRNLTGGIVAIHSGYKY

SEQ ID NO: 75964 - protein, 364 aa, Ruta graveolens
MGSLSESHTQYKHGVEVEEDEEESYSRAMQLSMAIVLPMATQSAIQLGVFEIIAKAPGGRLSASEIATILQAQNPKAPVMLDRMLRLLVSHRVLDCSVSGPAGERLYGLTSVSKYFVPDQDGASLGNFMALPLDKVFMESWMGVKGAVMEGGIPFNRVHGMHIFEYASSNSKFSDTYHRAMFNHSTIALKRILEHYKGFENVTKLVDVGGGLGVTLSMIASKYPHIQAINFDLPHVVQDAASYPGVEHVGGNMFESVPEGDAILMKWILHCWDDEQCLRILKNCYKATPENGKVIVMNSVVPETPEVSSSARETSLLDVLLMTRDGGGRERTQKEFTELAIGAGFKGINFACCVCNLHIMEFFK

SEQ ID NO: 75965 - protein, 502 aa, Nitrosomonas europaea ATCC 19718
MPDDPAENCHFPSDQTNTYMKHTLIPVILSGGSGTRLWPLSRQQYPKQLLPLVNRYSLLQETVRRLDGLEDIAVQSSIIVSNEEYRFVIAEQLRVLGKIGKIILEPYGRNTAPALTIAALAAMQDSDDPVLLVMPSDHVITDISVFQAIIHKGMTLAESGMLVTFGITPNAPETGYGYIQYGTALHEPGTFRIARFVEKPDLATAQNYLEEGSYLWNSGMFMMRASIWLTAIDTCRRDILEACRAAWQSGSIDGDFYRIDKTAFAACPSDSIDYAVMETLSARPDMLPPGAIIPLSAGWSDIGAWDALWRTLQKDESGNVVRGDVLLHACHDTLAFSEHRLVACIGVENVVIVETSDAVLVAHQDKTQEVKHIVDILKQRNRPEIRSHRKIYRPWGWYDSVDRGERFQVKRIVVNPGAALSLQMHHHRAEHWIVVRGTAQVTRADKTFLVSENESTFIPLGTPHRLENPGRVPLEMIEVQSGSYLGEDDIVRFEDKYGRKEN

SEQ ID NO: 75966 - protein, 79 aa, Fulvimarina pelagi HTCC2506
MSDTAERVKKIVVEHLGVEESKVTENASFIDDLGADSLDTVELVMAFEEEFGVEIPDDAAETILTVGDAVNFIEKNKTT

SEQ ID NO: 75967 - protein, 174 aa, Rickettsiella grylli
MLYSFEDKIPKLLGNHYFIAESAIVIGAVIIHNNVIILPNTVIRADNAVIEIGENTNIQDGAVLHTDPDCPMKIGKGVTIGHNAVFHGKSIGDNSVIAIGATVLSNAVVGRNCIVGANALVLENQKIPDGSLIIGTGRIKSKLTENQIENLKNYSQHYLDKISRYQKGLKLFQK

SEQ ID NO: 75968 - protein, 382 aa, Metarhizium anisopliae
MSFAGMLNRLHGQPESYDKKSKYKFGRTLGAGTYGVVREADGPSGKVAIKIILKKNVKGNEKMVYAELDMLQRLTHPHIVKFVDWFESRDKFYIVTQLATGGELFDRICDQGKFTEVDASQTIRQIMTAVDYLHDNDVVHRDLKPENLLYVTRDPDSDLVLADFGITKTLDIKEETLTTMAGSFGYAAPEVMEQKGHGKPVDMWSMGVITYTLLCGYSPFRSENLRDLLRECTAAPVPFHERYWKDVSQDAKDFILVLLVPEPEKRWTSKEALGHIWLSGKNATDHNLLPELEAYRRRARLRRVIEIVKLQNRIAKLKEHEEDPSESDMGDAQGASDNHKGDGSRLHALGLFAVREAKQKQESLQVEEELEKESRRRSFSNA

SEQ ID NO: 75969 - protein, 148 aa, Agrobacterium tumefaciens str. C58
MSKPHLLIVEARFYDDMADALLEGAKFALEEAGATYDVITVPGALEIPAAIAMALDGADNDGTEYDGFVALGMVIRGETYHFDIVSNESSRALMDLAVSESLPIGNGILTVENDEQAWARVRRSDKDKGGFAARAALTMIELKKKLGG

SEQ ID NO: 75970 - protein, 471 aa, Mesorhizobium loti
MKVVPVIISGGAGSRLWPASRQSHPKPFLKVADGLSLIQHTVLRAASMQHVVELVTVTSTGHLFLTKDVFDELDSVVLPRTFLLEPEGRDTAAAVAAATVHAKATQGPDAVLCVFPADHMIGDLPAFQTAMNRAIEQAQQGRIATLGITPDRPDTAFGYIEADGEKVVRFVEKPNAETAKSYVASKRFFWNAGIFCFKAQVMLDEMAAHCPQVIDAVLDSYDNARVSHGEHVASVELSSEHFAMAPRISLDHAVMEKTHNLAVVPCEMGWNDIGSWNAMAELVAADGSGNRIRGDVHVVDTVGSYISSDKRVIGTVGISDLVIVDSPDALLVASRDRVQDVKKLFEGLKAAGHEAHLLHSTVHRPWGTYTVLEESERFKIKRIEVKPGGRLSLQMHHHRSEHWVVVSGTAKIVNGDQELLLTTNQSTYIPCGHKHRLENPGNIGLVMIEVQSGEYLGEDDIVRLEDVYGRT

SEQ ID NO: 75971 - protein, 388 aa, Buchnera aphidicola str. Sg (Schizaphis graminum)
MNLRKMTELNITGKKILIRTDLNVPIKNGVIQSDARILAALPTIEIAIEKKAKIIILSHLGRPKEGCYTKKYSLFPIFEYLKKKLKKTKIYFSDNHLKKVEINSGEILILENVRFNVGELKNDENLSKEYANLCDIFVMDAFGSAHRMQSSTYGIGKFVKIACAGPLLISEINNLKKALKNPKRPMVAIVGGAKVSTKFNVLNKLAAISDTIIVGGGIANTFLAIDNKIGKSLHEPKFILKAKKLRDKYNNIVIPIDSRVGKNFSHKEKCTIKLSSNIEKNEEIMDLGDKTIKKIIKILKKSKTILWNGPVGVFEFPNFRKGTEMIAKAIAENNGFSIAGGGDTLSVIDMFQIKDKISYISTGGGAFLEFIEGKKLPAMKMLEENFHK

SEQ ID NO: 75972 - protein, 361 aa, Arabis stelleri
CKAAVAWEAGKPLVMEEVEVAPPQKHEVRIKILFTSLCHTDVYFWEAKGQTPLFPRIFGHEAGGIVESVGEGVTDLAPGDHVLPIFTGECGDCPHCHSEESNMCDLLRINTERGGMIHDGESRFSIDGKPIYHFAGTSTFSEYTVIHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTDGGVDRSVECTGSVQAMIQAFECVHDGWGVAVLVGVPSKDDAFKTHPMNFLNERTLKGTFFGNYKPKTDIPGVVEQYMNKELEIEKFITHAVPFSEINKAFDYMLKGEG

SEQ ID NO: 75973 - protein, 361 aa, Turritis glabra
CKAAVAWKAGKPLVMEEVEVAPPQKHEVRIKILFTSLCHTDVYFWEAKGQTPLGPRIFGHEAGGIVESVGEGVTDLQPGDHVLPIFTGECGDCRHCHSEESNMCDLLRINTERGGMIHDGESRFSINGKPIYHFPGTSTFSEYTVVHSGQVAKINPDAPLDKVCIVSCGLSTGLGATLNVAKPKKGQSVAIFGLGAVGLAAAEGARIAGASRIIGVDLNSKRFDQAKEFGVTEFVNPRDHDKPVQQVLAEMTDGGVDRSVECTGSVQAMIQAFECVHDGWGVAVLVGVPSKDDAFKSHPMNFLNERTLKGTFFGNYKPKTDIPGVVEKYMNKELELEKFITHTVPFSEINKAFDYMLKGES

SEQ ID NO: 75974 - protein, 361 aa, Arabis flagellosa
CKAAVAWEAGKPLVMEEVEVAPPQKHEVRIKILFTSLCHTDVYFWEAKGQTPWFPRIFGHEAGGIVESIGEGVTDLAPGDHVLPIFTGECGDCPHCHSEESNMCDLLRINTERGGMIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGES

SEQ ID NO: 75975 - protein, 533 aa, Oryza sativa Japonica Group
MGSACEAGTDEPSRDDVKGTGNGILENGHSHKPEEEEWRNGMGEDLPNGHSTPPEPQQTDEQKEHQVQIVRWERFLPVKTLRVLLVENDDSTRQVVSALLRKCCYEVIPAENGLHAWQCLEDLQNHIDLVLTEVVMPRLSGIGLLSKITSHKICKDIPVIMMSSNDSMGTVFKCLSKGAVDFLVKPIRKNELKNLWQHVWRRCHSSSGSGSESGIRTQKCTKPKVDDEYENNSGSNNDNEDDDDNDEDDDDLSVGHNARDGSDNGSGTQSSWTKRAVEIDSPQQMSPDQPSDLPDSTCAQVIHPTSEICSNRWLPTANKRSGKKHKENNDDSMGKYLEIGAPRNSSMEYQSSPREMSVNPTEKQHETLMPQSKTTRETDSRNTQNEPTTQTVDLISSIARSTDDKQVVRINNAPDCSSKVPDGNDKNRDSLIDMTSEELGLKRLKTTGSATEIHDERNILKRSDLSAFTRYHTTVASNQGGAGFGGSCSPQDNSSEALKTDSNCKGKSDITISCQSYPTYISIPSCAASNVTC

SEQ ID NO: 75976 - protein, 212 aa, Triticum aestivum
  misc_feature (33)..(33): Xaa can be any naturally occurring amino acid
EIDKAVHKMIIDAGAYPSPLGYGGFPKSVCTSXVNECMCHGIPDSRELKDGDIINIDVTVYLNGFHGDTSKTFFCGEVDEASKRLVKVTEECMLRGIAACKHGVSFKKIGRRISEHAEKHGFGVVEQFVGHGVGRVFHSQPIIYHQRNNMPGQMVEGQTFTIEPILTMGSSSIECDMWEDGWTAVTTDGSLAAQFEHTILITRTGAEILTKC

SEQ ID NO: 75977 - protein, 473 aa, Oryza sativa Japonica Group
MGSACEAGTDEPSRDDVKGTGNGILENGHSHKPEEEEWRNGMGEDLPNGHSTPPEPQQTDEQKEHQVQIVRWERFLPVKTLRVLLVENDDSTRQVVSALLRKCCYEVIPAENGLHAWQCLEDLQNHIDLVLTEVVMPRLSGIGLLSKITSHKICKDIPVIMMSSNDSMGTVFKCLSKGAVDFLVKPIRKNELKNLWQHVWRRCHSSSGSGSESGIRTQKCTKPKVDDEYENNSGSNNDNEDDDDNDEDDDDLSVGHNARDGSDNGSGTQSSWTKRAVEIDSPQQMSPDQPSDLPDSTCAQVIHPTSEICSNRWLPTANKRSGKKHKENNDDSMGKYLEIGAPRNSSMEYQSSPREMSVNPTEKQHETLMPQSKTTRETDSRNTQNEPTTQTVDLISSIARSTDDKQVVRINNAPDCSSKVPDGNDKNRDSLIDMTSEELGLKRLKTTGSATEIHDERNILKRSDLSAFTRCKK

SEQ ID NO: 75978 - protein, 745 aa, Oryza sativa Japonica Group
MGSACEAGTDEPSRDDVKGTGNGILENGHSHKPEEEEWRNGMGEDLPNGHSTPPEPQQTDEQKEHQVQIVRWERFLPVKTLRVLLVENDDSTRQVVSALLRKCCYEVIPAENGLHAWQCLEDLQNHIDLVLTEVVMPRLSGIGLLSKITSHKICKDIPVIMMSSNDSMGTVFKCLSKGAVDFLVKPIRKNELKNLWQHVWRRCHSSSGSGSESGIRTQKCTKPKVDDEYENNSGSNNDNEDDDDNDEDDDDLSVGHNARDGSDNGSGTQSSWTKRAVEIDSPQQMSPDQPSDLPDSTCAQVIHPTSEICSNRWLPTANKRSGKKHKENNDDSMGKYLEIGAPRNSSMEYQSSPREMSVNPTEKQHETLMPQSKTTRETDSRNTQNEPTTQTVDLISSIARSTDDKQVVRINNAPDCSSKVPDGNDKNRDSLIDMTSEELGLKRLKTTGSATEIHDERNILKRSDLSAFTRYHTTVASNQGGAGFGGSCSPQDNSSEALKTDSNCKVKSNSDAAEIKQGSNGSSNNNDMGSSTKNAITKPSSNRGKVISPSAVKATQHTSAFHPVQRQTSPANVVGKDKVDEGIANGVNVGHPVDVQNSFMQHHHHVHYYVHVMTQQQQQPSIERGSSDAQCGSSNVFDPPIEGHAANYSVNGSFSGGHNGNNGQRGPSTAPNVGRPNMETVNGIVDENGAGGGNGSGSGSGNDLYQNGVCYREAALNKFRQKRKVRNFGKKVACFQLHAYQSHES

SEQ ID NO: 75979 - protein, 361 aa, Arabidopsis kawasakiana
CKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVWIVSCGLSSGLGATLNVAKPKKGQSVAIFGLGAVGLAAAEGARIAGASRIIGVDLNPQRFDQAKEFGVTEFVNPRDHDKPVQQVIAEMTNGGVDRSVECTGSVQPMIQAFECVHDGWGVAVLVGVPSKDDAFKTHPMNFLNERTLKGTFFGNYKPKTDIPGVVEKYMNKELELEKFITHTLPFSEINKAFDYMLKGES

SEQ ID NO: 75980 - protein, 159 aa, Buchnera aphidicola str. Sg (Schizaphis graminum)
MNIIQSGINVKNASITIIIARFNEFINKNLLSGAIDTLTRIGQIDKEKILTIYVPGTYEIPIVASYIANTNKYDAIIAIGTIIKGSTDHFKHIANDAYSNLSRISTKYFIPITMGILTTENIQQSIERSGTKMGNKGSEAALAALEMINIMKKLKKINN

SEQ ID NO: 75981 - protein, 270 aa, Silicibacter pomeroyi DSS-3
MMETRKKLAPVDPVWDRITAEAQDAVDREPLMGGLVHACILHHKNLDRALSYRISAKLCSNEMSMMVLREIVDDAYDSAPELIEAARADLMAVYERDPACHRLLQPILYFKGYQAMQAYRVAHWLWTRKRYDLAYFFQMRVSEIFGVDIHPAARIGKGIMIDHAHSIVIGETAVVGDNVSMLHSVTLGGTGKEEEDRHPKIGDGVLIGAGAKVLGNIKVGHCSRIAAGSVVLSEVPPCKTVAGIPAKIVGEAGCDQPSVSMDQRFPNGSD

SEQ ID NO: 75982 - protein, 359 aa, Arabis hirsuta
  misc_feature (134)..(134): Xaa can be any naturally occurring amino acid
  misc_feature (255)..(255): Xaa can be any naturally occurring amino acid
  misc_feature (314)..(314): Xaa can be any naturally occurring amino acid
IRCKAAVAWEAGKPLVMEEVEVAPPQKHEVRIKILFTSLCHTDVYFWEAKEQTPLFPRIFGHEAGGIVESVGEGVTDLAPGDHVLPIFTGECGDCPHCHSEESNMCDLLRINTERGGMIHDGESRFSIDGEPIXHFVGTSTFSEYTVIHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTXGGVDRSVECTGSVQAMIQAFECVHDGWGVAVLVGVPSKDDAFKTHPMNSLNERTLKGTXFGNYNPKTDIPGVVEQYMNKELEIEKFITHAVPFSEINKAFDYML

SEQ ID NO: 75983 - protein, 174 aa, Streptomyces coelicolor A3(2)
MSKHTLSVLVENTPGVLARITALFSRRGFNIDSLAVGVTEHPDISRITIVVSVEDFPLEQVTKQLNKLVNVLKIVELEPTQAVQRELVLVKVRSDNETRSQIVEIVQLFRAKTVDVSPEAVTIEATGSSDKLTAMLRMLEPYGIKELVQSGTIAIGRGARSITDRSLRALDRSA

SEQ ID NO: 75984 - protein, 182 aa, Anabaena variabilis ATCC 29413
MGEELQVVIKNAVVVNAIIKKFYWQTITLILGIVVLCFPYPAIADWTHPLSFSNAELSRHNFAGESLQAAEFSNANLEMTNFVGADLRGAVLSASVMTQANLQGADLTNAMVDQVNLTGANLSDVVLKEALLLRAIFANVNIEGADFTDAILDKAQIKELCTKASGVNTKTGVKTRDSLGCQ

SEQ ID NO: 75985 - protein, 413 aa, Anabaena variabilis ATCC 29413
MFPASVFRLDNGLTFIHQEIPTTPVVVADVWVRAGAIREPEPWFGMAHFLEHMIFKGTATLPPGTFDHQIENRGGVSNAATSYDYANYSLTTAAPYLGDTLPYLADLLLNAAIPDDEFSRERDVVLEEIRACYDDPDWVGFQCLSQSIYQDHPYGRSVLGTEEELMQQSPEAMRRFHRAHYQPENMTVVIAGGIAQQPAWELVNRSFENFSEPVECPKINPKPKPIIKGIQRQELSLPRIEQARLLMAWVVPGVEKLRTAYGLDLLSVVLAEGRTSRLVRDLREELQLVQGICSNFSLQCESSLFTVTAWLEPENLEQVEDLILSHLDDIQTSGVTEQEIARTRRLLCNEYAFSTETPNQLTGLYGYYNTIAQAELAVTYPHQIQSFDTQELQQLAKQHLSPQNYAVTILKPL

SEQ ID NO: 75986 - protein, 427 aa, Anabaena variabilis ATCC 29413
MTQTVKPSLAQSPIHRTVLDNGIVLLVAENPAADIIAGRIFIRAGSCYEKREQAGLAHLLAALMTKGCEGLSSLEIAEQVESVGASLSADTSTDYFLVSLKTVTSDFPEILALAGRILRSPTFPETQIELERRLALQDIRSQKEQPFTLAFEQMRQVMYQNHPYAMSVLGDETTLNSITRADLVEYHQTYFRPDNLVISVAGRITLQEVVALVEQVFGDWQTPSVAPAVVNLPKISVNPQHRLKPVQTQQSIVMLGYLGPSVSSPDYASLKLLSTYLGNGLSSRLFVELREKRGLAYEVSAFYPTRLYPASFVVYMGTAPENTSIALEGLRTEVELLCSKEVSTTNLQAAKNKILGQYALGKQTNGQIAQIYGWYEILGLGIDFDREFQELIAAVTAQDALTSAQQYLQQPYVSLVGQEEAINRAIN

SEQ ID NO: 75987 - protein, 544 aa, Nitrosomonas europaea ATCC 19718; identical to SEQ ID NO: 1466

SEQ ID NO: 75988 - protein, 367 aa, Oryza sativa Japonica Group
MSAAISGASLVLSSPPAPGARPQPRPARVSVAAAAPAARRGVVAAAAVSSPAVSSSAGKDAKQIPKDFLHIDDFDKDTIMKILNRAIEVKAMIKSGDRSFQPFKGKSMAMIFAKPSMRTRVSFETGFFLLGGHAIYLGPDDIQMGKREETRDVARVLSGYNDIIMARVFAHQDILDLAKYAAVPVINGLTDYNHPCQIMADALTMLEHIGRIENTKVVYVGDGNNIVHSWLRLAALFPLHFVCACPKGFEPDAKTVEIARSAGSKIEITDDPMEAVKGADVVYTDVWASMGQKEEAEYRKKVFQGFTVDEAMMEMAGPNAFLMHCLPAERGIEVTDGAIEAPNSIVFPQAENRMHAQNAIMLHVLGA

SEQ ID NO: 75989 - protein, 250 aa, Brassica oleracea
MVKIAIGSLGDSFSVASLKAYLSEFIATLLFVFAGVGSAIAFGKLTSNAALDPAGLVAVAVAHAFALFVGVSIAANISGGHLNPAVTLGLAVGGNITVITSFFYWIAQCLGSIVACLLLVFVTIGESVPTHGVAAGLGAVEGIVMEIVVTFALVYTVYATAADPKKGSLGTIAPIAIGFIVGANILAAGPFSGGSMNPARSFGPAVVSGDFSQIWIYWVGPLVGGALAGLIYGDVFIGSYAPAPTTESYP

SEQ ID NO: 75990 - protein, 328 aa, Yersinia pseudotuberculosis IP 32953
MGQLINGVWKDVWYDTQSTGGHFKRSTAQFRNWVTTDGQAGPQGKGGFNAEAHRYHLYVSLACPWAHRALLMRTLKGLESLISVSVVHPLMQENGWTFSSDFPAATGDALYHLDYLYQLYLRAAPDYSGRVTVPVLWDKQQQTVVSNESADIIRMFNNAFDDVGAKAGDYYPTALRNDIDDINGWVYDQVNNGVYKAGFATTQEAYDEAVGTLFSALDRLEQILGQHRYLTGNQLTEADLRLWTTLVRFDPVYVTHFKCDKRRISDYPNLYGFLRDIYQMPGIAETVDFAHIRTHYYRSHGTINPYGIISIGPQQNLLEPHDRANRFV

SEQ ID NO: 75991 - protein, 453 aa, Arabidopsis thaliana
MILETQRNVEFPHRIVDKRPRKRPRLTWDAAPPLLPPPPPPTVFQPPLYYGPEFASGLVPNFVYPNMFYNGLPRQGSPPWRPDDKDGHYVFVVGDTLTPRYQILSKMGEGTFGQVLECFDNKNKEVVAIKVIRSINKYREAAMIEIDVLQRLTRHDVGGSRCVQIRNWFDYRNHICIVFEKLGPSLYDFLRKNSYRSFPIDLVRELGRQLLESVAYMHDLRLIHTDLKPENILLVSSEYIKIPDYKFLSRPTKDGSYFKNLPKSSAIKLIDFGSTTFEHQDHNYIVSTRHYRAPEVILGVGWNYPCDLWSIGCILVELCSGEALFQTHENLEHLAMMERVLGPLPPHMVLRADRRSEKYFRRGAKLDWPEGATSRDSLKAVWKLPRLPNLIMQHVDHSAGDLIDLLQGLLRYDPTERFKAREALNHPFFTRSREQSIPPFNPNPHPFLYNQKN

SEQ ID NO: 75992 - protein, 363 aa, Crucihimalaya himalaica
  misc_feature (17)..(17): Xaa can be any naturally occurring amino acid
  misc_feature (253)..(253): Xaa can be any naturally occurring amino acid
  misc_feature (350)..(350): Xaa can be any naturally occurring amino acid
IRCKAAVAWEAGKPLVXEEVEVAPPQKHEVRIKILFTSLCHTDVYFWEAKGQTPLFPRIFGHEAGGIVESVGEGVTDLQPGDHVLPIFTGECGDCRHCHSEESNMCDLLRINTERGGMIHDGESRFSIKGKPIHHFLGTSTFSEYTVVHSGQVAKINPDAPLDKVCIVSCGLSTGLGAVLNVAKPKKGQSVAVFGLGAVGLAAAEGARIAGASRIIGVDLNSKRFDEAKKFGVTEFVNPRDHDKPVQQVIAEXTDGGVDRSVECTGSVQAMIQAFECVHDGWGVAVLVGVPSKDDAFKSHPMNFLNERTLKGTFFGNYKPKTDIPGVVEKYMNKELELEKFITHTVPFSXINKAFDYMLKGES

SEQ ID NO: 75993 - protein, 363 aa, Olimarabidopsis pumila
IRCKAAVAWEAGKPLVMEEVEVAPPQNHEVRIKILFTSLCHTDVYFWEAKGQTPLFPRIFGHEAGGIVESVGEGVTDLQPGDHVLPIFTGECGDCRHCHSGESNMCDLLRINTERGGMIHDGESRFSINGKPIHHFLGTSTFSEYTVVQSGQVAKINPDAPLDKVCIVSCGLSTGLGATLNVAKPKKGQSIAIFGLGAVGLAAAEGARIAGASRIIGVDLNSKRFDQAKEFGVTEFVNPRDHDKPVQQVIAEMTDGGVDRSVECTGSVQAMIQAFECVHDGWGVAVLVGVPSKDDAFKTHPMNLLNERTLKGTFFGNYKPKTDIPGVVEKYMNKELELEKFITHTVPFSEINKAFDYMLKGES

SEQ ID NO: 75994 - protein, 585 aa, Buchnera aphidicola str. Sg (Schizaphis graminum)
MNFDITRYPILSFAHSVRRLRLLSIEQLPQLCTELRKYLLDVVSITQGHFASGLGVIEITVALHYVYDTPFDNLLWDVGHQSYPHKILTGRAEKIGSIRKKNGLHPFPFREESKYDILSVGHSSTSISAGLGLSIAAGKEGKNRKTICVVGDGSMTAGMAFEAMNHAGIIQSDLLVVLNDNQMSISKNIGALNKHLKFLRDIKKSSKIFNFSIFESLNFKYLGPFDGHNIFKLIEIFKKTKDYRKTCLLHLITKKGKGYLPAELDPIKWHTISQSFSSSSKILTYSDVFGSWLCEIAEFDKKIMAITPAMCEGSGMLKFSRLFPNQYFDVAIAEQHAVTFAAGLAIAGYKPVVSIYSTFLQRAYDQIIHDVALQKLPVLFAIDRGGIVGHDGPTHQGIFDLSYLRCIPGIVIMTPSNENECRQMLYTGYMYKEGPSVVRYPKGKGIGMSLSPMKLIPLGKSLIKRVGEKIAILNFGALLQNAYLAAEKLNATLIDMRFVKPLDTNMILKLSLKYNFLVTIEEGVIAGGAGSAVNEFIMMRKILLPVLNIGLPDMFIAHGSQEEIKHDYQLDPEGIQNKILAWLSY

SEQ ID NO: 75995 - protein, 1642 aa, Oryza sativa Indica Group
MGLVVTAASAAVEWVVQSILGSFFTGQLQVWTHEVGLIEHVQGLESEMRSMQMVLATTDRRKIDNRPLSESLNELQDVLFDAEDVMDELDYYQLQQQIEGKGSRASACIDPEGSCVSSYTPSLFQQVSSSMNQIIGWAMHGRKMKREEEPTHSIILPLEIKHDISDRIKGILNQLRIKGKPVLEILQLELSCQIAMSKQIQSGPRKPRQTTSLLIECKVYGRDAERDNIIELLTKGKSSDLGVLPLVGVGGVGKTTLARFVYHDQRIKDHFDLRMWVCVSDNFNEKSLTREILEHVCKDRQGYENIIGLGALQDTLLENIRCKRFLLVLDDMWEDGDMSGWDNLLAPFKCNEATGCMILVTTRRTSVAKRIGTVNKVEVNGLDETEFWLLFKAWAFNGYENLELDPFFQSTGKDIARELKGNPLAARSVGALMNRSVSFEHWRKVQYKWKSLVGQDDDILSILMISYEYLPVHLQHCFSYCSLFPKDHKFNGKKLVHAWISQNFVKCECHTERLEETGMQYLDNLVDWGFFEEVESHYVMHDLMHDLAEKVSSNECAAIDGLESNKISPSVRHLSIITTAYDKDGPRSFPTKNFENKLQNIRSLQKLRTLMFFGRRNTILLRSLQTLCKELKRLRLLRIYVTVSDISSIHNFLKPHHLRYLEFIVVPATNMFGHMDIANTSIPQAFTNFFHLQVLDVSSNGNIAVPIGMNKLINLRHLIAHEKVHSAIDSVGKLTCLQKLIFKVQDADSFEIGQLRAMNDLVILGISQLENVKTKKEARSARLMDKEHLKELSLSWNDNLLKRIQDMMCLRVLNLMVLHLENCTEWRIVQYLEMLPLLRKLKLIRMWNLVEVSIPSYLEELVLVNMPKLENCVGTYGIELTSRIRVLMVKDCPQLNEFVLFHRDHFHAEQKSWFPSLNKLMIGHCYRIIMWKILPLEEMRALKELELMDVPISRRIASSFSGKVGVNSNAEPANLHLVVSLPIPPSPLMSYSSIKRLSAFPTMEINNRKFTIESDELSELDGRILSFHNLKGVTSIYLRRCPNLTRISTEGFNQLITLECLVIQKCPNLFQLQISDQANNTSSATNIPALPSLKSLTISSCGIAGRWLTQMLHYVNSLEKLDLFDCPQIKFLLTNQPTEREVTSSLASAEITSAGDVQLLQIPCSLLQSLKWLSISECPDLEFCGASGGFAGFTSLVQLQIKNCPKLVSALVSETNDNGLLPMSLQDLSLSPLSVSENLQSFSPEGLPCLRRLSLCRSQHLKPMQLHSCTSLEYLKISGCRSLVVLEGLSSLRRLDIQMNPELSAAWHLKLPQNKNKVAIRLSLSPYLQQEASGMWFRLESLMIDDAAVLSVHLCIQLTSLRTLQFWSMGMASLTEEQERALQLLTSLRQLGFSRCQKLESLPANLQSLDFLEDANGLGLRAIPGEDYCRIVIQYPSDTDSKWKDPKTGEPEGLSFEFNLCEAVASWEQDEVLFGVQKGTHFTTWESILSNDGMSWCDPGRVVKWLPTKDTIEAARAASEKLLKRPGAGSEGPLSSCTMIKKLEKVKTAKRSVVHDAALNHLEYIRGSTSIFTGINGRAFFVAAFLRGYCRSFRTLEIFSGPPDVAAPAAKAVDIAVVLATAAAIVVTATTSPPADVAAAGV

SEQ ID NO: 75996 - protein, 294 aa, Buchnera aphidicola str. Sg (Schizaphis graminum)
MNFSHLYDIYYNRINKKLFEIIQELPFQDSVLFRAMKYSTLSGGKRLRACLIYATGETFQVNIAALDVISAAVELVHSYSLIHDDLPCIDNDYFRRGKISCHIKYGENFALLAGDALQGLAFNILSNSNMPGVHDSIRLKMIAEFSNAIGYSGMCIGQMLDLEKERKKINISELEKINLYKTAFLIRCSIRLAYFASNNFSKEVLFILDKFSVSIGLAFQIQDDILDLKNDIKKLESKRNKTKNTYPLLIGLKKSKIKIKELYKEAFFTLEILKKNFNVNILKLLTQFIMKRFK

SEQ ID NO: 75997 - protein, 362 aa, Olimarabidopsis cabulica
RCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCRHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSKRFDQAKEFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEKYMNKELELEKFITHTVPFSEINKAFDYMLKGES

SEQ ID NO: 75998 - protein, 90 aa, Arabidopsis thaliana
METQKTQAENPPKPATSSCRKKTKDDANFLEDVKDHIDDFINASMDDHKNCFNKTIKKMFGLSKAVADKQQSEAKGGVESYLPLQTTVSD

SEQ ID NO: 75999 - protein, 315 aa, Nostoc sp. PCC 7120
MSLTFVPPPIQKINSEIANNAGVEIYVLRLDLMHPWVNGNKWYKLKYNLLEAKEKSYTKLLTFGGAYSNHIFATAAAGNLLGFQTIGIIRGEETLPLNPTLSFATQQGMQLVYVDRETYRQRNSTTLHTDLRKRFGEVFIIPEGGSNLNGVRGCLEIISAATQVFDIVCVACGTATTLAGIALALEPQQRVIGFPVLKNGGFLAQDIAQLMKNYVAAGLPISSSSPASWELVCDYHFGGYAKVKDDLILFSHQFTQSYGVPLDYVYTAKMFYGVMDLLKQRYFTKGDGLRPTVGHRILMIHTGGLQGNIGMSERL

SEQ ID NO: 76000 - protein, 363 aa, Crucihimalaya wallichii
IRCKAAVAWEAGKPLVMEEVEVAPPQKHEVRIKILFTSLCHTDVYFWEAKAQTPLFPRIFGHEAGGIVESVGEGVTDLQPGDHVLPIFTGECGDCRHCHSEESNMCDLLRINTERGGMIHDGESRFSIKGKPIHHFLGTSTFSGYTVVHSGQVAKINPDAPLDKVCIVSCGLSTGLGAVLNVAKPKKGQSVAVFGLGAVGLAAAEGARIAGASRIIGVDLNSQRFDEAKEFGVTEFVNPRDHDKPVQQVIAEMTDGGVDRSVECTGSVQAMIQAFECVHDGWGVAVLVGVPSKDDAFKSHPMNFLNERTLKGTFFGNYKPKTDIPGVVEKYMNKELELEKFITHTVPFSEINKAFDYMLKGES

SEQ ID NO: 76001 - protein, 232 aa, Oryza sativa Indica Group
MASSSDPWVREYSEASRLADDVTSMIADRGSLPQSGPEIMRHTSAIRRKITILGTRLDSLEALLSRIPPKSITDKELHKRQDMLSNLKSRAKQMATSFNMSNFANREDLLGQSKKAADDMSRVAGLDNQGIVSLQRQVMKEQDEGLEKLEETVLSTKHIALAVNEELTLHTRLIDDLDDHVDVTNSRLQRVQKRLAILNKRVKGGCSCMALLISVVAIVFLAVIAWLLIKHL

SEQ ID NO: 76002 - protein, 347 aa, Streptomyces coelicolor A3(2)
MSRSLNLAVIPGDGIGQEVVAEGLKVLSAVLPQDVKLETKEFDFGARRYHATGETLTDADLDALKAHDAILLGAIGDPSVPSGVLERGFLLKLRFAFDHHVNLRPSKLLPGVATPLAGQPEIDFVVVREGTEGPYTGNGGTIRKGTEHEVATEVSVNTAYGVERVVRDAFARAQARPRKKLTLVHKNNVLTFAGHLWTNIFNKVAAEYPEVTTDYLHVDAATIFLVTDPARFDVIVTDNLFGDIITDLAAAVSGGIGVAASGNINPSGDFPSMFEPVHGSAPDIAGQGKADPTATVLSVALLLRHLGYEDEAARIEDAVSADLGERGDLPARSTSEIGDTLAARVAG

SEQ ID NO: 76003 - protein, 363 aa, Arabidopsis suecica
IRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSGYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPKDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGES

SEQ ID NO: 76004 - protein, 80 aa, Zea mays
  misc_feature (26)..(26): Xaa can be any naturally occurring amino acid
  misc_feature (61)..(61): Xaa can be any naturally occurring amino acid
MAEAEEQRGLMATGRTPTNMAGIKYXRKRNEVLILPINDRISVSVDPDHLWSTTTVARSPXFLYDRMWLKEEEILNMRRK

SEQ ID NO: 76005 - protein, 367 aa, Oryza sativa Indica Group
MGKVPHAMRAAKLPLAVLAKPTHASASQPPAPPRPSNPRHRKTPAKASKTPAPATAAAPPPVEKRPIKTASDLAAAIRAAADADVDAAVDLARSAARTIPLPPHSLSLLLRRLARHRSVAAARGLLAELHPSPASPPPRPALLALSDAVCRRGEPREIAQLLPVLADHGVKADAPVYNALMKAHCAASDPAGVLGVLRRMKDDGVEPDLVTYNTLVFGLARAGMVTKARTYLDAMAAAGHFPDVITYTSLMNGMCVKGDAMGALALLEEMEAKGCEPNERTYNTLLMGLCKNKKLDKAVDVYKSMVGAAMKLEAPAYATFVRALCRAGRVPDAYEVFDYGIESKSFAEVTLYTELENSLKWLHRMKS

SEQ ID NO: 76006 - protein, 517 aa, Triticum aestivum
  misc_feature (278)..(278): Xaa can be any naturally occurring amino acid
MGLVWMVAAAVAAVLASWAFNALVYLVWRPRAITRKLRAQGVGGPEYKFFAGNLGEIKRLLAATAGAVLDVGSHDFVPRVQPHFRKWIPIHGRMFLYWFGARPTLCVADVNMVKQVLSDRSGMYPKNIGNPHIARLLGKGLVLTDGEDWKRHRKVVHPAFNMDKLKMMTVTMSDCAGSMMSEWKAKMEKGGDMEIELSSQFEELTADVISHTAFGSSYEQGKKVFLAQRELQFLAYSTVFNVQIPALRYLPTEKNLKIWKLDKEVRSMLMNIIKTRLXTKTPWDTMGYGNDLLGLMLEACAPEHGQNPILSMDEIIDECKTFFFAGHDTSSHLLTWTMFLLSTHPEWQEKLREEVLRECGNGAPTGDMLNKLQLVNMFLLETLRLYGPVAVIQRKACSDLEVGGIKVPEGTVLTIPIATIHRDKEVWGEDANEFKPMRFENGVTRAGKHPNALLSFSSGPRSCIGQNFAMIEAKAVIAMILQRFSFSLSPKYVHAPMDVITVRPKFGLPMVLKSLEM

SEQ ID NO: 76007 - protein, 480 aa, Neisseria meningitidis Z2491
MKQLAMYINGRFENDFNGEWRNVLNPSTEEAIAREPKGGKADVDRAVAAARAAQPAWERLPAVERGAYLRKIAQGIRERADELTDTIVAEGGKTKDLARVEVMFTADYLDYQAEWARRYEGEIIQSDRPRENILLFKRPLGVIAGILPWNFPFFLIARKMGPALVTGNTIVVKPSSVTPINCHIFAEIVDAVGLPAGVFNVVNGPGAEIGNALSAHPQVDMVSLTGSVEAGRQVMEAASANITKVSLELGGKAPAIVLKDADLDLAVKSILASRVGNTGQICNCAERVYVHSSLKDAFIEKMTAAMKGVRYGNPAEAEAGALEMGPLIEERAVKAVAEKVERAVKQGAKLVCGGKRAEGRGYFFEPTLLTDTDNSMDIMKEETFGPVLPVSAFDTLDQVIALANDCEFGLTSSVYTTNLNEAFYVTRRLQFGETYINRENFEAMQGFHAGWKKSGIGGADGKHGLEEYLQTQVVYLETDI

SEQ ID NO: 76008 - protein, 483 aa, Pseudomonas syringae pv. syringae B728a
MIPVILSGGSGSRLWPLSRKQFPKQFLALTGEHTLFQQTLERLVFEGMQEPIVVCNKDHRFIVNEQLAALNLETQAILMEPFGRNTAPAVALTAMKLVNEGNDGLMLVLPADHVIEDQKALQRALALATVAAERGEMVLFGVPANKPETGYGYIKSTADALLPEGVSRVSQFVEKPDEKRAKEFVEAGGYYWNSGMFLFRASRFLEELKKHDPDIYDTCLLTLERSVQDGDALEIDSSTFACCPDNSIDYAVMEKTQRACVVPLSAGWSDVGCWSSLWEVNAKDANGNVTKGDVVIQDSRNCMIHGNGKLVSVIGLDNIVVVETKDAMMIAHKDKVQGVKQMVATLNEQGRTETQNHLEVYRPWGSYDSVDMGGRFQVKRISVKPGACLSLQMHHHRAEHWIVVSGTAQVTCDENVFLLTENQSTYIPIASVHRLRNPGKIPLEIIEVQSGSYLGEDDIERFEDIYGRSNALEAGVKTQTIAR

SEQ ID NO: 76009 - protein, 368 aa, Gibberella zeae PH-1
MSPSAVAAKKTYNIASIPADGIGPEVISAGIEALTALASTLQTFNLDFTHYDWSSDTYKKTGKYIPDGGLDQLKKHDAILFGAVGAPDVPDHISLWGLRLAICQPFQQYANVRPTRIMRGTQSPLRNCKTGDLDWVIIRENSEGEYAGQGGRSHRGHPWEVATEVSIFTRHAVNRLIRFAFEIAQKRPRKHLTVVTKSNAQRNGMVLWDEVAAEVAKDFPDVTVEKMLVDAMTTKMVLKPESIDTIVASNLHADILSDLAAALAGSIGIAPTSNLDPTRENPSMFEPIHGSAFDITGKGIANPVATFWTAAEMLSWLGEEDASAKLMECVENVTASGVLTQDLGGNATTKQVTDAVVAEIEKLGNGSD

SEQ ID NO: 76010 - protein, 519 aa, Schizosaccharomyces pombe 972h-
MSIAKNIENDPSKGWVVQKFGGTSVGKFPIKIAVDVAKEYLSTKRVALVCSARSTDTKAEGTTTRLIRATEAALRPAVGSVHDLVRIIETDHVQAARDFIQDVGIQDELIDAFHADCVELEQYLNAIRVLSEVSPRTRDLVIGMGERLSCRFMAAVLKDQGIDSEFIDMSHIIDEQREWRNLDASFYAYLASQLASKVTAVGNKVPVVTGFFGMVPGGLLSQIGRGYTDFCAALLAVGLNADELQIWKEVDGIFTADPRKVPTARLLPLITPEEAAELTYYGSEVIHPFTMSQVVHARIPIRIKNVGNPRGKGTVIFPDTISRHGSATPPHPPKIMPDDISASLANKGATAVTIKDTIMVINIQSNRKISAHGFLASIFAILDKYKLAVDLITTSEVHVSMALYEESDDGNMHEAFVELRRLGTLDILHGLAILSLVGKHMRNTTGYAGRMFCKLAEAQINIEMISQGASEINISCVIDEKMAVKALNVIHKELLEPLALHEVPSQASMLVEKPWLYSA

SEQ ID NO: 76011 - protein, 529 aa, delta proteobacterium MLMS-1
MQLAGSKILVVDDDSFVREMLTSILEAAGYRVTTAEDGLDALAKYEDDQQIELIISDVNMPRLDGIQLIQELQSRRLDVPIIMVTSVNSISVAVDALSSGAIDYVLKDEGVQETIEITVKRALEKDKIKQQNKQLVAELAAKTREQENTLSYLNAIIGNIPDGLLVTNDRARITMANPALGGMFREAAGGNLVGRDCREVFADSLGPMLAAISTSQQQAVTVQVELAGGRIGSAIGTAIYRGGAGQEEFIGYLIVVRDITHQKEIERMKDDFVSAVSHELRTPLTSVLGFARLIAKKLEGVILPVVPRQDPRVERAVRQVGDNINIIVTEGERLTKLINEVLDLSKMEAGKVEWQLEPVTAEEIVKRALDATTGLFGEGAPELLSEVEPELPVLCCDRDRIMQVLINLIANARKFTDHGRVTVRARRAAGEEAVLFEVSDSGCGITPENLQSVFEKFKQVGDTLTDRPKGTGLGLPICKEIVEYHGGTVTAESTPGAGSTFRFTLPTAAVVGSTAERERPGAKLEVADE

SEQ ID NO: 76012 - protein, 137 aa, Triticum aestivum
  misc_feature (11)..(11): Xaa can be any naturally occurring amino acid
  misc_feature (16)..(16): Xaa can be any naturally occurring amino acid
  misc_feature (18)..(18): Xaa can be any naturally occurring amino acid
  misc_feature (26)..(26): Xaa can be any naturally occurring amino acid
  misc_feature (32)..(32): Xaa can be any naturally occurring amino acid
  misc_feature (36)..(36): Xaa can be any naturally occurring amino acid
  misc_feature (39)..(39): Xaa can be any naturally occurring amino acid
  misc_feature (44)..(44): Xaa can be any naturally occurring amino acid
  misc_feature (57)..(57): Xaa can be any naturally occurring amino acid
  misc_feature (65)..(66): Xaa can be any naturally occurring amino acid
  misc_feature (72)..(72): Xaa can be any naturally occurring amino acid
  misc_feature (79)..(79): Xaa can be any naturally occurring amino acid
  misc_feature (81)..(81): Xaa can be any naturally occurring amino acid
  misc_feature (86)..(87): Xaa can be any naturally occurring amino acid
  misc_feature (93)..(93): Xaa can be any naturally occurring amino acid
  misc_feature (95)..(95): Xaa can be any naturally occurring amino acid
  misc_feature (102)..(102): Xaa can be any naturally occurring amino acid
  misc_feature (107)..(107): Xaa can be any naturally occurring amino acid
  misc_feature (109)..(110): Xaa can be any naturally occurring amino acid
  misc_feature (129)..(129): Xaa can be any naturally occurring amino acid
  misc_feature (133)..(133): Xaa can be any naturally occurring amino acid
  misc_feature (135)..(135): Xaa can be any naturally occurring amino acid
LVTESSQPSRXYMMIXAXGVQRGLIXEGISRXEKKXFYXKGLKXQNVEKSFAEQHYXDLCSKPFXXGLVEYXVSGPGVXMXWEVKXXVATGRXIXGATSPLXSEPGXIXXDFAVDIGRNVIHGSDSVEXARKXIXLR

SEQ ID NO: 76013 - protein, 246 aa, Desulfotalea psychrophila LSv54
MRAQSCSLFLEMKCREEFVLSKGPGVEKMFDAIAGRYDLMNKVMTMGQDQRWRRFVVAKAGDPGAGQVLDLATGTGDIAALMHRSYPRAQVTGGDFSRNMLEEAKKRFAGQGIDWQVCDANKLPFADNTFEAVTFGYLLRNVDDASSVLAEVYRVLKPGGRCVCLDTTPPAKNIIYPFVQFYFRYGIPLLGRMIAADEAAYAYLSGSTMEFHSAEVLADLFRGAGFVDVHYKKFMLGTIGIHWGVK

SEQ ID NO: 76014 - protein, 219 aa, Mycobacterium leprae TN
MTIAVHYDEKIAILELGDDENRFTSVFLEEINSHLDEIIASGANGLVTTALGKFYSNGLDLDWLSAHRDQTQWYVGKVQGLLARLLTLPIPTAAAVVGHAFGAGAMLAMAHDFRVMRADRGYFCFPEVDIRIPFTPGMAALIQAKLAPQAATASMTTGRRFGGGEAARLGIVDNTAAEDAVTAVAVDLLHPLGGKDPGTLGVIKQTMFGHAAAALSANA

SEQ ID NO: 76015 - protein, 364 aa, Rhodobacter sphaeroides 2.4.1
MKAARLYEYDPAMNVRLKIEDVPSPTIDRPDEVIVKVGAAGLCRTDLHIIEGVWRDIMDSHGSLLPYIMGHENAGWVEDVGSGVTSVKPGDAVICHPLRTCGICLNCRHGHDMHCQNNLFPGLGLDGGFAEYFKTSERSLIKLNTGITPLSVAPMADAGITAYRAAKRAAKLLNPGDWALILGVGGLGHIALQVLNEMAGCRTIAVDREPGAQVLAKELGADKVLSGGPDLIEEVRQITGGGARVVIDFVGELGVENLCWKLLKNGGDLIMVGYGGTIEIPTLELVAREIRIGGSLVGDYTELVELMELNADGKVKMHQTEFALEDINTAIDDFKNRRFTGRGVIVPGAPSARRVEERTAEAVK

SEQ ID NO: 76016 - protein, 437 aa, Mycobacterium leprae TN
MTLYQQISVDGSGTMSDVTTHQLPMHTPGYHRQRAFAQSSKLQDVLYEIRGPVSQHATRLETEGHRILKLNIGNPALFGFDAPDVIMRDMIQALPYAQGYSDSQGILPARRAVVTRYELVDGFPRFDVDDVYLGNGVSELITMTLQALLDNGDQVLIPSPDYPLWTASTSLAGGTPVHYLCDETQGWQPDIADVESKITERTKALVVINPNNPTGAVYSNEILNQIVDLARKHQLLLLADEIYDKILYDDTKHISVASIAPDLLCLTFNGLSKAYRVAGYRSGWLAITGPKDHASSFIGGINLLANMRLCPNVPAQHAIQVALGGHQSIEDLVLPGGRLLEQRDVAWTKLNEIPGVSCVKPTGALYAFPRLDPEVYGIVDDEQLVLDLLLQEKILVTQGSGFNWPAPDHLRLVTLPWSRDLAAAIDRLGNFLVSYRQ

SEQ ID NO: 76017 - protein, 431 aa, Arabidopsis thaliana
MKLLHLIFLLALTTGISAVLIYIIGVSNLYLEALQSLQNGFQKCVSANGLGLQAAMGRDYCKVSINFPKDTVPKWKDPKSGELEGLSYEFDLCEAVATWEQVRNSSTILTKEYIDALPNGWEDYAWRRINKGIQLNRCQNKSLCIEKLSLVLPETPPYFPRQFGRCAVIGNSGDLLKTKFGKEIDTYDTVLRENGAPIQNYKEYVGEKSTFRLLNRGSAKALDKVVELDEKKQEVLLVKTTIHDIMNKMIREVPIKNPVYLMLGASFGSAAKGTGLKALEFALSTCDSVDMYGFTVDPGYKEWTRYFSESRQGHTPLHGRAYYQMMECLGLIKIHSPMRADPNRVVKWVPSRSTIRSARIAAEKLLRRVGAGSADPLASCSIVKKRNKNKRPMVSHLRKPVSDHQKFVRSTSMYPVEHSPGHGQLCITPAD

SEQ ID NO: 76018 - protein, 444 aa, Saccharomyces cerevisiae
MGKLLQLALHPVEMKAALKLKFCRTPLFSIYDQSTSPYLLHCFELLNLTSRSFAAVIRELHPELRNCVTLFYLILRALDTIEDDMSIEHDLKIDLLRHFHEKLLLTKWSFDGNAPDVKDRAVLTDFESILIEFHKLKPEYQEVIKEITEKMGNGMADYILDENYNLNGLQTVHDYDVYCHYVAGLVGDGLTRLIVIAKFANESLYSNEQLYESMGLFLQKTNIIRDYNEDLVDGRSFWPKEIWSQYAPQLKDFMKPENEQLGLDCINHLVLNALSHVIDVLTYLASIHEQSTFQFCAIPQVMAIATLALVFNNREVLHGNVKIRKGTTCYLILKSRTLRGCVEIFDYYLRDIKSKLAVQDPNFLKLNIQISKIEQFMEEMYQDKLPPNVKPNETPIFLKVKERSRYDDELVPTQQEEEYKFNMVLSIILSVLLGFYYIYTLHRA

SEQ ID NO: 76019 - protein, 442 aa, Rickettsiella grylli
MRINLFGAGYVGLVTAACLAEHGNKVLCIDIDQEKIKRLQQGECPIHEPNLPNLLDKNLRAGRLHFSTHPEDGIQHGFYQFITVNTPQDEDGSADLSHVLKVAECIGQLLVEPKLIVNKSTVPVGTAHKVKAIIQNQLNQRGLKIPFYVASNPEFLREGAAVNDFMQSDRIIVGTENKDAEFHLRNLYRPFNRNNDRLIAMDIRSAELTKYAANAFLATKISFINEMSQLAERLNADIEQVRIGIGSDPRIGYHFINPGCGYGGSCFPKDVLALEATAKSVDYHARLLNAVHHVNNNQKKLLFNKLSQYFQHNLHGKTIALWGLAFKPNTDDMREAPSTVFITAALAQGMKIQAYDPVAMTEAMRLYAKHDHFSCSASAEDALIEADALVIVTEWDIFFNPNFELIKKRLKDPVIFDGRNLYDPNYLKQLKIKYYSIGRGGH

SEQ ID NO: 76020 - protein, 350 aa, Brassica oleracea
  misc_feature (227)..(227): Xaa can be any naturally occurring amino acid
PLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPEAPLDKVCIVSCGLSTGLGATLNVAKPKKGQSVAIFGLGAVGLAAAEGAKIAGAGRIIGVDLNPKRFEEAKEFGVTEFVNPXEHDKPVQQVIAEMTNGGVDRSVECTGSIQAMIQAFECVHDGWGVAVLVGVPSKDDAFKTHPMNLLNERTLKGTFFGNYKPKTDIPGVVEKYMNKELELEKFITHTVPFSEINKAFDYMLKGES

SEQ ID NO: 76021 - protein, 300 aa, Pseudomonas fluorescens Pf-5
MTLQYPTIADCVGNTPLVRLQRLPGATSNTLLLKLEGNNPAGSVKDRPALSMITRAELRGQIQAGDTLIEATSGNTGIALAMAAAIKGYKMILIMPDNSSAERKAAMTAYGAELILVSQEEGMEGARDLAERMQAEGRGKVLDQFANGDNPEAHYSGTGPEIWRQTQGSITHFISSMGTTGTIMGTSRYLKEQNPAVQIVGLQPMEGSAIPGIRRWPEQYLPKIYQASRVDRIVDMAQSEAEDVTRRLAREEGIFCGVSSGGAVAAMLRLSREVENAVMVAIICDRGDRYLSTGIFDAPN

SEQ ID NO: 76022 - protein, 294 aa, Rickettsiella grylli
MELNVVSYQNRINGLLKQCLSNPPPLSKPLYDAMIYAVLNGGKRLRPLYVYTLGNVLGLSLQDLDHIACAIEFIHAYSLIHDDLPCMDNDDWRRGKPSCHKQFGEAMALLAGDALQALAFDTLLKAPFQSLKVIKMLSVLTEAVGAQGMVAGQAMDFKDFNALGRSDRSNAENIHALKTGSLFGAAFQLPAIAADLPQDHSLTLKNVGHQVGLVFQIQDDICDDENVHFWQHSSRKESYLKRLEEQILANLNVILSFNEEKQAFQSPFIQLIKQLFRERTIEDNYHVDREKSFL

SEQ ID NO: 76023 - protein, 553 aa, Oryza sativa Indica Group
MAVAVAASLSTPAPSPAAGGRGRRRVNVAVASLRRAAAGGGSSWRSERRLMSELERTVTPGAAERVIRSYVASKSERAALAALSRLLMDSDPFAIPFYEVVTQARWFKWSSIHAAAVAALLESNGSAEESRSLISDSISRLHSTSSSSEEVSLFYCDLMAAFSSRGMRDRAMDFYSQLRASPPLSGKKTYTAMIKSLCLMGLAGEAEAALREMASRGHQPEAFQFGLVAKCYGKAGSMAEMERVISSMSDAGIRLGTGAANIVLSCYTSCRDHSRMLAWLRRMRKLRIAPTTKAFNFVLNSCPTVASMAQELGESLPLSTAELVKKLRSASQWPAEAELVQELLTSSSVLDKAMDWSESEVKLNLHGFSTIAAYVLILQWVDAMKARRALPLEVSVVCGIGKHSDVRGEPKVRELAQEVLSRMGSPLRLSMRNKGRLVAKRDRVKQWLATDWSSPVDEESTDQSPNGDNQQPFLLTLMRKLGQLLEGYGTDKPCRPVIEGKAYNLGGGLGRVEEIPEEISAAVSAAAGAGGTGFLGVELATTTTACTLHLYKP

SEQ ID NO: 76024 - protein, 197 aa, Buchnera aphidicola str. Sg (Schizaphis graminum)
MKSNSVLIPMVVEQHSRGERSYDIYSRLLKERIIFITGTIEDNMASSIVAQMLFLEAESLDKDIFLYINSPGGIITSGMSIYDTMQFIKPDVNTICIGQACSMAAFLLSSGTKGKRSCLPNARIMIHQPLGGYQGQASDIAIHAEEINKMKKKLNKLMSLNTGQSIKKINKDTERDCFLSAHESIKYGLIDLILTQR

SEQ ID NO: 76025 - protein, 339 aa, Streptomyces coelicolor A3(2)
MTFRMPPEWAPHERTWMAWPGPNATFTDAEELAGARAAWASVARAVRRFEPVTMVHGPGQAATARELLGPDVDLVERELDDAWMRDIGPTFVTDGRGGLAAVDWVFNGWGAQDWARWEHDAEIARHVADLAAAPVLSSPLVNEGGAIHVDGEGTVLLTDTVQLGSGRNPGWSREEVEAEIHAKLGTTTAIWLPHGLAGDYGRYGTQGHVDIVAAFARPGTVVVHSQRDPRHPDHERSQLYLEILRGRTDARGRRLEVVEVPAPTVLKDEEGEWADYSYINHYVCNGGVVLCAFGDPNDELAAGIFRRLFPERTVTLVDARTIFAGGGGIHCITQQQPRT

SEQ ID NO: 76026 - protein, 267 aa, Nostoc sp. PCC 7120
MENFVTPPAFGEKIRERWTLAGRKALITGATKGIGLAIAQEFLALGAEVVIVARNAEAIEQQMKAWHSAGKVHGVAADVSTSEGRQMMLDYVSKTFGELDILVNNVGTNIRKKATDYTEEEFAAIFQINLTSIFELSRLFYPLLKTSKNSSIVNIGSVAGLISVRTGAPYGMTKAALVQLTRSLAVEWADDGIRVNAIAPWFIQTPLTEPLLNNPETLSAVLSRTPMKRVGQPEEVASLTAFLCMPTASYITGQCIAVDGGFLAFGF

SEQ ID NO: 76027 - protein, 351 aa, Brassica napus
MGSSVEQNILVTGGAGFIGTHTVVQLLKEGFKVSIIDNLDNSVIEAVDRVRELVGPDLSKKLEFTQGDLRNKGDIEKLFSKQRFDAVIHFAGLKAVGESVGNPRRYFDNNLVGTINLYETMAKHNCKMMVFSSSATVYGQPEKIPCMEDFELKAMNPYGRTKLFLEEIARDIQAAEPEWRIVLLRYFNPVGAHESGRIGEDPKGIPNNLMPYIQQVAVGRLPELNVYGHDYPTEDGSAVRDYIHVMDLADGHIAALRKLFDDPKIGCTAYNLGTGRGTSVLEMVAAFEKASGKKIPIKLCPRRLGDATAVYASTEKAEKELGWKAKYGVEEMCRDQWNWANNNPWGYQKKR

SEQ ID NO: 76028 - protein, 53 aa, Triticum aestivum
EVTDADSANMLRRRSRPFGANIHTLGNEDHGPSDERNVFWNGNSTEFGGDDRK

SEQ ID NO: 76029 - protein, 674 aa, Hordeum vulgare subsp. vulgare
MFPLGARQPPPSAMDNQQQQQPPRGEHAAQPRCWEEFLHRKTIRVLLVETDDSTRQVVAALLRHCMYQVIPVENGHQAWAYLQDMQSNIDLVLTEVFMHGGLSGIDLLGRIMNHEVCKDIPVIMMSSHDSMGTVLSCLSNGAADFLAKPIRKNELKNLWAHVWRRSHSSSGSGSGSAIQTQKCTKSKSGDDSNNNSNDRNDDASMGLNARDGSDNGSGTQSSWTKRAVEIDSPQDMSPDQSADPPEGTCAHVNHPKSEICSNRWLPGTNNKKCQKPKETTNGDGFKGKELEIGAPGNLNTDDQSSPNESSVKPTDGRCEYLPQNNSSDTVMENLEEPIVRAADLIGSMAKNMDAQQAAARAIDAPNCSLQASEGKDTDGENAMPYLELSLKRSRSTGEGAGPIQEEQRNVVRRSDLSAFTRYNMCAVSNQGGAGFVGSCSPNGDSSEAAKTVAAQMKQGSNGSSNNNDMGSTTKSVVTKPCGNNKVSPINGNTHTSAFHRVQPWTPATAAGKDKADEVSKKNVAAAAAAAKEMGCEAQSKHPCAAADDVNGGSAGGTAQSSVVNPSGPVEGHTANYGSNSFSNNNTNNGSTAATTAAAAAVHAETGGGVDKRSNMMNMKRERRVAAVNKFREKRKERNFGKKVRYQSRKRLAEQRPRVRWQFVRQPPAPATVER

SEQ ID NO: 76030 - protein, 321 aa, Oryza sativa Japonica Group
MMAVTNGVIHASSREPLFSFGVIADVQYADIPDGRSFLGVPRYYRHSISVLQRAVSTWNKQHNIKFSINFGDIIDGYCPKDKSLWAVQKVLDEFEKFDGPTYHMFGNHCLYNLPRGKLVSLLKMPTDSDRAYYDFSPCPEYRFVVLDAYDFSALGWPRDHPVTAEAMKFLEEKNPNSDKNSPDGLVGVDRRFVMFNGGVGKEQLSWLNDVLQDASARRQNVILCSHLPMDPGSASFAALMWNYDEVMAIVRQYKCVKACFAGHDHKGGHSVDSHGVHHRTLEAALECPPGTSAFGHIEVYPDKLLLVGSDKMADTEMCFEP

SEQ ID NO: 76031 - protein, 400 aa, Hordeum vulgare subsp. vulgare
MDCCFPCPGARRKRKPPAPAEKPQIPPAPDKAKPGCSSSSAAARQDSLLEAKKEFVLSNGSEHRHIAAQTFTFRELAAATNGFRADCLLGEGGFGRVYKGYLESINQVVAIKQLDRNGLQGNREFLVEVLMLSLLHHPHLVNLIGYCADGDQRLLVYEYMPLGSLEDHLHDPSPDKPRLDWNTRMKIAAGAAKGLEHLHDKTNPPVIYRDLKCSNILLGEGYHPKLSDFGLAKLGPVGDKTHVSTRVMGTYGYCAPEYAMTGQLTLKSDVYSYGVVLLEIITGRRAIDNTRATGEQNLVAWARPLFKDRRKFPQMADPALEGRYPARGLYQALAVAAMCVQEQPTLRPLIGDVVTALSYLASQPYDPEVHGVHRPSRLTASGTPPRSRNHGADRQRGGSE

SEQ ID NO: 76032 - protein, 71 aa, Zea mays
  misc_feature (11)..(11): Xaa can be any naturally occurring amino acid
  misc_feature (30)..(30): Xaa can be any naturally occurring amino acid
DDLKIVAMIKXLLETHIRPTIQDDSGDFFXFDLEIGIIKLKMQGACSGYSSSSVTLNSWIENMLMHYGPVR

SEQ ID NO: 76033 - protein, 504 aa, Dendrobium hybrid cultivar
MSIFLITSLLLCLSLHLLLRRRHRSRFPLPPGPPNLPILGALPFIGPMPHSGLALLARRYGPIMFLKMGIRRVVVASSATAARSFLKTFDSHFSDRPSGVISKEISYNGQNMVFADYGPKWKLLRKVSSLHLLGSKAMSRWAGVRRDEAFSMIQFLKKHSDTEKPVLLPNLLVCAMANVIGRIAMSKRVFDEEGEEAKEFKEMIKELLVGQGASNIGDLVPSIGWLDPMGVKKRMLGLNRRFDRMVSKLLVEHAETAGERQGNPDLLDLVVGSELTGEDGEGLCEDNIKGFISDLFVAGTDTSAIVIEWAMAEMLKNPSILQRAQQETDRVVGRHRLLDESDIPKLPYLQAICKEALRKHPPTPLSIPHYASEPCEVEGYHIPGKTWLLVNIWAIGRDPDVWENPLLFDPERFLQGKMARIDPMGNDFELIPFGAGRRICAGKLAGMLMVQYYLGTLVHAFDWSLPEGVGELDMEEGPGLVLPKAVPLSVMARPRLAPAAYGLL

SEQ ID NO: 76034 - protein, 300 aa, Synechococcus sp. RS9916
MSKRHPVVAVTGSSGAGTSTVKRAFEHIFARENITPAVVEGDSYHRFERMAMKQAMADALAKGENFSHFGPEANLFDKLEELFRVYGETGGGQKRYYLHSTEEAAHHNGRLNVNLEPGQFTPWEDIPSGTDLLFYEGLHGGVKGSGYDVAGLADLLVGVVPIVNLEWIQKISRDNAERGYSAEATVDTILRRMPDYINHICPQFSQTDINFQRVPTVDTSNPFMIRNIPTPDESFVIIHFRKGAREKWGIDFTYLLDMIHDSFMSSPTSIVVNGGKMGFAMELILTPIIHRMIEEKKKLA

SEQ ID NO: 76035 - protein, 359 aa, Synechococcus sp. RS9916
MRQHRVVLLPGDGIGPEITAVARRLLEAVSERHGFTLSFEDQPIGGSAIDATGEPLPASTLAACRAADAVLLAAIGSPRFDSLPREKRPESGLLALRAGMELFANLRPVKIVPALIDASTLRPEVIEGVDLMVVRELTGGIYFGQPKGRVEADGEERGFNTMTYSSSEVDRIARVAFDLAKERRGQLCSVDKANVLDVSQLWRDRVDAMAPDYAGVEVSHMYVDNAAMQLVRAPRQFDVLLTGNLFGDILSDEAAMLTGSIGMLPSASLGSDGPGLFEPVHGSAPDIAGQDKANPMAMVLSAAMMLRIGLKEAQAASALEAAVDQVLADGFRTGDLMAEGCTALGCKAMGEALLKALDR

SEQ ID NO: 76036 - protein, 295 aa, Triticum aestivum
  misc_feature (260)..(260): Xaa can be any naturally occurring amino acid
  misc_feature (292)..(292): Xaa can be any naturally occurring amino acid
NKFVQKSRLVPVRNSRDIVDPRVRAVSGLTKGIEGLFKKNKVEYVKGFGKLVSPSEVSVDLVDGGSTIVKGKNIIVATGSDVKSLPGVTIDEKKIVSSTGALALTEIPKKLVVIGAGYIGLEMGSVWNRLGSEVTVVEFAPDIVPSMDGEIRKQFQRMLEKQKFKFMLKTKVVGVDTSGSGVKLTVEPAAGGEQTVIEADVVLVSAGRVPYTAGIGLDAIGVETDKGGRVLVDNRFMTNVKGVYAIGDAIPGPMLAHKAXEEDGVARGGFIAGKEGHVDYDTVPGVVYTHPXVAS

SEQ ID NO: 76037 - protein, 77 aa, Silicibacter pomeroyi DSS-3
MSDVADRVKKIVVEHLGVEEDKVTENASFIDDLGADSLDTVELVMAFEEEFGIEIPDDAAETIQTFGDAVKFISEAS

SEQ ID NO: 76038 - protein, 294 aa, Anabaena variabilis ATCC 29413
MSVNSEQLKTLITVEPSSQSLIFRSAISMSLELNLTGKTAIVTGGSAGIGLAVAKALYSEGVNVAIASRSQERLENAVSAIQSLPTPGAKVIAISADLTQAESVDRVVSSTLAQFGQIDILINNAGSARAGSFLDSTDDLFLDAWNLKLLGYIRFVRAVVPHLRSQGDGRIVNIIGGAGRTPRPNFLAGGTSNAALLNFTKGISKELAEYNIRINAISPGATATERAETLARQNAQARGITVEQAKAESLQSIPLKRIAQPDEIAALALFLVSDLAASITGTEIIVDGGSTPGV

SEQ ID NO: 76039 - protein, 438 aa, Pseudomonas syringae pv. syringae B728a
MRISIFGLGYVGAVCAGCLSARGHEVVGVDISSTKIDLINNGKSPIVEPGLEELLQKGITTGKLRGTTDFAEAIRATDLSMICVGTPSKKNGDLELDYIESVCREIGYVLRDKATRHTIVVRSTVLPGTVANVVIPILEDCSGKKAGVDFGVAVNPEFLRESTAIKDYDLPPMTVIGEFDKASGDVLQSLYEELDAPIIRKDIAVAEMIKYTCNVWHATKVTFANEIGNIAKAVGVDGREVMDVVCQDKALNLSQYYMRPGFAFGGSCLPKDVRALTYRASSLDVEAPLLNSLMRSNTSQVQNAFDMVASYDTRKVALLGLSFKAGTDDLRESPLVELAEMLIGKGFELSIFDSNVEYARVHGANKDYIESKIPHVSSLLNSDFEQVINDSDVIILGNRDERFRALANKTPEGKRVIDLVGFMANATSEDGRAEGICW

SEQ ID NO: 76040 - protein, 342 aa, Streptococcus suis 89/1591
MKKILAFGEVLLRLSPPQYQTLTQATSLDCQFGGSELNVLASLAQLGHSVELVTALPKNEVGKMAEHFLFARQIGQKYVIRNEGRLGLYYYQKGFSLRPSQVTYDRDYSAFSLSKEEDYDLEGMFDGVDWFHVSGITVALNPDIYRLAFRLMEMAKGQGVKVSFDLNYRESLWSSFEEAREKLSPFVGLADICFGLEPIQLFNESGKDLKDELGLKRPYENKEVLLAVVKGLAETYSLQGLAFTQREMTYNNEYLLKAYLHQDGILYETEKESIQVLDRVGTGDAFTAGIILGYLQEKSPREILDLGMASFQFKHTIEGDINVISQSDIDLLLKKGSREIKR

SEQ ID NO: 76041 - protein, 152 aa, Coccidioides immitis RS
MSLEQTFIAIKPDGVQRGLVGPIISRFENRGYKLVAMKLVSPSKEHLEKHYADLSDKPFFKGLVTYMLSGPICAMVWEGRDAVKTGRTILGATNPLASAPGTIRGDYAIDVGRNVCHGSDSVENAKKEIALWFSEGELIKYKHSQHEWIYEA

SEQ ID NO: 76042 - protein, 181 aa, Synechococcus sp. RS9916
MTASGPGNSGEVPTVLVRDSTGRDLLCFLEQLIPLDGKDYALLTPVDTPVCLFRLQDEGDPELIESIADSEQILSIADVVLQEHELTLVRSAVTLTVSGELDEPEPEDLEDEEGDDDDSETYELLVSFVADNQDYGLYIPLDPFFVVARMEESGAVLVEGEDFDRIQPRIEAELEEREPAE

SEQ ID NO: 76043 - protein, 148 aa, Triticum aestivum
  misc_feature (89)..(89): Xaa can be any naturally occurring amino acid
  misc_feature (95)..(95): Xaa can be any naturally occurring amino acid
  misc_feature (123)..(123): Xaa can be any naturally occurring amino acid
  misc_feature (135)..(135): Xaa can be any naturally occurring amino acid
  misc_feature (141)..(141): Xaa can be any naturally occurring amino acid
  misc_feature (147)..(147): Xaa can be any naturally occurring amino acid
MEQYEVVEQIGRGAYGTAYLVHHKAEKKRYVMKKIRLTKQNDKFQRTAYQEMSLMASLSNPYIVEYKDGWVDEGTSVCIVTSYCEGGDXAQRIKXGRGVLFSEERVCRWFTQLLLALDYLHCXRVLHRDLKCSIXLLPKDXNIRLVXF

SEQ ID NO: 76044 - protein, 474 aa, Streptomyces lividans
MLQAHTGYDLAIIGSGAGAFAAAIAARNKGRSVVMVERGTTGGTCVNVGCVPSKALLAAAEARHGAQAASRFPGIQATEPALDFPALISGKDTLVGQLRAEKYTDLAAEYGWQIVHGTATFADGPMLEVALNDGGTATVEAAHYLIATGSAPTAPHIDGLDQVDYLTSTTAMELQQLPEHLLILGGGYVGLEQAQLFARLGSRVTLAVRSRLASREEPEISAGIENIFREEGITVHTRTQLRAVRRDGEGILATLTGPDGDQQVRASHLLIATGRRSVTNGLGLERVGVKTGERGEVVVDEYLRTDNPRIWAAGDVTCHPDFVYVAAAHGTLVADNALDGAERTLDYTALPKVTFTSPAIASVGLTEAQLTEAGIAHQTRTLSLENVPRALVNRDTRGLVKLIAERGTGKLLAAHVLAEGAGDVITAATYAITAGLTVDQLARTWHPYLTMAEALKLAAQTFTSDVAKLSCCAG

SEQ ID NO: 76045 - protein, 257 aa, Zea mays
  misc_feature (42)..(42): Xaa can be any naturally occurring amino acid
VRELGIRIQLKALCEATGANVSEVAYAVGKDTRLGPKFLNAXVGFGGSCFQKDILNLVYICECNVLPEVANYWKQVIKINDYQKSRFVNRVVASMFNTVAGKKIAVLGFAFKKDTGDTRETPAIDVCKGLLGDKAQISIYDPQVTEDQIQRDLAMNKFDWDHPMHLQPTSPTAIKQVSCVWDAYEATKGAHGVCILTEWDEFKTLDYQKIFDNMQKPAFVFDGRNIVDPEKLREIGFIVYSIGKPLDAWLKDMPAVA

SEQ ID NO: 76046 - protein, 386 aa, Kluyveromyces lactis NRRL Y-1140
MFRKAIAIGGISLRRTFASSMIRKANQPGMMKAMVYYGANDLRFEDRAIPKIIDQRDAIIKMTNTSICGTDVGIWKGKSPEIEEIAVKNEGSFNGRVLGHEGTGIVTEVGDAVRNIKKGDKVIISCITRCGTCENCARGMYAHCMNDGGWALGYSIDGTQAEYVRTPFADTSLYALPEGLSDENAVLLSDALPTAHEIGVQMGNVKPGDSVAILGAGPVGMGCVLTSQLYSPSLLIVVDMDDNRLEMAKEMGATHTINSGKEDAVAKILEITNGRGVDCAMEAVGAQPTWDICQQIIKEGGHLANVGVHGKPVDFAIDKLWIKNLTITSGLVNTNTTSMLMKNCCSGKLQSDKLVSHHCNFKDMANNYNIFKHAAKEKALKLLISF

SEQ ID NO: 76047 - protein, 513 aa, Magnaporthe grisea 70-15
MFNLISSLKVGAALVAAVWIWQRIMLYNHRRKIKRDSGCLPAAKFPDWDPLFGIGFTYHMVTEDILDFQIMKNTADCLEKYGNTFTSKAMGFNFIWTCEPENIKAVLSTQFDQFNNQGRSVGAEDFLGKGIFVSDGEHWQKSRALVRPNFARDQITDLVSVEERFQTLISLLPKDGSTVDLLPFMFDFTMDTSTHFLFGDSVKSLEANAHERSIGHHGQENLDEFSAAWDYAQNDMLSRFVLGPLRYVYKEKKAARCIKLVQDHVEKYVDEAIRYNSQVRAAGGDEKKEPEERYIFLRALAKQTQDRRMLRDELLNILVAGRDTTASLLSNMLHTMANRPDIWTKLKNEVAFLQGRIPTYEDIRNMKYMRWCINESLRLHTVLALVGKEASIDTTLPRGGGPDHKAPIFVAKGTFIAYSFLALHRRKDLFGEDAHEFKPERWETLRPGWNYLPFNGGPRICVGQQYALTEAQYVLIRFLQTFSAIESRDPEPWSIGNRMTTCPKNGVQVSLRC

SEQ ID NO: 76048 - protein, 149 aa, Brassica napus
MASLPSASFLPSPSLVVLSPTKIFSSSSSSRSIVCSSSRAHGFSSIPRSSPSLRMTRSANHNKLQVVAMAPEEEKLTRRNPLDFPIEWERPKPGRRPDIFPKFSPMKTPLPPPMPYDPPAEDDEEEEEKKEEEEENPDQEEEEQPDKQQ

SEQ ID NO: 76049 - protein, 770 aa, Flavobacteria bacterium BBFL7
MSKDSKRREALVYHAKPTPGKIKVVPTKKYSSQRDLSLAYSPGVAEPCLEIAKDKANVYKYTTKGNLVAVITNGTAVLGLGDIGPEASKPVMEGKGLLFKIFADIDCFDIEIDTKNVDEFIQTVKNIAPTFGGINLEDIKAPEAFEIEKRLKEELDIPVMHDDQHGTAIISSAALLNALEIADKKIEDVKIVISGAGSAAISCTNLYAKLGARKENILMFDVDGLITTSRTDLGPEQMEFARDMDPITLVDAFKGADVFLGLSVGNIVSPAMLLDMNENPIVFAMANPNPEIEYDTAIATREDLIMATGRSDHPNQVNNVLGFPFIFRGALDVRASKINEEMKLAACHAIAQLAKEPVPEQVNIAYGETKLNFGREYIIPKPFDPRLISTIPPAVARAAMESGVAMEPIQDWEKYEDQLLSRMGSDNKLIRLILNRARTNPKRIVFAEADNLDVIKAAQIVHEDGIATPILLGRRDVIEELMTEIDWDDKILIIDPKSDEEKPRKDRYANELWQMRARKGVTEFDAGKLMRQRNYFAAMMVKLGDADAVITGVAQSFPISVKPMMEIIGKSPGVQKVATTNLMITDRGPIFVSDTSININPDATELAKIAQMTARTARMFGIDPAVAMISYANFGSSDHPHARKVTEAVNYLHRYYPDITVDGEIQADFALNPELLKKKFPFSKLAGKKVNTLVFPNLESANSTYKLIKELYNTDSIGPIMMGMQKPVHILQLNASVDEIVNMAAVAVIDAQQKEKHEQKREQATRNSAN

SEQ ID NO: 76050 - protein, 625 aa, Rickettsiella grylli
MDLNNSRCSLLVRINSPQQLRELAPAQLPQLAAELRTFLIQTLNQCGGHFAANLGTVELTLALHYVFNTPHDAIIWDVGHQAYAHKILTGRRDQLDSIRKTHGLAPFPSRNESLFDSFGVGHSSTSISAALGFSIAAKKNNTKQKAIAVIGDGALTAGMAFEALNHAGDIHADLLVVLNDNDMSISNNVGALSNYFARILSSKLYSSVRAGSKKILESIPRIRKLAKRTEEHVKGMFVPGTLFEELGFNYIGPLDGHDLPLLLNTFKNLRQLQGPQFVHVITTKGRGYKPAEENPIAYHAVNPHFLTCNSTKTNPIKPKTYANIFGRWICDMAAIDERLIAITPAMREGSDLVEFSERYPDRYFDVGIAEQHAVTLAAGLACAGLKPVVAIYSTFLQRAYDQLIHDVALQNLPVLFALDRAGIVGGDGATHQGCFDLSYLRCIPHMTLMTPSNENELRQMLYTGFHLSTPCAVRYPRGVGVGATIQQEMSLLPLGQAEICRKGQTIALLAFGSLLHPALHIGDQLDATVINMRFVKPLDEKMLSRLAKTHRLLVTLEENVKVGGAGSAVSEFLHQQGIFCDLLILGLPDEFIEHGDPSVLLAQAELETTALMSLIKQRLALSLTF

SEQ ID NO: 76051 - protein, 473 aa, Oryza sativa Japonica Group
MAAPPATASAPSLRPSAASPRAAAARSVAVPSGPRTVGPRRDGGRFLGVRAAKAVSGVQSGTVVDDGVQRPWKLSDARLVLEDGSVWKAKSFGASGTQVGEVVFNTSLTGYQEILTDPSYAGQFVLMTNPHIGNTGVNPDDEESNRCFLAGLIIRNLSICTSNWRCTETLEEYLMKRNIMGIYDVDTRAITRRLREDGSLIGVLSTDQSRTDDELLEMAKNWKIVGVDLISGVTCDAPYEWSDKTDSEWEFKKGQSTESFHVVAYDFGIKHNILRRLTSYGCKITVVPANWPASEVLNLKPDGVFFSNGPGDPAAVPYAVKTVQEIIGKVPVFGICMGHQLIGQALGGKTFKMKFGHHGGNHPVCDLRSGRVDISAQAFRITGVGRGAGLLAVTLPDENLELLRNHNYAVDPESLPEGVKVTHINLNDNSCAGLQYPKMKLLSLQYHPESSPGPHDSDLAFGEFIEMMKNNRL

SEQ ID NO: 76052 - protein, 513 aa, Saccharomyces cerevisiae YJM789
MSLSTKREHSGDVTDSSFKRQQRSNKPSSEYTCLGHLVNLIPGKEQKVEITNRNVTTIGRSRSCDVILSEPDISTFHAEFHLLQMDVDNFQRNLINVIDKSRNGTFINGNRLVKKDYILKNGDRIVFGKSCSFLFKYASSSSTDIENDDEKVGSESRSYKNDDEVFKKPQISATSSQNATTSAAIRKLNKTRPVSFFDKYLLGKELGAGHYALVKEAKNKKTGQQVAVKIFHAQQNDDQKKNKQFREETNILMRVQHPNIVNLLDSFVEPISKSQIQKYLVLEKIDDGELFERIVRKTCLRQDESKALFKQLLTGLKYLHEQNIIHRDIKPENILLNITRRENPSQVQLGPWDEDEIDIQVKIADFGLAKFTGEMQFTNTLCGTPSYVAPEVLTKKGYTSKVDLWSAGVILYVCLCGFPPFSDQLGPPSLKEQILQAKYAFYSPYWDKIDDSVLHLISNLLVLNPDERYNIDEALNHPWFNDIQQQSSVSLELQRLQITDNKIPKTYSELSCL

SEQ ID NO: 76053 - protein, 110 aa, Oryza sativa Japonica Group
MGHQLIGQALGGKTFKMKFGHHGGNHPVCDLRSGRVDISAQNHNYAVDPESLPEGVKVTHINLNDNSCAGLQYPKMKLLSLQYHPESSPGPHDSDLAFGEFIEMMKNNRL

SEQ ID NO: 76054 - protein, 363 aa, Buchnera aphidicola str. Sg (Schizaphis graminum)
MNYQILARKWRPQSFKKIIGQKYIVKAISNGFSLGKIHHAWLLSGTRGVGKTTIARLIAKSLNCEIGITSLPCRKCTICQEIEKGICLDFIEIDAASRTKVEEIREILDNIYYTPSKSRFKVYLIDEVHMLSRHSFNALLKTLEEPPQHIKFILATTDVEKIPKTIRSRCLHFKLNILSEEDIFNFLKHILKKGGNNFDEEALKIISDYANGSMRDALNLLEHAMHLSKNNINLKNTTEMLGIPNKKHAFLLTKFLLEQDSKKMMCLLNKISKIGLEWQNILIEMMRFLHHIAMLKSYPKIWNQIFIKNNENEIKKIAENNSKYNIQLCYKILLKGRKELFFSPNHKMGVEMILLQAITEIKR

SEQ ID NO: 76055 - protein, 527 aa, Streptomyces coelicolor A3(2)
MTVLDEAPGEPTDARGRVAELHGIRAAALAGPSEKATAAQHAKGKLTARERIELLLDPGSFREVEQLRRHRATGFGLEAKKPYTDGVITGWGTVEGRTVFVYAHDFRIFGGALGEAHATKIHKIMDMAIAAGAPLVSLNDGAGARIQEGVSALAGYGGIFQRNTKASGVIPQISVMLGPCAGGAAYSPALTDFVFMVRDTSQMFITGPDVVKAVTGEEITQNGLGGADVHAETSGVCHFAYDDEETCLAEVRYLLSLLPQNNRENPPRAESSDPVDRRSDTLLDLVPADGNRPYDMTKVIEELVDEGEYLEVHERWARNIICALARLDGRVVGIVANQPQALAGVLDIEASEKAARFVQMCDAFNIPIITLLDVPGFLPGVDQEHGGIIRHGAKLLYAYCNATVPRISLILRKAYGGAYIVMDSQSIGADLTYAWPTNEIAVMGAEGAANVIFRRQIADAEDPEAMRARMVKEYKSELMHPYYAAERGLVDDVIDPAETREVLITSLAMLHTKHADLPSRKHGNPPQ

SEQ ID NO: 76056 - protein, 253 aa, Brassica napus
  misc_feature (60)..(60): Xaa can be any naturally occurring amino acid
  misc_feature (150)..(150): Xaa can be any naturally occurring amino acid
MSSSNCPSPLPTVTKLQVDSVTFPPSVISPASSNPLFLGGAGVRGLDIQGKFVIFTVIGXVYLDPVSVPSLSVKWKGKTTEELTESVPFFREIVTGSFEKFIKVTMKLPLTGQQYSEKVTENCVAIWKSLGIYTDSEAKAVERFLEVFKXDETFPPGASILFALSPEGSLTVAFSKDDSIPETGKVVIENKLLAEAVLESIIGKNGVSPGARLSVAERLAQLMNSDKVEEDATKTDQEEANDLPLGDKLAKEN

SEQ ID NO: 76057 - protein, 251 aa, Brassica oleracea
MATIDESSSAKRWLPLEANPDVMNQVLSRFTKYSFSDHRKVKFLWGLGLAPDAAECNDVFGLDDELLEMVPKPVLAVLFLYPITKKSEEERIEQDKEIKEKVHSDKVYFMKQTVGNACGTIGLLHAIGNITSEIKLSEGSFLDKFFKTTSNMTPMERGRFLENDSQIEDAHSAAVTAGETPASDEVNTHFICLACVDGELYELDGRKAGPISHGASSPATLLKDSTKVIKKIIEKNPDTLNFNVMAISKRT

SEQ ID NO: 76058 - protein, 96 aa, Triticum aestivum
MDSGNTQTDGSQPAAPKNPAMTSCRKKKTDDDVTFLEDVKEHIDEFIHASMDEHKTCFKKTIQKMFGMSKVVAERSAAAKEAEVESALPLQTSVSQ

SEQ ID NO: 76059 - protein, 173 aa, Synechococcus sp. CC9605
MSIFVGNLPFRAEQEDVIELFAQFGEVTNCALPLERDTGRKRGFAFIEMADESTEEAAIEGLQGAELMGRPLRINKAEPRGSAPRRGGGGYGGGGGGGYGGGGGGYRGGGGGGYGGGGAGDRPSGARGWEDRSYGARDSAGEGNAYDEGRSRRRRGSSSGGGDEYSGYGGAEG

SEQ ID NO: 76060 - protein, 331 aa, Synechococcus sp. CC9605
MTASGSTAAYRFSVAPMLDCTDRHFRVLMRQISRRALLYSEMVVAQALHHSKRRNKLLDFDPVEHPIALQVGGDDPALLAEAARLAQDWGYDEINLNVGCPSQKVQAGNFGACLMAEPDLVARCVEAMVGAGGLPVTVKHRIGIDDLDSDVLLMNFVDRVALAGASRFAIHARKAWLEGLDPKQNRTIPPLQHERVVALKQRRPDLVIELNGGLECPEDCLQALEGCDGAMVGRAAYSHPLRWTSVDALIFGEESRQILASDIVDGLLPHAAAHLEQGGRLWDLCRHLVQLVEGVRGARHWRRELGEKAQRPGADLKVLVQAGQQLKDAGL

SEQ ID NO: 76061 - protein, 437 aa, Arabidopsis thaliana
MHRASSKHTNAKKEAISTSKIRDNNVRVTRSRAKALGVSNSPSKPAFKHETKRVARPSNKRMASDNITVCNQKRRAVLKDVTNTLAESIISTEGNVKACKRGGKETKQIEEDGLVDVDGEKSKLAEDLSKIRMVESLDASASKQKEDRSDVTDCVQIVDIDSGVQDPQFCSLYAASIYDSINVAELEQRPSTSYMVQVQRDIDPTMRGILIDWLVEVSEEYKLVSDTLYLTVNLIDRFMSHNYIEKQKLQLLGITCMLIASKYEEISAPRLEEFCFITDNTYTRLEVLSMEIKVLNSLHFRLSVPTTKTFLRRFIRAAQASDKVPLIEMEYLANYFAELTLTEYTFLRFLPSLIAASAVFLARWTLDQSNHPWNQTLQHYTRYETSALKNTVLAMEELQLNTSGSTLIAIHTKYNQQKFKRVATLTSPERVNTLFSR

SEQ ID NO: 76062 - protein, 276 aa, Thiomicrospira crunogena XCL-2
MARVLIAGCGDIGCRLGANLAKKGHEVFGMRRDVSKISAPIQPIEADLFGQLPELPDQLDYVFYIVSAKSYNDVAYYKAYVMGLKHLIDALKDQPIKRLFFISSSSVFSQSEGERVTEESPTEGKNFSSRRLLEGEELALNAPFPGTVVRFGGIYGPGRTYLIDLVLQGKAHCMEDVYSNRIHSEDCVGLLTHLMEQPALDPIYIGVDDEPTFTCEVYEWLAEQLSVSNIEHLEPTENSRAQRSNKRLSNAKVKATGYTFKYPSYREGYLELLESM

SEQ ID NO: 76063 - protein, 131 aa, Yersinia intermedia
MRKTGDIDRVMSARQLPNKALALILAGGRGSRLKDLTSVRAKPAVHFGGKYRIIDFALSNCLNSGIRRIGVITQYQSHTLVQHIQHGWSFLSEEMNEFVDLLPAHSAQGQNHWYTGTADAVFQDLDIIRRR

SEQ ID NO: 76064 - protein, 284 aa, Vitis vinifera
MTKDVEVAEHGSFSAKDYHDPPPAPLFDSVELTKWSFYRALIAEFIATLLFLYITVLTVIGYKSQTAGGDPCGGVGILGIAWSFGGMIFILVYCTAGISGGHINPAVTFGLFLARKVSLIRAILYMVAQCLGAICGVGLVKAFQSAYYDRYGGGANELSTGYSKGTGLGAEIIGTFVLVYTVFSATDPKRSARDSHVPVLAPLPIGFAVFMVHLATIPITGTGINPARSLGAAVIYNNEKAWDDQWIFWVGPFIGAAIAAFYHQFILRAGAVKALGSFRSTTHV

SEQ ID NO: 76065 - protein, 618 aa, Glycine max
MDAVLQTRGLLSLPANPVNRISLFNPSQGLKHRFFSPKPKNLSGSSLSSNGFPKLSPRPNNVFAQRDQNKNLFLCRAEAAAAAAASFGEPGSEKPKLLGIEVATLKKIVPLGLMFFCILFNYTILRDTKDVLVVTARGSSAEIIPFLKTWVNLPMAIGFMLLYTKLANVLSKQALFYSIILPFIAFFGAFGFVLYPLSNYIHPEAFADKLLNILGPRFLGPLAIMRIWSFCLFYVMAELWGSVVISVLFWGFANQITTVDEAKRFYPLFVLGANVALVFSGRTVKYFSNLRSTLSPGVDGWAISLKAMMSIVVGMGVAICFLYWWVNNYVPLPTRSKKKKEKPKMGTMESIKFLVSSKYIRDLATLVVAYGISINLVEVTWKSKLKAQFPSPNEYSSFMGDFSTATGIATFIMMLLSQFIFDKYGWGVGAKITPTVLLLTGVGFFSLILFGGPIAPVIAKFGMTPLLAAVYVGAMQNIFSKSAKYSLFDPCKEMAYIPLDEDTKVKGKAAIDVVCNPLGKSGGALIQQFMILTFGSLANSTPYLGGVLLVIVLVWLSAAKSLDTQFTALRREEELEKEMERAAAVKIPVVAKDEDENGSLKSVPLLNPTAGDSSSILN

SEQ ID NO: 76066 - protein, 174 aa, Brassica napus
MASINLSSSSPSTISLSRSRLSQTSTTTTLLHRITLPSHHPSSSFSIKTTSKVKASVISREDDLLSSYTNGSLVDEDSSSPAPANGFVAEDDDYELDLPTPGFSSIPEAIEDIRQGKLVVVVDDEDRENEGDLVMAAQLATPEAMAFIVKHGTGIVCVSMKDDDLQRLNLPPMV

SEQ ID NO: 76067 - protein, 337 aa, Streptococcus suis 89/1591
MTNVFKGRHFLAEKDFTRAELEWLIDFSAHLKDLKKRNIPHRYLEGKNIALLFEKTSTRTRAAFTVASIDLGAHPEYLGANDIQLGKKESTEDTAKVLGRMFDGIEFRGFSQKMVEELAEFSGVPVWNGLTDAWHPTQMLADYLTVKENFGKLEGLTLVYCGDGRNNVANSLLVTGAILGVNVHIFSPKELFPEEEVVALAEVFAKESGARVLITDNADEAVKGADVLYTDVWVSMGEEDKFAERVALLKPYQVNMELVKKAENENLIFLHCLPAFHDTNTVYGKDVAEKFGVEEMEVTDEVFRSKYARHFDQAENRMHTIKAVMAATLGDPFVPRV

SEQ ID NO: 76068 - protein, 412 aa, Pseudomonas aeruginosa PAO1
MALIVQKFGGTSVGTVERIEQVAEKVKKFREAGDDVVVVVSAMSGETNRLIGLANQIMEQPVPRELDVMVSTGEQVTIALLSMALIKRGVPAVSYTGNQVRILTDSAHTKARILHIDDTHIRADLKAGRVVVVAGFQGVDGNGNITTLGRGGSDTTGVALAAALKADECQIYTDVDGVYTTDPRVVPQARRLDKITFEEMLEMASLGSKVLQIRAVEFAGKYNVPLRVLHSFQEGPGTLITIDDEEESMEQPIISGIAFNRDEAKLTIRGVPDTPGVAFKILGPISAANVEVDMIVQNVAHDNTTDFTFTVHRNDYLNALEILKQTAANIGAREAIGDTNIAKVSIVGVGMRSHAGVASRMFEALAKESINIQMISTSEIKVSVVIEEKYLELAVRALHTAFELDAPARQGE

SEQ ID NO: 76069 - protein, 511 aa, Glycine max
MANIDIEGILKQQQPYDGRVPKTKIVCTLGPASRSVEMTEKLLRAGMNVARFNFSHGTHDYHQETLNNLKTAMHNTGILCAVMLDTKGPEIRTGFLKDGKPIQLKEGQEVTITTDYDIKGDPEMISMSYKKLPVHLKPGNTILCSDGTITLTVLSCDPDAGTVRCRCENTATLGERKNVNLPGVVVDLPTLTEKDKEDILGWGVPNKIDMIALSFVRKGSDLVNVRKVLGPHAKNIQLMSKVENQEGVLNFDEILRETDAFMVARGDLGMEIPVEKIFLAQKMMIYKCNLVGKPVVTATQMLESMIKSPRPTRAEATDVANAVLDGTDCVMLSGESAAGAYPELAVKIMARICIEAESSLDYGAIFKEMIRSTPLPMSPLESLASSAVRTANKAKAKLIVVLTRGGSTAKLVAKYRPAVPILSVVVPVLSTDSFDWTCSDETPARHSLIYRGLIPILGEGSAKATDAESTEVILEAALKSATERALCKPGDAVVALHRIGAASVIKICIVK

SEQ ID NO: 76070 - protein, 311 aa, Flavobacteria bacterium BBFL7
MKTIDILCIGEILIDFIGHEKNASISDTKNYHRFLGGSPTNVAVNAARLGLNSAIIASCGKDGLGDFIVDKLKDNDVDTSYIHRASGLPTSIILVSKSIDTPDFTAYREADCVIPEELVTDALLDLSKIYHTTCFALSKNPARNTILKGAQRASQLGLQLSIDLNYSEKIWPDRKKAKEVISEYLSYNPLLKISIDDCYRYFDSHKSDDEIFDYFHSLGVTTICLTKGKEGVTVSDLNFGLLHQEALKISDIKDVTGAGDAFWAGFLYAQIQSKSLRESISMAQKLATIKLQNVGRLPDMVGLKNIFNDLV

SEQ ID NO: 76071 - protein, 418 aa, Fagus sylvatica
MAIETKHPEAVPADETCSAKCSKQGEGLKQYYLQHIHEHQLQVRQKTHNLNRLEAQRNEFNSRVRMLREELQLLQEPGSYVGEVVKVMGKNKVLVKVHSEGKYVVDIDKNIDITKITPSTRVALRNDSYVLHLILPSKVDPLVNLMKVEKVPDSTYDMIGGLDQQIKEIKEVIELPIKHPELFLESLGIAQPKGVLLYGPPGTGKTLLARAVAHHTDCTFIRVSGSELVQKYIGEGSRMVRELFVMAREHAPSIIFMDEIDSIGSARMESGSGNGDSEVQDHMLELLNQLDGFESIKQIKVLMRTNRIDILDQALLRPGRIDRKIEFPNPNRESRFDILKIHSRRMNLMRGIDLKKIAEKMNGASGAELKAVCTEAGMFALTAERRVRLVTQEDFEMAVAKVMKKETEKNMSLRKLWK

SEQ ID NO: 76072 - protein, 435 aa, Flavobacteria bacterium BBFL7
MLGKVKLNFWQILNMNVGFFGIQYSFGLQQSAVTPIYDFLGAAPDQIPILHLAGPVTGLLVQPIIGAMSDKTWSPKFGRRKPYFLIGALLCSVSLLLFPFSSSLWMAAGLLWILDAGNNTAMEPYRALIADKLIPEQQPTGFQMQSFFTGLGQVLANLSIFIFPIFIVGKTGSLPTWVYASFFLGAFCSIATILWSISKTKEIPPTDEELALMRNEKRSVLGPLIEIASAIKNMPKVMWQLALVYLFQWYALFCYWQNSSKSVALSVWNATPASNEAAYEEAVSWTALVNGWYNVVTFLVAFALVGFAKKYSPKLVHSVCLLLAAAGFLAFPHIADKNLLLFAITGFGIGWASMMGIPYLMVISNIPKERYGVYMGIINMMIVIPMIFQTLTFGYVLKNFLGNDPRNAITFAGVLLILATIATMFIQTKKHVVNE

SEQ ID NO: 76073 - protein, 502 aa, Arabidopsis thaliana
MVLSHAVSESDVSVHSTFASRYVRTSLPRFKMPENSIPKEAAYQIINDELMLDGNPRLNLASFVTTWMEPECDKLIMSSINKNYVDMDEYPVTTELQNRCVNMIAHLFNAPLEEAETAVGVGTVGSSEAIMLAGLAFKRKWQNKRKAEGKPVDKPNIVTGANVQVCWEKFARYFEVELKEVKLSEGYYVMDPQQAVDMVDENTICVAAILGSTLNGEFEDVKLLNDLLVEKNKETGWDTPIHVDAASGGFIAPFLYPELEWDFRLPLVKSINVSGHKYGLVYAGIGWVIWRNKEDLPEELIFHINYLGADQPTFTLNFSKGSSQVIAQYYQLIRLGHEGYRNVMENCRENMIVLREGLEKTERFNIVSKDEGVPLVAFSLKDSSCHTEFEISDMLRRYGWIVPAYTMPPNAQHITVLRVVIREDFSRTLAERLVIDIEKVMRELDELPSRVIHKISLGQEKSESNSDNLMVTVKKSDIDKQRDIITGWKKFVADRKKTSGIC

SEQ ID NO: 76074 - protein, 186 aa, Xylella fastidiosa Temecula1
MSVLNTEILSFKATAYKNGQFVEVSEAVFKGKWAVFVFYPADFTFVCPTELEDLADHYEEFQKYGVEIYSVSTDTHFSHKAWHDISPAIGKIKYAMIGDPTHEISRNFNVLRPSGLADRGTFIIDPQGVIQSVEITAEGIGRDAKELLRKVKAAIYVANHPGEVCPAKWEEGGKTLAPSLDLVGKI

SEQ ID NO: 76075 - protein, 426 aa, Bacillus halodurans C-125
MATEITMPQLGESVTEGTISRWLVKPGDKVNKYDPLAEVLTDKVNAEIPSSFSGTIQELLVEEDETVAVGHVICTMNVEGEAVEAETNDTSVSSAETTESPTETQEQSTSAKKRYSPAVLRLAEEHDIDLTHVTGSGKGGRITRKDLQAIIEGGDIPKAAPMTEQKTAPVHETMPLTEKVQEPVQVPTVSGDVEIPVSGVRKAIAQNMVKSKHEAPHAWTMVEVDVTNLVQLRNQLKEGFKKKEGFNLTFLPFFIKAVVEALKAYPQLNSMWAGDKIIQKKDINISLAVATDDALFVPVIKHADEKTIKGLAREVNELAHKVRTGKVTSSDMQGGTFTVNNTGSFGSVLSTPIINHPQAAILSVESIVKRPVVIESEAGDMIAIRSMVNLCLSLDHRVLDGLICGRFLAKVKNILENMTIENTSIY

SEQ ID NO: 76076 - protein, 449 aa, Flavobacteria bacterium BBFL7
MREIAQVPALTFLAKSRQIYKDPLPFHRENFEKYGNTFKISPKPGLMIHFTCDEKITQHILQKNQKNYHKSSLQTEDLGKYIGHGLLTENGEKWRANRKLIQPAFYKKSINNFMATMDVVVKEELDRIQLDEITDVYAIFNDLAFKVVARSLFDFADIENLEQKISRLQEITEQAQNMLIKELRIPWMKWYFDREWLSGTNSVPYALKMVDEARDILYAIISNRRRSKNEPGDLLDMLLHSTYEDGSYMDDDQLVDEILVLFIAGHETTANALSFAVQLLAHHPETIEKAREDVSKANLDETLMNQLMAMPYLKQCVEETLRLYPPAYVTDREALEADECDDIFIEKGSIWLVSFYEMHRRKDLWENPESFDPSRFEPSKAKSYREFYFPFGAGPRMCVGNNFAMMEMMLVIRRMVERFEITTVQDHIDYHPLITLKPKNANLVFKPRV

SEQ ID NO: 76077 - protein, 423 aa, Zea mays
MSAAGITRAPIGQNPRLGCYAPGRGGGVVRCSLQGAVVGGRAEWQSSCAVLSSKVAALGTHSVNGHVAPAPTQNGAVLDLVPVSSSSINGAITKNLPQPLRIADLSPAPMHGSQLRVAYQGVPGAYSEKAAGKAYPGCDAIPCDQFEVAFQAVELWIADRAVLPVENSLGGSIHRNYDLLLRHRLHIVGEVQLPVHHCLLALPGVRKECLTRVISHPQALAQCEHTLTAMGLNVVREAFDDTAGAAEYVAANGLRDTAAIASSRAAELYGMEVLADGIQDDSGNVTRFVMLAREPVVPRTDRPFKTSIVFAHDREGTSVLFKVLSAFAFRDISLTKIESRPHRHRPIRLVDDANVGTAKHFEYMFYVDFQASLAEPRAQNALAEVQEYTSFLRVLGSYPMDMTPMTAGSSSTVVSSSDDPSSS

SEQ ID NO: 76078 - protein, 474 aa, Bacillus halodurans C-125
MAEEYDLVILGGGTGGYVAAIRATQLDLKVALVEKGKLGGTCLHKGCIPSKALLRSAEVFSTVQKADQFGVKIDGAALDFTSVQNRKEQIVTQLHRGVEMLMKKGKIDVYKGHGRILGPSIFSPTPGTISVEMNNGEDNMMLIPRNVIIATGSSPRVLPGMEIDGEAVLTSDEALKMEQLPKSMLIVGGGVIGIEWASMLNDFGVDVTVIEYGPRILPTEDADIAKEAERLLKKRGVTFKTNAKVLAETLEKGDNSVVIEAEVGGVSERFTAEKMLVSVGRTPNVNDIGLENTDIEVIDGAIAVNEWYQTKESHIYAIGDVIGGMQLAHVASHEGILAVEHMTDHKPEPLNYLTVARCVYSHPEMASIGLSEAEAKEKGYEVKVGTFPFQAIGKALVYGESDGFVKILSDKKTDDLLGVHMIGPHVTDMISEAALAKVLDAAHWEVAHTIHPHPTLSEVVGEAALAVDGKAIHF

SEQ ID NO: 76079 - protein, 72 aa, Glycine max
  misc_feature (34)..(34): Xaa can be any naturally occurring amino acid
MASSMISSPAGTTVNPAGAGMDAAWAGLNFMAAXHSKKTNSDIPSIASSGSRVHRMQVWPTTGMRKFETLYY

SEQ ID NO: 76080 - protein, 329 aa, Brassica oleracea
MLTSWFLNVFFLVLASVPSILSAPATNLTKDYYQKTCPDFSKIVRDTVTTKQAQQPTTAAGTLRVFFHDCFLEGCDASVLVATNSFNKAERDDELNESLPGDAFDIVTRIKTALELSCPGVVSCADILAQSTRDLITIVGGPFYEVKLGRKDGFESKAHKVHGNIPIANHTVHDMMSIFKKNGFSLKEMVALSGGHTVGFAHCIEFSNRLFGPRADPELDSRYADRLKDLCKNHMVNKSMAAFLDPITPGKFDNMYFKNLKRGLGLLASDHALFKDNGTRPFVDLYADNQTAFFEDFARAMEKLGMVGVKGDKDGEVRRKCDHFNKLDV

SEQ ID NO: 76081 - protein, 310 aa, Pisum sativum
MASQQQTVREWSGINTFAPATQTKLLELLGNLKQEDVNSLTILVMGKGGVGKSSTVNSIIGERVVSISPFQSEGPRPVMVSRSRAGFTLNIIDTPGLIEGGYINDMALNIIKSFLLDKTIDVLLYVDRLDAYRVDNLDKLVAKAITDSFGKGIWNKAIVALTHAQFSPPDGLPYDEFFSKRSEALLQVVRSGASLKKDAQASDIPVVLIENSGRCNKNDSDEKVLPNGIAWIPHLVQTITEVALNKSESIFVDKNLIDGPNPNQRGKLWIPLIFALQYLFLAKPIEALIRRDIATETKPAWETRDVGDRK

SEQ ID NO: 76082 - protein, 306 aa, Triticum aestivum
  misc_feature (232)..(232): Xaa can be any naturally occurring amino acid
MGEIPEPEVPKPTPEPSSWLSLRVFYLRLSRCEVDESMLDTLTITHAPLTSDTVLEVNGDRPRSTGNHHGHVSCPLRRDRVDAASREASFVSTATVRMAGSVRFEVRVGGGERLLVGIMEMCDVAEEKKGWVMKCQVAMQRCSGFLKGGGEEGAKSPMVEVYVASLFRGNPVVFTKAMKLRLRRTRQVKAPFMEPIPECGEHAGDDAKETPSDQKHDPQESEYRCYKPEPGXDDVDYDSLYARSAGLDHGLDGEDSELSWFTAGVRVGVGISLGIFLGVGIGAGLLARSYQSTSRSMRRRLISGLL

SEQ ID NO: 76083 - protein, 133 aa, Brassica napus
PEPPRVRTMQTSSSALRRGGPPPPGPKTKKPKTFPATGIAGRPQGGALTNEPGEAGSYDPLIGKKVWTKWPEDNNFYEAVITNYDPIEGRHALVYDISTPNETWEWVNLKEISPGDIRWEGEDSGVSRKGGHP

SEQ ID NO: 76084 - protein, 341 aa, Synechococcus sp. CC9605
MTLRVAINGFGRIGRNVLRGWISRGADTGLEIVGMNSTSDPATSAHLLTYDSILGRLDPSVDIKTTDSSMFVNGKEIKFFADRNPLNCPWKEWGVDLVIESTGVFNTDEKASMHIQAGAKKVILTAPGKGDRVGTFVVGVNDDQYRHEDWDILSNASCTTNCLAPIVKVLDQNFGLDWGLMTTIHSYTGDQRILDNSHRDLRRARAAALNMVPTTTGAAKAVALVYPEVKGKLTGFAMRVPTPNVSAVDLTFGPSRAASVDDIKAAIKSASENGMKGIIKYGDLPLVSTDYAGTNESTIFDADLTYAMGDKAVKILAWYDNEWGYSQRVVDLAEVVAKNWK

SEQ ID NO: 76085 - protein, 427 aa, Arabidopsis thaliana
MAFAPILRRASAVKNLFSLTRLAVGSALSTRSLQTGASGDDSQSMGGYHVSPGGFMRGAVYREPNKPLTIEEFHIPRPKSNEILIKTKACGVCHSDLHVMKGEIPFASPCVIGHEITGEVVEHGPLTDHKIINRFPIGSRVVGAFIMPCGTCSYCAKGHDDLCEDFFAYNRAKGTLYDGETRLFLRHDDSPVYMYSMGGMAEYCVTPAHGLAPLPESLPYSESAILGCAVFTAYGAMAHAAEIRPGDSIAVIGIGGVGSSCLQIARAFGASDIIAVDVQDDKLQKAKTLGATHIVNAAKEDAVERIREITGGMGVDVAVEALGKPQTFMQCTLSVKDGGKAVMIGLSQAGSVGEIDINRLVRRKVWVIGSYGGRARQDLPKVVKLAESGIFNLTNAVSSKYKFEDAGKAFQDLNEGKIVSRGVVEIL

SEQ ID NO: 76086 - protein, 411 aa, Glycine max
MNALAATNRNFKLASRLLGLDSKLEKSLLIPFREIKVECTIPKDDGTLQSYVGFRVQHDNARGPMKGGIRYHPEVDPDEVNALAQLMTWKTAVANIPYGGAKGGIGCDPAELSISELERLTRVFTQKIHDLIGIHTDVPAPDMGTGPQTMAWILDEYSKFHGYSPAVVTGKPIDLGGSLGRDAATGRGVLFATEALLNEYGKSVSGQRFVIQGFGNVGSWAAQLISNKGGKVVAVSDITGAIKNSNGLDIPSLLEHSKVHRGVKGFNGSDPIDPNSILVEDCDVLVPAALGGVINRENANEIKAKFIVEAANHPTDPEADEILKKKGVVILPDIFANSGGVTVSYFEWVQNIQGFMWDEEKVNNELKTYMTKGFKDVKEMCKTHECDLRMGAFTLAVNRVARATVLRGWEA

SEQ ID NO: 76087 - protein, 546 aa, Gluconobacter oxydans 621H
MLQIENLVFNAWGRQFFNRASANLPNPSKVSLVGRNGVGKSTLFKLIKGELQPDSGEIVIPRAARVATVDQEHPATPISLIDTILAADTERAALMAELETADPERMGDIWMRLIEIDADSAPSRAAEILNGLGFSTADLDRPMAEFSGGWRMRVALAAALFAEPDLLLLDEPTNYLDLEGALWLEARLARYPHSALIISHDRELLNNSVDFTLHVTEGKLELYTGGYDDFERQRAEKIRLQSATRAKQEAERAHLQSFVDRFKASAAKAAQAQSRVKRLAKLTPIETTIEASVSPFLLPSPARPLAPPLIRLENVEVGYGDDPAILRDLNLRLDVDDRIGLLGVNGAGKSTFAKMIAGALEVRSGEVSRSPRIEVGWFHQHQIEALDPEQTPLDIMREARPTDSDQSHRSRLAQFGIHFEKQGTKVEALSGGERARLLLNMIAMAAPHLLILDEPTNHLDIDSRRALLDALNSYEGAVILITHDRSLMELVADRLWLAADNQIVPFDGDMDDYARFVIERAKGGTSAPSQSAAKEKRSKGKKKKTK

SEQ ID NO: 76088 - protein, 429 aa, delta proteobacterium MLMS-1
MPVEKIACLGVNHQTAPVEIREKLAFSGDCTNPLVRIKEIEGCDECCFLSTCNRVEVLLVTDGRQQTITAVRDFLFSDSGLAGEEAARYSYLYTGQEAVNHVFRVAASLDSMVVGEPQILGQLKDAYRLAVEHQATGPILHRLLSKSFSTAKRIRTETNIGGNAVSISYAAVQLARKIFGELTGKTVMLAGAGEMAELAAEHLLAQGIGKVVVANRTLERALTLARRFHGEAISLRELVPKLAEVDILISSTGAPDLILRREELSPLMRQRHHSPIFLIDIAVPRDLDPALNDLDNVYLYDIDDLQQVVEGNKGERRREADRAERIVGEESIKFLQWLENMALAPTITELRRRADELRAAELERTMAALPSLGPEERQAVEKMSVALVNKLLHHPMVFLKNGGGGEVKQRNLMALRKVFGLDTEEGSKD

SEQ ID NO: 76089 - protein, 530 aa, Mycobacterium sp. MCS
MTHSAPCNGGSAGRHSRCPETCYRPGSVSSAAGMVATSHPMAVRTAVTILEEGGTAADAAVAAAAMLTVVDPPSTGVGGDLFALYWESGGTEPVGLAAAGVAPAALSVQALRDSGFDTMPADGPWTVTVPGATWGWSALLERYGTLGRDRVVAPAVEAARTGFAVTPAVAEEWKLGANRLRADPHAAALFLPAGRAPRVGDVFRNPDLAETLQTYAREGHAPFYTGDIAADFADAVHPLRTSDLGEWAGPEWVTPIRARFRGVDVYEMPPPGQGLAVLQALRLYQRFAPYSDHHLVESIKAAVADAADHIADPRFHPVPVAELLGDGRVGELADRIGATASDGRTPGTPSDTVYVCVVDRWGAACSLIQSIYDGFGSGVLVPGRGVLLHNRGAGFTLRDGHPNRPEPRKRPYHTIIPAMLGGPDGFRGCLGVVGGFMQPQGQVQVLRNVLDRGMSAQQAVDAPRLRVLGGHTLGLEEGFDAGGAAELARRGHRLSALPRSECGGAQLILRTPAGLDGGSDFRRDGYVGVC

SEQ ID NO: 76090 - protein, 276 aa, Xylella fastidiosa Temecula1
MVETQDKEIHDMRNEHWGERFSGIDRLYGLGTVARLSTCRVAVIGIGGVGSWIVEALARSAIGYMSLIDADDLCISNTNRQLPALIGQYGRNKAQAMAERCRAINPRINVSATELFLARSNMEALLGENFDLIIDACDSFRIKVETIVSCRRHKQPLITVGAAGGRTEPTLVRVRDISRTEHDTLLALIRKKLRSEFHFPKNPKRYFGVPAVYSLENVKYPQADGSVCGIRPSLISNAALNLDCSTGLGAATHVTGAFAFAATGKAIEMLLTPKKR

SEQ ID NO: 76091 - protein, 380 aa, Triticum aestivum
MASPSPSPSPLHPHQLQQHPLPPHQHPHPQYQAPPPSMPPPPGAPPKAMDLEVTVVSGKHLKNVNWRRGDLRAYAVAYLDPSRRTATRPDDAGGCKPAWNERITLQLPPHLSPHDPSLLLSLDVFHSKPSDSPKPLVGSARSPLRDLLFPAGPNPSSDSPTSPIITLPLLRPSGRPQGKLRIRVALRERSPPPPEPQYPPPSSSPYYFPAPPPPTYSAPPQYGSDQYYRPSGYYSAPPAPPPSQYEYTTGPSAPVEYGRQYEQRGRTEGVTGQYDPRRTEGVTGQYDPRRTEGVTGQYEPKGRTEGVTGQYEQRGRTEGGTPSERYGLGTGLAVGAVAGGVGALAIDEGVKYKEEKAAERVGEKVTPAARDDYSEYRREY

SEQ ID NO: 76092 - protein, 214 aa, Zea mays
  misc_feature (96)..(96): Xaa can be any naturally occurring amino acid
  misc_feature (118)..(118): Xaa can be any naturally occurring amino acid
  misc_feature (138)..(138): Xaa can be any naturally occurring amino acid
MAYSMLSSAAVVTSPAQATMVAPFTGLKSSSAFPVTRKANNDITSIVSNGGRVSCMKVWPPVEKKKFETLSYLPDFTEVELGKEGDYLLPAQGIPXVKSKLSKDFVYREHGSTPRIQXGRYWKMGKSPLFGRPPLAQXVKEAQKGKKGNPKPFLQGSSGFKTTREGRGVIFFPQKKPKFPGGLKLLLKKKKLSLFFLPKKGGCFFFLRGIVEKK

SEQ ID NO: 76093 - protein, 478 aa, Xylella fastidiosa Temecula1
MSEHYDVVVIGAGPAGYHAAIRAAQLGLKVACVDAALGKDGKPALGGTCLRVGCIPSKALLDSSRQYWNMGHLFNEHGISFKDAKMDIATMIARKDKIVKQFTGGIAMLFKANKITPYYGFAQLQPGNVVKVKQHEGKNIELKGANVILASGSDSVELPFATFDGETIVDNIGALDFTKVPKRLAVIGAGVIGLELGSVWKRLGAEVTILEAMPNFLAAVDADVAKTAAKEFKQQGLDIKLGAKVSRTEISSKNNKKEVIVTYTDASGKQTLTVDKLLVAVGRKAATKGLLADGTGVQLNERGQIVVDEHCHTGVDGVWAIGDCVRGPMLAHKGFEEGIAVAELIAGLPGHVNFETIPWVIYTEPEIAWVGKTEQELKADNIPYKAGSFPFAAVGRAVAMAEPSGFAKVLAHAETDRVLGLHLIGVNVSELVHEGVLAMEFSGSADDLARICHAHPTLSEAIHDAAMAVSKRSIHKAN

SEQ ID NO: 76094 - protein, 184 aa, Crocosphaera watsonii WH 8501
MTQLESKKPASLPPGDKGLPLIGESLSFLFDPDFGKKKLKKYGHVYKTNIFGNNAVIMIGAEANQFLFRNENQYVVSTWPKSTRILLGKLSLSTNDGTFHTSRRKLLAQAFKPRALNSYIPKMTEITQQYIDKWLQTKELTWYPELRDYTFDVACSLLISIDNASQTKLASYFETWVKGLFRVC

SEQ ID NO: 76095 - protein, 391 aa, Xylella fastidiosa Temecula1
MSTEVKVPVLPESVSDATIASWHKKAGEIVKRDENIVDLETDKVVLEVPSPVDGVLKEIKFDAGSTVTSNQVLAIIEEGSIVTAPSPAPSQVIDQKPVAVSAPAAKSNVDSLPPGARFTATTEGIDPAQIEGSGRRGAVTKEDIINFAKQNGAARASGTRLEERIPMTRIRQRIAERLMQSKNSTAMLTTFNEINLAKVSNIRKELQEEFQKAHGIKLGFMSFFVKAAANALQRFPLVNASIDGTDIIYHGYSDISIAVSTDKGLVTPVLRNVERMSFADIEHRIADYAKKARDGKLSLEELQGGTFTVTNGGTFGSLLSTPIVNPPQSAILGMHTIKERPIAENGNIVIAPMMYVALSYDHRIIDGKDSVQFLVDIKNQLEDPGRMLFGL

SEQ ID NO: 76096 - protein, 345 aa, Agrobacterium tumefaciens str. C58
MTIHSSALSAIGNTPLIRLKAASEATGCEILGKAEFLNPGQSVKDRAALYIIRDAERRGQLRPGGTIVEGTAGNTGIGLSLVANALGYKTVIVIPETQSQEKKDALKLLGAKLVEVPAAPYSNPNNYVKVSGRLAKQLAATDENGAIWANQFDNIANRQAHIETTAPEIWDQTDGKVDGFICSVGSGGTLAGVADGLRDFNPDIKIGLADPEGAALYEFYKHGVLKSEGSSITEGIGQGRITANLEGFAPDFSYRISDAEALPVLFDLVTKEGLCLGGSSGINIAGAIRLARELGPGHTIVTILCDYGNRYQSKLFNPDFLRSKGLPVPQWLATKSEIPVPYETV

SEQ ID NO: 76097 - protein, 133 aa, Triticum aestivum
  misc_feature (87)..(87): Xaa can be any naturally occurring amino acid
MAAAALRPAILRHIRLSPATAVPLAAAAAAGRPLALAPWLARPMSSHDAHLTRDEVVGRVLDVLKCHPKVDPSKVTPEAHFEKDLGXLDSLDTVEVVMAIEEEFKLEIPDLEADKINSLPLAIEYVANHPMAG

SEQ ID NO: 76098 - protein, 251 aa, Brassica oleracea
MTTVEVSNVSLGATDRDLKEFVSFSGGILYPETLSEAERSKLAYVTFKDLQGAETAVLLSEPKDSSKSPRAGDSVFRKAEDVVSSMLAKGFILGKDAIAKAKSVDEKHQLTSTASARVASLDKKFGFTDKINTGTVVVDDKTISAIAASEQTAIMKNRYVLTGATWVTGAFRKVAKAAEEEKVGMAEEEDKRKVVDEFARVHLSESPKAPSSKEEEVHEPKLSDSPEPKESEHHEPQQQQQSSQPVGPAQP

SEQ ID NO: 76099 - protein, 265 aa, Triticum aestivum
  misc_feature (203)..(203): Xaa can be any naturally occurring amino acid
  misc_feature (235)..(235): Xaa can be any naturally occurring amino acid
  misc_feature (246)..(246): Xaa can be any naturally occurring amino acid
VFHRTSLYKKAGWYRSGIPGISSTHASGSGNFVKMVHNGIEYGDMQLIAEAYDVLKSVGKLTNGELQQVFAEWNKGELLSFLVEITADIFSIKDDQGEGYLVDKVLDKTGMKGTGKWTVQQAAELSVAAPTIEASLDSRFLSGLKDERVAASKIFQGDYSSGETVDKAQLIEDVRKALYASKICSYAQGMNIIKAKSTEKGWXLTLGELARIWKGGCIIRASFLDRIKKAYDKEXNLPTLLFDPEXFAQEILEQANPRGRKGPSC

SEQ ID NO: 76100 - protein, 300 aa, Brassica oleracea
MTTVKVSNVSLGATDRDLKEFFSFSGDILYLETQSETERSKLAYVTFKDLQGAETAVLLSGATIVDSSVIVTMAPDYQLSPEALASLEISKSPRAGDSVLRKAEDVVSSMLAKGFILGKDAIAKAKSVDEKHQLTSTASAKVASLDKKLGFTDKINTGTVVVGDKVREVDHKYQVSEKTKSAIAAAEQTVSNAGSAIMKNRYVLTGATWVTGAFNKVAKAAEEVGQKAKEKVGMAEEEDKRKVVDEFARVHLSESPKAPSSKEDDVHEPKRSESPEPKESEHQEPQQQQQSSQPVGPAQP

SEQ ID NO: 76101 - protein, 172 aa, Crocosphaera watsonii WH 8501
MDLKALIRDIPDFPKQGIVFRDITTLLSDAEGLRYTIDTLKEKCLSANLSPDYIVGMESRGFLFGAPLAYQLNAGFVPVRKPGKLPAAVHKVEYELEYGTDSLEIHQDALEDHHNVLIVDDLMATGGTAKATAELLEKIGCNVLGFAFIIELKALEGRKKLPDVPIITLIEY

SEQ ID NO: 76102 - protein, 423 aa, Rhodobacter sphaeroides 2.4.1
MKAQPPLRLTAQAMAFVLAGGRGSRLKELTDRRAKPAVYFGGKARIIDFALSNAMNSGIRKMAIATQYKAHSLIRHIQRGWNFFREERNEYLDILPASQRVDENRWYLGTADAVTQNIDIVDSYDIKYVIILAGDHVYKMDYEIMLRQHCETGADVTIGCLTVPRAEATAFGVMHVDANLRITDFLEKPADPPGIPGDEANALASMGIYVFDWAFLRDLLIRDAEDPNSSHDFGHDLIPAIVKNGKAMAHRFSDSCVMTGLETEPYWRDVGTIDAFWQANIDLTDFTPKLDLYDREWPIWTYSQIVPPAKFIHDSENRRGTAISSLVSGDCIVSGSEIRSSLLFTGCRTHSYSSMSHVVALPHVTVNRKADLTNCVLDRGVVVPEGLVIGQDAEEDARWFRRSEGGIVLVTQDMLDARARALN

SEQ ID NO: 76103 - protein, 389 aa, Aspergillus oryzae
MSLNIAQHHSHNLLKQFQIPVPEGFVVKSPEAARDVVYNIGAPSVMKAQILAGGRGKGKYNSDGKGGVRIVDSPDEAFENASNMIGYSLVTKQTPPDGLPVNKLYIYKSVDIAQEFYVAITFDRARYKPVLLMSDDGGVNIESNVNQLQRFWFNLSTGITPEIAAYIEAQFGFSDDDMGMVTHILRQLVKLFREKDATLLELNPFVRTTEGSLICIDAKFNFDDSAKFRQPELVSLVEHSAEEKDEYEASQLGLSYIRLDGNIGVIVNGAGLAMATNDLVTLYGGNCANFLDIGGGATKETLSKAFSILQGDSRTKALFINIYGGIVRCDMIAESILAASAAMGGFSIPVVVRLQGTNYEKGFKLGNNIILEADFDAAAKKIVELTNSS

SEQ ID NO: 76104 - protein, 621 aa, Saccharomyces cerevisiae YJM789
MNSSYTQRYALPKYIAISDYLFHRLNQLNIHTIFGLSGEFSMPLLDKLYNIPNLRWAGNSNELNAAYAADGYSRLKGLGCLITTFGVGELSAINGVAGSYAEHVGILHIVGMPPTSAQTKQLLLHHTLGNGDFTVFHRIASDVACYTTLIIDSELCADEVDKCIKKAWIEQRPVYMGMPVNQVNLPIESARLNTPLDLQLHKNDPDVEKEVISRILSFIYKSQNPAIIVDACTSRQNLIEETKELCNRLKFPVFVTPMGKGTVNETDPQFGGVFTGSISAPEVREVVDFADFIIVIGCMLSEFSTSTFHFQYKTKNCALLYSTSVKLKNATYPDLSIKLLLQKLLANLDESKLSYQPSEQPSMMVPRPYPAGNVLLRQEWVWNEISHWFQPGDIIITETGASAFGVNQTRFPVNTLGISQALWGSVGYTMGACLGAEFAVQEINKDKFPATKHRVILFMGDGAFQLTVQELSTIVKWGLTPYIFVMNNQGYSVDRFLHHRSDASYYDIQPWNYLGLLRVFGCTNYETKKIITVGEFRSMISDPNFATNDKIRMIEIMLPPRDVPQALLDRWVVEKEQSKQVQEENENSSAVDTPTPEFQPLLKKIKLDTDLISPPYYQGPS

SEQ ID NO: 76105 - protein, 233 aa, Pisum sativum
MASHLCKSASRAARSLLSASFHSQGRAVAAAAAVASIRKVPVFAPNYRRTGSGNGPSSWIAGALALPAAAYMLQDQEVHAAELERTFIAIKPDGVQRGLISEIISRFERKGFKLVGIKVLIPTKQFAQQHYHDLKERPFFNGLCDFLSSGPVIAMVWEGEGVITYGRKLIGATDPQKSAPGTIRGDLAVVVGRNIIHGSDGPETAKDEIKLWFKPEELVSFTSNSEKWIYGDN

SEQ ID NO: 76106 - protein, 317 aa, Synechococcus sp. CC9605
MLADLVKRSRPLSADSKLLVLGGGYSGRCLAGLARALGTPVLCTRRSLDSAEADLLFDSNGQDQLDPASLEGITHLLSTIPPDRDGNDPVLLKLLPTLGNLPLRWAGYLSTTGVYGDRQGGWVSEHDDPAPALDRSMRRLNCEQAWLRSGLPIQILRLPGIYGPGRSVLNGLEQGRARLIDKPGQVFCRIHVEDIAGACWHLMHRAEQGVPASPGNGSIVNVVDDLPAPTAELMRHAADLLGCALPPLKPFDQIVESMSPMAQSFWSENRRVSNHKLCQELGYALLHPNYRVGLQDCLNQDKLNSLDLGSPPRSANG

SEQ ID NO: 76107 - protein, 192 aa, Helicobacter pylori 26695
MKRLEVSNQAKLPTQFGEFYIQCFREKGSNGSKDHLVVFTPNFSQNPLVRLHSECLTGDALGSQKCDCGGALQMALERISKEGGLVIYLRQEGRGIGLFNKVNAYALQDKGYDTIQANEMIGFKDDERDYSVAGEILEYYRIKKMRLLTNNPKKIAALEKYAEVTRESLIVCANEHNQGYLEVKKLKMGHLL

SEQ ID NO: 76108 - protein, 167 aa, Buchnera aphidicola str. Sg (Schizaphis graminum)
MANIEKKNNSELQEKLITVNRVSKTVKGGRIFSFTALTVVGNGEGRVGFGYGKAREVPAAIQKAMEKARRNMVTIPLVNKTLQHSLKGSHTGSNIFMKPASDGTGIIAGGAMRAVLEVAGIHNVLAKTYGSTNPINVVRATMNGLTNMKSPEMIAAKRNKLIEDILG

SEQ ID NO: 76109 - protein, 404 aa, Rhodococcus sp. RHA1
MAPDTAQIETLQEPLTDEEIFSAHLGGKLAVQAVVPLASRRDLSIAYTPGVAQVSRAIAADPQLAQQYTWTNRLVVVVSDGSAVLGLGNIGARASLPVMEGKSALFKQFADLNSIPLVLDTTDPDEIVETLVRLRHSFGAVNLEDIAAPRCFEIEERVIAALDCPVMHDDQHGTAIVVLAALISAARLQNRDIQSLRTVISGAGAAGVACAKMLLARGISNVTVTDSVGIVHSLRDDLNAYKAGLAACTNPEGRTGGLAEALVGADVFIGVSSGAVAEELIATMAPESIVFALSNPEPEIHPDVAINHAAIVATGRSDFPNQINNVLAFPGVFQGALDVGATTITEGMKLAAANAIASVVLPDIGVDHIVPSPLDPTVAPAVAAAVAEAAIAEGVAAAPLTPSR

SEQ ID NO: 76110 - protein, 344 aa, Helicobacter pylori 26695
MILKRVTEALEAYKNGEMLIVMDDEDRENEGDLVLAGIFSTPEKINFMATHARGLICVSLTKDLAKKFELPPMVSVNDSNHETAFTVSIDAKEARTGISAFERHLTIELLCKDTTKPSDFVRPGHIFPLIAKDGGVLARTGHTEASVDLCKLAGLKPVSVICEIMKEDGSMARRGDKFLSDFALKHNLKTLYVSDLISYRLENESLLKMFCQEEREFLKHQTQCYTFLDHQQKNHYAFKFKGAKTHDLAPLVRFHPIKEDFDFLTTDAFEVFFKALEYLKHEGGYLIFMNTHSKENNVVKDFGIGALVLKNLGIKDFRLLSSCEDRQYKALSGFGLKLVETISL

SEQ ID NO: 76111 - protein, 490 aa, Oryza sativa Japonica Group
MQVHHDMNAPLSHYFIYTGHNSYLTGNQLSSDCSDIPIIKALQIGVRVIELDMWPNSSKDDVDILHGRTLTAPVSLIKCLKSIKEYAFVASPYPVIITLEDHLTSDLQAKVAKMVLEVFGDTLYYPESKHLQEFPSPEALRGRVILSTKPPKEYLESKGGTMKDRDIEPQFSKGQNEEAVWGTEVPDIQDEMQTADKQHENDILYTQRDVEEDDEKKMCQHHPLEYKHLITIKAGKPKGAVVDALKGDPDKVRRLSLSEQELAKVAAHHGRNIVSFTHKNLLRIYPKGTRFNSSNYNPFLGWVHGAQMVAFNMQGYGRSLWLMHGFYKANGGCGYVKKPDFMMQTCPDGNVFDPKADLPVKKTLKVKVYMGEGWQSDFKQTYFDTYSPPDFYAKVGIAGVPSDSVMQKTKAVEDSWVPVWEEEFVFPLTVPEIALLRVEVHEYDVSEDDFGGQTALPVSELRPGIRTVPLFDHKGLKFKSVKLLMRFEFV

SEQ ID NO: 76112 - protein, 498 aa, Magnaporthe grisea 70-15
MSTMALHRTASTKSDTTMACPNGLVKNLPLGGNTKCSACGSHRAEKRRASSTSSVSTTPTSPSFSEADWSPLHNSSQEPQPEYTKVANSLMRAITDYVGHLQNENLPMPSLEPAADAHGVLKHPEGVAARNAVVELAQRIVAMTMDPDMNLLISSLQFHFCSSLKVAIDLKVHEHVPRRGSITSSELAAKVGADESILVRIMRALILKHVFCSPTPGTYAHTAMSWCMMKSPDAIDLLGHRLDESFRASSRQADALALVNYREPDEADVKGFSMAFGTTENFWEVLGHEGEEERAQRFNRAMRAVSLNTLDVIPRMYPFDRIRGDGLLVDVGGGLGQVARAIMGAHRGAGLRSCIVQDAHAGDDAKKQPDVMEANRKLGVELQKHNFFDPQPVKGASVYFLRHIFHDWPDRACVKILKQTVEAMGKDSTLLICDQVVDDEASPQATLYDIDMWSLFGGKERNRSEWEALFRSADERLYIKKVWTTAEAPTTMLEVCLS

SEQ ID NO: 76113 - protein, 382 aa, Synechococcus sp. CC9605
MQDKLTLMIPGPTPVPETVLKAMGRHPIGHRSGEFQAIVRRTTEQLKWLHQTTSDVLVITGSGTAAMEAGIINTLSRGEKVLCGDNGKFGERWVKVARAYGLDVEVIKAEWGQPLDPEAFRSALEADSAKAIKAVILTHSETSTGVINDLESIARHVKTHGTALTLADCVTSLGATNVPMDAWGLDVVASGAQKGYMLPPGLSFVAMSARAWEAYERSDLPKFYLDLGPYRKTAAKDSNPFTPAVNLYFGLEAALDMMQKEGLEAIFARHARHRAAAQAGMKAMALPLFAAEGYGSPAITAVAPEGIDAEQLRKAVKEKFDILLAGGQDHLKGQVFRIGHLGYVCDRDVLTAVAAIEATLQSLGLHKGSMGAGVAAASAALG

SEQ ID NO: 76114 - protein, 310 aa, Rhodopirellula baltica SH 1
MPFSYLKDRSMRVRKAVITAAAPNQNTLPLQRLVDGSGEEKTALQLIVEETLSAGVEEICVVIQPGDEDNYRKAAGGSLGNLQFVHQERPLGYADAILQAESFCGDDAFLHLVGDHLYLSATSKTCAAQLIEMAEQHSCPVSAVQSTREHRLPYFGIVAGASVPRFDGLYDVRTVVEKPTPTLAEQSLITPGLRSGYYLGYFGMHVLTPAVMECLHEVVADQSMERPSLSDAMAKLPHRGKYLAYQLLGRRYNIGEQYGVLIAQLAIGLSGRDRDLLLTELVELLATRTENPVTATIDPPSESSSLEGSN

SEQ ID NO: 76115 - protein, 343 aa, Coccidioides immitis RS
MPLDGVKNIVLVLSGKGGVGKSSVTLQLALTFCLQGRSVGILDVDLTGPSIPRLVGLEDAKITQAPGGWLPVTVHPFHTPSSDGLNGSQRANKPDDSNESSSSTVETAPQSTNFCGSLRCMSLGFLLRDRGDAVIWRGPKKTAMIRQFLTDVLWGETDYLLIDTPPGTSDEHIALAEQLLTIQQTYSLRSSRATAPKLAGAVLVTTPQAISTSDVRKEINFCVKTRIPVLGVIENMSGYTCPCCGEVSNVFSRGGGQIMAQETGVRFLGAVPIDVGFGEMVEGWKKDSTGQDQGNKATKKGQDARLDSYDDLLVERYKKCWSFSVFEEFAKKLIGLIEGSDQQ

SEQ ID NO: 76116 - protein, 437 aa, Streptomyces avermitilis MA-4680
MPERTSRPMPDLSLAELLDLDRRHVWHPYGPMPGRQEPLVVEAASGVRLRMADGTGELIDGMSSWWSAIHGYNHPVLNEAAREQLSRMSHVMFGGLTHEPAVRLAKRLVDISPEGLEHVFLADSGSVSVEVAVKMCLQYWRSLGRPGKQRLLTWRGGYHGDTWQPMSVCDPQGGMHELWQGVLQRQVFADAPPVAYEESYADQLRELIERHADELAAVIVEPVVQGAGGMRFHSPAYLRVLREACDAHDVLLVFDEIATGFGRTGALFAADHVGVTPDVMCLGKALTGGYLTLAATLCTARVADGISRGEVPVLAHGPTFMGNPLAAAVANASIDLLLGQDWQTEVKRIETGLREGLAAAADLPGVRDVRVLGAIGVVQLDRPLDEAAMAAATRAAVREGVWLRPFRDLVYTMPPYVTGDADVARIAGAVCAAAREG

SEQ ID NO: 76117 - protein, 259 aa, Streptococcus pyogenes M1 GAS
MTHTKEVAFITGAASGIGKQIGETLLKEGKTVVFSDINQEKLDQVVADYTKEGYDAFSVVCDVTKEEAINAAIDTVVEKYGRIDILVNNAGLQHVAMIEDFPTEKFEFMIKIMLTAPFIAIKRAFPTMKAQKHGRIINMASINGVIGFAGKSAYNSAKHGLIGLTKVTALEAADSGITVNAICPGYVDTPLVRGQFEDLSKTRGIPLENVLEEVLYPLVPQKRLIDVQEIADYVSFLASDKAKGVTGQACILDGGYTAQ

SEQ ID NO: 76118 - protein, 629 aa, Bacillus halodurans C-125
MDLEKLHDPSLIKSMTKQELEQLAEEIRQFLIEKLSITGGHLGPNLGVVELTLALHSLFDSPKDKLIWDVGHQAYVHKILTGRAGQFDQLRQYKGLCGFPKRDESEHDVWETGHSSTSLSAAMGMATARDLKGTDENVIAIIGDGALTGGMALEALNHIGHEQKDLIVVLNDNEMSIAPNVGALHNVLGRLRTAGKYQKAKEDLEMLIKKIPAFGGKLAQAAERVKDSLKYLLVSGIFFEEMGFTYLGPVDGHDLDDLMENLKYAKKTKGPVLIHVLTKKGKGYAPAENDEKGTWHGVGHYKIESGELVKKPAPPSYSGVFAETLKKIARNDPRIVALTAAMPGGTKLDQFAKEFPDRMFDVGIAEQHATTMAGGLATQGLKPVFAVYSTFLQRGYDQVVHDICRQNLNVFFAIDRAGLVGADGETHQGVFDIAYLRHLPNMKILMPKDENELQHMVYTAIQYEGGPIAVRYPRGNGYGIKMDEVLKEIPIGSWEVLQEGTDACILTFGTMIPVAEQASKELSQQGYSIRLINARSVKPLDEAMLHEIAKSGRPVLTLEETAVQGSFGSAVLEFFHDHGYHNVVTQRMGIPDRFIEHGSVSELLEEIGLTSSQVANQLSKLLPRKQKRA

SEQ ID NO: 76119 - protein, 554 aa, Zea mays
MADSKDLNSASPNSDTRLTNLSAAEHENLEDDMKKMDEEIQRQQDQMLKVAKKWYLSHFKVDRHQKVVKEREMDADYMSSMLQQLPTIGDARSDRPEHQKSLVIRLMRKADINITGHPSPKNQKRKTPLLRLGHGPSGPRPRTVRAVAEGPTRRSGDLSQAATTVHLAKPNPSQSEPFVSTRSICTVRSTVTPTPRLGNSPLPPPASQFSALPSSSARQSAKKAVCPAVLVRCLTLRGSAAPSIRASTLPFGRISTVHRHNGLATKVEKSRKQMKERKNRVTKIRGVKKTKAGDAKKKGGSYLPCHFSHHRLWHTTRCLAFLKLKGLDHAIGVTVVKPIFERTKESDEHLGWVFPAAADEEPGAEPNPLNDARSVRELYEIASSNYAGKPTIPVLWDKQLKTVVNNESSEIIRMLNAEFNGIARNPGLDLYPAHLQASIDEANELVYDAINNDVYKCGFAKKKDGCVLVPDLGLLTNIHDRARELFYYLKGGQVDYGEEHIKACDHNRALSCLLRAQPSAFCGALCWHVGCEGAATDACRQARLIAAMAISYEL

SEQ ID NO: 76120 - protein, 294 aa, Bacillus halodurans C-125
MSVQLLQFLDEIKDIIEERMPAHIERLNSPDMLKNSMLYSLKAGGKRIRPALLLATMKSFQKDISQGIDLACAIEMIHTYSLIHDDLPSMDDDDIRRGKPTNHKVFGEAHAILAGDALLTYSFEIVAKMKGVDPAKTLCLIEELARAAGPEGMVGGQVADIEGENQKLTVEGLEYIHHHKTGALLSFAIVAGARLADASEQDIENIRRFSRELGLLFQIKDDILDVEGDQAAIGKPVGSDDGNQKSTYPSLLTLEGAKEKLHLHTLLAKEYLYSVQMNHRLLEELTDYVVNRNH

SEQ ID NO: 76121 - protein, 170 aa, Prochlorococcus marinus subsp. marinus str. CCMP1375
MPRGYIPEDDISILNLFGFMSVERTFLAIKPDGVQRGLVGEILGRFERKGFKLVGLKQLIPSKELAEKHYGVHKERPFFTGLVGFITSGPVVAMVWEGDGVILSARKLIGATKPLEAEPGTIRGDLGINIGRNVIHGSDGPETASFEIDLWFNSSELNNWNPSDQKWRVE

SEQ ID NO: 76122 - protein, 249 aa, Crocosphaera watsonii WH 8501
MIADFRVIFERDPAARNWLEVLFCYPGLQAIMLHRVAHSLYKQGMPFLPRLISHLARFFTGIEIHPGAQIGTGVFIDHGMGVVIGETAEVGDYSLIYQGVTLGGTGKESGKRHPTLGKNVVVGAGAKVLGNLNIGNSVRIGAGSVVLRDVPSDCTVVGIPGRIIYQSGVKVNPLEHGNLPDSEAKVIRLLLDRIEALEKQVEALQEDKLKQRELVVSGISKLTASSDHDESHSCYIKDKEIEEFLGGTM

SEQ ID NO: 76123 - protein, 601 aa, Escherichia coli K12
MEGSDFLLAGVLFLFAAVAAVPLASRLGIGAVLGYLLAGIAIGPWGLGFISDVDEILHFSELGVVFLMFIIGLELNPSKLWQLRRSIFGVGAAQVLLSAALLAGLLMLTDFAWQAAVVGGIGLAMSSTAMALQLMREKGMNRSESGQLGFSVLLFQDLAVIPALALVPLLAGSADEHFDWMKVGMKVLAFVGMLIGGRYLLRPVFRFIAASGVREVFTAATLLLVLGSALFMDALGLSMALGTFIAGVLLAESEYRHELETAIDPFKGLLLGLFFISVGMSLNLGVLYTHLLWVVISVVVLVAVKILVLYLLARLYGVRSSERMQFAGVLSQGGEFAFVLFSTASSQRLFQGDQMALLLVTVTLSMMTTPLLMKLVDKWLSRQFNGPEEEDEKPWVNDDKPQVIVVGFGRFGQVIGRLLMANKMRITVLERDISAVNLMRKYGYKVYYGDATQVDLLRSAGAEAAESIVITCNEPEDTMKLVEICQQHFPHLHILARARGRVEAHELLQAGVTQFSRETFSSALELGRKTLVTLGMHPHQAQRAQLHFRRLDMRMLRELIPMHADTVQISRAREARRELEEIFQREMQQERRQLDGWDEFE

SEQ ID NO: 76124 - protein, 299 aa, Pseudomonas aeruginosa PAO1
MTVQYPTIADCVGNTPLVRLQRLPGETSNTLLVKLEGNNPAGSVKDRPALSMITRAELRGDIRPGDTLIEATSGNTGIALAMAAAIKGYKMILIMPDNSTAERKAAMTAYGAELILVSKEEGMEGARDLADKLQREGRGKVLDQFANGDNPEAHYHSTGPEIWQQTGGSITHFVSSMGTTGTIMGVSRYLKEQNPAVQIVGLQPMEGSAIPGIRRWPQEYLPKIYDASRVDRVVDMHQDEAEDIMRRLAREEGIFCGVSSGGAVAAMLRLSRELENAVLVAIICDRGDRYLSSGVYDPR

SEQ ID NO: 76125 - protein, 941 aa, Arabidopsis thaliana
MKFGETFTEYLHGEEEWFLEKCRFVEYKKLKKVLKKCKTCNSTKSDDGQIIPSATSSSLSDSCECKACPWCDQMFFEELMKEATDIAGFFRSRVRHLLHLHVATGMQRYMIRLRRCFTDEKQALVQEGQILIQYITMNAIAIRKILKKYDKVHSSENGKNFKLKMRAERIELLHSPWLIELGAFYLNSGLDNVGNFKNSFGRVACENLNEDQPVLKLMLPNSIELEYDLTCAICLETVFNPYALKCGHIFCNSCACSAASVLIFQGIKAAPRHSKCPICREAGVYAEAVHMIELHLLLKTRHGNILYGFIIHVDDANEWFVFSLSENAAVWRNQKPDDSIKSSKDESSRKKNDKSVNGDDSNGHVSSTVDPAPSTLPTPSTPPPPVKMANEEPPPKPITENKEDPNSKPQKKEAHMKRMASAGLQIDSVLGRKTENLKDIYSVGRKLGQGQFGTTFLCVDKKTGKEFACKTIAKRKLTTPEDVEDVRREIQIMHHLSGHPNVIQIVGAYEDAVAVHVVMEICAGGELFDRIIQRGHYTEKKAAELARIIVGVIEACHSLGVMHRDLKPENFLFVSGDEEAALKTIDFGLSVFFKPGETFTDVVGSPYYVAPEVLRKHYSHECDVWSAGVIIYILLSGVPPFWDETEQGIFEQVLKGDLDFISEPWPSVSESAKDLVRRMLIRDPKKRMTTHEVLCHPWARVDGVALDKPLDSAVLSRLQQFSAMNKLKKIAIKVIAESLSEEEIAGLKEMFKMIDTDNSGHITLEELKKGLDRVGADLKDSEILGLMQAADIDNSGTIDYGEFIAAMVHLNKIEKEDHLFTAFSYFDQDGSGYITRDELQQACKQFGLADVHLDDIHKTSLSVSVSLLLQNIKNGIRNFLGNYSGDSSTSRRRFPSIWLWGRVLDLSLVDDTGLHPWDHLCYLRSCRMMTKFSCKFFIIFI

SEQ ID NO: 76126 - protein, 140 aa, Rhodobacter sphaeroides 2.4.1
MAIERTLSIIKPDATRRNLTGKINAKFEEAGLRIVAQKRIHLSLAQAQKFYGVHKDRPFFGELTEFMASEPVVVQVLEGEGAIAKNREVMGATNPANADAGTIRKEFALSVGENSVHGSDAPETAAEEIAFFFSGLELVG

SEQ ID NO: 76127 - protein, 182 aa, Triticum aestivum
YTYIVQSLVPTVMASLATSVAPFQGLKSTAGLPVSRRSNGASLGSVRNGGRIRCMQVWPIEGIKRFETLSYLPPFSTEALLKQVDYLIRSKWVPCLEFSKVGFIFREHNASPGYYNGRYWTLWKLPMFGCTDASQVINEVEEVKKEYPDAYVRIIGFDNMRQVQCVSFIAFKPPGCEESGKA

SEQ ID NO: 76128 - protein, 615 aa, Rhodobacter sphaeroides 2.4.1
MLRISDISYSVEGRPLFQGASATIPTGHKVGLVGRNGTGKTTLFRLIRGELALEGGEIALPARSRIGGVAQEVPSSSTSLLDTVLAADTERAALMEEAETATDPHRIAEIQHRLADIDAWSAEGRASAILKGLGFDAEAQLRPCSDFSGGWRMRVALAGVLFAQPDLLLLDEPTNYLDLEGALWLESYLQKYPHTVLIISHDRGLLNRAVQGILHLDQKKLTYWTGPYDQFARQMAEKRAVQAAEAKKQEARRAHLQSFVDRFKAKASKAVQAQSRVKMLEKMTPITPPEEAKRQVFTFPKPEELSPPIITMEGVSVGYDGPPVLRRLSLRIDQDDRIALLGRNGEGKSTLSKLLAGKLAAQEGRMVSSSKLRIGYFAQHQVDELHIEETPLQHVMRLRPDEGQPRLRARLAGFGLMADQAETAVGRLSGGQKARLSLLLATIDAPHLLILDEPTNHLDMESREALVEALTEYSGAVVLVSHDMHLLGLVADRLWLVKGGAVAPFTEDLEAYRRQLLAGDDPPPEKKAEKPAPKAASREEKLALRAEVRRCEERLEKLNGMRDKLATKLADPALYEPERLGEMETWQKKYAEVMEGLDRAEALWLTAQERLEAAG

SEQ ID NO: 76129 - protein, 253 aa, marine gamma proteobacterium HTCC2143
MARLNNKVAIITGGSGGIGKAAAARFIVEGAKVMLVDIDEHALKNTAEELGENAAYCVADVTKKMDTLHFVNATIEQFGGIDIFLANAGIEGQVAPITEYDEDIFDQVIAVNIKGVWLGIKHIFPIMQNNGGGSIVITSSTEGVRGGIGISAYTTSKHAVIGLMRGIAKEGAPDNIRVNTVNPCPVETRMMRSLENGISPGDSQGAHDRITESIPLQRYGQPEDIANIMLFLASDESAFITGGVYMADGGSTA

SEQ ID NO: 76130 - protein, 125 aa, Aspergillus oryzae
MSSAKVYVGNLSWNTNDESLRQTFSEFGNVLDAIVMKDRETGRSRGFGFVTFSAQTEADAAIGGLNEQELDGRRIRVNLANARPAGGSRNYGGGNGYGGGYGGGYSQGGYQGGGYQGGNYGQGDY

SEQ ID NO: 76131 - protein, 306 aa, Gibberella moniliformis
MSLYDKSVTATRSAHRTSDTLHSLVAGSVAGGLEIAITYPAEFAKTRLQLNQVSGRNKQNVPWPRFGLQWYSGCIPFLIGNSVKTSIRFVSFDGYQKLLADDDGNISRFGILLAGFGAGATESLLAVTPSERIKTIIIEDRRLEKPRIRNSFHAMSIIARDHGLSGFFQGFWPTTARQSAGSAIRLGSYTFLKQVVQSRTPQGGKIGTVKTFIIGSLAGLITVYLTQPLDTIKTRMQRLEARTRYGNAFICARGILEQEGFTAFWSGAVARSLRLVMSGGIVFMVYEKVVEGLDVISPAKRYEIAA

SEQ ID NO: 76132 - protein, 849 aa, Vitis vinifera
MFLSLPLPYAINEILTFTVCITTFKIQRPGSGGDLPQSGEFIPFPVARRVNSSHAVTMDDDVESGALGPYQDKPRIFPNMRSKSYTPLIFRIFMGINVRVLFVLLLLGLGAVFYVGARTSPILVFVFSVCIISFLLSVYLTKWVLAKDEGPPEMAQISDAIRDGAEGFFRTQYGTISKMAMLLALVILSIYFTTPQQESSGIGRSTTAYITVAAFLLGALCSGIAGYVGMWVSVRANVRVSSAARRSAREALQIAVRAGGFSALVVVGMAVIGVAILYATFYVWLGVDSTGSMKVTDLPLLLVGYGFGASFVALFAQLGGGIYTKAADVGADLVGKVEQGIPEDDPRNPAVIADLVGDNVGDCAARGADLFESIAAEIISAMILGGTMAQHPSGFILFPLVIHSFDLVISSVGIFSIRGTRDSGVKSPVEDPMAILQKGYSITIILAVLTFGLSTRWLLYTEQAPSAWMNFALCGLVGIMTAYVFVWITKYYTDYKHEPVRTLALSSSTGHGTNIIAGVSLGLESTALPVIVISISIVSAFWLGQTSGLVDETGNPTGGLFGTAVATMGMLSTAAYVLTMDMFGPIADNAGGIVEMSQQPESVREITDLLDAVGNTTKATTKGFAIGSAALASFLLFSAYMDEVSAFAHEPFKQVDIAIPEVFVGGLLGSMLIFLFSAWACSAVGRTAQEVVNEVRRQFIERPGIMDYKEKPDYGRCVAIVASASLREMIKPGALAIVSPIVVGFLFRILGYYTGHPLLGAKVVASMLMFATVAGILMALFLNTAGGAWDNAKKYIETGALGGKGSDAHKAAVTGDTVGDPFKDTAGPSLHVLIKMLATITLVMAPVFL

SEQ ID NO: 76133 - protein, 255 aa, Helicobacter pylori 26695
MLSRLEKERYLRHIMLEDVGEEGQLKLLKSSVLVIGAGGLGSAVLMYLCAAGIGKIGIVDFDVVDMSNLQRQIIHSQDFLNQSKASSAKARLKQLNAGIEIEAFEERFKAHNALSLIEPYDFIIDATDNFNAKFLINDACVLAQKPYSHAGVLEYRGQSMSVLPHSACLACVFDKPPKKGLNPISGLFGVLPGVLGCIQASECLKYFLGFETLLINTLLIADIKTMDFKKIQAPKNPECRVCGTHKITHLQDYEI

SEQ ID NO: 76134 - protein, 559 aa, Rhodococcus sp. RHA1
MTAQHSDITATSAWQKLHAHRDETSALTIRELFAADTERGRELTLTAGELYIDYSKQRVSRHTLALLVELARAAGVEERRDAMFRGERINTSEDRAVLHTALRLPAHASLRVDGHDVVADVHRVLARMGVFSDRLRSGEWRGATGRPIMTVVNIGIGGSDLGPHMVYRALRHYADSGISVRFISNVDPSDLVATLADLDPSTTLFIVASKTFSTLETLTNAANARRWVTSALGEQAVARHFVAVSTNAERVAAFGIDTENMFGFWDWVGGRYSVGSAVGLAVMVAIGKDSFEEFLDGFHTIDRHFADTPLEDNAPAILALLGVWYSNFFGAETRAILPYSNDLGRFPAYLQQLAMESNGKSVRADGSPIGTTTGAVFWGEPGSNGQHAFYQLLHQGTRLVPADFIGFAEPTHDLPAADGAGSMHNILMSNLFAQSRVLAFGKTPEELTREDTAPDLIAHKTMPGNQPSTTILAPRLTPSVLGQLIALYEHQVFVEGIIYGIGSFDQWGVELGKTQALELEPALSSGNGSLPSDLDSSTASMIRWYHGVRAHGTATVGRP

SEQ ID NO: 76135 - protein, 320 aa, Oryza sativa Indica Group
MAAAQGSGVPAALALSSGHTMPSVGLGVWRMDSPAIRDLIHSALRIGYRHFDCAADYQNEAEVGDALAEAFQTGLVKREDLFITTKLWNSDHGHVVEACKDSLKKLRLDYLDLYLIHFPVATRHTGVGTTASALGDDGVLDIDTTISLETTWHAMEDLVSMGLVRSIGISNYDIFLTRDCLAYAKIKPAVNQIETHPYFQRDCLVKFCQKHGILVTAHTPLGGSTANTEWFGSVSCLDDPVIKVSLAEKYGKTPAQLVLRWGLQRNTVVIPKTSKEERLQENFAVFDFAISDEDMEKMRSIDRKYRTNQPAKFWGIDLFA

SEQ ID NO: 76136 - protein, 596 aa, Gibberella moniliformis
MRGLNNIAVALALSAIWSFGLDLGRHGTSGSSLLLALFRTLCKAYPFVVISHFVWSAIIWPTFFSPLRQLPNVPSDGWLSKETLRLVSEPRGVPQSDWINSLSNRPVDLARYRSFLGFERLLIISPKALAEVLTTKSYDFRKPGLIVSELKQATGMGVLLAEGSEHKSQRKALQTAFNYRHIKNLYPVFWDVAGEFATVLEKQIPTGTPRTSDTTAVIDIVDWASRATLDIIGRAGMGQGFDAIQNDDSRLHQAYRMIFEPSRGAIFLALLRLIFPERLVNWLPLRRNKRMRHGIQVIRSKCQELIRERKEKIKRQKAGVDNSGNDILTVALLNGVFTDEQLIDQLMTFLAAGHETTATALTWAIYILCKQPEVQNRLREEIRMHFPNPKGWPRSERPSSNTLQQAIDFKLPYLNVVCLEVMRYFAPIPLTMREATCDTTILHTFVPAGTRIILAPRVTNRDSALWGPDANNFNPDRWLSPKNGNREATEQSKFKIGNQKRDSTAAPEVTQEEVRGRTEARSNYADLTFLHGPRSCIGQSFARVEFAILLATLIANFEFQIEDESLLDERNISISRGATSRIVGGLKVRVRPIAVV

SEQ ID NO: 76137 - protein, 788 aa, Saccharomyces cerevisiae YJM789
MAGHSHRSSLKNGHKSYKSKHASKGALKRLYKGKVEKEPVGTGKPDKQVSKLQRRNKAKQLRAQKILDSIENRKLFEGKNGAAKIITIVPLVNDLDPLDILYKLLKCADDEEIMVQEVDSKRIFNVHIKKFKSNLKIIIPDMTNFLNILDCAKVADFVVFGLSGVQEVDEEFGEQIIRALELQGIASYIGVISNLSAVHEKEKFQLDVKQSLESYFKHFFPSEERVYNLEKNSDALNVLRTLCQRLPRSINWRDNRGYVVADFVDFVETSPDSGDLVIEGTVRGIGFNANRLVHIPDFGDFQLNKIEKISESSQKRKIIKEKATDSLSLELDLQTVFESNMNRDTLDEYAPEGTEDWSDYDEDFEYDGLTTARYDDHGFLPGREQTSKKAAVPKGTSDYQAKWYLDDVIDANEEEEAEQTNGKDETMMEIDDEMMVEQDNEEVAGDEEYDIEDNEGFEELSPEEEERQLREFRDMEKEDREFPDEIELEPSESAIERLKRYRGLKNLYNCDWQVDEKDPSSPAEWKRLLRIGNYKNTKNRIIKETKNEAQAIAGDRIRMFIRFPKFLLEKIQDPKQLLFAVYGLLLHEHKNAVVNFSLQRWEQYDKPVPSQEPIVVQYGVRRYTIQPLFSQGSNSPNNVHKYERFLHPDTVSVATCIAPVDFTQSPAIFFKPSPTDAKNIELIGHGTFLNADHSRILAKRAILTGHPFRFHKTVVTVRYMFFRPEDVEWFKSIPLFTKSGRSGFIKESLGMHGYFKATFDGKLSAQDVVAMSLYKRMWPMPSLPWNGM

SEQ ID NO: 76138 - protein, 515 aa, Rhodococcus sp. RHA1
MSMPQVTDPVTINPVGGQTVIPDAVSPAAGFVPSSSMVIFGITGDLSRKKLLPAIYDLANRGLLPPSFSLVGFGRHEPDRVIETIQAAMIAGARTSFRIDTWNQLARNFRYVRGSFDDRSAFEILKQELAQLDMLHSAVGHSFYMSISPAHFSLVCAQLNAVGLSQHHRGWRRIVLEKPFGNDLASSRALGATVDEVFGAGSVFRVDHYLGKETVQNILALRFANGLFEPLWNHRHIDNVQITMAEDIGVEGRAGYYDGVGAARDVIQNHLLQLLALIAMEEPVGVDAASLSAEKVKVLSATSAVGPWTETTARGQYAATIRGETYLPGLLEEDGFNPCSTTETYAAITAQIANRRWAGVPFYLRAGKRLTKRTTEVAVTFAAPHHLTGSAEAGPPPQNVLVVRVQPDDGISLRIGAKTPGDGMRIQDVDLSMSFADSFGGSSPEAYERLILDVLRGDASLFPSQAEVDASWAIIDPVITFWAEHGRPDEYRSGSAGPSSAESIVGRTGRVWRPL

SEQ ID NO: 76139 - protein, 300 aa, Bordetella pertussis Tohama I
MNRRPAGAARGSDAIGIARAVAGPAALTATQSPAMAARTAYLGPAGSWTHQACLDLYGADGLVPLSREALFAAYADGKVERACVPVATSVVGLTPYMEDVLALPRVVVVAEYPKMLGYSLLARPGTRREDIKEVHAHPVAFEEVRPWLEREMPGARRVPAASGGAAAQAVAASATQDKASFGPRVGASVYQLVSLADGIEEGPHNVTRWWVLGRDMPAPTGKDKTSLLACIPDARLAPLLADFAQAGVPILTIYERPARKTLDAHRYVVEVAGHVRDDALAGLLARQSELRVLGSYPRRY

SEQ ID NO: 76140 - protein, 204 aa, Yarrowia lipolytica CLIB122
MSQFSAIPEALEAFKNGEFLVVMDDESRENEGDLIIAAAQTTTEKMAFLIRHSSGFVCVPLSNELANKYELPYMVENRTDRHGTAYTVTCDAIEGTTTGISAHDRALTARCLADKNTTAASFMRPGHVVPLRAVDGGVLARRGHTEAAVDLCKLTGQPAAGVICEIVRDEDGLMARTDDCLEFAKTHGIKAITIDALVKYIEQQ

SEQ ID NO: 76141 - protein, 363 aa, Rhodopirellula baltica SH 1
MSSVDPRDTIASIDTQILDLLRERCRAMTENTASNSNPDWASTLTSIDAVVDRFKQSGSGNDGTNNEMPESEIQRNILQHVASACWRATRPGTYAFLGPPDSYSHLAALAYFGEAANLLPVSSIGAVFDAVGRSDCAGGIVPIENSTDGRVVDTFGRLSKGEVSITGEVQLAIHHQLLAMCDRDSITEVHSKPQAISQCRVWLANHLPKAKLIECSSTAAAAKLAATQAGVAAIASEAAGRRHGLRVIGANIEDNRDNVTRFAVLGHEQPAPTGQDKTTLLFQVAHQPGALADVMGIFKRHELNLTWIESFPQPGTKNEYFFVVEFPGHCQDIAIAKAIEDLKTATHHTHVLGSYGRAARAES

SEQ ID NO: 76142 - protein, 468 aa, Photobacterium sp. SKA34
MATGKIVQIIGAVVDVEFPQDSVPQVYDALHVDVKENGTLVLEVQQQLGGGVVRGIAMGTSDGLRRGLSVENTGRPIEVPVGTATLGRIMNVLGQPIDECGEIGEQERYAIHREAPSYEDQSNVTELLETGVKVIDLICPFAKGGKIGLFGGAGVGKTVNMMELINNIALKHSGLSVFAGVGERTREGNDFYYEMQEAGVVNIENPEESKVAMVYGQMNEPPGNRLRVALTGLTMAERFRDEGRDVLLFIDNIYRYTLAGTEVSALLGRMPSAVGYQPTLAEEMGVLQERITSTKSGSITSVQAVYVPADDLTDPSPATTFAHLDATVVLSRQIASLGLYPAIDPLDSTSRMLDPLVVGQEHYDIARGVQSLLQRYKELKDIIAILGMDELSEEDKQAVSRARKIERFLTQPYHVAEVFTGDPGIYVTLKDTLRSFKGLLAGEYDDIPEQAFMYCGAVEDVLENAKKL

SEQ ID NO: 76143 - protein, 264 aa, Anabaena variabilis ATCC 29413
MGQIITQVDAFTDKPFGGNPAAVCVVPSPQPDIWMQNIAQEMNLSETAFLVKQDDGFNLRWFTPTVEVPLCGHATLASAHVLWSEGHLSPDEIARFHTKSGLLIAKRQGDWIELDFPVNHSQPITTPPELTEALGVSLKSVFQNSLGYLVEVESEDVVRNLQPNFQLLKTLAVADVIVTSQTQPDSPYDFVSRFFAPGLGINEDPVTGAAHCCLASYWRDRLGKDEFLAYQASSRGGVVKVSYGGGDRVFLAGQAVTVLRGELI

SEQ ID NO: 76144 - protein, 211 aa, Streptomyces avermitilis MA-4680
MNRPSARYALPEFTERLSTGLRTLDPYSKLLDERIVFLGTPIDDTSANDVMAQFMHLEHLAPDRDISLYINSPGGSFSAMTAVYDTMQFVSCDVETICLGQAASAAAVLLAGGTPGKRLALPGARVLIHQPSLPAPVQGQASDLVIQAAELARTREQLEELLVRHTGQSPERVAADIERDKILDAPAAVAYGLVDRVVPSRKSSAAAPGAR

SEQ ID NO: 76145 - protein, 266 aa, Brucella melitensis 16M
MTAHSRQDLETRLALAEKIVQEAGAKALDYFNRRETLVIETKRDPQDVVSIADRDVEQLIRARVSESFPQDGFLGEEYGLNAGSSGYTWVVDPIDGTSPFVNGMPNWCVSIAVLKDGEPVVGVILAPCFNELYVSAKGQGATLNGRKLALDPSRNIRNAVTGIGANNYVTPQLVAKVVENLLEAGGTFIRNGSGALMIAYVAAGRLVGYYEPYMHAWDCMAGFCLVREAGGYIHPFPTDGENLTKGNRVFAAAPGAVDDLKKVAGL

SEQ ID NO: 76146 - protein, 442 aa, Mesorhizobium loti MAFF303099
MSNRLKVTPNDLSAFWMPFTANRQFKQAPRMFVSAKDMHYTTSDGRKVLDGTAGLWCVNAGHCRPKITEAIQHQAAELDYAPAFQMGHPIVFELANRLVDIAPKGMDHVFFTNSGSESVETALKMAIAYHRMKGEGARTRLIGRERGYHGVNFGGISVGGIVSNRKMFGTLLGGVDHMPHTHLPEKNAFSKGVPEYGAELANELERIVALHDASTIAAVIVEPVAGSTGVILPPKGYLQKLREICTKHGILLIFDEVITGFGRLGAPFAADYFGVVPDIMTTAKGVSNGVIPMGAVFVKKEIHDAFMTGPEHMIEFFHGYTYSGNPIACAAALGTLDTYKEEGLLTRGEELAPYWEDALHSLKGEPHVIDIRNIGLIGAIELAPIAGSPTKRAFSAFVKAFERGALIRTTGDIIALSPPLIITKGQINELIDHVREVLRSID

SEQ ID NO: 76147 - protein, 438 aa, Schizosaccharomyces pombe 972h-
MSAESLLHNTFSTEQIEVLENEYAAHNYHPLPVCFSKAKGAKVWDPEGREYLDFLSAYSAVNQGHCHPKIIEALVEQAQRVTLSSRAFYNDKFGPFAKYITEYFGYEMVIPMNTGAEAVETACKLARLWGYKAKKIPTDEAIILSCVDNFHGRTMGIISMSTDPDARDNYGPYLPNVGPKISGADRVLRYNNIEDLKYYLDTFGPKVAAFLVEPIQGEAGVMVPDDGYLEEAYKLCKAHNVLFIADEVQTGVARTGKMLCIEHSNVKPDVVILGKAISGGVYPVSAVLSSREIMLNFEPGTHGSTYGGNPLGAAVSIAALEVVKEEKLTERAAVLGEKFRTALIECKSPIVQKVRGRGLLNAVVIDESKTNGRTAWDLCLIMRSRGVLAKPTHGNIIRFSPPLVITEEDLMKGIEVIKKSLNDLPTIDMTPYAEKPIH

SEQ ID NO: 76148 - protein, 399 aa, Prochlorococcus marinus str. MIT 9515
MTPEKLGLLWGITVFAGACARLISSVFGFPSVVILLLSGLFIGRSGLGLVEPLDLGQGLEAIVGLLVCLVLFEGGLNLKLPEGNIRNTVLKISLIRLFISLSAGIFVAHWLAGLSWPVAGVYSAIVLATGPTVVSPLVDQIKLVSPLPEVLKAEGLVLEPIGAVLALLLLELILGDLHGIKEVFIALMQRLGGGVLIGLSSGWLLSEILKKIKNEASFGIELQVTLGFIFLVYGICEYILPESGLPASVASGFIVGKREIIDKERLDNLIGELAQLAITVLFPLLASDVSWGELSPLGWGGIVCVLMLMLIVRPISISLATMGRELDIKQRVFLAWLAPRGIVTAAVASLFSIRLEQAGVLGAGRLQGLVFLTILMTVGIQGLTARPLANFLDLIEKKI

SEQ ID NO: 76149 - protein, 326 aa, Zea mays
MASTLLHAATASLQSPSQPSRGGAATAFHPLASTPSIRLARSSFSSNRRLEVSLRAVSAGHRFAGRGAPRGRRVVAALAGEQTEGSEVGDDKDNSNGEIKPEEAQEAWKVMLEQFKAEALRMQALSVQAYDVYSKRAREVLLEASEKLKIQADKAQKDLSVIATEVSQEGQEYLVMAARNSPDSIKDITTTFRALGRLNWPSEYEDYHVGIPFGTFLTVGGFLNFMLTGSTSALRFGIVLGLALLTLGISSLRSHREGDRRPRLLVKGQAAIALVIFFREFSVLLQNGWFPKIFIVLLSGVVAAFYFYRIATGNPKDLSSKNDSAN

SEQ ID NO: 76150 - protein, 427 aa, Triticum aestivum
MESVEALVAHIQGLSGSPDELAQLHGLLKQADGDALRVHSAGLLPFLSHLHPGAHSLGYLYLLDSFVSSSANLRAHAGGDLLVTVADFLTSCSADQIRMAPDKFLNVCRVLKNEVMQLNAPIRGIAPLRAAVRKIQTSSEQLTPLHAEYLMLCLLAKQYKAGLSVLEDDIFEVDQPKDLFLYCYYGAMIYIGLKKFRKALELLHNAVTAPMSSLNAITVEAYKKYVLVSLIQSGQVPSFPKYTSSTAQRNLKNHTQIYVDLSTCYGTGSYSDLETFIQSNAEAFQTDNNFGLVKQVLSSMYKRNIQRLTQTYLTLSLEDIASSVQLNTPKEAEMHVLRMIEDGEIHATINQKDGMVSFNEDPEQYKSSEMVEHIDSSIQRLMALSKKLTSIDQNISCDHAFLMKVQSGRERARFDYDDFDSVPHKYF

SEQ ID NO: 76151 - protein, 504 aa, Solanum tuberosum
MYRCASSRLSSLKARQGNRVLTRFSSSAAVATKPSGGLFSWITGDTSSSVTPLDFPLNDVKLSPPLPDYVEPAKTQITTLANGLKVASEASVNPAASIGLYVDCGSIYETPASYGATHLLERMAFKSTLNRSHLRIVREIEAIGGNVTASASREHMIYTYDALKTYVPQMVEMLADCVRNPAFLDWEVKEQLEKVKAEISEYSKNPQHLLLEAVHSAGYAGPYGNSLMATEATINRLNSTVLEEFVAENYTAPRMVLAASGVEHEEFLKVAEPLLSDLPKVATIEEPKPVYVGGDYRCQADAEMTHFALAFEVPGGWMSEKESMTLTVLQMLMGGGGSFSAGGPGKGMYSRLYLRVLNQYPQIHAFSAFSSIYNNTGLFGIQGTTSSDFGPQAVDVAVKELIAVANPSEVDQVQLNRAKQATKSAILMNLESRMVASEDIGRQLLTYGERNPVEHFLKAIDAVSAKDIASVVQKLISSPLTMASYGDVLSLPSYDAVSSRFRSK

SEQ ID NO: 76152 - protein, 439 aa, Oryza sativa Japonica Group
MNGAGGNHQQQQQQQQRLRQQQQQQALLMQQALQQQQQYQSGVLAAAAAAAMTQMEPISNGNLPPGFDPSTCRSVYVGNVHPNVTESLLIEVFQSSGLVERCKLIRKEKSSFGFVDYYDRRSAALAIMTLHGRHICGQAIKVNWAYASTQREDTSVMPESCGITKPDAPEVMVLSPSVINRHEQLRPFSISQMFTNFCPVGDEAETAITEMTGKWLGSRQIRCNWATKNNAEEKQETDNHNAVVLTNGSSSNPGMEASQDTGSKENPENNPDCTTVYVGNLGHEVNRDELHRHFYNLGVGAIEEVRVQQDKGFGFVRYSNHGEAALAIQMANGLVVRGKPIKCSWGNKPTPPGTSSKPLPPPLPSYQPVPMAGVPQGFSAADIVAYQRQLTLSQVAAGQIAGQHGLAGQVSAGLLAAGSQALYDGYPNQSSAQQLMYYN

SEQ ID NO: 76153 - protein, 333 aa, Pseudomonas syringae pv. syringae B728a
MTLRIAINGFGRIGRNVLRALYTQGYRQDLQVVAINDLGDSEMNAHLLRFDTVHGPFSGTVECDKDSLTVNGDRISVSAIRNPAELPWKAQDIDVVFECTGLFTSRDKAAAHLTAGARKVIISAPASGADATIVYGVNHDTLRQSHQIISSASCTTNCLAPVAQILHRELGIENGLMTTIHAYTNDQNLIDVYHTDPYRARSATQSMIPSKTGAAEAVGLVLPELAGKLTGMAVRVPVINVSLVDLTVTLKRETTADEVNALMKEASQHSKVLGYNSLPLVSHDFNHNPLSSIFDANHTKVSGKLLKVLSWYDNEWAFSNRMLDNCLALHNAQ

SEQ ID NO: 76154 - protein, 656 aa, Ustilago maydis 521
MQKRDARGMPTEDDPLLPSSVQHDSEGASTNPTSPSQEAGPSTPRTAMNASSSMVEATSASSSGSFVSSLIADNPIFSGGLGLMVFGGAVAMTRRGVKVAASTAQRRLLISLEIPSKDRAHPWFLHWMGAQAQAQSMRQRGLLGKQKKEGLVDFLGLRDRSAETLSASSSKDRAHDPLLIASSGSSVSPVRILSHELSVETNYTPHASASTPNAEAAERGKARFSLVPGPGTHWFRYRGVWMRLTRERDGKMVDLSTGAPWETVTLTTLFAYAHLFPQLLEEARQLALSSTEGKTVIYTSWGPEWRPFGQPRRTRELGSVVLGKGKKEAIVDDVKRFLSRDRWYAERGIPYRRGYLLHGAPGSGKSSFITALAGHLDFNICLLNLSERGLTDDKLNHLLSNAPDRSILLLEDVDAAFLGRQQAAEDGYQASVTFSGLLNALDGVASGESRIIFMTTNHIEKLDPALIRPGRVDMIAELGDAEREQVEELMVRFYRTTMREIRIKQAEISPNALEASKPLLAAAAGSTDHASVLESYKSLEAVSGLRAAVQEADDEVRQLAADFGGIVEEEAMARRAASGLGPDGRQADSAYGGPEQASYANAPILTQRVHRPAPSASGGVSMAELQGLFIRFPDDPRTAVEAFVSENASRRHANSA

SEQ ID NO: 76155 - protein, 289 aa, Escherichia coli K12
MSAKHPVIAVTGSSGAGTTTTSLAFRKIFAQLNLHAAEVEGDSFHRYTRPEMDMAIRKARDAGRHISYFGPEANDFGLLEQTFIEYGQSGKGKSRKYLHTYDEAVPWNQVPGTFTPWQPLPEPTDVLFYEGLHGGVVTPQHNVAQHVDLLVGVVPIVNLEWIQKLIRDTSERGHSREAVMDSVVRSMEDYINYITPQFSRTHLNFQRVPTVDTSNPFAAKGIPSLDESFVVIHFRNLEGIDFPWLLAMLQGSFISHINTLVVPGGKMGLAMELIMLPLVQRLMEGKKIE

SEQ ID NO: 76156 - protein, 634 aa, Brucella melitensis 16M
MSKRLDLITIGRSSVDLYGAQIGGLLEDMASFNKYVGGSPTNIATGTARLGLRSALITRVGDEHMGRFLLRELEREGVDTRGIVTDPERLTALVILGIRDQQHFPLIFYRENCADMALCEDDIDPDFIAEARCVLATGTHLSHPRTEAAVLKALRLARENGSRTALDIDYRPNLWGLSGHGDGENRFIESAAVTAKLQSTLHLFDLIVGTEEEFHIAGGSTDTLEALKAVRRVTKAALVCKRGPMGAVVFEGDIPDDLDKGQSGQGFPIEVFNVLGAGDGFMSGLLRGWLKGEDWPTSLKFANACGAFAVSRHGCTPAYPSWEELQFFLQRGIRNKALRKDAELEQVHWSTNRNGTWPHMRVFAFDHRIQLEEMAAEAGASTDKIGEFKQLCLDAALKVAGGAQGYGILCDGRLGRDALYRAAGTGLWIGRPAEWPGSRPLKLEPELGPDCGGLMEWPVEHVVKLLCFYHPDDPAEMRAGQEETVQRLFTAARRNRLEFLLEIIPSKAGPVDDMTTARVIERFYEIGVYPDWWKLEPLKTKAAWANACDAITRNDPHTRGIVVLGLDAPAEELEQSLGIAAGFDLVKGFAVGRTIFAEAARKWLSGTIDDAQAIAEMAARYQSLCDVWDKAHAY

SEQ ID NO: 76157 - protein, 238 aa, Gibberella zeae PH-1
MPLDTSTYSLALLRVDGRRWNELRRLHAQIRTQDAADGSSYLEMGHTKVMCVVTGPSEQQQRRGGQQAGRDMAAINVNVVVAGFSSVDRKKRGRNDKRIQEIETTIANALSSNLHTHLFPNSSISISLHVLSQDGSLLAALINATTLALIDAGIPMSDYIAACTAGSTSTYAAGDDNADPLLDLNNQEEQELPFLTVATHGDTDRVAVLVCESRVQVSRLEGQAVLGSSGERQGRRDG

SEQ ID NO: 76158 - protein, 279 aa, Prochlorococcus marinus str. MIT 9515
MKHFADLLLNKNNSRSNDQVPFIQRRRGIEIKSSREIKLMKKSSRIVATVLREINDLIEPGMSTKDLDDFAEKRIREMGAAPSFKGYHGFPSSICASINNEVVHGIPNKNVTIKDGDLVKIDTGAYLDGFHGDSCITICVGQVSDQAKKLSEVALEALFSGLSKIKSGNTLLDVAGAIEDVVRLNGFSVVEDYTGHGVGRNLHEEPSVFNFRTNDLPNIILREGMTLAVEPIVNQGSKFCKTLNDKWTVITKDGKLSAQWEHTIVVMKDGIEILTDREF

SEQ ID NO: 76159 - protein, 428 aa, Flavobacteria bacterium BBFL7
MALEMKVPSPGESITEVEIAEWLVATGDWVEKDQAIAEVDSDKATLELPAEASGIITLKAEEGDAVAVGAVVCLIDTEAANPNGGSQDVENAPSSMGGGDEGGNNGDVATEMKKNAPADKSANSEKAPQPAQAKETYASGTASPAAKKILDEKGVDAKSVSGTGRDGRITKDDAVNAKPSMGTPGAGSRGESRTKLSMLRRKVAERLVSVKNDTAMLTTFNEVDMKPIFDLRKEYKEDFKAKHGVGLGFMSFFTKAVTRALEMYPAVNSMIDGKEMVSFDYKDISIAVSGPKGLMVPVIRNAENLSFRGVEAEVKRLALRARDGNITVDEMTGGTFTITNGGVFGSMMSTPIINPPQSAILGMHNIIERPVVVDGNIVARPMMYLAVSYDHRIIDGKESVGFLVAIKEALEDPINILMDGDVKKALEM

SEQ ID NO: 76160 - protein, 522 aa, Schizosaccharomyces pombe 972h-
MSSTLTCYCPGDGSLLGEVKLFNKSDIDQSIILAEEAQKEWKSTSFAERRNFLKALKENIIRNQDKYAEIACKDTGKTLVDAAFGEILVTLEKINWTLANGEQSLRPTKRPNSLLTSYKGGYVKYEPLGVIAALVSWNYPLHNALGPIISALFAGNAIVVKGSELTAWSTHQYCEMVRSLLQSMGHSPELVQCITCLPDVADHLTSHSGIKHITFIGSQPIAKLVAASAAKQLTPLCLELGGKDPCILTDDHRLEEILSIVMRGVFQSAGQNCIGIERIIALDGVYDTIITKLYNRISTMRLGMYTQNDVDMGAMVSNNRFDHLESLIQDAVSKGARLVYGGHRFQHPKYPKGNYFLPTLLVDATNEMKIAQEECFAPIALVFRAKSPEHALEIANGTEFGLGASVFGRDKQLCQYFTDNLETGMVAVNDFGAFYLLQMPFGGCKKSGYGRFAGYEGLRGICNSKAIAYDRFSAIHTGIPPAVDYPIPDSQKAWQFVRGLMGTVYGAWISLVPNVYQLWRNS

SEQ ID NO: 76161 - protein, 340 aa, Gibberella zeae PH-1
MSSLPQTYKACVIEKANAPFTLKDVPLKHPSKGQILVKVLACGVCFSDVGVSEGHMGDVFPRVPGHEIIGDVVEVGEDVDNFKNGDRVGGPWHGGHDRTCRQCQRAQFQMCDHKEVNGVSRDGGFAEYVLLRSEAVVRVPKEIEPADAAPLLCAGVTVFNGIRKMHVEQGRIVAVQGLGGLGHLAVQYAYKMGYEVAVLSSTDDKADFAKKLGAHHYINTKTSDVGEELNKLGGASIIVQTAPNPKAISPLIQGLAPEGKLLNLAPVGGAEFDTVALVLKGASVVGWPSGHALDSEEALRFSLTHGVKCMVEKYPLEKVQDAVDSLKAGKPRFRNVLVME

SEQ ID NO: 76162 - protein, 459 aa, Streptococcus pyogenes M1 GAS
MSIKEQTDNNELENGMVRGLENRHVQLIAIAGTIGTGLFLGAGRSIALTGPSIIFVYMITGAFMFMMMRAIGEMLYYDPDQHTFINFISKYIGPGWGYFSGLSYWISLIFIGMAEITAVGAYVQFWFPSWPAWLIQLVFLVLLSSINLIAVRVFGETEFWFAMIKILAILALIATAIFMVLTGFETHTGHASLSNIFDHFSMFPNGKLKFFMAFQMVFFAYQAIEFVGITTSETANPRKVLPKAIQEIPTRIVIFYVGALVSIMAIVPWHQLPVDESPFVMVFKLIGIKWAAALINFVVLTSAASALNSTLYSTGRHLYQIANETPNALTNRLKINTLSRQGVPSRAIIASAVVVGISALINILPGVADAFSLITASSSGVYIAIYALTMIAHWKYRQSKDFMADGYLMPKYKVTTPLTLAFFAFVFISLFLQESTYIGAIGATIWIIIFGIYSNVKFK

SEQ ID NO: 76163 - protein, 355 aa, Zea mays
  misc_feature (237)..(237): Xaa can be any naturally occurring amino acid
MATPRKPIKLTLPSHETTIGKFLTHSGTFTDGDLRVNKDGLRIVSRREGGEAPPIEPLDSQLSLDDLDVIKVIGKGSSGNVQLVRHKFTGQFFALKVIQLNIDESIRKQIAKELKINLSTQCQYVVVFYQCFYFNGAISIVLEYMDGGSLADFLKTVKTIPEAYLAAICTQMLKGLIYLHNEKRVIHRDLKPSNILINHRGEVKISDFGVSAIISSSSSQRDTFIGTRNYMAPERIXKKHGSMSDIWSLGLVILECATGIFPFPPCESFYELLVAVVDQPPPSAPPDQFSPEFCAFISACLQKDANDRSSAQALLDHPFLSMYDDLHVDLASYFTTAGSPLATFKSVIGSITLLI

SEQ ID NO: 76164 - protein, 327 aa, Flavobacteria bacterium BBFL7
MNEISQLRTVFLEALNSRVTAQEPASLYDPVHYILQLGGKRLRPILTLMSAQMYGGKIDKAMDAAIAVEVFHNFTLLHDDIMDDADLRRGKETVHVKWDVNTGILSGDAMLIMAYQLFNSYDPETFYWLNQVFSKTALEVCEGQQYDVDFETRDDVTISEYINMIKLKTSVLVGCALQMGAIIAGVNKKEQQLIYDYGINIGLAFQLMDDYLDAFGDPATFGKEVGGDIRENKKTYLYLKSVEDQGCATELKEWFAMDYQEMNEEQIETKKETVKVFFEESGGALATQDAIKSYTDKALNIIEQLAISDDSKKQLTAFSLDLMSRVS

SEQ ID NO: 76165 - protein, 187 aa, Escherichia coli K12
MILLIDNYDSFTWNLYQYFCELGADVLVKRNDALTLADIDALKPQKIVISPGPCTPDEAGISLDVIRHYAGRLPILGVCLGHQAMAQAFGGKVVRAAKVMHGKTSPITHNGEGVFRGLANPLTVTRYHSLVVEPDSLPACFDVTAWSETREIMGIRHRQWDLEGVQFHPESILSEQGHQLLANFLHR

SEQ ID NO: 76166 - protein, 324 aa, Manihot esculenta
MEFPVINLEKLNGEERAATMAKIKDACENWGFFELLNHGIEPEFLDRVESMTKGHYRKCMEQRFKEMVANKGLDAVQTEIKDMDWESTFFIRHLPDSNLAQLPDLDDEHRAVMKEFAAKLEKLAEDLLDLLCENLGLEKGYLKKAFYGSRGPTFGTKVSNYPPCPKPDLIKGLRAHTDAGGIILLFQDDRVSGLQLLKDGQWIDVPPMRHSIVVNLGDQLEVITNGKYKSVEHRVVAQTDGTRMSLASFYNPGSDAVIYPAPALVEKEAEEKKQVYPKFVFEDYMKLYVGLKFQAKEPRFEAMKAVENNVNLGPNCYCLIINYY

SEQ ID NO: 76167 - protein, 528 aa, Crocosphaera watsonii WH 8501
MDKQQLWQRYQDWLYYHEGLGVYVDVSRMRFDHGLVTQLTPKFEKAFADMETLESGAIANPDEGRMVGHYWLRAPELAPNDDVRKEITEPLANIGEFVQKVHAGTIKPPTADKFTHVLSVGIGGSALGPQFVAEALSDVDPPMVIHFIDNNDPAGIDRVIEQIGDHLKNTLVLITSKSGGTPETRNGMLEVKNAYESKGLAFEPNAVAVTMPGSKMDKVAVDDKWLARFPMQDWVGGRTSELSAVGLLPAALQGINIDEMLVGAKEMDEATRVKDLKTNPAALLALAWYHSGNGKGEKDMVVLPYKDSLLLFSRYLQQLVMESLGKEKDLDGNTVYQGIAVYGNKGSTDQHAYVQQLREGVPNFFATFIEVLEDGRDTLFEIEPGVTSGDFLSGFLQGTRQALFENNRDSITITIPQVNPRIVGALIALYERTVSFYASLVNINAYHQPGVEAGKKMAASILDLQTKVQTVIKETSEVLDMATLAEKAGSPDEVESVYKIVRHLAANGRGVSLEGELTDLKTLKVSAS

SEQ ID NO: 76168 - protein, 211 aa, Xylella fastidiosa Temecula1
MIELIYVQLNRHAVALSDSHHNRCHMIRKNPRGDLPDVHESAFVDPTAILCGCVIVEAGVFIGPYAVIRADETTAEGDINPIRIGIGANIQDGVVIHSKSGAAVTIGARTSIAHRAIVHGPCTIGERVFIGFNSVLFNCVVGDGCVVRHNAVVDGCDLPPGFYVPSTERIGPSTDLGTIPRVTVAASEFSEDVAQTNNRLVEGYRRLRNEL

SEQ ID NO: 76169 - protein, 156 aa, Pediococcus pentosaceus ATCC 25745
MTEYLGTFNGSKLKIAIIVARFNDLVTKRLLDGAFQTLAQNGVSKEDIDIYWVPGAFEIPRVAQKISQKGNVDGIITLGAVVRGETSHYESVCSGVTSGIAQIALEGKVPVMFGVLMTENMEQALNRAGGKAGNKGSECATGLLEMIDIEQTIDRE

SEQ ID NO: 76170 - protein, 404 aa, Pediococcus pentosaceus ATCC 25745
MKNRIIEKIENALQTLKNGGLIIITDDENRESEGDMVGLAEYVTPKAVNTMVTNARGLLCVPMSAEIAQKLGLSPMVTNAEDAFGTAFTISTDAKTTKTGISAFDRAKTIQKLADPQAKFSEFYHPGHVFPLIAEEGGVLARGGHTEAAVDLAKLAGVRPVAYITEVLKKDGTMARRNTLKSLAEGMQMPLLTIEEIKIYRYMKDAGIVKSVAKVHLPTKYGEFEMEAFDTGAGQEPTLLLTKGSLSEVQPLLLRIHSECLTGDIFGSKRCDCGEQLERSLKEIQSRGRGALLYLRQEGRGIGLANKLKAYELQEQGMDTVEANLKLGFQADERHYGVAAAILRKKGITKVNLLTNNPDKIKQLETLGIKVEERVTIQIPARPENRSYLKVKKEKMHHLLKGMD

SEQ ID NO: 76171 - protein, 356 aa, Vitis vinifera
MALESESQKKSYGVFGDVYGVMMVPKELEIEKDASIDQFRFQLPDLKQAFQDFMRTREVGEFISGALAGAMTKAVLAPLETIRTRMVVGIGSKNISGSFLEVIEQQGWQGLWAGNTINMLRIIPTQAIELATFECVKRSMTEAQEKWSKKECPKLQIGPVSLNLSISWISPIAVAGAAAGIVSTLACHPLEVLKDRLTVSPDIYPSISVALSKIHNDGGIGAFYAGISPTLIGMLPYSTCYYFMYETMKKSYCTAKKKTSLSRPEMLLIGALSGFTASTISFPLEVARKRLMVGALQGKCPPHMAAALSEVIREQGIMGLYRGWGASCLKVMPSSGITWMFYEAWKDILLAERRHL

SEQ ID NO: 76172 - protein, 1501 aa, Candida albicans
MSDSKMSSQDESKLEKAISQDSSSENHSINEYHGFDAHTSENIQNLARTFTHDSFKDDSSAGLLKYLTHMSEVPGVNPYEHEEINNDQLNPDSENFNAKFWVKNLRKLFESDPEYYKPSKLGIGYRNLRAYGVANDSDYQPTVTNALWKLATEGFRHFQKDDDSRYFDILKSMDAIMRPGELTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSAVILDTTPLIAIYQCSQDAYDLFDKVVVLYEGYQIFFGKATKAKEYFKKMGWKCPQRQTTADFLTSLTNPAEREPLPGYEDKVPRTAQEFETYWKNSPEYAELTKEIDEYFVECERSNTRETYRESHVAKQSNNTRPASPYTVSFFMQVRYGVARNFLRMKGDPSIPIFSVFGQLVMGLILSSVFYNLSQTTGSFYYRGAAMFFAVLFNAFSSLLEIMSLFEARPIVEKHKKYALYRPSADALASIISELPVKLAMSMSFNFVFYFMVNFRRNPGRFFFYWLMCIWCTFVMSHLFRSIGAVSTSISGAMTPATVLLLAMVIYTGFVIPTPSMLGWSRWINYINPVGYVFESLMVNEFHGREFQCAQYVPSGPGYENISRSNQVCTAVGSVPGNEMVSGTNYLAGAYQYYNSHKWRNLGITIGFAVFFLAIYIALTEFNKGAMQKGEIVLFLKGSLKKHKRKTAASNKGDIEAGPVAGKLDYQDEAEAVNNEKFTEKGSTGSVDFPENREIFFWRDLTYQVKIKKEDRVILDHVDGWVKPGQITALMGASGAGKTTLLNCLSERVTTGIITDGERLVNGHALDSSFQRSIGYVQQQDVHLPTSTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDRLLFLQKGGRTAYFGELGENCQTMINYFEKYGADPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKIFLVVSAALFNGFSFFKAKNNMQGLQNQMFSVFMFFIPFNTLVQQMLPYFVKQRDVYEVREAPSRTFSWFAFIAGQITSEIPYQVAVGTIAFFCWYYPLGLYNNATPTDSVNPRGVLMWMLVTAFYVYTATMGQLCMSFSELADNAANLATLLFTMCLNFCGVLAGPDVLPGFWIFMYRCNPFTYLVQAMLSTGLANTFVKCAEREYVSVKPPNGESCSTYLDPYIKFAGGYFETRNDGSCAFCQMSSTNTFLKSVNSLYSERWRNFGIFIAFIAINIILTVIFYWLARVPKGNREKKNKK

SEQ ID NO: 76173 - protein, 159 aa, Aeluropus littoralis
MAQESWKQESHAPEAPILCINNCGFFGSSMTNNMCSKCYRDFVKLMEMDAPVVDKKLITTASSSTVPFETAKQDDTVPDAAAMDDKQPAQEPPKPPSNRCSTCRKKVGLTGFQCRCGGTFCSLHRYTDSHECTFDYKKVAREQIAKQNPVVIAEKINKI

SEQ ID NO: 76174 - protein, 291 aa, marine gamma proteobacterium HTCC2143
MTEAQIGEIVTNIATTGLMLIMFSMGIMLRVRDFLNVVKTPLASLLGLIGQILLLPIIAFGICYLMELPSLLAIGLMVLSACPGGPTSNAISMIAGGDTALSITLTALSGIVAFITVPLVMSFSLTYFQMAGMQLELPFIETAMRIFFTTVVPVCLGMYLSGKFSNLKNYRQTIFRFGFGLVITTSLLLLVARSELLGSAQAMFAALALNVSMMGLAYLLGSLLLKQETQVRTITVEVGLQNVSLAIVVILTMLEIPEMFTPTLFYLPIAYVTGFGFAYLMRKRDQQPVEA

SEQ ID NO: 76175 - protein, 69 aa, Glycine max
  misc_feature (44)..(44): Xaa can be any naturally occurring amino acid
CRNATSAVPAGASMVAPFTGLKYIAVLPTRNTILDFAYIASNGXRAQCMHVWPPIGKKKVETLSYLPDL

SEQ ID NO: 76176 - protein, 1501 aa, Candida albicans
MSDSKMSSQDESKLEKAISQDSSSENHSINEYHGFDAHTSENIQNLARTFTHDSFKDDSSAGLLKYLTHMSEVPGVNPYEHEEINNDQLNPDSENFNAKFWVKNLRKLFESDPEYYKPSKLGIGYRNLRAYGVANDSDYQPTVTNALWKLATEGFRHFQKDDDSRYFDILKSMDAIMRPGELTVVLGRPGAGCSTLLKTIAVNTYGFHIGKESEITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSAVILDTTPLIAIYQCSQDAYDLFDKVVVLYEGYQIFFGKATKAKEYFEKMGWKCPQRQTTADFLTSLTNPAEREPLPGFEDKVPRTAQEFETYWKNSPEYAELTKEIDEYFVECERSNTRETYRESHVAKQSNNTRPASPYTVSFFMQVRYGVARNFLRMKGDPSIPIFSVFGQLVMGLILSSVFYNLSQTTGSFYYRGAAMFFAVLFNAFSSLLEIMSLFEARPIVEKHKKYALYRPSADALASIISELPVKLAMSMSFNFVFYFMVNFRRNPGRFFFYWLMCIWCTFVMSHLFRSIGAVSTSISGAMTPATVLLLAMVIYTGFVIPTPSMLGWSRWINYINPVGYVFESLMVNEFHGREFQCAQYVPSGPGYENISRSNQVCTAVGSVPGNEMVSGTNYLAGAYQYYNSHKWRNLGITIGFAVFFLAIYIALTEFNKGAMQKGEIVLFLKGSLKKHKRKTAASNKGDIEAGPVAGKLDYQDEAEAVNNEKFSEKGSTGSVDFPENREIFFWRDLTYQVKIKKEDRVILDHVDGWVKPGQITALMGASGAGKTTLLNCLSERVTTGVITDGERLVNGHALDSSFQRSIGYVQQQDVHLPTSTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDRLLFLQKGGRTAYFGELGENCQTMINYFEKYGADPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKIFLVVSAALFNGFSFFKAKNNMQGLQNQMFSVFMFFIPFNTLVQQMLPYFVKQRDVYEVREAPSRTFSWFAFIAGQITSEIPYQVAVGTIAFFCWYYPLGLYNNATPTDSVNPRGVLMWMLVTAFYVYTATMGQLCMSFSELADNAANLATLLFTMCLNFCGVLAGPDVLPGFWIFMYRCNPFTYLVQAMLSTGLANTFVKCAEREYVSVKPPNGASCSTYLDPYIKFAGGYFETRNDGSCAFCQMSSTNTFLKSVNSLYSERWRNFGIFIAFIAINIILTVIFYWLARVPKGNREKKNKK

SEQ ID NO: 76177 - protein, 624 aa, Cryptococcus neoformans var. neoformans JEC21
MRGLAKLFFLSCSFVSLVSSEKTDESPTAVSDNYMPKATATIDPSVFALSNDFEITDVPTTREYTFDIANAFASPDGYEREVYVVNNMFPGPVIEANTGDTIIVHVNNHLDEGQSLHWHGLRQLGTAFMDGVPGITQCPIPPGGSFTYNFTVSHQSGTYWWHSHYSNSMADGIWGPLIVHSPNEPLQRGRDYDEDRIVFITDWMHDNSEIIIAALATPEGYKGNIAPPQGDAILINGRGQTNCTATGSSSCFYPPPPEIQVPVNCRVRLRFISATAHPMYRISIDNHPMEVVEADGTAVYGPTVHEISIAPGERYSAIINTNEGKEGDAFWLRTSVALSCMFGAVSQEGLAVVRYTGNGIVSTEEPQTSAWSDLAGVTVPCTGLDQTYTLSPRDSLSAPREPLQSHFFNSERGAFVNVLGNTFQGYGFNNISYQNQIFNPLLSIVQRGGSCENTLVSSRTFPDFGPGNIIINNLDTVIDHPYHLHGNEFQVIGRGTGALSIDNLTNIDFTLDNPVRKDTLWIQGGSWAVLRITADNPGVWALHCHIGWHLTEGKLAVIVVQPSAIGHMESPESWTNLCANTDPNAFGPAKRSSSPSIQSSKTSSFQYLREVKGKVVKRRGAREA

SEQ ID NO: 76178 - protein, 1501 aa, Candida albicans
MSDSKMSSQDESKLEKAISQDSSSENHSINEYHGFDAHTSENIQNLARTFTHDSFKDDSSAGLLKYLTHMSEVPGVNPYEHEEINNDQLNPDSENFNAKFWVKNLRKLFESDPEYYKPSKLGIGYRNLRAYGVANDSDYQPTVTNALWKLATEGFRHFQKDDDSRYFDILKSMDAIMRPGELTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSAVILDTTPLIAIYQCSQDAYDLFDKVVVLYEGYQIFFGKATKAKEYFEKMGWKCPQRQTTADFLTSLTNPAEREPLPGYEDKVPRTAQEFETYWKNSPEYAELTKEIDEYFVECERSNTRETYRESHVAKQSNNTRPASPYTVSFFMQVRYGVARNFLRMKGDPSIPIFSVFGQLVMGLILSSVFYNLSQTTGSFYYRGAAMFFAVLFNAFSSLLEIMSLFEARPIVEKHKKYALYRPSADALASIISELPVKLAMSMSFNFVFYFMVNFRRNPGRFFFYWLMCIWCTFVMSHLFRSIGAVSTSISGAMTPATVLLLAMVIYTGFVIPTPSMLGWSRWINYINPVGYVFESLMVNEFHGREFQCAQYVPSGPGYENISRSNQVCTAVGSVPGNEMVSGTNYLAGAYQYYNSHKWRNLGITIGFAVFFLAIYIALTEFNKGAMQKGEIVLFLKGSLKKHKRKTAASNKGDIEAGPVAGKLDYQDEAEAVNNEKFSEKGSTGSVDFPENREIFFWRDLTYQVKIKKEDRVILDHVDGWVKPGQITALMGASGAGKTTLLNCLSERVTTGVITDGERLVNGHALDSSFQRSIGYVQQQDVHLPTSTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDRLLFLQKGGRTAYFGELGENCQTMINYFEKYGADPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKIFLVVSAALFNGFSFFKAKNNMQGLQNQMFSVFMFFIPFNTLVQQMLPYFVKQRDVYEVREAPSRTFSWFAFIAGQITSEIPYQVAVGTIAFFCWYYPLGLYNNATPTDSVNPRGVLMWMLVTAFYVYTATMGQLCMSFSELADNAANLATLLFTMCLNFCGVLAGPDVLPGFWIFMYRCNPFTYLVQAMLSTGLANTFVKCAEREYVSVKPPNGESCSTYLDPYIKFAGGYFETRNDGSCAFCQMSSTNTFLKSVNSLYSERWRNFGIFIAFIAINIILTVIFYWLARVPKGNREKKNKK

SEQ ID NO: 76179 - protein, 285 aa, Saccharomyces cerevisiae
NVTTGEMMAVKQVEVPKYSSQNEAILSTVEALRSEVSTLKDLDHLNIVQYLGFENKNNIYSLFLEYVAGGSVGSLIRMYGRFDEPLIKHLTTQVLKGLAYLHSKGILHRDMKADNLLLDQDGICKISDFGISRKSKDIYSNSDMTMRGTVFWMAPEMVDTKQGYSAKVDIWSLGCIVLEMFAGKRPWSNLEVVAAMFKIGKSKSAPPIPEDTLPLISQIGRNFLDACFEINPEKRPTANELLSHPFSEVNETFNFKSTRLAKFIKSNDKLNSSKLRITSQENKTE

SEQ ID NO: 76180 - protein, 172 aa, Brassica napus
MSTMKPSRSDEIADPDQQIKNTNQIRAGFDSLAPKRPTKPTRSEPGPFGCFSTPEPTTDHPEADKFQTLQSQTHGDILHEGVSAAVQDEFLETEYYTSLTAIDKQHHTTGSGFINVGKEDGGEEAVIAAAAIGDGGEKAVYRSNPATNEWIPAVEEDLGSESSSKPNRSENS

SEQ ID NO: 76181 - protein, 325 aa, Rhizobium leguminosarum bv. viciae 3841
MTSVLAPDQLGPTVCVGEILVEIVATTVGDGFLEAQPLVGPFASGAPAIFISQCGRLGGKAAMVGAVGDDDFGRVNTDRLKRDGVDVSTISIDPDYPTGSAFVRYRKDGSRDFVYNIATSAAARFGWSQTVGDLINRSGHLHVMGSALSVPSARAVIDKAVGIVKARGGTLSVDPNIRKELKLDKDTERRFSKLVAAADLLLPSGEELERAAGVEGKAEAIRRLFEVGVKEIVLKRGAEGATYFGRDGDRIDAPAFVVQEVDPTGAGDCFGGAYLTCRRLGMSPQQALTYGSAAGARNVTVLGPMEGAGTQQELDAFIASTERRP

SEQ ID NO: 76182 - protein, 895 aa, Arabidopsis thaliana
MELRATVENRIRYSTKHIKHLPPGSITEFDWKDYCPVGFGLIQELEGIDHDDYLLSICTDETLKKISSGKIGNVFHISNDNRFLIKILRKSEIKVTLEMLPRYYRHINYHRSSLFTRIFGAHSVKPLGGVKTYFAVMSNMLHSTIFVNKLYDLKGSPKGRSNKKIEVRNTTVLKDIDFDFCFYVDPLARQRIIKQTKLDCELLEEEGIMDYSLLVGLQSKGSCQGSLDGLNPVYGSFAPPSSFKSNSTKSMKTASSSPDRSSVAMYSCSPDRDSVENEMSMTIQSVTSNSASSETNILATTLSDLFHNSSNINFGMKIPARARRVTRETGEEEWFKMKKKQQKQEFVAETSEMNNNNECSGQDQQKRYVWPWVGLVANVPTEVEPSGRRVGKSGSTLRDEFTLKGFNPTRVKPIWNTKGHTGFALVEFAKDFKGFESAMQFEKSFDLDRHGKRDWKKGHRLRDDKLYGWLAREDDYNRSDTVGKNVKKKRDLKSISQIVEEDQRKLYHLFENMCQTIEKNKQRKQQLEQKVDETLESLEFHNLMLNNSYQEEIQKMEKNMQEFYQQVLGGHEKSFAELEAKREKLDERARLIEQRAIKNEEEMEKTRLEREMIQKAMCEQNEANEEAMKLAEKHQASTSLKEKEKLHKRIMEMEAKLNETQELELEIEKLKGTTNVMKHMVGCDGDKDIVEKIAKTQIELDARETALHEKMMTLARKERATNDEYQDARKEMIKVWKANEELMKQEKIRVKIMGELNPAPFLPAVMNKHKAMMLCSVWAAEIGDVQWTPFRVDESDGTPKQKLHISQHSKCEMQRVVDENDEKLRMLKNQYGEEVYSEVVRAKLEMEEHNASGSYETEELWNYEENRKATIEEITDVMLKIRSKLAAMKNKRKRP

SEQ ID NO: 76183 - protein, 216 aa, Clavispora lusitaniae
MANEVSKNVILLPQTNQLIGLYSIIRDKSTKRSDFVFYSDRIIRLLVEEGLNQLPVEKAVIKCHGSYEYTGARFLGKICGVSIVRAGESMEQGLRDCCRSVRIGKILIQRDEETAMPKLFYEKLPEDISERYVFLLDPMLATGGSAMMAVEVLLSRGVKMDRIFFLNLLAAPEGIEAFQAKYPDVKIITGGIDKCLDEHKYIVPGLGDFGDRYYCI

SEQ ID NO: 76184 - protein, 279 aa, Mesorhizobium loti MAFF303099
MDLKDKTILITGSTDGVGRVVAQRLGADGARVLVHGRDAARGKAAVAEIEAAGGRAEFFAADLASLAEIRHLAEAVRARTNRLDILINNAGIGTAAAKRQVSADGYELRFAVNYLAGFLLTSELLPLLKASAPARIVNVASAGQQAIDFGDVMLTHGYSGVRAYCQSKLAQILFTVDLAEQLKGTGVTVNALHPASYMNTTMVRQAGVTPWSSVETGAEAIVNLAASPALEGRSGLYFDGLREARADAQAYDATARQQLRSLSRDLVGAASSKSRERHS

SEQ ID NO: 76185 - protein, 257 aa, Treponema denticola ATCC 35405
MERLIFIFNITQIVLFGVGLICFVVLFFVPAGYGKMINKKWGFSFNNKIAWFLMEVPTLITMIVLMCVWAKPENFVRIIIGLFFVLHYAQRVFIFPFLLKGKSKMPILIVLMGITFNTINAFLIGAWLFYLSPKTMYPISWLYDPRFIIGALVFLLGMAINIDSDKYIRSLRKPGDTAHYFPHKRMYKYVSSANYFGEILEWFGFALLSWSFVGLLFAFWTCANLVPRAYTINKRYREEFPEEFAALKPKRVFPFIF

SEQ ID NO: 76186 - protein, 847 aa, Oryza sativa
MEFLDVSLVEVDKWAKAHIDLVVGLQSRFARLELSNGLRLRLLRFSFPSPSSSPLRWVRVGNLVPLNEGNASSSNGSVSSIPIYLGANVVGRNHLVVVDKRVSRKHLSLHASADGSIEAVVEGPNPIIVRSEGQRRKVCAQERVKIAHDDVLELIPGEYFVKYLNVGDNHKSSTSMGSSDFKKGKRLCEDDTVVIKRNRQIMEDEALARSLQKSFAEESSTISGLGCDQMLSSLDSAGFSERNNERIHSVDYLKDVLSLTFRLMRVQGLPSWTNTSSVTIQDVIQGEVLLAVLSNYMVDMEWLLTACPSLRKVRHVLVIHGEDGASVELLKKVKPANWILHKPPLPISFGTHHSKAMLLVYPQGIRVVVHTANLIHVDWNNKTQGLWMQDFPWKDAKDVNRSVSFENDLVDYLSAIKREILELLATCCKLIWPEFRVNLPVVGDVNINAAFFRKFDYKSSSVRLIGSVPGYHVGPNIKKWGHMKLRSVLEGCTFEQQFCKAPMIYQFSSLGSLDEKWMSEFAFSLSAGKSDNGSPLGIGKPLIVWPTVEDVRTSIEGYAAGSCIPSPQKNVEKDFLRKYWARWKADHVGRCAPDQTGLGPVRPQRLDHHKGAGQIGFQDLEPEATARIELYGLTAHKASLGVLFLPKTHQSVPQFSCTGKNNSNLFLTQNNLAPGKEIKTKLVTLCWKSDEEKEQSTEIIRLPVPYQLPPKPYGTEDVPWSWDKRYTKKDVYGSVWPRHVQYCFFTLCLTQAIFSLAITNNRGENETPDMKTESNIIETENGAKTNRREYVLGVACHFHQQSFMSDLDIQIPTAFGMHVVLFPLCDGLSAWNICAHHVFLNMYRSLC

SEQ ID NO: 76187 - protein, 184 aa, Brucella melitensis 16M
MLGIGDKLPPFKVTGVKPGFNHHEENGVSAFEEVTEQSFPGKWKVIFFYPKDFTFVCPTEIAEFARLASEFEDRDAVVLGGSTDNEFVKLAWRRDHKDLNKLPIWSFADTNGSLVDGLGVRSPDGGAYRYTFVVDPDNVIQHVYATNLNVGRAPKDTLRVLDALQTDELCPCNREVGGETLKAA

SEQ ID NO: 76188 - protein, 451 aa, Mesorhizobium loti MAFF303099
MPEGQFKEGIVGGRLAAEQYADNFSDLHPPLDHHEGLVESDRCYFCYDAPCMNACPTSIDIPLFIRQISTGNPIGSAKTIFDQNILGGMCARVCPTETLCEEVCVREVAEGKPVQIGRLQRYATDVAMAENKQFYPRAEPTGKTVAVVGAGPAGLAAAHRLARHGHDVTILEARPKAGGLNEYGIAAYKSVDNFAQAEVEYVTAIGGIDIQNGKALGRDYQLSDLIRNYDAVFLGMGLGGVNALRADGEDAEGVTNAVEFIAELRQASDLSGLPVGRRVVVIGGGMTAIDAAVQSKLLGAEEVTICYRRGQEHMNASGFEQDLAAANGVTIRHWLQPKRVIAEAGQVSGIELEYTALKGDKLAGTGETLTLVADQVFKAIGQSFVPAALNGSEASIELEAGRIKVDGEGRTSLAKVWAGGDCIFGGDDLTVSAVAQGRDAAESIHRSLTQG

SEQ ID NO: 76189 - protein, 576 aa, Oryza sativa
  misc_feature (20)..(20): Xaa can be any naturally occurring amino acid
WEDHSSARLKNSFVFSSGYXTNMELTSSSAMWLAMAILAITAALTKIALGGGRRRCLSESSDLTCKTPPPPPVVNCIALLGLLPALFRGDVPATMQQLYAKFGSVFTVSVAGLLKATFLVGPEVSAHFFQGLESEVSHGDLFEFTVPMFGKEVGHGVDNATRIEQGRFFAEALKPVRLRIHVDPMVQEVEDYFAKWGQHGTVDLKHELEQLLLLISGRCLLGKEVMGTKFDEVCNLFRDIEGGVNLMSVFFPYTPLIPSNRRRDMARERLHAIFSDIVRSRKQQQGDQEEVNDKDVLQSFIDSRYKADGRATTEAEVAGLITGVLFAAKHTSTHTSVWTGARLLTHEKFLAAAVDEQDQIVRKHGIINGRIVTDHYGFLMEMHMLHICIKETLRLHPPAPMIVRTALRQFTVRTREGHEYCVPAGHTMASPIVISNRVPYIYKDAHLYDPDRFGPRREEDKVGGKFSYTSFGGGRNSCVGENYAYMQIKAIWSHLLRNFELKLLSPFPKTDWSKLVPEPQGKVMEKKRKYNSEELARYTLLKEGNGGGSESARLPHHQVYVIFSYHLILMYFYITR

SEQ ID NO: 76190 - protein, 268 aa, Prochlorococcus marinus str. MIT 9515
MSTSFKNVTPTGPGGTATLLIVLSFTGFLLLTQSLFVVPSGQVAVVTTLGKVSGGSRRAGLNFKVPFVQSVFPFDIKTQVQPEKFETLTKDLQVIRATATVKYSVKPNEAGRIFATIASRNSDVYQKIVQPSLLKALKSVFSQYELETIATEFNVISERVADTVAEELNSFDYVDVKSLDLTGLEIAEEYRAAIEQKQIAGQLLLRAKTEVEIAEQEALRYETLNKGLNDQVLFKLFLDKWDGSTQVVPGLPGTNGGTPPVIVGGNNR

SEQ ID NO: 76191 - protein, 233 aa, Zea mays
MHACMPASLLCFGLVLLDRHCNPSSEREREIERERELVCMGCVSSKESRRRPPGYEDPNTLARETTFSVNEVEALYELYKRISYSITKDGLIHKEEFQLALFRNSNKRNLFADRIFDLFDLKRNGVIEFGEFVRSLDVFHPATPVEEKIAFAFRLYDLRGTGFIGREELKEMVLAILNESELLLSDDAVEEIVDQTFRQADMNGDGKIDPDEWKVFASKNPALLKNMTLPYLK

SEQ ID NO: 76192 - protein, 202 aa, Cryptococcus neoformans var. neoformans B-3501A
MSNLEKSLFQLKFTAKSLQRQAKKATKDEAAEKNKLKQALAKGNTDGARIYAQNAIRKKNEGLNLLRLSSRIDAVASRVETAVTMRSVTNSMGSVVKGMDKAMESMNLERISLVMDKFESQFADMDVQTSYMESTMSDTTAMATPQDQVDSLMLQVADEAGLEIQHGLGEAKVPAKEPTLGEASKEEDSNLAERLRALRPAT

SEQ ID NO: 76193 - protein, 342 aa, Kluyveromyces lactis NRRL Y-1140
MSDVPPPPAVEEETYEKPYEKPYEKPYETAPPPQSYENFNNRVDDDEELSDTRLFVKPFPPDVTDAEMKEIFEPFGALKEIKILNGFAFVEFEEAESASQAIQNVAGKMFADYPLEVVFSKKLKPRFRVIIRNLPEGCAWQELKDLARDNQLETTFSSVNTRDFDGTGALEFPTEEILQEAIEKLNNIEFRGSVLAVEKDENPPPIRSSRGRGGFRGRGGFGRGGFGGRGGFGGRGGFGGRGGFGGPRGGFGGRGGFGGRGGFGGPRGGFGGRGGFGGPRGGFRGGRGGYGGPRGGYGDFGGRGGGYGGRGGYGNRDYAPREDYQRGSGEGYQARERSPVRD

SEQ ID NO: 76194 - protein, 287 aa, Glycine max
MAKDVEQVTEQGEYSAKDYHDPPPAPLIDPDELTKWSLYRAAIAEFIATLLFLYITVLTIIGYKRQSDTKIPGNTECDGVGILGIAWAFGGMIFILVYCTAGISGGHINPAVTFGLFLGRKVSLVRALLYMIAQCAGAICGAGLAKGFQKSFYNRYGGGVNTVSDGYNKGTALGAEIIGTFVLVYTVFSATDPKRNARDSHVPVLAPLPIGFAVFMAHLATIPVTGTGINPARSFGPAVIFNNDKAWDDQWIYWVGPFVGAAVAAIYHQYILRGSAIKALGSFRSNA

SEQ ID NO: 76195 - protein, 204 aa, Schizosaccharomyces pombe 972h-
MLASIEEAVNDFRDGKFLIVLDDETRENEGDLIIAGCKVTTEQMAFLVRHSSGYVCVPMTGERLDSLEIPMMVDNNEDRMRTAYAVTLDYANGTTTGISAHDRALTTRQLANPEVTSPREFNRPGHIVPLRARDGGVLERDGHTEAAVDLCKLAGLPPVGAICELVREEDGLMSRFDDCISFGKKWGIKVITIESLKSYIKGRM

SEQ ID NO: 76196 - protein, 408 aa, Erwinia carotovora subsp. atroseptica SCRI1043
MSSVDILVPDLPESVADATVATWHKKPGDSVQRDEVLVEIETDKVVLEVPASEAGILDAVLEEEGATVMSRQLLGRIRRGDSSGKETGEKSQSKESTPAQRHTAGLEEEHSDALSPAIRRLIAEHNLDASAIKGSGVGGRITREDVDKHLAAQKKDSAKAAKPEAPAASPAPALGARSEKRVPMTRLRKRVAERLLEAKNSTAMLTTFNEINMQPIMDLRKQYGEAFEKRHGVRLGFMSFYIKAVVEALKRYPEVNASIDGEDVVYHNYFDVSIAVSTPRGLVTPVLRDVDALGMADIEKRIKELAVKGRDGKLTVEELLGGNFTITNGGVFGSLMSTPIINPPQSAILGMHAIKDRPMAVDGQVVILPMMYLALSYDHRLVDGRESVGFLVTVKEMLEDPARLLLDV

SEQ ID NO: 76197 - protein, 388 aa, Erwinia carotovora subsp. atroseptica SCRI1043
MNLHEYQAKQLFARYGLPAPTGYACTTPREAEEAASKIGSGPWVVKCQVHAGGRGKAGGVKVVSNKEDIRAFAENWLGKKLVTYQTDAQGQPVHQILVEAATDIDKELYLGAVVDRGTRRVVFMASTEGGVEIEKVAEETPELIHKAAIDPLVGPQPYQGRELAFKLGLSGKQVAQFTKIFMGLATLFLERDLALVEINPLVITKQGDLICLDGKLGADGNALFRQPELREMRDPSQEDSREAHAAQWELNYVALDGNIGCMVNGAGLAMGTMDIVKLHGGSPANFLDVGGGATKERVTEAFKIILSDDKVKAVFVNIFGGIVRCDLIADGIIGAVAEVGVSVPVVVRLEGNNAELGAKKLADSGLNIIAATSLTGAAQQVVAAAGDK

SEQ ID NO: 76198 - protein, 357 aa, Prochlorococcus marinus subsp. marinus str. CCMP1375
MTNSQFPNDLGETVPSERLWLRSELMGTQVITRDTGRRLGVVGEVVVDIDRREVIALGLRDNPLTRFLPGLPKWMLLERIRQVGDVILVDSIDSLSEEFTPDRYSKVINCQVITESGEQLGRVLGFSFDIETGELISLVMGALGVPLLGEGVLSTWEIPVNEIVSSGADRIIVYEGAEEKLKQLNSGLLEKIGVGGGAWDERERERYRVNLVPVENQLTSGEEIEQFQKTLEPSSDVAFNEEEEELEYVEVEERNQFDDSQSRYLEDIPLSRPSNLGEPLKEEYDEQLSNEENYIPQQTLESKSENNRRNRSVNRKAISNLDDPLDVEPIKIDRPINDHLEDKNDEKMQSSEIEDPW

SEQ ID NO: 76199 - protein, 268 aa, Zea mays
MAATFRPGQEPPTSSSASAWLRWQAAARLDAVTRREMAPHDTDRDGAVTLRECFAGECVRPCVRNISLSRAHDDGYIYEDWINMGHDKMGWWMHKCASADRDGDGSLNAVEFNDFLHPEDSSQESVMLWLLKDKLSEMDHDGDGRLSLEEFLAQSHIIISGARHADDGGHAHDLERAEAAKKFTELDADKDNYLTVEEARCVLQSLVTGEFSYATSHAKFLMKADVNHDGKLSLEEMLDDYISFYSTVYMDDHYASEGEVDSDSRDEL

SEQ ID NO: 76200 - protein, 313 aa, Rhodobacter sphaeroides 2.4.1
MTPPRRIIIDTDPGQDDAVAILLALASPELEVLGITAVAGNVPLRLTERNARILCEIAGRTDIPVFAGCDAPLARPLVTAEHVHGKTGLDGPALPDPTLPLQERHAVDYLIETLRSEPAGSITLCPLGPLTNIAAMLQRAPDVAPRIREIVLMGGAYFEVGNITPTAEFNIFVDPEAAAIVFGAGVPLVVMPLDVTHKAVTDRARVARFREMGTRIGELVEEWMDFFERFDREKYGSEGAPLHDPCVIAYLLNPDLFLGRHINVEIETEGRFTTGMTVADWWRVSDRTPNALFMRDLDADGFFALLTERIARL

SEQ ID NO: 76201 - protein, 327 aa, Zea mays
MASPSPSSPLHPHQHPPPPNVHHQFQSLPPSMPPPPPSTALPKALDLEVTVVCGKHLKNVNWRRGDLRAYVVVYLDPSRRAATRPDDGGGCKPTWNERLVLPLPPHLSPHDPSILLSLDVFHSKPSDSPKPLVGSARSPLRDLLFPANPNPSHDPAASALVSLPLLRPSGRPQGKIRIRVAIRERSPPPPEPQYPPPSSSPYYFPPPPPAYSAPPQYGSDQYYRPSGYYSAPAPPPHPYEYTGGPSAPVDYNRQYEQRGRTGAAGSGSGNGRYGAGTGLAVGAVAGALGGLAIDEAVKYKEDKGAERVEEKVVPAGRDDYSEYRGDY

SEQ ID NO: 76202 - protein, 1499 aa, Candida albicans
MSTANTSLSQQLDEKPWVDASDNSSVQEYQGFDATASHNIQDLARKLTHDSTNGDHHSANDLARYLSHMSDIPGVSPFNGNISHEKLDPDSENFNAKYWVKNLKKLFESDSDYYKPSKLGVAYRNLRAYGIANDSDYQPTVSNALWKFTTEAINKLKKPDDSKYFDILKSMDAIMRPGELTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSATILDTTPLIAIYQCSQDAYELFDNVVVLYEGYQIFFGKASKAKEYFENMGWKCPQRQTTADFLTSLTNPAEREPLPGYEDKVPRTAQEFETFWKNSPEYAELTKEIDEYFVECERSNTGETYRESHVAKQSNNTRPSSPYTVSFFMQVRYVIARNFLRMKGDPSIPLISILSQLVMGLILASVFFNLRKSTDTFYFRGGALFFSVLFNAFSSLLEILSLYEARPIVEKHRKYALYRPSADALASIISELPVKLLMTMSFNIVYYFMVNLRRTAGNFFFYWLMCALCTLVMSHMFRSIGAVTTTIATAMSLSTVFLLAMIIYAGFVLPIPYILGWSKWIRYINPVTYIFESLMVNEFHGREFECGQYIPSGPSFENLPVENKVCTTVGSTPGSTAVQGTEYIKLAYQFYSSHKWRNFGITVAFAVFFLGVYVALTEFNKGAMQKGEIVLFLKGSLKKHKRKTAASSKGDIEAGPVAGKLDYQDEAEAVNNEKFTEKGSTGSVDFPENREIFFWKDLTYQVKIKKEDRVILDHVDGWVKPGQITALMGASGAGKTTLLNCLSERVTTGIITDGERLVNGHALDSSFQRSIGYVQQQDVHLETTTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDRLLFLQKGGRTAYFGELGENCQTMINYFEKYGANPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKLILVISSSLFIGFSFFKSKNNLQGLQSQMLAVFMFFVPFTTFIDQMLPYFVKHRAVYEVREAPSRTFSWFAFIAGQITSEIPFQIVVGTISYFCWYYPVGLYANAEPTDSVNSRGVLMWMLLTAFYVYTSTMGQLAISFNELIDNAANLATTLFTLCLMFCGVLAGPNVIPGFWIFMYRCNPFTYLIQAILSTGLANAKVTCAPRELVTLKPPMGETCSSFIGPYTEAAGGYFSTNSDGTCSVCRIDSTNQFLESINALFSQRWRNFGIFVAFIGINIILTIFFYWLARVPKGNREKKMKK

SEQ ID NO: 76203 - protein, 54 aa, Populus trichocarpa
MFPGMFMRKPDKAEALKQLKSHVAMFGAWVVVLRVTPYVLHYLSDEKDELKLEF

SEQ ID NO: 76204 - protein, 172 aa, Rhodobacter sphaeroides 2.4.1
MIYALDGVAPRIDAEAWVAPGASVIGKVVLEAGSSVWFGAALRGDNEEIVIGAGSNVQENAVLHTDMGYPLTVGANCTIGHKAMLHGCTIGENSLIGMGATVLNGAKIGRFCLIGACALVTEGKEIPDFSLVKGSPGKVVRELTEEERARLIASAEGYAANARRFRAGLTAL

SEQ ID NO: 76205 - protein, 159 aa, Pediococcus pentosaceus ATCC 25745
MNIKIIVVGKLKEKYLKQGIAEYSKRLSKFCKFQIIEVPDEKAPESLSDAQMNEVKVKEGERILGKIKDRDYVFTLEIKGKERSSEELSAEMAKLATYGNSDITFVIGGSLGLSDAVMKRSNSAISFGRFTLPHQLMRLVLTEQIYRSFMIQAGSPYHK

SEQ ID NO: 76206 - protein, 210 aa, Agrobacterium tumefaciens str. C58
MKNPVDTAMALVPMVVEQTNRGERSYDIFSRLLKERIIFLTGPVEDQMASLVCAQLLFLEAENPKKEIALYINSPGGVVTAGMAIYDTMQFIRPAVSTLCVGQAASMGSLLLAAGEKGMRFATPNARIMVHQPSGGFQGQASDIERHARDIIKMKRRLNEVYVKHTGRTLEEVEKTLDRDHFMDADEAKDWGVIDKILTSRQEMEGAVAN

SEQ ID NO: 76207 - protein, 1499 aa, Candida albicans
MSTANTSLSQQLDEKPWVDASDNSSVQEYQGFDATASHNIQDLARKLTHGSTNGDHHSTNDLARYLSHMSDIPGVSPFNGNISHEQLDPDSENFNAKYWVKNLKKLFESDSDYYKPSKLGVAYRNLRAYGIANDSDYQPTVTNALWKFTTEAINKLKKPDDSKYFDILKSMDAIMRPGKLTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSAVILDTTPLIAIYQCSQDAYELFDNVVVLYEGYQIFFGKASKAKEYFKNMGWKCPQRQTTADFLTSLTNPAEREPLPGFEDKVPRTAQEFETYWKNSPEYAELTKEIDEYFVECERSNTRETYRESHVAKQSNNTRPASPYTVSFFMQVRYVIARNFLRMKGDPSIPLISILSQLVMGLILASVFFNLRKSTDTFYFRGGALFFSVLFNAFSSLLEILSLYEARPIVEKHRKYALYRPSADALASIISELPVKLLMTMSFNIVYYFMVNLRRTAGNFFFYWLMCASCTLVMSHMFRSIGAVTTTIATAMSLSTVFLLAMIIYAGFVLPIPYILGWSKWIRYINPVTYIFESLMVNEFHGREFECGQYIPSGPGFENLPVENKVCTTVGSTPGSTVVQGTEYIKLAYQFYSSHKWRNFGITVAFAVFFLGVYVALTEFNKGAMQKGEIVLFLKGSLKKHKRKTAASNKGDIEAGPVAGKLDYQDEAEAVNNEKFTEKGSTGSVDFPENREIFFWRDLTYQVKIKKEDRVILDHVDGWVKPGQITALMGASGAGKTTLLNCLSERVTTGIITDGERLVNGHALDSSFQRSIGYVQQQDVHLETTTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDKLLFLQKGGRTAYFGELGENCQTMINYFEKYGADPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKLILVISSSLFIGFSFFKSKNNLQGLQSQMLAVFMFFVPFTTFIDQMLPYFVKHRAVYEVREAPSRTFSWFAFIAGQITSEIPFQIVVGTISYFCWYYPVGLYANAEPTDSVNSRGVLMWMLLTAFYVYTSTMGQLAISFNELIDNAANLATTLFTLCLMFCGVLAGPNVIPGFWIFMYRCNPFTYLIQAILSTGLANAKVTCAPRELVTLKPPMGETCSSFIGPYTEAAGGYFSTNSDGTCSVCRIDSTNQFLESINALFSQRWRNFGIFVAFIAVNIILTIFFYWLARVPKGNREKKLKK

SEQ ID NO: 76208 - protein, 404 aa, Buchnera aphidicola str. Sg (Schizaphis graminum)
MIGKIKLITRDSFNKLILPVYNPAFFIPVKGKGSRLWDQKGKEYIDFSGGIAVTSLGHCHPVLNKVLRQQSKKLWHISNIFTNEPALRLADKLISSSFASRVFFANSGAEANEAAFKLARYYSSKIYNLKKNKIISFYNSFHGRTFFTVSVGGQAKYSDFFGPKPPAIMHAKFNEINSVKSIIDDNTCAVVMELIQGEGGIVPADVAFVREIRDLCYKYNALLIFDEIQTGIGRTSKLYAYEHYEVQPDILTIAKSLGSGFPISATLTTNGIASVIKPGIHGTTYGGNPLACSIAESVVNIVNTKKFLLGVEKKSKKIISELNIINKRFGLFTEIRGKGLLIGIVLRPELSEEIHNILNALFLEGVIVLTAGKNVIRLAPSLIISKRDIVEGMKRFYCALEKCL

SEQ ID NO: 76209 - protein, 120 aa, Populus trichocarpa
MAKRSSWFLISATILILMAMGLSSTVQGSGDHHLGWIPATRSSVCKGSIAECMAEDGEEFEMDTEINRRILATTKYVSYGALQRNNVPCSRRGASYYNCQRGAQANPYSRGCSRITRCRS

SEQ ID NO: 76210 - protein, 1499 aa, Candida albicans
MSTANTSLSQQLDEKPWVDASDNSSVQEYQGFDATASHNIQDLARKLTHGSTNGDHHSANDLARYLSHMSDIPGVSPFNGNISHEQLDPDSENFNAKYWVKNLKKLFESDSDYYKPSKLGVAYRNLRAYGIANDSDYQPTVTNALWKFTTEAINKLKKPDDSKYFDILKSMDAIMRPGELTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSATILDTTPLIAIYQCSQDAYELFDNVVVLYEGYQIFFGKASKAKEYFENMGWKCPQRQTTADFLTSLTNPAEREPLPGYEDKVPRTAQEFETFWKNSPEYAELTKEIDEYFVECERSNTGETYRESHVAKQSNNTRPSSPYTVSFFMQVRYVIARNFLRMKGDPSIPLISILSQLVMGLILASVFFNLRKSTDTFYFRGGALFFSVLFNAFSSLLEILSLYEARPIVEKHRKYALYRPSADALASIISELPVKLLMTMSFNIVYYFMVNLRRTAGNFFFYWLMCASCTLVMSHMFRSIGAVTTTIATAMSLSTVFLLAMIIYAGFVLPIPYILGWSRWIRYINPVTYIFESLMVNEFHGREFECGQYIPSGPGFENLPVENKVCTTVGSTPGSTVVQGTEYIKLAYQFYSSHKWRNFGITVAFAVFFLGVYVALTEFNKGAMQKGEIVLFLKGSLKKHKRKTAASNKGDIEAGPVAGKLDYQDEAEAVNNEKFTEKGSTGSVDFPENREIFFWRDLTYQVKIKKEDRVILDHVDGWVKPGQITALMGASGAGKTTLLNCLSERVTTGIITDGERLVNGHALDSSFQRSIGYVQQQDVHLETTTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDRLLFLQKGGRTAYFGELGENCQTMINYFEKYGANPCPKEANPAEWMLQVVGAAPGSHAKQDYFEVWRNSSEYQAVKEEINRMEAELSKLPRDNDPEALLKYAAPLWKQYLLVSWRTIVQDWRSPGYIYSKLILVISSSLFIGFSFFKSKNNLQGLQSQMLAVFMFFVPFTTFIDQMLPYFVKHRAVYEVREAPSRTFSWFAFIAGQITSEIPFQIVVGTISYFCWYYPVGLYANAEPTDSVNSRGVLMWMLLTAFYVYTSTMGQLAISFNELIDNAANLATTLFTLCLMFCGVLAGPNVIPGFWIFMYRCNPFTYLIQAILSTGLANAKVTCAPRELVTLKPPMGETCSSFIGPYTEAAGGYFSTNSDGTCSVCRIDSTNQFLESINALFSQRWRNFGIFVAFIGINIILTIFFYWLARVPKGNREKKMKK

SEQ ID NO: 76211 - protein, 387 aa, Petroselinum crispum
MDGSTQPSDTVMSDAAPASQTAGIENIPASLSHGGRFIQYNIFGNIFEVTAKYKPPILPIGKGAYGIVCSALNLETNEHVAIKKIANAFDNKVDAKRTLREIKLLRHMDHENVVAIRDIIPPPQRGSFNDVYIAYELMDTDLHQIIRSNQGLSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEAELEFLNENAKRYIRQLPLYRRQSLTEKFPNVHPSAIDLVEKMLTFDPRRRLTVEDALAHPYLTSLHDISDEPVCAAPFSFDFEQHALTEEQMRELIYREALAFNPEHQQM

SEQ ID NO: 76212 - protein, 228 aa, Buchnera aphidicola str. Sg (Schizaphis graminum)
MKKFFLASSILSADFARLGEDTKKAIDAGSDWIHFDVMDNHYVPNLTMGPMILKALRNYNITVPIDVHLMVKPVDNLIPQFAEAGADFITFHPESTDHIDRTLNLIKECGCKAGLALNPATSLNFLDYVMEKLDLILLMSVNPGFGNQSFLPTSFNKLREVRKKIELNSSNILLEVDGGVKLENISEVAFSGANVFVIGSGIFGYTDYNVIIKKIRKKLKNVYSTSIH

SEQ ID NO: 76213 - protein, 1499 aa, Candida albicans
MSTANTSLSQQLDEKPWVDASDNSSVQEYQGFDATASHNIQDLARKLTHGSTNGDHHSANDLARYLSHMSDIPGVSPFNGNISHEQLDPDSENFNAKYWVKNLKKLFESDSDYYKPSKLGIAYRNLRAYGIANDSDYQPTVTNALWKFTTEAINKLKKPDDSKYFDILKSMDAIMRPGKLTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSATILDTTPLIAIYQCSQDAYELFDNVVVLYEGYQIFFGKASKAKEYFENMGWKCPQRQTTADFLTSLTNPAEREPLPGYEDKVPRTAQEFETFWKNSPQYAELTKEIDEYFVECERSNTGETYCESHVAKQSNNTRPSSPYTVSFFMQVRYVIARNFLRMKGDPSIPLISILSQLVMGLILASVFFNLRKSTDTFYFRGGALFFSVLFNAFSSLLEILSLYEARPIVEKHRKYALYRPSADALASIISELPVKLLMTMSFNIVYYFMVNLRRTAGNFFFYWLMCALCTLVMSHMFRSIGAVTTTIATAMSLSTVFLLAMIIYAGFVLPIPYILGWSKWIRYINPVTYIFESLMVNEFHGREFECGQYIPSGPGFENLPVENKVCTTVGSTPGSTVVQGTEYIKLAYQFYSSHKWRNFGITVAFAVFFLGVYVALTEFNKGAMQKGEIVLFLKGSLKKHKRKTAASNKGDIEAGPVAGKLDYQDEAEAVNNEKFTEKGSTGSVDFPENREIFFWRDLTYQVKIKKEDRVILDHVDGWVKPGQITALMGASGAGKTTLLNCLSERVTTGIITDGERLVNGHALDSSFQRSIGYVQQQDVHLETTTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDKLLFLQKGGRTAYFGELGENCQTMINYFEKYGADPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKLILVISSSLFIGFSFFKSKNNLQGLQSQMLAVFMFFVPFTTFIDQMLPYFVKHRAVYEVREAPSRTFSWFAFIAGQITSEIPFQIVVGTISYFCWYYPVGLYANAEPTDSVNSRGVLMWMLLTAFYVYTSTMGQLAISFNELIDNAANLATTLFTLCLMFCGVLAGPNVIPRFWIFMYRCNPFTYLIQAILSTGLANAKVTCAPRELVTLKPPMGETCSSFIGPYTEAAGGYFSTNSDGTCSVCRIDSTNQFLESINALFSQRWRNFGIFVAFIAVNIILTIFFYWLARVPKGNREKKMKK

SEQ ID NO: 76214 - protein, 387 aa, Schizosaccharomyces pombe
MSNRKADEKHHMSSSSLTNDRSYIRNLSNRKTSISRKVPITRTLEDPSNFVAKDGTKLVQAPLFLLVWQKEICLSIIAICFACLLSPSLRPYAEPFIFLSYKQPDGSYGKGPKDACFPIFWVIVFTAFRVIVMDYVFRPFVLNWGVRNRKVIIRFCEQGYSFFYYLCFWFLGLYIYRSSNYWSNEEKLFEDYPQYYMSPLFKAYYLIQLGFWLQQILVLHLEQRRADHWQMFAHHIVTCALIILSYGFNFLRVGNAILYIFDLSDYILSGGKMLKYLGFGKICDYLFGIFVASWVYSRHYLFSKILRVVVTNAPEIIGGFHLDVPNGYIFNKPIYIAFIILLFTLQLLIYIWFGMIVKVAYRVFSGEEATDSRSDDEGGRRGGEFNE

SEQ ID NO: 76215 - protein, 270 aa, Zea mays
MAALLELFLGSSPTPVDWEAEVYPAYGDFAVLPLLVAFFPAVRFLLDRLVFEICAGVGLGKVLARKFIFGKGHDKLSETDDSRKKINKFKESAWKFVFFLSGELLSLSVTYNEPWFKNTRYFWIGPGDQIWPDQKIKFARVGTVVLALHDASDIFLEIGKMAKYSSCEWLAVMAFLLFVASWILLRLVMFPFWILRSTSYEVLLTLDREKHRFYGPIYYYVFNCLLFSLLVLHIYWWVLIWRMLVKQIQSKGRVGDDVRSDSEGEDEHED

SEQ ID NO: 76216 - protein, 374 aa, Petroselinum crispum
MESSSAATADHTHIKGVPTHGGRYVQYNVYGNLFEVSRKYVPPIRPVGRGAYGIVCAAMNSDTREEVAIKKIGNAFDNRIDAKRTLREIKLLRHMNHENVIAIKDIIRPPQIESFNDVYIVYELMDTDLHQIIRSNQQLTDDHCRYFLYQLLRGLKYVHSANVLHRDLKPSNLLLNANCDLKIGDFGLARTTSETDFMTEYVVTRWYRAPELLLNCSEYTAAIDIWSVGCILGEVMTRQPLFPGKDYVHQLRLITELIGSPDDASLGFLRSDNARRYVRQLPQYPKQQFSARFLNKSPGALDLLEKMLIFDPNRRITVDEALCHPYLAALHDINEEPVCPRPFSFDFEQPTCTEENIKELIWKESVKFNPDPIL

SEQ ID NO: 76217 - protein, 370 aa, Petroselinum crispum
MANPGDGQYDFPAIATHGGRFIQYNIFENLFEVTAKYRPPIMPIGRGAYGIVCSIMNTEANEMVAIKKIANAFDNYMDAKRTLREIKLLRHLDHENIIALTDVIPPPVRRNFSDVYIATELMDTDLHQIIRSAQVLSEEHSQYFLYQLLRGLKYIHSANIIHRDLKPSNLLLNANCDLKICDFGLARPNTDDEFMTEYVVTRWYRAPELLLNSSDYTAAIDVWSVGCIYMELMNRTPLFAGRDHVHKMRLLTELLAAPTEPDLGFVRNEDSRRYILQLPRRPRLSLRMLYPQVHPVAIDLIDKMLTFDPSKRITVEEALAHPYLERLHDVSDEPVCSKPFSFEFETAHLGEEQIKEMIYQEALSFNPGMA

SEQ ID NO: 76218 - protein, 233 aa, Picea sitchensis
MEACGEEGQLKLLGATRSPFLVRVRIALALKGIDYEFIEEDFQNKSQLLLQSNPVHKMIPVLIHNGKPVCESMIIVQYIDEAWYSKAPNLMSKDPYDRAIARFWSAFVDDKIVPCLRGVLNGQGEQQQKAAEESVANFLLLEEALQTNGKTYFGGDEIGLVDISLGGIVVFIKTMEKVTNIVLIDTDKMPLLSAWAERFYKADGLKDVLSDPAEIFEFITGWRAKLTSPPAGN

SEQ ID NO: 76219 - protein, 517 aa, Photobacterium sp. SKA34
MSEVKQATDEKLLSGADYLRNILRAPVYEVAQVTPLQNMDRLSARIANQIQLKREDRQPVHSFKLRGAYNMMSQLTEPQKAAGVIAASAGNHAQGLALSSQKLGVKATIVMPRTTPDIKVDAVRSFGGIVVLHGNNFDEAKGYAEQLAQQHGYTFIPPFDHPSVIAGQGTIGIELVQQNGHLDCVFVPVGGGGLAAGVAVLLKQLLPEIKVVGVEAEDSACLKAALDAGKPVSLDQVGMFADGVAVKQIGSETFRLCQQYLDDVITVSSDEICSAVKDIFEDTRAIAEPSGALSLAGLKKYVEQHQIRDQQLAAILSGANLNFHGLRYVSERCELGEKREGLLAVTIPERPGAFLDFCHLIGGRAVTEFNYRYNDDALANVFVGVRLIQGQEELDGIIKDLRKGGYPVVDLSDDEMAKVHVRYMIGGRPSKPLKERLYSFEFPEYPGALIRFLNTLGCHWNISLFNYRNHGADYGRVLCGFELEDKDLLSFTSHLRELGYQWKDETENPAYKFFLAQ

SEQ ID NO: 76220 - protein, 138 aa, Brassica napus
  misc_feature (59)..(59): Xaa can be any naturally occurring amino acid
  misc_feature (77)..(77): Xaa can be any naturally occurring amino acid
MEEELRVRLNDHQPSKIFPVKPKSTPKTLSKPETPDSRYWSSFKPHSIPNLVSSISAVXFSPIHPHSFAVAHSTTVXSLFSSNTLTTSRRFSFKDVVSSVSFRSDGALLAASDLSGTVQVFDVKERMALRSLRSHKAA

SEQ ID NO: 76221 - protein, 226 aa, Bordetella pertussis Tohama I
MLTQQELKQQAADAALELVEQVAGPDVIIGVGTGSTADLFIDGLACFKGRLRGTVASSERSAARLAGHGLAVLDLNDVQSMPIYVDGADEIDPNLHMIKGGGGALTREKIVASVARRYICIADESKLVERLGRFPLPVEVIPMARNAVARGLSRLGGQPALREGFVTDNGNIILDVAGLSIADAPGLEKTINDIPGVVTCGLFALAGADVALLATQDGIRRLERRG

SEQ ID NO: 76222 - protein, 489 aa, Pseudomonas syringae pv. syringae B728a
MPLITVEPCTFALFGALGDLAVRKLFPALYQLDRAGLLHEDTKILALAREPGDEESHLAYIEKSMRRFIPETELEPDNLSRFLARLSYLHVDFLKAEDYVALAERVGNAETLIAYFATPASVYGAICENLASVNLAERTRAVLEKPIGHDLASSRRVNDAVAQFFPENRVYRIDHYLGKDTVQNLIALRFANSLFETQWNQNHISHVEITVAEKVGIEGRWGYFDQAGQLRDMIQNHLLQLLCLIAMDPPSDLSADSIRDEKVKVLKALAPFTPERLATQVVRGQYTSGYSEGKAVPGYLEEENSNTQSDTETFVALRADIRNWRWSGTPFYLRTGKRMPQKLSQIVIHFKEPPHYIFAPEQRLQISNRLIIRLQPDEGISLQVMTKDQGLDKGMQLRSGPLQLNFSDTYRSARVPDAYERLLLEVMRGNQNLFVRKDEIEYAWQWCDQLIAGWKKAGDAPKPYPAGTWGPMSSIALITRDGRSWYGDM

SEQ ID NO: 76223 - protein, 872 aa, Vitis vinifera
  misc_feature (164)..(164): Xaa can be any naturally occurring amino acid
  misc_feature (169)..(169): Xaa can be any naturally occurring amino acid
  misc_feature (482)..(482): Xaa can be any naturally occurring amino acid
  misc_feature (496)..(496): Xaa can be any naturally occurring amino acid
  misc_feature (520)..(520): Xaa can be any naturally occurring amino acid
  misc_feature (619)..(619): Xaa can be any naturally occurring amino acid
  misc_feature (742)..(742): Xaa can be any naturally occurring amino acid
  misc_feature (799)..(799): Xaa can be any naturally occurring amino acid
  misc_feature (803)..(803): Xaa can be any naturally occurring amino acid
  misc_feature (866)..(866): Xaa can be any naturally occurring amino acid
MEKENWATANAEELTTRVTRSRAATYRASKQMLPKNASMPQEQKRTSQSNLKRPALEEKNNAASATTAPQCKKRAVLKDVANICCENLYMNCIDATKIQKRNSKQARKGWVMLPKVAPSVTVEISLLSADPKATVAQEVEKQEIEPEVICLTIDGNLPSQLTSXTTLRXCGIADNQVEKHCSEIASQLHSSSNEAEKGSFDGKLTTSSNPDVKDIDSDDKDPQLCSLYAPEIYNNLHVAELNRRPCSNFMETVQRDITQSMRGILVDWLVEVSEEYKLVPDTLYLTVHLIDWFLSQNYIERQKLQLLGITCMLIASKYEEICAPRVEEFCCITDNTYSRGEVVKMESQVLNYFGFKIFAPTAKTFLRRFLRAAQASYKNPSLELEYLGNYLAELTLIDYGCLKYLPSIIAASAVFLARWTLDQSGHPWNPTLEHYTRYKASDLKTAVFALQDLQLNTSGCPLNAIRGKYRQNKQSRILPLPXPRRRHLPRNPLPPXPPSQRSLGISSASPTTNBEENESXSLSNHHRPPKKSSPPRTVSHLLVGLFIHTVLELRKVPENLCTCALMVWLFNPFTFSIGTRGNCKVLQAAFWYGLVVHFRIYPIIYSIPIILVLDPHCFXYGLKPALSSWVGQGNSTQSIPSTAVPESCGIWIALTSMFTRARIMFGLISGAVFFAFTGLFFYLYRWEFLHEALLYHLTRTDPRHNFSIYFYHIYLHYEHEFSVVERLISFLPQFLVQLVLIXCFAQDLPFCFFAQTVAFVAFNKVITAQYFVWFFCLLPLILPWSNMKLKWTGLSCILXWMGXQTHWLMWGYLLEFKGKNVFLELWIASILFLAANTFVLIKIIRYHTYSSLFQRLEFSSSDNDLXEGKKSN

SEQ ID NO: 76224 - protein, 326 aa, delta proteobacterium MLMS-1
MSTTCSSKCGGAAGDSDCGQRAAVDAQRNLSIDRALGRIRYKIMVMSGKGGVGKSTVAVNLAVGLARRGFKVGLMDVDLHGPDICRMLNLSEAPVTTAAGRITPLPAAAGLQVMSLENMMENRDDPVIWRGPLKNQAIRRFIADVEWGPLDYLIIDAPPGTGDEPLTVARMIKDAWALVVTTPQKVALADVRKSINFCGHVDMKILGLVENMSGFICPHCQQTSELFKSGGGQRLAAENRLEFLGGIPLDPRVMLSGDEGIALLADDRQSPAVAAMDTVVANVSRLLPVAAPAPAMAQFPAPGGGIPLAASACGCGGVCDPVKCDC

SEQ ID NO: 76225 - protein, 396 aa, Leptospira interrogans serovar Lai str. 56601
MELPRLENVDLSGKRVFLRVDFNVPVENGKVTDKTRIEKTLPTIELLIKKGARIIIASHLGRPKGQVNPEFSLAPVVETFQSLVKSKVYFSKTVIGEDAIKLSKELKNGEILVIENVRFHKEEEENDPGFSKKLSALADIYVNDAFGAAHRAHSSTEGIARLLPAYAGLLMHKEILELSALLHKPARPFVAIIGGSKVSTKIKVLTNLFDKVNHLLIGGGMAYTFLKSRAIPIGNSLVEKEFEVQAFQLIEKAGVAGIDLQLPVDHIIGDQFNEKAKTKSVDKMGILDGWMGMDIGSKTVSNYEKIIKNAGTIFWNGPMGVFEMDKFASGTMAIAKAVAKSKAKTVVGGGDSIAAINKAGVADKITHISTGGGASLEFMEGRKLPGVEALKKKTSE

SEQ ID NO: 76226 - protein, 521 aa, Physcomitrella patens subsp. patens
MVLSELKGMKEVDSSNVDSIYASRYVQNELPRWSLPEREFPKDAAYQVIADELMLDGNPRLNFASFVTTWMEPECDKLMLGALSKNYIDMDEYPITTELQDRCVNMIARLFNASLEEGQTAIGAGTVGSSEAIMLAGLAFKRKWQLERKAKGLPFDKPNMVTGANVHVVWEKFANYFEVELRAVKLREDYYVMDPAKAVEMCDENTICVSAILGSTYNGEFEDVETLNNLLEKKNKEKGWHIPIHVDAASGGFVAPFLYPDLVWDFRLPLVKSINVSGHKYGLVYPGVGWVVWRSKEDLPEELIFHVNYLGADQPTFTLNFSKGASQIIAQYYQFIRLGFEGYSKIIANCAKNAKTLAESIVATGRFKLLSKPQGVPLVAFSLKDKRKFDEFDIADGLRRHGWTVSAYTMAPDAQQTTLLRVVVREDFSRGLSDRLVEDLKKVLKTLDSQPAKLVQAVAEVIQEQHHELANSNATVEDIKQTVEHDVPFHEMVKKLSDAHNHRKKAQAHKLHSIHKTNGVC

SEQ ID NO: 76227 - protein, 335 aa, Leptospira interrogans serovar Lai str. 56601
MTRIAINGFGRIGRLVFRAGIKDPNLEFVAINDLVTPDNLAYLLKYDSTHGRFQGTVEHTEKELIVDGKKILCVSERDPEKLPWKDLKVDYVIESTGLFTDRVGAEKHIKAGAKKVVISAPAKDKDIPTFVMGVNNEKYNPSNDHIVSNASCTTNCLAPIVKVVLDNWGIEEGLMTTIHATTATQPTVDGPSKKDFRGGRGAMQNIIPASTGAAKAVGLCIPEVNGKLTGMSFRVPTPDVSVVDLTVRTTKETSLKEISAKMKAASEGAMKGILGYTEDMVVSNDFVSSTLSSIFDMDACIELNSRFFKLVSWYDNEMGYSNRVLDLIRYMAKKG

SEQ ID NO: 76228 - protein, 263 aa, Arabidopsis thaliana
MVNYSSISCIFFVALFSIFTIVSISSAASSHGEVEDEREFNYKKNDEKGPERWGELKPEWEMCGKGEMQSPIDLMNERVNIVSHLGRLNRDYNPSNATLKNRGHDIMLKFEDGAGTIKINGFEYELQQLHWHSPSEHTINGRRNRRMAVVTVLYKIGRADTFIRSLEKELEGIAEMEEAEKNVGMIDPTKIKIGSRKYYRYTGSLTTPPCTQNVTWSVVRKVRTVTRKQVKLLRVAVHDDANSNARPVQPTNKRIVHLYRPIV

SEQ ID NO: 76229 - protein, 195 aa, Prochlorococcus marinus str. MIT 9515
MANLNQPPSRVTPNLLHILDAFTDSKKSVVNTIVELNSNTINKYELITETGHLKLDRVGYSSLAYPFAYGCIPRTWDEDGDPLDIEIVGVTEPLVPGSIVESRIIGVMKFDDGGEVDDKVIAVLADDKRMDHINTFKDLGEHWLKETKYYWEHYKDLKKPGTCRVNGFYGIEEAVKVIQDCESRYHKEIEPKLVD

SEQ ID NO: 76230 - protein, 698 aa, Moritella sp. PE36
MASIRLEQDDAGIVHLIFDKPASKVNLLDRSFIDDYVTTVNKLKLMTFTGVILRSAKTSFFAGGDITELSQSAEQGIEESFQLLSSLKDAMRWLETCGKPVVACINGAALGSGWELALACHYRVALVKNVLLGLPEVTLGLIPGVGGVVRMTRLLGLKAAMPYLLKGKQFDSEEGFTLGLINQTATSNVQMMAQATNWILSQQHPVSQGFDINGYQLPGGNMSDPNVVSMIVQAPATLKKKTQGNLPAPEAILSVMIESTEVDVETALRLETRYFLSIIRGQVAKNMINTFWHQHNEIKAGASRPLDLPVKKFSKVGVLGAGMMGAGIAYALASHGITVILKDISLEKAVFAKSYTASILANCKLEDEEKCTILQRITPSKESADLIGCDMVIEAVFEDRKVKNQAITEILTAVGDELIMASNTSTLPISSLATASTKPENFIGLHFFSPVDKMPLVEIIKGDKTSSATLAAAYDLVIQIGKVPIVVNDSRGFFTSRVFFTYVSEGMRMLSEGIPAEVIENAAIQAGLPVGPLAITDEVSLSLIDHVRNQARLDFKAEGKELLDNPADAVLDKLLALKRRGKLAGAGFYDYNGQGHKQLWAGLVDVFPTQDNWDIETVKDRLLFVQSLEALRAYEEGVVTSTRDANIGSILGLGFPAWTGGVLQFIDHHGVDDFKQRAEQLCEQFGPQFTPVAILSEW

SEQ ID NO: 76231 - protein, 612 aa, Streptococcus pyogenes M1 GAS
MEFSRETRRLALQKMQERDLDLLIIGGGITGAGVALQAAASGLDTGLIEMQDFAQGTSSRSTKLVHGGLRYLKQFDVEVVSDTVSERAVVQQIAPHIPKPDPMLLPVYDEPGSTFSMFRLKVAMDLYDLLAGVSNTPAANKVLTKEEVLKREPDLKQEGLLGGGVYLDFRNNDARLVIENIKRANRDGALIASHVKAEDFLLDDNGKIIGVKARDLLSDQEIIIKAKLVINTTGPWSDEIRQFSHKGQPIHQMRPTKGVHLVVDRQKLPVSQPVYVDTGLNDGRMVFVLPREEKTYFGTTDTDYTGDLEHPQVTQEDVDYLLGVVNNRFPNANVTIDDIESSWAGLRPLLSGNSASDYNGGNSGKVSDDSFDHLVDTVKAYINHEDSREAVEKAIKQVETSTSEKELDPSAVSRGSSFERDENGLFTLAGGKITDYRKMAEGALTGIIQILKEEFGKSFKLINSKTYPVSGGEINPANVDSEIEAYAQLGTLSGLSMDDARYLANLYGSNAPKVFALTRQLTAAEGLSLAETLSLHYAMDYEMALKPTDYFLRRTNHLLFMRDSLDALIDPVINEMAKHFEWSDQERVAQEDDLRRVIADNDLSALKGHQEG

SEQ ID NO: 76232 - protein, 283 aa, Prochlorococcus marinus str. MIT 9515
MDDSLRVSILSEALPYIQSFSGRKIVVKYGGSIMEDEKLKKAFFRDIALLSSVGVCPVVIHGGGPEINRWLSKLEISPKFEKGLRVTDDKTMEIVEMVLMGRVNKQIVRGINKTGSLAVGISGLDGNLIQSRELGDGSHGLVGEVTQINPELLEPLIAKGYIPVISSIGSTTDGISHNINADFVAGELAAAINAEKLILLTDTPGILKERNNPNSLAKQINLKEARKFIEKNIVSNGMLPKTECCIRALAQGVRAAHIIDGRIEHSLLLEIFTNSGIGTMINA

SEQ ID NO: 76233 - protein, 462 aa, Sulfitobacter sp. EE-36
MSSYDVIIIGSGPGGYVSAIRCAQLGLKTACVEGRETLGGTCLNVGCIPSKALLHATHMLHEAEHNFADMGLKGKSPSVDWAQMQTYKQNTIDTNTKGIEFLFKKNKIDWIKGWATIPEAGKVKVGDEVHEAKNIIIATGSEPSALPGVEVDEKVVVTSTGALSLNKIPKKLVVIGAGVIGLELGSVYARLGAEVTVVEYLDAITPGMDGEVQKNFMRILKKQGVNFVMGAAVQGTEASKTKAKVTYKLRKDDSEHTLDADVVLVSTGRKPFHDGLGLEGLGVELTKRGQIAVSDTWETSVKGIYAIGDVIEGPMLAHKAEDEGMAAAEVVAGKHGHVNYGVIPGVIYTHPEVANVGATEEQLKEAGRAYKVGKFSFMGNARAKAVFAGEGFVKLIADKETDRILGAHIIGPGAGDLIHEVCVAMEFGASAEDLAMTCHAHPTYSEAVREAALACGDGPIHM

SEQ ID NO: 76234 - protein, 417 aa, Prochlorococcus marinus subsp. marinus str. CCMP1375
MKSKKNLAEITRKDFELFSLGSQENNDLIYLDHAATSQKPKFVIERMVHYYKYENANVHRGAHQLSAKATQAFEDAREITSQFVQAKSNREIVFTRNATEAINLVAYSWGDSQLKEGDEILITLMEHHSNLVPWQLLAKRKGCKLRYIGITKTGELDLNDLKNKVNEKTKLVCLLHVSNTLGTCNPIKKISEIAHSAGALILIDACQSLAHKKINVEALDIDFLAGSSHKLCGPTGCGFLWAKEEILEIMPPFLAGGEMIQDVSLQKSNWSDLPHKFEAGTPAIGEAIGMGAAISYLQSIGLENIGLYEKELTQYLFKNLETIEGIRILGPTPEQQPNRAPLATFYIENIHSNDIAELLDSKNICIRSGHHCCQPIHEYYGISSTARASLSFTSTKKEIDFFTQELMSSINFIKEHS

SEQ ID NO: 76235 - protein, 509 aa, Sulfitobacter sp. EE-36
MTSEVRVPTLGESVTEATVATWFKKPGDSVAVDEMLCELETDKVTVEVPSPVAGTLADIVAAEGETVGVDALLANISEGDAAPAKSEAPKAVDAGAEDVKPRDAADDVDVMVPTLGESVSEATVSTWFKTVGDHVEADEMLCELETDKVSVEVPAPTSGTLTQIIAEEGSTVEANGKLAVISQGEGGSASKPADDTAEPKAGGQVPAPGNAPSGDVEDAPSAKKAMAEAGISRDQVTGTGRDGRVMKEDVAKAVAAGKNAAKPAAAAPRAPSAPQDAAREERVKMTRLRQTIAKRLKDSQNTAAMLTTYNEVDMTEIMALRNEYKDLFLKKHGVKLGFMSFFTKACIHALNEVPEVNAEIDGTDVVYKNYVNMGIAAGTPTGLVVPVVKDAQAMSFADIEKEIGELGAKARDGKLSMAEMQGGTFTISNGGVYGSLMSSPILNPPQSGILGMHKIQDRPMAINGQVVIRPMMYLALSYDHRIVDGKGAVTFLVRVKEALEDPRRLLMDL

SEQ ID NO: 76236 - protein, 1499 aa, Candida albicans
MSTANTSLSQQLDEKPWVDASDNSSVQEYQGFDATASHNIQDLARKLTHGSTNGDHHSANDLARYLSHMSDIPGVSPFNGNISHEQLDPDSENFNAKYWVKNLKKLFESDSDYYKPSKLGVAYRNLRAYGIANDSDYQPTVTNALWKFTTEAINKLKKPDDSKYFDILKSMDAIMRPGELTVVLGRPGAGCSTLLKTIAVNTYGFHIGKESQITYDGLSPHDIEHHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSATILDTTPLIAIYQCSQDAYELFDNVVVLYEGYQIFFGKASKAKEYFENMGWKCPQRQTTADFLTSLTNPAEREPLPGFEDKVPRTAQEFETYWKNSPEYAELTKEIDEYFVECERSNTGETYRESHVAKQSNNTRPASPYTVSFFMQVRYVIARNFLRMKGDPSIPLISILSQLVMGLILASVFFNLRKSTDTFYFRGGALFFSVLFNAFSSLLEILSLYEARPIVEKHRKYALYRPSADALASIISELPVKLLMTMSFNIVYYFMVNLRRTTGNFFFYWLMCALCTLVMSHMFRSIGAVTTTIATAMSLSTVFLLAMIIYAGFVLPIPYILGWSKWIRYINPVTYIFESLMVNEFHGREFECGQYIPSGPGFENLPVENKVCTTVGSTPGSTVVQGTEYIKLAYQFYSSHKWRNFGITVAFAVFFLGVYVALTEFNKGAMQKGEIVLFLKGSLKKHKRKTAASNKGDIEAGPVAGKLDYQDEAEAVNNEKFTEKGSTGSVDFPENREIFFWRDLTYQVKIKKEDRVILDHVDGWVKPGQITALMGASGAGKTTLLNCLSERVTTGIITDGERLVNGHALDSSFQRSIGYVQQQDVHLETTTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDRLLFLQKGGRTAYFGELGENCQTMINYFEKYGANPCPKEANPAEWMLQVVGAAPGSHAKQDYFEVWRNSSEYQAVRKEINRMEAELSKLPRDNDPEALLKYAAPLWKQYLLVSWRTIVQDWRSPGYIYSKLILVISSSLFIGFSFFKSKNNLQGLQSQMLAVFMFFVPFTTFIDQMLPYFVKHRAVYEVREAPSRTFSWFAFIAGQITSEIPFQIVVGTISYFCWYYPVGLYANAEPTDSVNSRGVLMWMLLTAFYVYTSTMGQLAISFNELIDNAANLATTLFTLCLMFCGVLAGPNVIPRFWIFMYRCNPFTYLIQAILSTGLANAKVTCAPRELVTLKPPMGETCSSFIGPYTEAAGGYFSTNSDGTCSVCRIDSTNQFLESINALFSQRWRNFGIFVAFIAVNIILTIFFYWLARVPKGNREKKLKK

SEQ ID NO: 76237 - protein, 459 aa, Vitis vinifera
MLSLAFQNRKSAAAVLSTAASLAASAMLIRSIANDLLPNEVHDYFSSTLHNLSRYFSSQLTIVIDEFQGLSMNKLFEAADVYLGTRMTPSVRKIRVVKGDEEKKLAVTMDRNEEIVDVFENVRVKWTMVCRQGQALGRGNSRNRGETPRLEVRSYELSFNKNYRDIVLDSYLPYILERARAIKEENKVVKLHTVNYSNWDLGSILLDHPMTFQTLAMDSELKKELVEDLDNFVNGKDYYRRIGKAWKRGYLLYGPPGTGKSSLIAAMANHLNYDIYDLDLTNVNSNSDLRALLLAMSSKSILVIEDIDCMIKLQNRDSEERWQPHKNQVTLSGLLNFIDGIWSCCGDQGRIIVFSTNHRDQLDPALLRPGRMDMHIHMSYCTISAFKQLALNYLGVWQHPLFDQVEGLMGEVKVTPAEVAGELIKSKDPDVSLQGLLGFLHSKNEAKPQKEMEAEDRSD

SEQ ID NO: 76238 - protein, 751 aa, Debaryomyces hansenii CBS767
MVETKAQLKVLGVNIETVRLLLQVIIFISIAGAAISSRLFSVIRYESIIHEFDPWFNFRATKYLVTHSYYEFLNWFDDRTWYPLGRVTGGTLYPGLMVTSGIIWHTLREWFSLPVDIRNICVLLAPAFSGLTAISTYFLTKEMKDSNAGLLAAIFMGIAPGYISRSVAGSYDNEAIAITLLMATFYFWIKAMKIGSVFYGTLTALFYFYMVSAWGGYVFITNLIPLHIFVLILMGRYNHRLYTAYTTWYALGTLASMQIPFVGFLPIRSNDHMAALGVFGLLQLVAVGHYVKSKVPSKQFKGFLMVSLSLITILGVAGLFALTALGWIAPWTGRFYSLWDTNYAKIHIPIIASVSEHQPTAWPAFFFDTNMLIWLFPAGIYLCFQELRDEHVFVIIYGVLCSYFAGVMVRLMLTLTPIICVSAAIALSKLFDVYLNVVDIFKSDSLEDVKTDSKKSKSKVSSSSSASKSSKFIQLLSKAVVLLSFTFYLVYFVYHCTWVTSNAYSSPSVVLASRNPDGSQNIIDDYREAYYWLRMNTPEDAKVMAWWDYGYQIGGMADRTTLVDNNTWNNTHIATVGKAMCSSEDVAYDILKKHDVDYVLVIFGGLLGYSGDDINKFLWMVRISEGIWPDEIHERDYFTERGEYKVDADASKAMKDSLMYKMSYYRYTDLFNGRDGMDRVRNQAIPASQSPELDVVEEAFTSQNWIVRIYKVKDLDNIGRDLHSAAKFDKSSSQQTKRKRIIKKPSLDLRE

SEQ ID NO: 76239 - protein, 557 aa, Zea mays
  misc_feature (231)..(231): Xaa can be any naturally occurring amino acid
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGLLSDGGVHSRLDQLQLLLKGVSERGAKKIRVHILTDGRDVLDGSSVGFVETLENDLLELRGKGIDAQIASGGGRMYVTMDRYENDWDVVKRGWDAQVLGEAXPYKFKSALEAVKTLRAQPKANDQYLPPFVIVDDSGKAVGPVLDGDAVVTINFRADRMVMLAKALEYADFNNFDRVRVPKIRYAGMLQYDGELKLPSRYLVSPPEIDRTSGEYLVKNGIRTFACSETVKFGHVTFFWNGNRSGYFDETKEEYVEVPSDSGITFNVAPKMKALQIAEKARDALLSGKFDQVRVNLPNGDMVGHTGDIEATVVACKAADEAVKIILDAVEQVGGIYLVTADHGNAEDMVKRNKSGKPLLDKNGGIQILTSHTLQPVPVAIGGPGLHPGVKFRNDIQIPGLANVAATVMNLHGFEAPADYEQTLIEVADN

SEQ ID NO: 76240 - protein, 229 aa, Buchnera aphidicola str. Sg (Schizaphis graminum)
MNNININIKIIKKKIQYFLKKNNYPLKKIKIIAVSKNQGIDKIKLAISSGIHEFGENYVQEGIDKIQKLKKYQNIIWHFIGKVQSNKTKIIAENFDWCQTIDREKIAILLNKYREKKSFPMNVLMQINISNEVTKNGICIKNYKKLAKTISLMPNLNFRGIMMMPEVEKKMIKQNDNYKNGNFIFNELKKEYQSIDTLSLGTSFDIENALLFHSNMIRIGRFIFKNQVR

SEQ ID NO: 76241 - protein, 381 aa, Oryza sativa Indica Group
MASSTQGQVITCKAAVAWEANKPMTIEDVQVAPPQAGEVRVKILFTAFCHTDHYTWSGKDPEGLFPCILGHEAAGIVESVGEGVTEVQPGDHVIPCYQAECRECKFCKSGKTNLCGKVRAATGVGVMMNDRKSRFSINGKPIYHFMGTSTFSQYTVVHDVSVAKINPQAPLDKVCLLGCGVSTGLGAVWNTAKVEAGSIVAIFGLGTVGLAVAEGAKSAGASRIIGIDIDSKKFDVAKNFGVTEFVNPKDHDKPIQQVIVDLTDGGVDYSFECIGNVSVMRSALECCHKGWGTSVIVGVAASGQEISTRPFQLVTGRVWKGTAFGGFKSRSQVPWLVEKYLNKEIKVDEYVTHSMNLTDINKAFDLLHEGGCLRCVLATDK

SEQ ID NO: 76242 - protein, 158 aa, Neisseria gonorrhoeae FA 1090
MNTIAPNLDGKHLRIGIVQARFTNEIGSQMLKVCCRTLQELGVADENITVATVPGALEIPIALMNFASSEKFDALIAIGVVIRGETYHFELVANESGAGIGRVALDYNIPIANAVLTTENDAQAIERIGEKASDAAKVAVECANLVNLLLEEQFEDEE

SEQ ID NO: 76243 - protein, 2254 aa, Arabidopsis thaliana
MKHIFFNSCITKKNIEDETQFNYEKKGEKGPENWGRLKPEWAMCGKGNMQSPIDLTDKRVLIDHNLGYLRSQYLPSNATIKNRGHDIMMKFEGGNAGLGITINGTEYKLQQIHWHSPSEHTLNGKRYLKRITDTHESQEFVEMVHPRTFGFESKHYYRFIGSLTTPPCSENVIWTISKEMRTVTLKQLIMLRVTVHDQSNSNARPLQRKNERPVALYIPTWHSPFRCVLSVNMKKDEKIGLTGRTIYTRSLAASIPASVEQETPGLRRSSRGTPSTKVITPASATRKSERLAPSPASVSKKSGGIVKNSTPSSLRRSNRGKTEVSLQSSKGSDNSIRKGDTSPDIEQRKDSVEESTDKIKPIMSARSYRALFRGKLKESEALVDASPNEEELVVVGCSRRIPAGNDDVQGKTDCPPPADAGSKRLPVDETSLDKGTDFPLKSVTETEKIVLDASPIVETGDDSVIGSPSENLETQKLQDGKTDCSPPANAESKTLPVGETSLEKEYPQKFQDDNTDCLPPANAESKRLPVGETSLEKDTDFPLKSTTETGKMVLYASPIVETRDDSVICSPSTNLETQKLLVSKTGLETDIVLPLKRKRDTAEIELDACATVANGDDHVMSSDGVIPSPSGCKNDNRPEMCNTCKKRQKVNGDCQNRSVCSCIVQPVEESDNVTQDMKETGPVTSREYEENGQIQHGKSSDPKFYSSVYPEYWVPVQLSDVQLEQYCQTLFSKSLSLSSLSKIDLGALEETLNSVRKTCDHPYVMDASLKQLLTKNLELHEILDVEIKASGKLHLLDKMLTHIKKNGLKAVVFYQQATQTPEGLLLGNILEDFVGQRFGPKSYEHGIYSSKKNSAINNFNKESQCCVLLLETRACSQTIKLLRADAFILFGSSLNPSHDVKHVEKIKIESCSERTKIFRLYSVCTVEEKALILARQNKRQNKAVENLNRSLTHALLMWGASYLFDKLDHFHSSETPDSGVSFEQSIMDGVIHEFSSILSSKGGEENEVKLCLLLEAKHAQGTYSSDSTLFGEDHIKLSDEESPNIFWSKLLGGKNPMWKYPSDTPQRNRKRVQYFEGSEASPKTGDGGNAKKRKKASDDVTDPRVTDPPVDDDERKASGKDHMGALESPKVITLQSSCKSSGTDGTLDGNDAFGLYSMGSHISGIPEDMLASQDWGKIPDESQRRLHTVLKPKMAKLCQVLHLSDACTSMVGNFLEYVIENHRIYEEPATTFQAFQIALSWIAALLVKQILSHKESLVRANSELAFKCSRVEVDYIYSILSCMKSLFLEHTQGLQFDCFGTNSKQSVVSTKLVNESLSGATVRDEKINTKSMRNSSEDEECMTEKRCSHYSTATRDIEKTISGIKKKYKKQVQKLVQEHEEKKMELLNMYADKKQKLETSKSVEAAVIRITCSRTSTQVGDLKLLDHNYERKFDEIKSEKNECLKSLEQMHDVAKKKLAEDEACWINRIKSWAAKLKVCVPIQSGNNKHFSGSSNISQNAPDVQICNNANVEATYADTNCMASKVNQVPEAENTLGTMSGGSTQQVHEMVDVRNDETMDVSALSREQLTKSQSNEHASITVPEILIPADCQEEFAALNVHLSEDQNCDRITSAASDEDVSSRVPEVSQSLENLSASPEFSLNREEALVTTENRRTSHVGFDTDNILDQQNREDCSLDQEIPDELAMPVQHLASVVETRGAAESDQYGQDICPMPSSLAGKQPDPAANTESENLEEAIEPQSAGSETVETTDFAASHQGDQVTCPLLSSPTGNQPAPEANIEGQNINTSAEPHVAGPDAVESGDYAVIDQETMGAQDACSLPSGSVGTQSDLGANIEGQNVTTVAQLPTDGSDAVVTGGSPVSDQCAQDASPMPLSSPGNHPDTAVNIEGLDNTSVAEPHISGSDACEMEISEPGPQVERSTFANLFHEGGVEHSAGVTALVPSLLNNGTEQIAVQPVPQIPFPVFNDPFLHELEKLRRESENSKKTFEEKVSFPHYPKSILKAELERKMAEVQAEFRRKFHEVEAEHNTRTTKIEKDKNLVIMNKLLANAFLSKCTDKKVSPSGAPRGKIQQLAQRAAQVSALRNYIAPQQLQASSFPAPALVSAPLQLQQSSFPAPGPAPLQPQASSFPSSVSRPSALLLNFAVCPMPQPRQPLISNIAPTPSVTPATNPGLRSPAPHLNSYRPSSSTPVATATPTSSVPPQALTYSAVSIQQQQEQQPQQSLSSGLQSNNEVEPTRWLRSLLLKRNVLLSCI

SEQ ID NO: 76244 - protein, 569 aa, Pseudomonas sp. K-62
MQELNEVGLSVAGMTCPSCTRHVEDALLAVPGVTRAAVDYPSNKAQVTGNRLDVSALVAAVGALGYGATPTDEFESKERSVEQPGLLGKAAQWLSGERAVEKPAGQLHVAIIGTGGAAVAAALKAAENGARFTLIERGTIGGTCVNVGCVPSKIMIRAAHIAHLRRESPFDVGLSATPQLFLRDRLLAQQQARVDELRHAKYESILESNPSINLVRGSARFKDGQTLIVEAAEGDTREVAFDRCLIATGASAAIPPLPGLAGTPYWTSTEALVSERIPKRLAVIGASVVALELAQAFARLGSEVTVLARRTLFASDDPAIGEAVTAAFRAEGITVLTQTQASAVTYCDRQFILTTAQGELKVDQLLVATGRTPNTASLNLERAGVTFDSQHRILIDQGMRTSASNIYAAGDCTDQPQYVYVAAAAGTRAGINMTGGDVKLDLDAMPAVVFTDPQVATVGYSEAEAQRIGLQTESRTLTLDNVPRALANFDTRGFIKLVAEAGSGRILGVQAVTPEAGEIIQTAAIAIRARMTVQDLANQLFPYLTMVQGLKLVAQTFSKDVTQLSCCAG

SEQ ID NO: 76245 - protein, 330 aa, Rhodopirellula baltica SH 1
MSDSSPKTFLVTGCAGFIANEVASQLLAAGHRVVGIDNVNDYYDVRLKEHRLEKLTSQGGAFTFVRGDIEDQSTLQHIFDENSFDAVLNLAARAGVRYSMENPHVYMTTNAMGSLNLLDQMQRVGVKKYVLASTSSLYAGQPMPFIETLPVNTPISPYAASKKAAEAMAYSYHHLYDIDVSVCRYFTVYGPAGRPDMCIFRFIKWIDEGTPIELFGDGEQSRDFTYVSDIAAGTIAALKPVGYEVINLGGGGTPVSLNDIIGRLENLLGKKAKVEHKTFHKADIKITSADISKANDLIGWTPKVELDEGLAASVDWYRENQPWSSELELP

SEQ ID NO: 76246 - protein, 386 aa, Vibrio campbellii AND4
MSDLIQNVKTSFEQVLGYAPSHIIQAPGRVNLIGEHTDYNDGFVLPCAINYQTVVAAVKREDNLVRVVSVDYGNAVDEFDITQEITFQQDKMWANYIRGVVKCLLARGYQFSGADISVSGNVPQGAGLSSSAALEVVIGQTFKVLFNLEISQAEIALNGQRAENEFVGCNCGIMDQMISAEGRENHAMLLDCRSLETEAVSMPEDMAVVIINSNKKRGLVDSEYNTRREQCEEAARIFGVKALRDVTIEQFNEKVSELDEMVAKRARHVITENDRTVEAAQALRAHDMKRMGELMAESHASMRDDFEITVKEIDTLVEMVKEVIGEQGGVRMTGGGFGGCIVAIVPPALVDEVKATVEAKYQAATGLKESIYVCQAKNGAGLVEVL

SEQ ID NO: 76247 - protein, 444 aa, Cryptococcus neoformans var. neoformans B-3501A
MAKSAKSAPAATVKVDKKDKKSKKDEKPVPAPAPAKAAKSLQKDVKEKKEKKSKKAKTPTPPPESSTSESEDSEEDSSDSESSSSEDEKPAAKTAAPAAKAKEEEPSTEESSDSDSESEEEFKTETKKEVNEESESDSDSDSGSDSNSSEDEDEKVEETKEEAKPQANGNKRKAEEESIAPAKKARADGGDEEATTNVFVGQLSWNVDNDWLKSEFESCGEVVSARVVFDRDSQKSRGFGYVEFADLESSAKAIEKDGSEIDGRAIRVNYATQRKPNEAAEKRARVFNDKQSPPAETLWIGSLSFSVTEDQVYEAFGQHGDVQSVRLPTDRDTGAPKGFGYVQFSSVDDASAALKAMNGAEIAGRAIRVDFAPPKQDNGERGGFGGGRGGGGFGGRGGGRGGGRGRGGFDRGGRGGGRGRGGPPRGGARTGGIVKPEGQKVTFD

SEQ ID NO: 76248 - protein, 622 aa, Oryza sativa Japonica Group
MAAASISRSLLRRSRCGGGEHHLLLLARGFVTAECHRPVVLHKRGSDILHDPWFNRGTGFSMTERDRLGLRGLLPPNVVSSQQQIDRFMLDMQRLQKYARDGPSDTYPLAKWRILNRLHDRNETMYYKVLIDNIEEHAPIVYTPTVGLVCQNYSGLFRRPRGMYFSAEDRGEMMSMVYNWPADQVDMIVVTDGSRILGLGDLGVHGIGIAIGKLDLYVAAAGINPQRVLPVMIDVGTNNEKLLKDPLYLGLQEHRLEGEEYVAIIDEFMEAVFARWPNVIVQFEDFQSKWAFRLLQRYRKTYRMFNDDVQGTAGVAIAGLLGAVRAQGRPMLDFPKQKIVVAGAGSAGIGVVNAASRTMARMLGNNEVAFESARSQFWIVDAHGLITEERTNIDPDARPFARRKSELGHQGLSEGASLVEVVKKVKPDVILGLSAVGGLFSKEVLEALKDSSSSRPAIFAMSNPTKNAECTPEEAFSILGEKIIFASGSPFSDVDLGNGKIGHSNQGNNMYLFPGIGLGTLLSGARVISDGMLQAAAERLASYMKEEEVLEGIVYPPISRIRDITKEVAAAVVKEAVAEDLAEGYRDMDARELARLSEEETVEYVQQNMWSPVYPTIVYKKD

SEQ ID NO: 76249 - protein, 320 aa, Physcomitrella patens subsp. patens
MEWGSVLILLLLSSVILFSEGHLSSDYYKSTCPNVERVVRSSLRRAFLLDPSAPASLLRLSFHDCQVEKCDASILLDSVSNDINGERESGGNFGIRRLDIIDRVKQDLEKECPGVVSCADIVAMAGRDAVSYTGGPEIPIPLGRKDATTASSENADDQLPPASSTVSTMLQVFSRYGMTAAETVGILGAHTLGIGHCVNVVDRLYPTRDPALSTGLYLQLRVLCPTKEPLNLTILPNDLSVYSFDNRYFKDVLGGRGLFRADANLVGDARTKPLVAKFASDQSLFFKTFASAYVKLVSAQVLTGSRGEVRTNCRRVNAQD

SEQ ID NO: 76250 - protein, 181 aa, Leptospira interrogans serovar Lai str. 56601
MMKSNNQILEYMGKKPQIHESVFLAPGSQVVGDVVIGKNSSIWFQTLVRGDVNYIRIGENVNIQDLTVIHVARDVYPVEIGNNVSIGHRATIHGCKLKDNSFVGMCATLMDDVEVGEFAFIGAGALVTPGKKIPPGVLVMGSPGKIIRDITDKEKEIIVRTTNNYIKYKENYMQDPFYNRG

SEQ ID NO: 76251 - protein, 279 aa, Streptococcus pyogenes M1 GAS
MVTTVKMTSGYEIPVLGFGTYQAADGEEAYQSTLAAIKAGYRHIDTAAIYKNEESVGRAIKDSGVLREDLFITTKLWNDAHSYEGAKDALAASLDRLGLDYVDLYLIHWPNPKALRNTWKEANAQAWQYMEEAVEAGLIKSIGVSNFMVHHLEALQETAKITPAINQIRLAPGCYQKEVVDYCKANEILLEAWSPLGQGEIFDNETMQQLANKYDKTVAQVALAWSLAEGFIPLPKSVHDERIKENMAIFDVSLTQEDKKTIRYLSGMSAIPNPDTTSF

SEQ ID NO: 76252 - protein, 397 aa, Sulfitobacter sp. EE-36
MNIHEYQAKALLRSYGAPVSDGRVVLKAEEAKTAAGEMDGPLWVVKAQIHAGGRGKGSFKEADAGDKGGVRLTKSVEEAAEEAKKMLGRTLVTHQTGPAGKQVNRIYIEDGSGIETELYLALLVDRQTSRIGFVCSTEGGMDIEEVAESTPEKIISFSVDPAAGFQPYHGRRVAFALGLEGKQVKQCVTLMGQLFKAFVEKDMEMLEINPLIVTDSGDLKVLDAKVSFDGNAMYRHGDIADLRDTTEEDPKELEASKYDLNYIALDGEIGCMVNGAGLAMATMDIIKLYGAEPANFLDVGGGATKEKVTEAFKIITSDPQVKGILVNIFGGIMRCDVIAEGVVAAVKEVGLQVPLVVRLEGTNVEEGKAIINNSGLDVIAADDLKDGAQKIVKAVKG

SEQ ID NO: 76253 - protein, 154 aa, Colwellia psychrerythraea 34H
MNIIEGSFEAKGKKFAIVVSRFNHFIVDSLLDGAVDALKRHGNVNDEDITIVRVPGAYELPLAAKKIAKKGEADAIIAIGAVIRGGTPHFDFVAGESNKGLAQVCLESEIPVSFGVITTDSIEQAIERAGTKAGNKGAEAALGALEMVNVLAQI

SEQ ID NO: 76254 - protein, 309 aa, Leptospira interrogans serovar Lai str. 56601
MKAKSILETIGNTPHVKINRLFNTKSEVYAKLERSNPGGSIKDRIALSMIEDAEKTGKLTKDSIIVEPTSGNTGIGLALVAAVKGYKLLLVMPESMSIERRRIMAAYGAEFELTPREKGMPGAIEKAKQIVAENPKAWMPQQFENEANIKIHVETTAQEIAKDFPDGLDYVITGVGTGGHITGVAQVLKQKFPKLKVFAVEPEASPVISGGKPGPHPIQGIGAGFIPKNLHTNLLDGTIQISKDEAFEYAQRAAKEEGLFIGVSSGAALAAVAKKLPEIPEGSRILTFSYDTGERYLSIEGLFPVPSNA

SEQ ID NO: 76255 - protein, 250 aa, Erwinia carotovora subsp. atroseptica SCRI1043
MAVTKLVLVRHGESQWNNENRFTGWYDVDLSEKGRSEAKAAGQLLKDEGFAFDFAYTSVLKRAIHTLWSVLDELDQAWLPVEKSWKLNERHYGALQGLNKAETAEKYGDEQVKQWRRGFAITPPELTRDDERFPGHDPRYASLSDKELPQTESLALTIERVVPYWTETILPRIKSGERVIVAAHGNSLRALVKYLDNMGEDEILELNIPTGVPLVYEFDENFKPIKRYYLGNADEIAAKAAAVANQGKAK

SEQ ID NO: 76256 - protein, 227 aa, Morus bombycis
MACKQRLRFGRFFYVSAVVMVIIAASFASTCGGSGVGHVPSTTEEGRDFEEVKERAQQTQNKAAETAKEANEASETWTDWAKEKISEGLGFNKDADAKDAPKKASDTVSDTAKKSEEVASETGEYSADKARSATERAAAETISGAKEKAYDTAKSAEEKAYETAQKAKEKVYDSTGTAKEVKDKEKADEGYDAAKHKGEETLESAKDKTQHLKDKVAGGGRGRDEEL

SEQ ID NO: 76257 - protein, 850 aa, Brassica napus
MKGIRKNYENSYTLSFLLVFFVLILLPPAFSINTLSSEESLTISSNRTLVSRGDVFELGFFKTTSSSRWYLGIWYKKFPYRTYVWVANRDNPLPNSIGTLKISNMNLVLLDHSNKSVWSTNLTRRNERTPVMAELLANGNFVMRDSNNNDASEFLWQSFDYPTDTLLPEMKLGYNLKKGLNRFLISWRSSDDPSSGDYSYKLEPRRLPEFYLLQGDVREHRSGPWNGIRFSGILEDQKLSYMEYNFTETSEEVAYTFRMTNNSFYSRLTLSSTGYFERLTWAPSSVVWNVFWSSPNHQCDMYKICGPYSYCDVTTSPVCNCIQGFRPKNRQQWDLRISLRGCIRRTRLSCSGDGFARMKYMKLPETTMAIVDRSIGVKECEKRCLSDCNCTAFANADVRNGGTGCVIWTGRLDDMRNYVPDHGQDLYVRLAAADLVKKSNANGKIISLIVGVSVLLLLIMFCLWKRKQNREKSSAASIANRQRNQNLPMNGIVRSSKRQLSGENKIEELELPLIELEAIVKATENFSNSNKIGQGGFGIVYKGILLDGQEIAVKRLSKTSVQGVDEFMNEVTLIARLQHVNLVQILGCCIDADEKMLIYEYLENLSLDSYLFGKTRRSKLNWKERFDITNGVARGLLYLHQDSRFRIIHRDLKVSNILLDRNMVPKISDFGMARIFERDETEANTMKVVGTYGYMSPEYAMGGIFSEKSDVFSFGVMVLEIITGKRNRGFDEDNLLSCAWRNWKEGRALEIVDPVIVNSFSPLSSPFQLQEVLKCIQIGLLCVQELAENRPTMSSVVWMLGNEATEIPQPKSPGCVRRSPYELDPSSSRQRDDDESWTVNQYTCSVIDAR

SEQ ID NO: 76258 - protein, 122 aa, Oryza sativa Japonica Group
MSSVFSGDETAPFFGFLGAASALIFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVR

SEQ ID NO: 76259 - protein, 329 aa, Physcomitrella patens subsp. patens
MVYSMWHLRTCLRQNGLSNVFKKARTVTPDVYSSPRYCHRSSLHRESSTCPSWGDRFAGKVVVVTGGASGIGEATARLFAKNGAYVVIADINTEGGSQLSSELGSQAQFVHCDVRKERDVASLVDEAVRWKGKLDVYFSNAGFVGALGSIDELNLDDFDETLAVNLRGAVVGIKHATRVMKPVKSGAIVCTGSTASQMGGLGPHTYCVSKTALKGLVRSTALELRSYGIRVNMVSPDATATPMFQRVMEDSTGEPYTLEQIKERMAKKALLPNRPLTSLDVANAVLFLCSDEAGYISGHNLLLDAARTVGLPIPPGFSHWFEGYSPILK

SEQ ID NO: 76260 - protein, 223 aa, Morus bombycis
MACKQRLRFGRFFYVSAVVMVIIAASFASTCGGSGVGHTTEEGRDFEEVKERAQQTQNKAAETAKEANEASETWTDWAKEKISEGLGFNKDADAKDAPKKASDTVSDTAKKSEEVAAETGEYSADKARSATERAAETVSGAKEKAYDTAKSAKEKAYETAQKAKEKVYDSTGTAKEVKDKEKADEGYDAAKHKGEETLESAKDKTQHLKDKVAGGGRGRDEEL

SEQ ID NO: 76261 - protein, 680 aa, Staphylococcus aureus subsp. aureus COL
MKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVASQQQSKEADNSQDSNANNNLPSQSRIKEAPSLNKLDQTSQREIVNETEIEKVQPQQNNQANDKITNYNFNNEQEVKPQKDEKTLSVSDLKNNQKSPVEPTKDNDKKNGLNLLKSSAVATLPNKGTKELTAKAKDDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNHDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTKATDKIQKGIWQVTPTKHDWDHVDFVGQDSSDTVRTREELQDFWHHLADDLVKTEKLTDTKQA

SEQ ID NO: 76262 - protein, 479 aa, Zea mays
MSVQEYLEKHLLSRKIEEAVNAAVRAKAPDPVLFIAGHMRRAAPAVITRVRARQILDGHGAPAVEVELHTNKAIHRASAAGSGALEGAAADAAGAAERRKILAKVVADSVRMINDKVSEALVGMDPQEQSQIDQAIMDLNKARHKAELGVGANAMLAVSIAACKAGAAEKEVPLYKHIANLVGKSATTLPVPAITVINGGKHAGNGLPIQEIMILPIGAKNFEEAMQMGSETYHHLKDVILEKYGSDSCNIGDHGGFAPNISSISEGLDLVIAAIERAGYNGRIKLAIDVAATDFCTGKKYDLEFKSTKKSGQNFKTADDMIEIYSQLCSEYPLVSIEQPFDKDDWEHSKKLTTLELCQVAGDDLLMSDPERIKRAVNEYTCNALVLKANQVGTVTEAIEVVKQAKDAHWGVMVSHRSGDTEDSFIADLAVGASAGQIKAGAPCRGECLTNYNQLLRIEGELGSEGVYAGENWRTVNTS

SEQ ID NO: 76263 - protein, 511 aa, Manihot esculenta
MSVAILTSLPPQWLSILAVFLLPILTLLLFRGKDDNQKKGLKLPPGPRQLPLIGNLHQLGGQPYVDFWKMAKKYGPVMYLQLGRCPTVVLSSTETSKELMKDRDVECCSRPLSVGPGQLSYNFLDVAFSPYSDYWREMRKLFIFELLSMRRVQTFWYAREEQMDKMIEILDGAYPNPVNLTEKVFNMMDGIIGTIAFGRTTYAQQEFRDGFVKVLAATMDMLDNFHAENFFPVVGRFIDSLTGALAKRQRTFTDVDRYFEKVIEQHLDPNRPKPETEDIVDVLIGLMKDESTSFKITKDHVKAILMNVFVGGIDTSAVTITWAFSELLKNPKLMKKAQEEVRRAVGPNKRRVEGKEVEKIKYIDCIVKETFRKHPPVPLLVPHFSMKHCKIGGYDILPGTTIYVNAWAMGKDPTIWENPEEYNPDRFMNSEVDFRGSDFELVPFGAGRRICPGLAMGTTAVKYILSNLLYGWDYEMPRGKKFEDFPLIEEGGLTVHNKQDIMVIPKKHKWD

SEQ ID NO: 76264 - protein, 349 aa, Triticum aestivum
MGSLPVPSVQALVAATGGDDVPLRYLRPEAAAEAVTGDADGEAQIPIIDHQRLLLELDHGGEESARLHRACQDWGFFQLVNHSVPDDVVESMKANIQQFFQLSAETKKRFAQEQGQLEGYGQLFVVSEDQKLDWADMLFLYTQPPEMRNTKFWPDQPAAFRSALDRYSDAVKDVSDSLLATMAKNLGLKREAIADKCIRGMQKVRINYYPPCAQPEKVVGLSPHSDANVLTLVLQVNHVQGLQIKRNGSWLPVKPVPGAFIVNIGDMFEVFTNGRYRSIEHRAVVDPKEERLSVAAFHLPNIHATIGPLKELTAQEDDAYKTLDLESFMKIFFATKLEGKSFLEQMKLN

SEQ ID NO: 76265 - protein, 384 aa, Oryza sativa Japonica Group
MASATLLKSSFLPKKSEWGATRQAAAPKPVTVSMVVRAGAYDDELKTIASPGRGILAMDESNATCGKRLASIGLENTEANRQAYRTLLVTAPGLGQYISGAILFEETLYQSTVDGKKIVDILTEQKIVPGIKVDKGLVPLAGSNNESWCQGLDGLASREAAYYQQGARFAKWRTVVSIPNGPSELAVKEAAWGLARYAAISQDNGLVPIVEPEILLDGEHGIDRTFEVAQKVWAETFFYMAENNVMFEGILLKPSMVTPGAECKDRATPEQVSDYTLKLLHRRIPPAVPGIMFLSGGQSEVEATQNLNAMNQGPNPWHVSFSYARALQNTCLKTWGGQPENVKAAQDALLLRAKANSLAQLGKYTSDGEAAEAKEGMFVKNYVY

SEQ ID NO: 76266 - protein, 339 aa, Erwinia carotovora subsp. atroseptica SCRI1043
MNVLVTGGSGYIGSHTCVQLLAAGHTPVILDNLCNSKASVVKTITRLTDKTPIFYQGDIRDSALLDDIFAKHAIDSVIHFAGLKAVGESVREPLSYYDNNVYGTLVLVEAMKKAGVRSLIFSSSATVYGDQPHTPYQESFPTGQPASPYGRSKLMVEQILQDLQHAEPEWSITLLRYFNPVGAHPSGEMGEDPQGVPNNLMPYIAQVAVGRRDSLAIFGNDYPTVDGTGVRDYIHVVDLADGHIAAMNTLQNRAGVHIYNLGAGVGYSVLQVVEAFSQACGKPLAHHFAPRRQGDLPAYWADAERAAKDLNWRVTRSLQEMAQDTWRWQSNHPNGYEEA

SEQ ID NO: 76267 - protein, 205 aa, Oryza sativa Japonica Group
MASATLLKSSFLPKKSEWGATRQAAAPKPVTVSMVVRAGAYDDELVKTAKTIASPGRGILAMDESNATCGKRLASIGLENTEANRQAYRTLLVTAPGLGQYISGAILFEETLYQSTVDGKKIVDILTEQKIVPGIKVDKGLVPLAGSNNESWCQGGHVRQELRLLIRSNPIKTVNLLLLLLRTTATAILLVPRGHCSQCVVTVTG

SEQ ID NO: 76268 - protein, 506 aa, Vibrio cholerae
MIYPIPNSETSTVHFKDVYDNYIGGQWMKPHSGEYFSNTSPVNGLVFCRVARSSSQDVELALDAAHNALESWSTTSAVERSNILLRIADRIESNLETLAIVESWDNGKPIRETLAADLPLTIDHFRYFAACIRSQEGAASELDSRTLTYHLPEPIGVVGQIIPWNFPLLMAAWKLAPALAAGCTVVLKPAEQTPVSILFLMEIIGDLIPAGVINVVNGFGSEAGNALATSQRIDKLAFTGSTEIGNHILKCAADNLIPSTIELGGKSPNIYFPDIFSHEDQYLDKCIEGALLAFFNQGEVCTCPSRILVHESIYEKFIAKIIERVALIKQGNPLDTETQIGAQVSKEQYDKILGYIQIGKDEGAELIFGGHPNNQENYLSGGYYIKPTLFFGHNQMHIFQEEIFGPVIAITKFKDEIEALHLANDTVYGLGAGVWTRDINIAHRMAKNIKAGRVWVNCYHAYPAHAAFGGYKKSGIGRETHKLTLSHYQNIKNVLISHEIHPLGLF

SEQ ID NO: 76269 - protein, 533 aa, Helicobacter pylori 26695
MLQTINLTQRYATKKLFENVNIKLDKNKRYGLIGANGAGKSTFLKILSKSIDCSSGEVIITSGMKMGVLGQDQYAFEDLSLKDAVLIGNKRLYDAIKEKERLYTEGDLSDDKVNARLGELETICVEEDPMYECEVAIEKILEDLGIPSSKHNDLMKTLPSSDKFKILLAQVLFPKPDILLLDEPTNNLDLNAIEWLENNLKRHEGTMVVISHDRHFLNAVCTHILDLDFHSVREFSGNYDDWYIASTLIAKQQEAERNKKLKEKEELEKFIARFSANASKAKQATSRQKQLDKLDIQSLAVSSRRDPSIIFKPKRTIGNEALECENISKSYDDQIVLNQVSLKVMPKDKIALIGPNGVGKSTLCKILVEELKPDKGVVKWGATVSKGYFPQNVSEEISGEETLYQWLFNFNKKIESAEVRNALGRMLFNGEEQEKCVNALSGGEKHRMVLSKLMLEGGNFLVLDEPTNHLDLEAIIALGEALFKFDGALICVSHDRELIDAYANRIIELVPSPKGASIIDFKGSYEEYLASKK

SEQ ID NO: 76270 - protein, 394 aa, Triticum aestivum
  misc_feature (221)..(221): Xaa can be any naturally occurring amino acid
MATNGYSNGGSTKGKPIKCKAAVAWGPGEPLVMQEVEVAPPARMEVRVKVLYTSICHTDLSFWRGENERQRRFPRIFGHEAAGVVESVGEGVEDLAPGDHVVPIFNGECGTCAYCHSSATNLCGTYRVDAFKSTMVSDNGTRFSVVNTSGDTVPVYHFLNTSTFAEYTVLDAACAVKINPAAPLEKMCLLSCGISTGVGAAWNTANVSKGSTVAIFGLGAXGLAVGEGARIRGASQIIGVDINPEKFAKGKEMGITDFVNSKACGKPVHEVIRELTDGGVDYSFECSGNVDVLREAFVSTHDGWGLTVVLGIHPTPRMMPLHPMELFDGRRITGCTFGDFKGKSQLPLLVDQCMQGEVKINFDGFITHEMPFSEINEAFRLLEEGKSLRCVLRL

SEQ ID NO: 76271 - protein, 1126 aa, Ralstonia metallidurans CH34
MQLDARALHSGLHPGGTASIPHGIEPVKKLLIANRGEIALRVQRAAQDLGIATVAVYATDDAQSRHRQLADEAIALPGNGPATYLDIDAILGAARAAGCDAIHPGYGFLSERADFAQACAAAGITFVGPTPEQLALFGDKGRALELAAQCDVPVMPATPGGASLDDVRAFFAAQQGNGIVLKAVGGGGGRGMRVVRDAEALAEAYARCQSEARSAFGIEAIYAERLVERARHIEVQIIGDGTETIALGERDCTLQRRFQKLVEIAPSPVLTPALRDRIVQAASRIAKHTGYRSLGTFEFLVETDDAGTPHGFVFIEANPRLQVEHTITEQVTGLDLVALQLGLADGRSLRDLGLDPAAPPTARGFSVQLRINAEATDAQGQARPALGRLERFDPPTGPDVRVDTHGYTGYAPPAGYDSLLAKLIVSTSSPRFEDVVRRVRRALGECRVDGVPSNLDLLRALVAREDFATQHVHTRHFEAILPELLTAAQRVAASDAARQASIGIAQTAPVPVPTATAEAIDEGLVAVRAPMNGRVVEMRVQEDDIVQPGQIVAILDAMKMEHTIAAECAGRVIDVRVGATGQTVEGQILLVLEPVADAGVAHHRSEAADPRAIRPDLQRVRDRDAFLDDAARPDAVAKRHARGQRTARENVADLCDAGSFVEYGAYAVAAQASRRSAEDLIANTPADGLITGTGRINGTRFAPERARCAVLAYDATVLAGTQGKRNHIKTDRILQVAAEQKLPTVIFAEGGGGRPGDVDFPTVAGLYQPSFAAFAALSGEVPVIGIAAGRCFAGNAALLGCSDVIIATRDANIGMAGPAMIEGGGLGVYRPEDIGPAAVQYQNGVVDLLVDDEAEAVRAAKHYLSMFQGRTQDWEAPDALMLRGVVPENRLRVYDTRAAIQGIADVGSVIELRAGYGTGVHTALARIEGRPVGIVANNPRHLGGAIDVDGADKAARFMQLCDTHGLPIVSLIDTPGFMVGPEIEARAQVRHVSRLFVLGAKVRVPFMAVVLRKGYGLGAMAMAAGGFRAPAFTISWPTGEFGGMGLEGAVRLGFRKELEALPAGPERDALYQQLVAQMYERGHAINAAAGLEIDAVIDPAETRRWLLAGLDAAPRDEAPRRYVDAW

SEQ ID NO: 76272 - protein, 189 aa, Brassica napus
  misc_feature (115)..(115): Xaa can be any naturally occurring amino acid
  misc_feature (170)..(170): Xaa can be any naturally occurring amino acid
  misc_feature (179)..(179): Xaa can be any naturally occurring amino acid
MDDWEDEQLAPIPAKVELKSNWDDEDVDENDIKDSWDDDDDVDEPAPVKPATEKTPPKKAASKAVEKKGKAADVPKQAPKEEPLDPISEKLRMQRLVEEADYKATAELFGTKGEXKNLDVFIPKSESDFLEYAEMISHKLKPYEKSYHYIALLKAVMRLSLTNMRAADVXKDVASPVTXIANEKLKVEK

SEQ ID NO: 76273 - protein, 337 aa, Nicotiana tabacum
MAKVKIGINGFGRIGRLVARVALQRDDVELVAVNDPFISVEYMTYMFKYDSVHGQWKHHELKVKDDKTLLFGEKAVTVFGFRNPEEIPWGQTGADYIVESTGVFTDKDKAAAHLKGGAKKVIISAPSKDAPMFVVGVNEKEYKPELNIVSNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEATYDEIKAAIKEESEGKLKGILGYTEDDVVSTDFVGDNRSSIFDAKAGIALSKNFVKLVSWYDNEWGYSTRVVDLIKHMASVQ

SEQ ID NO: 76274 - protein, 330 aa, Helicobacter pylori 26695
MRYIDDELENQTILITGGAGFVGSNLAFYFQENHPKAKVIILDKFRSNTLFSNKRPSSLGHFKNLIGFKGEVIAADINNPLDLRRLEKLHFDYLFHQAAVSDTTMLDQELVMKTNYQAFLNLLEIARSKKAKVIYASSAGVYGNTKAPNVVGSNESPENVYGFSKLCMDEFVLSHSNDNVQVGLRYFNVYGPREFYKEKTASMVLQLALGAMAFKEVKLFEFGEQLRDFVYIEDVIQASVKAMKAQKSGVYNVGYSQARSYNEIVSILKEHLGDFKVSYIKNPYAFFQKHTQAHIEPAILDLDYTPLYDLESGIKDYLPHIHAIFKGQCA

SEQ ID NO: 76275 - protein, 530 aa, Vibrio campbellii AND4
MCSFAHKEVKFMSIQQNASTTNSSPTLDMIVIGGGINGAGIAADAAGRGLSVGLYEANDFASATSSASSKLIHGGLRYLEHYEFRLVSEALAEREVLLRKAPHIASPMRFRLPHRPFLRPAWMIRCGLFLYDNLGKRTTLPGSKTIDLAKSGLLKPEMKTGFEYSDCWVDDARLVLLNVLAAKENNAEVRNYCRVEKAHREGGVWHVTIHDMTTDQRFERKAKTLVNAAGPWVKQFFDDGLDQTSPRNIRLIKGSHIVVPRIHDEPQAYILQNKDNRIVFMIPYLDQFSIIGTTDVEYKGDPREVAISDGEVDYLIDVVNQHFVQQLSKEDVVWTFSGVRPLCDDESDSPQAITRDYTLELDAEYDHAPLLSVFGGKLTTYRKLGEAALNKLAPFLPEMGKDWTANQALPGGNFSCSREQLVKMIHAKYTWASESMLLRYVTQFGTRTWDLMEGANDAEDLGHCFSDQASGVYQREIDYLINHEMARTDEDILWRRTKLGLYLAEEEKLALADYLKDKLQQKVVSLSQVS

SEQ ID NO: 76276 - protein, 622 aa, Cryptococcus neoformans var. neoformans B-3501A
MFFRLRRFGLLHRPRSPTACISPISYSFASPSHLNFSGKFRICSRPLHQSSAALKLSPFKLHDIGEGITEVEILKWHVTDGQAVEEFDALCEVQSDKSVVELTSHAKGIVRDIKTDPGHMVKVGTVLCVIETDEPSEDAAEDDLQAPPQLDNAQDSVEDNTKSPTLGVQPQKLSGQDEIRAHESATVAQAEDLSEELERASERESPPPTPSASRRKHPLADADKDEDDRFSETETLFRAHDASMDASGPTKLSGEAAILPSASRREPEQYTGPVPERRSQPVGDRERAVIKAAPAVRTLALRLGIDLSQVTPSGEGGRVVREDVFSAANTTAGVENQSAQVKKYNTQATSNKSEVIEQETTRVEFGRTRKVMFKALSEQAKIPHFGYSHTLDLTALIPYLKSKPFSPSKPSYTASDIPSSLIHEDEAIPEVGKNAKPTLLTFLIKTILLALEEHPIMRSRVKHGTDGTEKWLEVNPKYGLLTPSLPPLNPSTPIPILTNHLTHLRQTAHRPSSQEGAHLTVSSVGGLGECSGASPILPPGGGLAICAVGRAKWEVEWVKKEGGKVFDLGVEDVKSAGLKAVLRVPVGWSADHRVLEGAELISFTETWKKYIEEPWRWMKFSG

SEQ ID NO: 76277 - protein, 458 aa, Nocardioides sp. JS614
MTGPTTRADIVVVGMGVGGEAVAGSLAEAGLDVVGIEAELVGGECPYWGCIPSKMMIRAANLIAEASRIPGMSGTVDVRPDWTPVADRIRHEATDDWNDQVAVDRFTGKGGRFVRGAATVLGPRSVSVEGVGVIEARRGIVLATGTSSVAPPIDGLADTPFWTNREAVSAKDLPASLVVLGGGAIGVEIGQAFARFEVEVTVVEAAERILPAEEPEVSALLADTFRSEGITVLAGRAATQVGYAGGTFAIRLDNGDDVTAEGLLVATGRRPQVAPEMLRALELEPGLRALPVDERMRVADGVWAVGDVTGKGAFTHVATYQADLVVADVLGRPTPEAEYRALPRVTFTDPEVGSVGLSEAQAREQGLAVAVGTANLQHTARGWLHKAGSHGLIKLVMDTDTGLLVGATSAGPVGGEVLGALAVAIHGRVPVEQLRHMIWAYPTFHRGIQDALRDLPIG

SEQ ID NO: 76278 - protein, 187 aa, Kluyveromyces lactis NRRL Y-1140
MSITEYATELKGALRQYPNFPQEGILFEDFLPIFRDPQLFKKLIESFKLHLQEKFTGKKIDYVIGLEARGFLFGPALALALDAGFVPVRKQGKLAGEVVHAVYAKEYGEDVFEIQADSIPEHSNVVIVDDIIATGGSAKAAGDLALQLNANILEFCFVMELDFLKGTQKLQAPSFTLLSGQEEALSK

SEQ ID NO: 76279 - protein, 775 aa, Xanthomonas campestris pv. campestris str. 8004
MRPTQPMSNDDFKQAALDYHRQQPAGKIKVTATKPMLTQRDLSLAYSPGVAFACEAIVEDATQASELTARGNLVAVITNGTAVLGLGNIGPLASKPVMEGKGVLFQKFAGIDVFDIEINENDPDKLVDIIASLEPTFGGINLEDIKAPECFIVERKLRERMNIPVFHDDQHGTAIIVGAAVLNALVVTGKKIEDVKLATTGMGAAGISCVNMLVSLGLKSENILALDRDGVIHTGRTDLDPDKQRYARDTDKRTLAEIVEGADIFLGLSAAGILKPEMVATMARQPVIFALANPNPEITPEAAKAVRPDCIIGTGRSDYPNQINNVLCFPYLFRGALDVGATGINEDMKIACVKAIAAMARREASDLGAAYGGETPSFGPEYLIPRPLDPRLLVELSSAVAQAAMDSGVATRPIADMAAYRDRLSQFVYRTSLMMKPVYDRARADKQRVVYAEGEEEVVLRAVQNVIDEGLALPILIGRPDVIEARIQRMGLRIRAGEDFEITNIHDDPRFNDYWQYYYALTERRGVTVTAAKELMRSRPTLIAAVMVARGEADAMLSGVVGRFHKKLGYARSVIPLEPRVSSTSAMTGVINQQGVFFFLDTHVQEDPTVEQVVEATLQAAYRLKLFGIEPNIALLSHSNFGSHDSRDALKMREVREALLKRKPELNIDGEMQGDTAWDEALRKQIMPNSTLKGRANLFVLPNLEAANIAYNLVRVFTDGVAIGPILMGISKPVHILTTSATSRRVMNMTAIAAVDAQIRKQRDAEKHNAEKNGG

SEQ ID NO: 76280 - protein, 231 aa, Oryza sativa Japonica Group
MVPRSRRPCLARGGILPAGRTVVSIPNGPSELAVKEAAWGLARYAAISQDNGLVPIVEPEILLDGEHGIDRTFEVAQKVWAETFFYMAENNVMFEGILLKPSMVTPGAECKDRATPEQVSDYTLKLLHRRIPPAVPGIMFLSGGQSEVEATQNLNAMNQGPNPWHVSFSYARALQNTCLKTWGGQPENVKAAQDALLLRAKANSLAQLGKYTSDGEAAEAKEGMFVKNYVY

SEQ ID NO: 76281 - protein, 220 aa, Oryza sativa Japonica Group
MASATLLKSSFLPKKSEWGATRQAAAPKPVTVSMVVRAGAYDDELVKTAKTIASPGRGILAMDESNATCGKRLASIGLENTEANRQAYRTLLVTAPGLGQYISGAILFEETLYQSTVDGKKIVDILTEQKIVPGIKVDKGLVPLAGSNNESWCQGLDGLASREAAYYQQGARFAKWRTVVSIPNGPSELAVKEAAWGLARYAAISQVHIKLDYRTKTART

SEQ ID NO: 76282 - protein, 425 aa, Streptomyces lavendulae
MDTEQVTAVVIGDVALIVVASWLLGALARRLGQPTVIGQIVAGIALGPTLLGRLPGDPTKTLFPPEVLPFLTVLSQVAVVIFMFLAGYEINYRQLRSGGRSVLAVAALALLVPAGLSTGAVTLLEGMFTAVEPDAGGRTFVMFMAVACSVTALPVLVAIVRERGMAGTSTGTVATTAAGVMDVAAWLVLAAAFAGTAHSSGPSWLQALVLIVLFSAVMFLVVRPLLDRLLRRSESRLLSPVPLALGLALGSAWVTSMLGLHPVFGGFLAGLVMPRRNEVPDAEVLQPMEQTAAVLLPLFFVTTGLKFDIGTLDTDGLVLLALILGIAVLGKLGPAYAACRFTGLGPHQSARVAALVNTRGLTELIVLNVALEAGVIGPGLFTVLVLMALITTFMTGPLLTLIGRKERPEKEIGRVDEPVGRIQAQ

SEQ ID NO: 76283 - protein, 178 aa, Glycine max
  misc_feature (83)..(83): Xaa can be any naturally occurring amino acid
  misc_feature (86)..(86): Xaa can be any naturally occurring amino acid
  misc_feature (98)..(98): Xaa can be any naturally occurring amino acid
  misc_feature (113)..(113): Xaa can be any naturally occurring amino acid
  misc_feature (137)..(137): Xaa can be any naturally occurring amino acid
MASSMISAPAGTTVNRAGAGMVATFTGLKFMAGFRTRKTNSVITCIASNGGRVQCMQAWPPVGTKKTETLSYLPDLDDAQLAXKYXYLLRKGWIPCLXFELEHGLVFRDHNRXPRYYDGLYWTMSNLSIYSFADAFXVLNELHDAKTAYPNSFIHIIGFYNIHQLHYISFISYIPAVF

SEQ ID NO: 76284 - protein, 158 aa, Chromobacterium violaceum ATCC 12472
MFRIGQGYDVHQLVEGRPLILGGVDIPHDKGLLGHSDADALLHAITDALLGAAALGDIGRHFPDTAAEFKGADSRALLREAAARVRAAGWRPVNVDSTLIAQRPKLAPHIDAMRANIAADLGLDVGAVNVKGKTNEKLGYLGRCEAIEAQAVCLLAQA

SEQ ID NO: 76285 - protein, 290 aa, Zea mays
MGKDDVIESGAGGGEFAAKDYTDPPPAPLIDAAELGSWSLYRAVIAEFIATLLFLYITVATVIGYKHQTDASASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGFGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKALGSFRSNA

SEQ ID NO: 76286 - protein, 109 aa, Populus trichocarpa
MASSLLRSLVSRSRSRSSNVGAALSTRNYSLVTNQISNHTAKWMQDTSKKSPMELINEIPPIKVEGRIVSCEGDTDPALGHPIEFICLDLKEPAVCKYCGLRYVQAHHH

SEQ ID NO: 76287 - protein, 569 aa, Prochlorococcus marinus subsp. marinus str. CCMP1375
MIRLEKVSKIYPTAEVLKEITWEIKPSQRIGLVGVNGAGKSTQLRIIAGLEEVSSGEVLYEGQPRIAYLQQEFDVDVNRTLREELFQAFADAAEVLIEINKIEQQMNSEKAKSDDQFLNSLIKQLGTLQMRFEALHGYELEAQIEKLLPQIGFFSDDAERLVGDFSGGWQMRVALGKILLQEPDLLLLDEPTNHLDLETIEWLEKYLLKQTAAMVIISHDRSFLDRICTNIVSTERGISRTYNGNYSDYLNQKELESESIKAAFDRQQKELTAQQDYIERFRASATRSTQAKSREKLLNKLDKIEAPISELKKPNFSFPKAPRSGKSVVRVDDLTHTYNDKIIFLGAKLHIETGDHIAILGPNGAGKSTLLRLIIGKEKAEDGLVELGRHNVIPSYFEQNQSEALELSKTVLDTLFDVVPDWSNTKVRSLLGSLGFSNDDVFKKVADLSGGEKARVALALIIVKPCNLLLLDEPTNHLDIPAKEMLEEAIKNYEGSLVVVSHDRYFISKVANRIVEIRDGQLIFYSGNYDYYKDKKRQQIEKEKALLDEAKKEAKRIAKRKLQRKSKKK

SEQ ID NO: 76288 - protein, 219 aa, Chromobacterium violaceum ATCC 12472
MLTQDQLKLAVAKKALEFVPEDAIIGVGTGSTVNLFIEELAGIKGRIKGAVSSSEASTARLKAHHIQVFDLNEVEKLSVYIDGADEINHHLHMIKGGGAALTREKIVAGVADEFICIADEKKYVTMLGAFPLPIEVIPMARSYVARELVKLGGHPELRQGVTTDNGNVILDVHGLQIMKPVELEETINHIAGVVTCGLFARRRADVLLLGKQDGVEVLR

SEQ ID NO: 76289 - protein, 122 aa, Crocosphaera watsonii WH 8501
MKTKIETWKCVEGCGACCNLDPSDRPDLEDYLTPEELDHYLSLVGEKGWCINFEQETRKCLIYEQRPRFCRVQPDSFQEMYDIDPSEFNDFAIECCRQQIEGVYGGKSTEMKHYNREITQIN

SEQ ID NO: 76290 - protein, 451 aa, Oryza sativa Japonica Group
MKRVSSHVSIASEAEINLDLSRLLIDKPRLTLERKRSFDEQSWSELSHRQNDGFDSIMHSPAFPSGFDSPFSLGTLGDPHPLVNEAWEALRKSVVYFRGQPVGTIAAVDHASEEVLNYDQVFVRDFFPSALAFLMNNETDIVKNFLLKTLHLQSSEKMVDRFKLGAGAMPASFKVDRNRNRNTETLVADFGESAIGRVAPVDSGFWWIILLRAYTKYTADTSLAESPECQNCMRLILNLCLSEGFDTFPTLLCTDGCSMIDRRMGIYGYPIEIQALFYMALRCALQMLKPDGEGKDFIEKIGQRLHALTYHMRNYFWLDFPHLNNIYRYKTEEYSHTAVNKFNVIPDSIPDWVFDFMPCRGGYFLGNVSPAMMDFRWFALGNCIAIISSLATPEQSVAIMDLIEERWEELVGEMPLKICYPAIENHEWRIITGCDPKNTRWSYHNGGSWPG

SEQ ID NO: 76291 - protein, 532 aa, Physcomitrella patens subsp. patens
MAAATACVSTGCCSITSAREGYGRQQQGSPSNAAAKSLSRSSFCGDKVAASLKAQAWLPATPKRQNAAMGPIQVSSVLAELDEALEDGTEEKARVDPRTVLSIILGGGAGTRLYPLTKRRAKPAVPIGGAYRLIDVPMSNCINSRINKVFILTQFNSTSLNRHLARTYNFGKINFGDGFVEVLAATQTPGDRGADWFQGTADAVRQYLWLFEDAKNKVVEDVVILSGDHLYRMDYMDFVQKHRDSGADITISCVPMDDSRASDYGLMKIDDEGRVLYFNEKPKGDALKSMQVDTTVLGLTPEEAAAKPYIASMGIYVFKKDVLLKLLRWRYPTANDFGSEIIPASAKEFNVQAYLFNDYWEDIGTIKSFFDANLALTSQPPQFSFYDATKPIFTSPRYLPPTKIEQCQVVDSIISHGCILKGCSVNHSIVGIRSRLQEGIVLKDTMMMGADFYQTEEEVAQLLKAGKIPLGVGENSRISNCIIDKNARIGKNVVIANTDNVQEASRPEEGFYIRTGVTVIEKNGIVKDGTVI

SEQ ID NO: 76292 - protein, 536 aa, Debaryomyces hansenii CBS767
MRGALETITNFILESKEDLIQDPIRGKLCVIHNLFNKYNEKNGTGSSYTFLAFISLVLKLYEISGRALEFDIDLQEYNWNETTTSITEPCLKWINWQRLAILKERLNSLQIKESTYKESNQLSMDQYKSKYDFLISFLEQPLQTTIKEERPTNYGSNLEVNIDLPMLDNLLTKPIALISLAQEKVQLKTRSKPYYEICDDPHHSHILSSVCLKRELLKLGLPELLYVHKIIHQAHNVVQPEILKCSQTKIHYLPILNNHTDLYLGDCSYLDTCHKMKTCRYLHYYSLFPITTKQDDHEQGITKRPSDHEYTVGECYTEYQRKQIPAQWINCDVRYLPFLILGKFAVIVSDPAWDIHMSLPYGTCKDFELLSLPMHELQDEGLILLWVTGRAIEIGRQALQNWGYTIADEMIWIKLNQLKRTIVTGRTGHWLNHSKEHLLVGIKGDPPWINRLMDIDVIVSGTRETLRKPDEIYDIVERIVGTHSRKLEIFGRDHNVRPGWLSMYKIYQKLSIRILTYFKPSEISYRERLSTKRKFR

SEQ ID NO: 76293 - protein, 222 aa, Francisella tularensis subsp. tularensis SCHU S4
MKHIQINPSILSADLARLGDDVKAVLAAGADNIHFDVMDNHYVPNLTFGPMVLKALRDYGITAGMDVHLMVKPVDALIESFAKAGATSIVFHPEASEHIDRSLQLIKSFGIQAGLALNPATGIDCLKYVESNIDRVLIMSVNPGFGGQKFIPAMLDKAKEISKWISSTDRDILLEIDGGVNPYNIAEIAVCGVNAFVAGSAIFNSDSYKQTIDKMRDELNKV

SEQ ID NO: 76294 - protein, 499 aa, Populus trichocarpa
MSEPASKAFLLFLTLIFLFFTSTLPRDLPDATTTTTTTILDVASSLQQAHNILSFDLQTQKSSTHTTITTSTPSFSNSSLSFSLELHPRETIYKIHHKDYKSLVLSRLHRDTVRFNSLTARLQLALEDISKSDLKPLETEIKPEDLSTPVTSGTSQGSGEYFTRVGVGNPARQFYMVLDTGSDINWLQCQPCTDCYQQTDPIFDPTASSTYAPVTCQSQQCSSLEMSSCRSGQCLYQVNYGDGSYTFGDFATESVSFGNSGSVKNVALGCGHDNEGLFVGAAGLLGLGGGPLSLTNQLKATSFSYCLVNRDSAGSSTLDFNSAQLGVDSVTAPLMKNRKIDTFYYVGLSGMSVGGQMVSIPESTFRLDESGNGGIIVDCGTAITRLQTQAYNPLRDAFVRMTQNLKLTSAVALFDTCYDLSGQASVRVPTVSFHFADGKSWNLPAANYLIPVDSAGTYCFAFAPTTSSLSIIGNVQQQGTRVTFDLANNRMGFSPNKCQ

SEQ ID NO: 76295 - protein, 339 aa, Francisella tularensis subsp. tularensis SCHU S4
MNKKILVTGGVGYIGSHTVVELLDRDYQVVVVDNLSNSKVSVIDRVKKITNKDFDFYQLDLLGKAKLTKVFQEYDIYAVIHFAGFKAVGESVEKPLEYYHNNIQGTLNLLELMQEYKVYNFVFSSSATVYGMNNKPPFTEDMPLSTTNPYGATKLMLEDILRDLQNANNNFNITCLRYFNPVGAHSSGMIGEDPQGIPNNLMPYVAQVGAGKLAKLSIFGGDYETIDGTGVRDYIHVVDLAIGHILALEKLSQDKPSWRAYNLGSGNGYSVLEIVKAYQKALGKEIPYQIVARRAGDIAASFADVAKAKRELGFETQKTIDDICDDMLKWQKYAKENNI

SEQ ID NO: 76296 - protein, 160 aa, Photobacterium sp. SKA34
YIDPSCVLVGDIRCDDDSSIWPLVAARGDVNYITIGKRTNIQDGTVLHVSRISEDNPKGFPLIIGDDVTVGHKAMLHGCQIGHRVLVGMGAIILDGAVVEDDVIIGAGSLVPPNKCLVSGFLYVGSPVKQTRPLTEKEKAFLPRSANNYVILKNEYLCDL

SEQ ID NO: 76297 - protein, 203 aa, Zea mays
AVTAKGYNLVLNSCPSLASVVRELGPELPLSTAGLVGWLRSASTTPAPAAEVEVVRELLASSASVLDRAMEWSEAEAKLNLHGFSTVAAYVLVLQWVDAGRGRPPAFPLEVSVVCGVGKHSDVRGESRVRELAQEVLGRMGSPLKLSARNRGGLVGKRDRVEQWLASFPVPEDGTDPSPDAANEEPFVFALFRKLGQFFSTLM

SEQ ID NO: 76298 - protein, 119 aa, Arabidopsis thaliana
MASSMLSSATMVASPAQATMVAPFNGLKSSAAFPATRKANNDITSITSNGGRVNCMQVWPPIGKKKFETLSYLPDLTDSELAKEVDYLIRNKWIPCVEIRVGARIFVPVSTGNLNPGYY

SEQ ID NO: 76299 - protein, 130 aa, Brassica napus
AYLQFYYILLGTETSEKDLPITGGDKLLLKGLKFYGFHGVIAEERTLGQMFLVDIDACVSLKKAGVSDNLADTISYVDIFSIAKEIVEGPPLNLLEAVAERIASKTLEKFPRVTAVQVKLVKPNVALIRV

SEQ ID NO: 76300 - protein, 623 aa, Oryza sativa Japonica Group
MVARDRLMPRSLAACALLLHRCPYQEKIGWSPASAHRQLCIAGRPPSWASTLLVRNLRGEGWEEEEEAECAGGCSDARSGVGKVGLGKIRVSVSDREVDRSLFSPFIHARGYIDRIGGENGLSNFVRLAYGKTLSLFVLMKYGDEVINEDLWRFVYRVVDDQIGGANFGFRFPTCSMTSLLSASSHLLFRATILATLCLVCLFTVHYPSLLSHSFHLSSAAAAANGKHRAASRSSHRSLLGSSAAVAYGGAAWEKEVRRSAAPRRDGGLSVLVTGAAGFVGAHCSLALRARGDGVVGLDNFNSYYDPSLKRARQRLLASRGVAVLDADINDAALLERLFDAARFTHVLHLAAQAGVRYAMRAPQTYVASNVAGLVSVFEVAAKHADPQPAIVWASSSSVYGLNTDAPFSEEHRTDRPASLYAATKKAGEAIAHAYNHIYGLSITGLRFFTVYGPWGRPDMAYFSFARSIVAGEPITLFRTADGADARRDFTYIDDVVKGCLGALDTAGESTGTKSGKKRGPAPLRVYNLGNTSPVPVTRMVAILEKLLGRKANKRVVTMPSNGDVPFTHANVSHAARDFGYRPATPLDAGLRRFVDWFVHYYKLDTAKIAKGKRKSMAMSAAS

SEQ ID NO: 76301 - protein, 428 aa, Psychrobacter arcticus 273-4
MALIVQKYGGTSMGSIDRIKNVAKRVKRWHDNGHQVVVVVSAMSGETNRLIDLARQISSQPDPREYDQMVSTGEQVSISLLAMAIKELGIGARSFTGRQVAIKTDNAHNKARIESIDDKNIRQQLDAGNIVIVAGFQGIDEEGNATTLGRGGSDTTGVAIAAALGADECQIYTDVDGVYTTDPRVTSKAKKLEKITFEEMLEMASLGSKILQIRSVEFAGKYGVPLRVLSSFDENNDGSFDQDFQDNVGTLITIDEGDNMEQAIISGIAFNRDEAKIVVRGVPDHPGIASAILSPIGRANIEIDMIVQNLSTNGMTDFTFTVNRTDMEKTMKVLENEVKDEIGAKEILANDEVVKVSLVGVGMRSHAGVASLMFQTLAENNINIQMISTSEIKVSVLIQEQYLEKAVRSLHTAFGLDREDGESKVAGL

SEQ ID NO: 76302 - protein, 476 aa, Triticum aestivum
MSVQEYLEKHLLPRKIEEAVNAAVRAKAADPVLFISTHMRRAAPAVITRVCARQILDSRGAPAVEVDLHTNKAVHRASAAGPGAPEGAAVDATRDVEKRRLLAKAVADSVRLINGKVSEALVGMDPQQQAQIDQAIMDLDKAHHRTEVGANAMLAVSIAACKAGAAEKEVPLYKHIADLVGKSATTLPVPAITVINGGTHAGNNLPIQEIMILPIGAKNFEEAMQMGSETYHHLKDIIWEKYGSDSCNIGDDGGFAPNISSITEGLDLVIAAIDRAGYNGRIKLAIDAAATDFCVGKKYDLEFKSAKKSGQNFKTGDDMIEIYSQLCSEYPLVSIEQPFDKDDWEHSKKFTTLELCQVVGDDLLMSDPERIKRAVNEYTCDALTLKASQVGTVTEAIEAVKQAKDAHWGVMVSHRSGDTDDSFIADLAVGAAAGQIKAGAPCRGECLTKYNQLLRIEEEFGSEGVYAGENWRTTAS

SEQ ID NO: 76303 - protein, 361 aa, Glycine max
MSIGTTLLSTPPHYCFHSNTQTTFLSTVTPIQNLSIRNNNFRVLCFSSDPSQLPPVVVVGSANADIYVEVDRLPGEGETLAARSGQTIAGGKGANQATCSAKLAYPTYFVGQVGDDAYGRLVTAGLRGGGVRLDNLAVVASAATGHAVVMLQSNGQNSIVYIGGANLSCWPSSLPRQHLDLVAQAGIVLLQREIPDAVNAQVAQAAKNAGVPVVLDAGGMDGPLPPQLINFVDILSPNETELARLTGMPTESFEEIQQAALKCHEMGAKQVLVKLGHKGSALFVEGEKTIQQPAILAKTVVDTTGAGDTFTAAFAVALVEGKSKKECLRFAAAAACLCVQVKGASPSMPDRKSVLDLLNCQ

SEQ ID NO: 76304 - protein, 173 aa, Bordetella pertussis Tohama I
MPIYQLDDLIPAIDPSAYLADSADIIGNVTLEAGVSIWSQVSIRGDNAPILVRSGTNIQEASVLHVDAGCPMTVGPNVTIGHQAMLHGCTIHEGALVGMQAIVLNNAVIGRNCLIGAGAIIPEGRIIPDNSLVIGIGKIVRELSAEEIAEMQANNRHYVERGQHYKTALKRIG

SEQ ID NO: 76305 - protein, 248 aa, Colwellia psychrerythraea 34H
MFSLEGKVALVTGASRGIGKAIATQLQSLGATVIGTATSENGANNITKYLTADNGSGMGLVLNVTSDESIAEMFVAIKEAHGSMIFLVNNAGITRDNLFMRMKDDEWSDIIETNLTSVFKVSKAAIRPMMKKRTGRIINIGSVVGTMGNAGQVNYATAKAGLLGFTKALAREVASRGITVNTVSPGFIDTDMTQTLTDEQKEGIFSQVPANRLGKPEEIASTVAFLASDAAAYVTGETIHVNGGMYMV

SEQ ID NO: 76306 - protein, 318 aa, Streptomyces avermitilis MA-4680
MPDSVETFDLITMGRIGVDLYPLQPGVPLPQVESFGKFLGGSAANVAVAAARLGRSTAVITRTGNDPFGTYLHQALEEFGVDDRFVTPVDAYPTPVTFCEIFPPDDFPLYFYRQPKAPDLEIRTEELDFFALRAARIFWITGTGLSEEPSRSATLAALKARTKGGTTVFDLDWRPMFWQDPRAARPYYAEALRHATVAVGNLDECEIATGVREPRACAEALIEAGVELAVVKQGPKGVLAVHRDGTTAEVPPVPVEVVNGLGAGDAFGGSLCHGLLAGWELERTMRYANAAGALVASRLACSSAMPTLDEVEDLVARG

SEQ ID NO: 76307 - protein, 320 aa, Physcomitrella patens subsp. patens
MWQTSGGWGKIEPGPAVDAMFRHVDAGFTTFDMADHYGPAEDLYGIFINRVRRERGDELESQVRGLTKWVPPPVKMTRAFVESNIDRSRKRMDVKSLDMLQFHWWDYSDKGYLDALKHLTDLKLEGKIKTLALTNFDTKRLQVILENQIPIVSNQVQHSLVDMRPQNYMADLCNVTGVKLITYGTVMGGLLSEKFLDVNVSIPFAGPPLDTPSLNKYKRMVDAWGGWKLFQELLREVKYVSNKHGVSMSAVAVRYVLDQPAVAGSMIGVRLGLKDHIRDSQEIFKLQLDQDDYARIASVTKRGKNLQDVIGDCGDEYRRA

SEQ ID NO: 76308 - protein, 335 aa, Colwellia psychrerythraea 34H
MTIITDSKPYIARATINHKLSVAPMLDWTDKHSRYFYRLMTQHTVLYTEMVTTGAILRGKGDYLSYNDAEHPLVLQLGGSDVKAMTECAKIAEQYGYDEVNINVGCPSDRVQNGRFGACLMAEPALVAQCVNQMQSATNIPVTVKSRIGIDDLDSYEFLHTFIEEVSKADCRHFIIHARKAWLTGLSPKQNRDVPPLDYDRVYQIKNDFKDLEVSINGGIKTFSEANEHLQHIDGVMIGREIYNSPYMLADADNEIYQSDTIKLSRSEVIDLMVPYIDETIANGGRAWHVLRHMLGLCNGLSGARKFRQHLSECAGKDGAGGQVLLDAFNKVTLP

SEQ ID NO: 76309 - protein, 250 aa, Vitis vinifera
MVKLAFGSFGDSFSVGSLKAYLSEFNATLLFVFAGVGSAIAYGKLTSDAALDPPGLVAVAIAHAFALFVGVSIAANISGGHLNPAVTFGLAIGGHITILTGIFYVIAQCLGSIVACLLLKFATNGESIPTHGVAAGMNAIEGVVMEIVITFALVYTVYATAVDPKKGSLGIIAPIAIGFIVGANILAAGPFSGGSMNPARSFGPAVVSGDFSENWIYWVGPLVGGGLAGLVYGNIFIESYASVPISDEYA

SEQ ID NO: 76310 - protein, 484 aa, Nocardioides sp. JS614
MSAGHPRGDGPWDLVIIGGGTAGIVGAKTAARFGARVLLIERDRTGGDCLWTGCVPSKALLAAADVAATARSGHRLGVEAYGVSVDFHAVLGHVRGAIDHIAPIDSPQALEAEGVTVWRGDAKFTGRDQVAVGDRRATFTQALLATGAAPAVPRIPGLAQTPHLTSDSVWQLDRLPEDLVVLGGGSIGCELGQAFARLGSRVTVVEGAPRLLPREDADAATAVTTGLRTDGVDVITGVAVTRVGQGGGRPRLELADGRALAFSQLLVAVGRSPRTHGMGLELAGVEVTDHGFVRTDSHLRTTNPRIWAAGDLTGHPQFTHTAGVHGSLAASNAVLGVRRKVDLSAIPRVTYTQPEVAAVGVGTESPPDGLRRLTWQHTRVDRAVTELATGGFTRLTVDRRGRLVGATVVGPRAGESIGELTLAISQGLRTRDLAGVTHAYPTWNDGLWQAAIADLRDQLARPGTRRALGMLARSRRWWLNRASS

SEQ ID NO: 76311 - protein, 522 aa, Medicago truncatula
MLVELAVTLLLIALFLHLRPTPTAKSKALRHLPNPPSPKPRLPFIGHLHLLDNPLLHHTLIKLGKRYGPLYTLYFGSMPTVVASTPDLFKLFLQTHEATSFNTRFQTSAISRLTYDNSVAMVPFAPYWKFIRKLIMNDLLNATTVNKLRPLRSREILKVLKVMANSAETQQPLDVTEELLKWTNSTISTMMLGEAEEVRDIARDVLKIFGEYSVTNFIWPLNKFKFGNYDKRTEEIFNKYDPIIEKVIKKRQEIVNKRKNGEIVEGEQNVVFLDTLLEFAQDETMEIKITKEQIKGLVVDFFSAGTDSTAVSTEWTLSELINNPRVLKKAREEIDSVVGKDRLVDESDVQNLPYIKAIVKEAFRLHPPLPVVKRKCTQECEIDGYVVPEGALILFNVWAVGRDPKYWVKPLEFRPERFIENVGEGEAASIDLRGQHFTLLPFGSGRRMCPGVNLATAGMATMIASIIQCFDLQVPGQHGEILNGDYAKVSMEERPGLTVPRAHNLMCVPLARAGVADKLLSS

SEQ ID NO: 76312 - protein, 443 aa, Clostridium magnum
MAKIVVMPKLGLTMTEGTLVTWKKAEGDQVKVGEIFFEVSTDKLTNEVEASDEGIVRKLLVNEGDTVECLKPVAIIGSADEDISSLLNGSSEGSESAEQNDTKAPKKEAEAPKGAVEKQQGKVKASPAAKKLAAENNIDITLVEGTGPQGRITTEDVEKYIEDSKNASKASPMASKVAAELNVDLSTIEKDGRIMKEDVLSLCKGNAPEECKVNPSEDKYTEKIVPMTQIRKIISARMHESWITSPTVTYDIKVDMTSLKRFKDALKDVCKVTYTDLIVKIVSKVLLQFPLLNCSINGNELITRNYVNMGVAVAIDGGLVVPVVKYANEKGLKEISTEVKDLAKKAKSNQLKPENMTGGTFTITNLGMFGIEYFSPIINQPEVAILGVNKITETPVVQNGEIVIKPLMNLSLTANHRAVDGSVAAQFLSKVKEYMEKPELLML

SEQ ID NO: 76313 - protein, 367 aa, Nostoc punctiforme PCC 73102
MYEIILPKFNNNDESYTLLYWLSDIGKPVNKEEAIAIFETSKAAFDLESEAEGILHTLPEAGDECKPGDVIGYLFETEAERQDFLNSSGKKAKITNDKSLTITKVAQELIDKHGISEENIRKLGKNIIKRPDIEKLISEQSRDEVTGLEISRQQMAIARVVTQSHTQIPKAFLLMKIYGDAATQMLSDYGKKHDIIIGLPELLIKITATLLSEFPFFFGSLIDDNRFMPGEVANIGVTLDLGKGLFIPVIKNVGEISLADIANKLMEFRLKAMRGQFNEEELNQGNISLSINMDKDSLVTIPIILPSQSCMLSLGGIQEELYLGSEQNVKNRSYINLGLAYDHRVINGREAAQFLTKIKTKVEQPSI

SEQ ID NO: 76314 - protein, 248 aa, Zea mays
MVKLAFGSFRDSLSAASLKAYVAEFIATLLFVFAGVGSAIAYSQLTKGGALDPAGLVAIAIAHAFALFVGVSMAANISGGHLNPAVTFGLAVGGHITILTGILYWVAQLLGASVACFLLQYVTHGQAIPTHGVSGISEIEGVVMEIVITFALVYTVYATAADPKKGSLGTIAPMAIGFIVGANILAAGPFSGGSMNPARSFGPAVAAGNFAGNWVYWVGPLVGGGLAGPVYGDVFIASYQPVGQQEYP

SEQ ID NO: 76315 - protein, 472 aa, Staphylococcus aureus subsp. aureus COL
MENTVKYRKFILPIVVGLLIWALTPFKPDAVDPTAWYMFAIFVATIIACITQPMPIGAVSIIGFTIMVLVGIVDMKTAVAGFGNNSIWLIAMAFFISRGFVKTGLGRRIALHFVKLFGKKTLGLAYSIVGVDLILAPATPSNTARAGGIMFPIIKSLSESFGSKPKDGSARKMGAFLVFTEFQGNLITAAMFLTAMAGNPLAQNLASSTSNVHITWMNWFLAALVPGLVSLIVVPFIIYKIYPPTVKETPNAKSWAENELATMGKIALAEKFMIGIFVVALTLWIVGSFIHIDATLTAFIALALLLLTGVLTWQDILNETGAWNTLVWFSVLVLMADQLNKLGFIPWLSKSIATSLGGLSWPIVLVILILFYFYSHYLFASSTAHISAMYAALLGVAIAAGAPPLFSALMLGFFGNLLASTTHYSSGPAPILFSSGYVTQKRWWTMNLILGFVYFIIWIGLGSLWMKVIGIF

SEQ ID NO: 76316 - protein, 368 aa, Pseudomonas syringae pv. tomato str. DC3000
MTTLNSTPRADGFHMPAEWAPQTQVWMVWPERPDNWRLGGKPAQAAHVAIAKAIARFEPVTVAVSAAQYDNARARLDMPNIRVVEMSSNDAWVRDSGPTFVINDRGELRGVNWEFNAWGGFDGGLYAPWNLDSQVGSKVLEIERCPRYATQGFVLEGGSIHVDGEGTLITTEECLLNRNRNPHLTREQIEAVLSDYLAVDKIIWLPDGLFNDETDGHVDNFCCYIRPGEVLLAWTDDPEDPNYPRCHAALSILENTRDAQGRAFIVHKMPIPGPLFATEEECAGVDQVHGSQERNPSVRLAGSYVNFLIVNGGIIAPSFDDPMDEKAREILQKLFPEHEVVMAPGRELLLGGGNIHCLTQQQPAPFKA

SEQ ID NO: 76317 - protein, 140 aa, Zea mays
FQPQVARPTFASAIQIGDPVSVDRAVVALKATDGIVEEATEEELMNAMSLADRTGMFACPHTGVALAALFKLREQRVIGTNDRTVVVSTAHGLKFSQSKIDYHDSKIEDMACKYSNPPVSVKADFGAVMDVLKKRLKGKL

SEQ ID NO: 76318 - protein, 255 aa, Oryza sativa Indica Group
MPKRTTHTYSSEDALPEGPESDLFVYYCKHCASHVLITELNQKTLEMQSVCKGDCVLYSSFDTQLQKMPKRKTDRAHVLDKKKHLSRLNVKEAGKVLLKRGEGKLEKQFRMSCLGCGLFVCYRSEEELELAPFIYVVDGALSSVAAETNPHDAPVPPCITQLEGGLVQVAIEVEDRAQRSAITRVNADDVRVTVAAPAARGEANNELLEFMGKVLGLRLSQMTLQRGWNNKSKLLIVEDLSARQVYEKLLEAVQP

SEQ ID NO: 76319 - protein, 970 aa, Pseudomonas syringae pv. tomato str. DC3000
MPLATLIRRSSLPCPEVSVDQALQLLAQHYGLSGTLKTLGSQQDRNFLLETDKRRYVLKICHGAYSTRELMAQHAALQHLASHRAVSVPGVIRANDTEPLLSVDVDGQAVHVRLLEFIDGQSLGHVGHLSHDIVVGLGELCARVDLALADFEHPGLERILQWDPRHAQALIKHLLPVIKDADARACVIEAGEQAHRRLLPLIPSLPIQAVHLDITEHNVVWLRDSQRQWQMQGLIDFGDLVSTWRVADLSVTCAALLHHAEGDPLYILPAIRAYHALNPLKREELQALWPLIVARSAVLVLSSEQQASVEPGNAYIQANLAGEWNIFDVATSVPMALMEAAILQAAGVDLPSVDQPVYQPLLPGLPGLTPTVVDLGVLSEHFVAGNWEQGGIDEYLLSQAAGDDGLAASRFGEYRLSRTLPDCAKEPETFALHVELHVPAGTAVHAPFSGTLRLTADAALLLVGDAISLKLWGVLPNASLADHVSAGALIGQGGGSLLLQLCTAPDLSPPLFTTPSWAAAWRRFCPSPSMLLGFDCDAPALADPAQLLARRDASFARSQKHYYQAPPQIERGWRNHLIDMQGRSYLDMLNNVAVLGHGHPRMAYEAARQWSLLNTNSRFHYAAIAEFSERLLKLAPDGMDRVFLVNSGTEANDLAIRLAWAYSGGRDMLSVLEAYHGWSVATDAISTSIADNPQALSTRPDWVHPVTAPNTYRGPYRGADSAPEYVRSVDQVLAALAEQQRQVAGFICEPVYGNAGGISLPAGYLQQVYQKVRAVGGVCIADEVQVGYGRLGHYFWGFEEQGVVPDIISMAKGMGNGHPLGAVITRREIAEALEAEGYFFSSSGGSPVSCRIGMAVLEVMEEEKLWDNARIVGDHFKARLQALTDKHPLVGAVHGMGFYLGVELVRDRQTLEPATEETAQLCERLRELGIFMQPTGDHLNILKIKPPMCTTRQSVDFFVDNVSKVLYELE

SEQ ID NO: 76320 - protein, 334 aa, Eustoma grandiflorum
MEVQRVQEIASLSKVIDTIPAEYIRSENEQPVISTVHGVVLEVPVIDLSDSDEKKIVGLVSEASKEWGIFQVVNHGIPNEVIRKLQEVGKHFFELPQEEKELIAKPEGSQSIEGYGTRLQKEVDGKKGWVDHLFHKIWPPSAINYQFWPKNPPAYREANEEYAKRLQLVVDNLFKYLSLGLDLEPNSFKDGAGGDDLVYLMKINYYPPCPRPDLALGVAHTDMSAITVLVPNEVPGLQVYKDGHWYDCKYIPNALIVHIGDQVEIMSNGKYKSVYHRTTVNKEKTRMSWPVFLEPPPDHEVGPIPKLVNEENPAKFKTKKYKDYAYCKLNKLPQ

SEQ ID NO: 76321 - protein, 232 aa, Populus trichocarpa
MPVEETRKKVWLVDSKGLIVSSRRESLQHFKKPWAHEHEPVKTLLDAVNDIKPTVLIGTSGVGKTFTKEVIEAMASFNEKPIILSLSNPTSQSECTAEEAYTWSQGRAIFASGSPFAPFEYEGKTFMPGQANNAYIFPGLGLGLIMSGAIRVHDDMLLAASEALAAQVTQENFDKGLIYPPFKNIRKISAEIAAKVAAKAYELGLATRVPPPRDLVKHAESCMYSPAYRSYR

SEQ ID NO: 76322 - protein, 435 aa, Rhodopirellula baltica SH 1
MSDIIPVEVPTVGESISEVQIGNWLKQEGDWVKSGEDLVEIETEKASVQIPAPASGYLQSITKQSDEFAEVGQQIASIQVAEQPAGGDGGSSNGGSAPAAGNTASAPAPTASAPAPSSPAKSGGGFVMPAAQRLLDEHKLDASQVPATGPGGRLLKEDVLAYIRNGSSRPAPAAPPAAPAAPVAPTQQMSSPETASLMTSGGYRSEEVKPMSMLRRTIASRLVQAQQTAALLTTFNEINMAPVMAIRSKYKDAFAKKHGVKLGFMSFFAKATVEALRRYPAVNAEIRGDSMVYRNYQDIGIAIGGGKGLVVPVLRNVERMSFAEVEGSIAEYARLAGENRLQPSDLMGGTFTISNGGIYGSLLSTPIVNPPQSGILGLHSIQERPVAEDGQVVIRPMMYVALTYDHRIVDGREAVGFLVAIKETIEDPARLFLEV

SEQ ID NO: 76323 - protein, 453 aa, Cryptococcus neoformans var. neoformans JEC21
MLPRLGAIQSTTHPFFFTTTKMLVHSSKYLLARSAAISKVLPAVAARRAGSTWTNVPAGPPDPILGVTEKFKADKSPKKINLGVGAYRDGSGKPYVLPTVRKAEKILAEAMQDKEYLPITGLSDFTKLAAELAYGKDSKPLVENRLAITQSISGTGALRIGTAFLARWFPGAKSIYLPTPTWGNHIPIAKDSGLEVKQYKYFDKKTVGLDFEGMKADIKAAPEGSIVLLHACAHNPTGIDPTEAQWKELSDIVKEKKHFPFFDMAYQGFASGDTLKDAFAVRYFVEQGHQLLLCQSFAKNMGLYGERAGAISFVCESPEEKARVDSQLKIIIRPMYSNPPVHGARLVSTILGSPELTKEWLVEVKGMADRIIEMRERLYNKLVELDTPGEWGHIKSQIGMFSFTGLKPEQVDKLAEKASIYLTRDGRISMAGLNSNNVDYFAESVSKAVKGTL

SEQ ID NO: 76324 - protein, 573 aa, Neisseria gonorrhoeae FA 1090
MNSLFLLGGALLFLSVVSTTLSARLGMPLLLVFLAVGMLAGEEGVGGIAFNNVVMANFISQLALAVILLDGGLRTQLSSFRIALKPASVLASWGVFATVLPLGLFATFYLGLDWKFGVLMAAIVGSTDAGAVFSLLRNSGVRLNERVQATLEIESGANDPMAVFLVTALITMIMQPAESGAAAFVRMLALQIGFGLLTGWAGGKILAKLVRRLNLAEGLYALMIVSGGLLVFAFTNTIGGSGFLAVYLAGIIVGNQRNRATEHVLRVMDGLAWLAQATLFVMLGLLVSPAGVLDRAAEALAIAAFLMLVARPLAVFGGLWKFNYSLREKAYISWLGLRGAVPISLAMMPLVMGVPNSHLLFDVAFAVVVLSLLIQGTTIPVMARLLKVAMPNKPEPKDTHDIWLAEKEIVRMSAFKVVAESEAEGHHPDTVEPISDSFDARCFALIRNGSRIEMQSDTVLQAEDLAWYILADGKVDKMAKYFTETGIGVRENFDFFGEFVVSPAARSGDLALAYGLKLEAGEEGLSLAELFDKRSDSQEPVEGDRIDIGGFMLTAKEVDGGGNIGSMGLKVPR

SEQ ID NO: 76325 - protein, 263 aa, Triticum aestivum
  misc_feature (89)..(89): Xaa can be any naturally occurring amino acid
  misc_feature (158)..(158): Xaa can be any naturally occurring amino acid
  misc_feature (175)..(175): Xaa can be any naturally occurring amino acid
MAAGGMSREERWSLAGATALVTGGSKGIGHAIVEELAGHGARVHTCARSAAELEECRRRWEAKGLPVTVSVCDVSLRAHREQLVETVKXVFDGKLDILVNNAAQILAKAAVEWTSEEYSHLMATNFESCFHLSQLAHPLLLRASIAGGGSIVNISSLXGTLGFPGLTIYSMTKGXINQLTRSLATEWAQNKIRVNCVAPGATKSDMLNSLPPKIKENELTRTPMRRAGEPEEVAAVVSFLCMPAASFVTGQVITVDGGRTISA

SEQ ID NO: 76326 - protein, 754 aa, Phaeosphaeria nodorum
MSEVANSTSPVQDGADANGAQINTNVPAASGDAPTPTTAAQQAHQNSASLYVGELDPSVTEAMLFELFSSIGQVASIRVCRDAVTRRSLGYAYVNYNSSEDGEKALEELNYTVIKGKPCRIMWSQRDPALRKTGQGNVFIKNLDHAIDNKALHDTFAAFGNILSCKVAQDELGNSKGYGFVHYETAEAANNAIKHVNGMLLNEKKVFVGHHIPKKERMSKFEEMKANFTNIYVKNIDLDVTDEDFRELFEKHGDITSASIARDDQGKSRGFGFVNYIRHEAAAVAVDHLNDIEFKGQKLYVGRAQKKHEREEELRKQYEAARLEKQSKYQGVNLYIKNLNDDVDDEKLRDMFTPFGTITSAKVMRDAMPADRPESARRGEEGRGGEGGQGREEGGREEGGRGGQGGLFQRAEREDTKAGDKVTIKGEKKILGKSKGFGFVCFSNPDEATKAVTEMNQKMIEGKPLYVALAQRKDVRKNQLEATIQARNQLRMQQQQQQQFGGIPQMFIAPGQQPMMYPPGARGQMPFPAGMPGAQGGRGAGFPGGMPGQQGGRGGPNAQQMPPMYMPPGMAPGAFPPGPYMNQQYMQLAQAAQQAMGGRGGRGGPMPGMPGMPQAQIAGGPGIRGGQGGFPQGGRGAPGGRGQPPMPGFPQGGRPGGPGVDMSVLSAAAPGQQKQMLGEALYPKIHEMQPELAGKITGMLLEMDNSELINLTADESALRAKVDEAMSVYDEYVKNKEGDGEKEAPKEESKEEKA

SEQ ID NO: 76327 - protein, 461 aa, Triticum aestivum
MVEAAAGRRSGTSPRRPSGGGEQQLPLVAVALATRVVMVTSAPPAGGGVGGGGAAAGGRCLDDLLGCLLGVLRVLGFPWAASPQRQPRPVPPRGAIPSTADGRRFAAELRRIPGRIAGNGACAVASLYTMQGKKGVNQDAMIVWENFCSRDDTIFCGVFDGHGPYGHLVAKRVRDLLPVKLGADMGTDKGREAPASNMEGNTNEVGLPVNPERKETTTSVGAEQDREYPEIFTTFRTSFLRAFHIMDRDLKLHKNIDCFFSGTTAVAVLKQGHNLIIGNLGDSRAILGTRNEDGQLIAVQLTVDLKPNIPSEAQRIRQRRGRIFALPEEPEVARVWLPKYNSPGLAMARAFGDFCLKEYGLISMPEVSCHRVTEKDEFIVLATDGVWDVLSNTEVVSIISRATSRASAARFLVESANRAWRTRYPTSKIDDCAVVCLFLNTHEADQPSSSAANNLANGSRS

SEQ ID NO: 76328 - protein, 428 aa, Bordetella pertussis Tohama I
MSAIVDIIGREILDSRGNPTVECDVLLESGAMGRASVPSGASTGSREAIELRDGDKGRYLGKGVLRAVENLNTEISEALMGLDAQEQTFVDRTLIELDGTDSKERLGANAMLAASMAVARAAADESGLSLYRYFGGSGPMSMPVPMMNVINGGAHANNTLDLQELMILPVGAASFREALRWGAEVFHMLKKLIHDQGMSTAVGDEGGFAPNVASHEAAIQLILKAITEAGYEPGTQIALGLDCASSEFYRDGKYTLAGEGGVSLSSQEFANLLATWCDKYPIISIEDGMAENDWDGWKLLTDQLGKKVQLVGDDLFVTNTRILREGIQKGVANSILIKINQIGTLTETFAAIEMAKRAGYTAVVSHRSGETEDSTIADIAVATNAMQIKTGSLSRSDRMAKYNQLLRIEEELAEVASYPGLEAFYNLR

SEQ ID NO: 76329 - protein, 269 aa, Vibrio campbellii AND4
MRELDTPASDSYNQRFGGTRRLYGNSEVEILRAAHVCVIGIGGVGSWAVEALARTGVGELTLIDMDDVCVTNINRQIHAMTGTVGQSKIEVMAERVKLINPECKVNLIDDFITPDNQDQYLSKKFDYVLDAIDSVKAKASLLAYCRSNKIKVITTGGAGGQIDPTQIMVADLTKTIQDPLAKKIKDTLRRHHNFPKNPARKFGIDCVFSTEQLKYPQADGSVCGVKSTAEGPKRMDCASGFGAATVVTATFGFVAVSRIVEKLIQKHKK

SEQ ID NO: 76330 - protein, 369 aa, Arabidopsis thaliana
MASSVFLSSFSSSSSLQLCSSFHGEYLAPSRCFLGAPVTSSSLSLSGKKNSYSPRQFHVSAKKVSGLEEAIRIRKMRELETKSKVRRNPPLRRGRVSPRLLVPDHIPRPPYVESGVLPDISSEFQIPGPEGIAKMRAACELAARVLNYAGTLVKPSVTTNEIDKAVHDMIIEAGAYPSPLGYGGFPKSVCTSVNECMCHGIPDSRQLQSGDIINIDVTVYLDGYHGDTSRTFFCGEVDEGFKRLVKVTEECLERGIAVCKDGASFKKIGKRISEHAEKFGYNVVERFVGHGVGPVFHSEPLIYHYRNDEPGLMVEGQTFTIEPILTIGTTECVTWPDNWTTLTADGGVAAQFEHTILITRTGSEILTKC

SEQ ID NO: 76331 - protein, 405 aa, Arabidopsis thaliana
MAAALQTNIRTVKVPATFRAVSKQSLAPFRVRCAVASPGKKRYTITLLPGDGIGPEVVSIAKNVLQQAGSLEGVEFNFREMPIGGAALDLVGVPLPEETISAAKESDAVLLGAIGGYKWDNNEKHLRPEKGLLQIRAALKVFANLRPATVLPQLVDASTLKREVAEGVDLMVVRELKGGIYFGEPRGIKTNENGEEVGFNTEVYAAHEIDRIARVAFETARKRRGKLCSVDKANVLEASILWRKRVTALASEYPDVELSHMYVDNAAMQLVRDPKQFDTIVTNNIFGDILSDEASMITGSIGMLPSASLSDSGPGLFEPIHGSAPDIAGQDKANPLATILSAAMLLKYGLGEEKAAKRIEDAVLVALNNGFRTGDIYSAGTKLVGCKEMGEEVLKSVDSQVPASV

SEQ ID NO: 76332 - protein, 403 aa, Vibrio campbellii AND4
MFNANTVRQQFPALNQDVNQSPLVYLDSAATTQKPQCVIDVISHYYSAQNANVHRGSHSLTANATSQFEAARETVAKFIGASSSKEVIWTRGATEALNLIAQTYARSVLQAGDEILISEMEHHANIVPWQIVAEQTGATVVKVPMTADCQFDIDAFETLLSERCKIVACAQITNVTGSRQPIEEIIAMVHAVGAVVVVDGAQGIVHEQLNLADLDVDFYVFSGHKLYAPAGIGVLYGKLELLETMPPWHGGGKMVERVSFEKTTFSALPGKFEAGTPNVAGAIALAKAIDWYQSFDQTAVEAHLHFLQDKTYQALSQLDDIQILGYQPNASVLTFVMDGVHHQDIATLLDQQGIAVRAGHHCAHPLMNALKVKGTVRVSFGIYNTLEDVEKLIAAVKKAVDML

SEQ ID NO: 76333 - protein, 507 aa, Nocardioides sp. JS614
MTVFAPPGTAGSTISVQARCGHFIGGEWVPPIKGAYFENISPVTGQPFTEIARGTAEDIEAALDAAHNAAPAWGRTSPAERSNALLRIADTMQAHLEDLAVIETWDNGKAVRETLNADLPLAIDHFRYFAGVLRGQEGTISQIDEDTIAYHFHEPLGVVGQIIPWNFPILMAVWKLAPALAAGNTVVLKPAEQTPWSILKLVELIGDLLPAGVVNVVNGFGVEAGKPLASSPRISKIAFTGETTTGRLIMQYASENLIPVTLELGGKSPNIFFEDVAAARDAFYDKALEGFAMFALNQGEVCTCPSRALVQRSIYSEFVADAIARVQAIKQGNPLDTETMMGAQASRDQLEKILSYIEIGKQEGAGVLTGGARLELGGDLAGGYYVQPTVFEGHNAMRIFQEEIFGPVVALTSFDDDADALKIANDTLYGLGAGVWSRDGSRAFRTGKGIQAGRVWTNCYHAYPAHAAFGGYKGSGIGRETHKMMLDHYQQTKNLLVSYSPDALGFF

SEQ ID NO: 76334 - protein, 283 aa, Oryza sativa
  misc_feature (253)..(253): Xaa can be any naturally occurring amino acid
  misc_feature (266)..(266): Xaa can be any naturally occurring amino acid
LFLSSSPSPRLALPMSACGSSSSRGAVSYHSKAAAFASPQPHGGGGGRRGRRRGRRRRGGDGSDRMDAVRRLLTRIWGGVAGDLNLDMRTGGYGQGRHLLRLNRHTWPKIRFKAHTANEMTEAVRRDNTQRLGLREEEGELLIRANQGHTAPTVTSESLGKPMLSADEGSGCVHGTYRKNLDSILHQGLKRMARLHVHFSSGLPTDGGVISGMRQSVNILIYLDVSMALQDGMKLDISDNKVILTEGFDGVVXVKYFEKMETWPGXAPIPLENRDTVGICSCV

SEQ ID NO: 76335 - protein, 578 aa, Clostridium magnum
MAKIVVMPKLGLTMTEGTLVTWKKAEGDQVKVGEILFEVSTDKLTNEVESSDEGIVRKLLVNEGDVVECLNPVAIIGSADEDISSLLNGSSEGSGSAEQSDTKAPKKEVEAVKGGDNLVVIGGGPGGYVAAIRAAQLGAKVTLIEKESLGGTCLNVGCIPTKVLLHSSQLLTEMKEGDKLGIDIEGSIVVNWKHIQKRKKIVIKKLVSGVSGLLTCNKVKVIKGTAKFESKDTILVTKEDGVAEKVNFDNAIIATGSMPFIPEIEGNKLSGVIDSTGALSLESNPESIAIIGGGVIGVEFASIFNSLGCKVSIIEMLPHILPPMDREISEIAKAKLIRDGININNNCKVTRIEQGEDGLKVSFIGDKGEESIDVEKVLIAVGRRSNIEGLDVEKIGVKTEGGSIIVNDKMETNVEGIYAIGDCTGKIMLAHVASDQGVVAAENIMGQNKKMDYKTVPACVYTKPELASVGLTEEQAKEKGIDYKVGKFQLAANGKSLIMNETGGVIKIITDKKYEEILGVHILGPRATDLITEAALALRLEATLEEIITTVHAHPTVGEAMKEAALAVNNQAIHMMNK

SEQ ID NO: 76336 - protein, 407 aa, Streptococcus pneumoniae
MINVIGLGYIGLPTILMLATNGVKVVGTDYNQDLVRTLNEGQTTFKEDGLDELFHKAVESGVDFTTEYQQTDTYIISVPTPYDSFSKKIDPSYVIEATKTVLDNCNKGAVIIIESTVSPGTVDKFIRPVVEEKGFVIGSDIHLVHAPERIIPGNMVYELVNNNRTIGADDLEIGYKVKELYASFCKGDIVVTDIRTAEMTKVVENTFRAVNIAFANELAQICSYDNMNVYEIIRICNMHPRVNILQPGPGVGGHCISVDPWFLVGDYPELTNVIEHSMRTNAAMPEFVLNRIYTIMNEHHLTDISRVGLYGLTYKENVDDMRESPTLQLLESMSRHLATPAIKVYDPFIEKDVVANQSHDLDEFLSNVDIVVLLVGHDEILQNMDKLKDKIVLDTRYICHLDGTYRL

SEQ ID NO: 76337 - protein, 490 aa, Aspergillus fumigatus
MPTLGGLLKKRRTKDSHTLSKELESSSSPAAAQTQTSPNSADHDHHYQHYDQTHHHQHSASSNPSNNSATPSAAQPHRSSNDNPNRSSGTDQKSEGQTASMQFAVTQPHPSTHHNPRLHHLQQQQQQPQQQSHTSRLHNILHPSHHASSQASTEGHAHSQQANQTEARTTKGKYSLDDFTIQRTLGTGSFGRVHLVQSKHNHRFYAIKVLKKAQVVKMKQVEHTNDERRMLNRVRHPFLITLWGTWQDARNLYMVMDFVEGGELFSLLRKSQRFPNPVAKFYAAEVTLALEYLHSQQIIYRDLKPENLLLDRHGHLKITDFGFAKEVPDITWTLCGTPDYLAPEVVSSKGYNKSVDWWSLGILIFEMLCGFTPFWDSGSPVKIYENILRGRVKYPPYLHPDAVDLLSQLITADLTKRLGNLHGGSEDVKNHPWFAEVTWDRLARKDIDALYVPPIREGQGDASQYDRYPEETEQYGQQGEDVHGHLFPDF

SEQ ID NO: 76338 - protein, 213 aa, Erwinia carotovora subsp. atroseptica SCRI1043
MTDQSHQCVIIGISGASASGKSLISSTLYRELRDQVGDQHIGVISEDSYYKDQSHLTMEERVKTNYDHPSSMDHSLLIKHLQMLKSGQAIEVPQYSYVEHTRKQETVHIELKKVIILEGILLLTDARLRNEMNFSIFVDTPLDICLLRRMRRDVNERGRSMDSVMEQYQKTVRPMFLQFIEPSKQYADIIVPRGGKNRIAIDILKAKISQFFE

SEQ ID NO: 76339 - protein, 345 aa, Bacillus thuringiensis serovar konkukian str. 97-27
MKAVVVNKNSKANIEVVEKELRPLHSGEALVDVEYCGVCHTDLHVANHDFGNTDGRILGHEGVGIVTKIADDVTSLKVGDRVSIAWMFQSCGRCEYCVTGRETFCREVKNAGYSVDGGMAEQCIVTADYAVKVPEGLDPAQASSITCAGVTTYKAIKVSDIKPGQPIVIYGCGGLGNLAIQYAKNVFGAKVIAVDINDDKLALAKEVGADMTINPISQGSADKIIQEEFGGAYAAVVTAVSKVAFNSAVDAVRACGKVVAVGLPVETMDLNIPRLVLDGIEVVGSLVGTRKDLEEAFMFGAEGKVVPVVQTCSLDKVQNVFEEMEQGRIQGRMVIDFKQHNCDCK

SEQ ID NO: 76340 - protein, 223 aa, Acidovorax sp. JS42
MSFPATFLSAPGDLPQEVTLAPLPAVIAAIAAGRPVLVLDDADRENEADLVCAAANMTEATMALMIREGSGIVCLCLTPAHAKALGLRPMVEVNRSAFSTAFTQSIEAAHGVSTGVSAADRLQTVRCALRIPAPGCAPEVVSPGHVFPLVARAGGVLERDGHTESAVDLAVLAGLPPAGVLCELMNPDGSMARGAQVARFARAHGLLCTTVRALADYRRARQP

SEQ ID NO: 76341 - protein, 242 aa, Wolbachia endosymbiont strain TRS of Brugia malayi
MITLNNLNCCTKFGIELEFYTEGIEREHLFLNSVKNKIALLGFSCKKESSTHQYEIKSGCYNDSNNLIKHFDLAKELLTETAQKLGGNTSFKAKPYLDRAGSALNVHVNLVDSNNSNLFYCNEQKYSDYLIYGIGGLCAMMKEHMSFFAPSDDSYLRFQYPDIHTPTTISWGVNNRTAAIRIPCLGSKCRLEHRVPGADCNLEKVLIAIIEGITFGIENKIAPPNRVYGIASDPQYKMENLV

SEQ ID NO: 76342 - protein, 308 aa, Clostridium tetani E88
MNVKKILVIGSFMMDLVAQTPRAPIEGETIIGKSFSQFTGGKGANQAVAAARLGAYVTMIGKLGKDSFGEAHIESLRREGINHDYVLFDDVESSGVGHITLEENGNNRIIVIPGANLKLTPKEVEDLEDNIKSSDIVILQLEIPFETVYKTIELAHKHGKTIILNPAPAAKLKEHFVELVDYIVPNESEASLLTGIKVNSIESARKAAKSLLNLGCKNVIITLGEKGVLLVNNNEEIFQESFKVKPVDTTAAGDSFIGAFAYSLANGLGNVKSLEFACAVGALTVTKIGAQPSLPKLTEVEMFMKENR

SEQ ID NO: 76343 - protein, 360 aa, Wolbachia endosymbiont strain TRS of Brugia malayi
MFIGNRNRNKVERAISEIRRGLPIIIYDKSNYLLVAAAETLEKDLFNQYGLISGKIYVILPSSKVTCISQNVEHSSKRLLINNFDELFHLVNCSKEDHTKELQRSKAIDECAITLLKSSELLPYALVVDVNFKDEYEMRGWCEKSDVIALDVLFINNFQQNQDIYEVCKTPLFLKQTQKVNIISYRTCNGRKEHYAIIIGNPGKNSEPLVRVHSSCYTGDLLDSLSCDCRSQLHQAIQIMTDSGNGIILYLMQDGRGIGLTNKLRAYDMQRKYNLDTVDANRILGFEDDERSFAVAAEMLKKLGIKKIQLLTNNGRKLSELKNNGIEVTRCLPLIMERNKYNDSYIETKFSRLGHRLRTF

SEQ ID NO: 76344 - protein, 607 aa, Vitis vinifera
MDNKIGSQLDSCKPANNDVGSAPQNGTVSTIQDSPSPAHPTGSRATLGSHIAHRLVQIGVNDVFSVPGDFNLTLLDCIIAEPGLNNIGCCNELNAGYAADGYARARGVGACVVTFTVGGLSILNAIAGAYSENLPVICIVGGPNTNDYGTNRILHHTIGLPDFSQEVRCFQPVTCYQAIINHLDEAHELIDKAISTALKESKPVYISVSCNLPTIFHPTFSREPIPFALSPKMSNCKGLDAAVEAAAAFLNKAVKPVIVGGPKLRVAKATKAFVELADACGYALAVMPSAKGLVPEHHPHFIGTYWGAVGTAFCGEIVESADAYVFVGPIFNDYSSVGYSLLLKREKAIIVQPERVVIANGPAFGCVLMKDFLPALAKRLNNNTTAYENYRRIHIPDGVPLKCEPTEPLRVNILFQHIQKLLSHDTAVIAETGDSWFNCQKLKLPEGCGYEFQMQYGSIGWSVGAMLGYAQSVPDKRVIACIGDGSFQVTAQDVSTMIRCEQKSIIFLINNGGYTIEVEIHDGPYNVIKNWNYTGLVDAIHNGEGNCWTKKVNNEQELIEAIEIATGEKKDCLCFIEVVVHKDDTSKELLEWGSRVSSANSRAPNPQ

SEQ ID NO: 76345 - protein, 421 aa, Peptoniphilus asaccharolyticus
MTDTLNPLVAAQEKVRIACEKLGCDPAVYELLKEPQRVIEISIPVKMDDGTVKVFKGWRSAHSSAVGPSKGGVRFHPNVNMDEVKALSLWMTFKGGALGLPYGGGKGGICVDPAELSERELEQLSRGWVRGLYKYLGDRIDIPAPDVNTNGQIMSWFVDEYVKLNGERMDIGTFTGKPVAFGGSEGRNEATGFGVAVVVRESAKRFGIKMEDAKIAVQGFGNVGTFTVKNIERQGGKVCAIAEWDRNEGNYALYNENGIDFKELLAYKEANKTLIGFPGAERITDEEFWTKEYDIIVPAALENVITGERAKTINAKLVCEAANGPTTPEGDKVLTERGINLTPDILTNSGGVLVSYYEWVQNQYGYYWTEAEVEEKQEADMMKAIKGVFAVADEYNVTLREAVYMYAIKSIDVAMKLRGWY

SEQ ID NO: 76346 - protein, 216 aa, Lactobacillus johnsonii NCC 533
MKRIYIVRHGQTYINRYDKMQGWCDTPLTDEGIQGAKDAGKALSEVPFDIAISSDLKRASDTCDYIINENCNRDELQHIATPFFREQFYGFFEGMNSDEAWRMIGGPHGYPRRDELLKEVDINTIKDYMKEADPYHEAENAEEYWNRVDKGFDLISQLDGAENILLVTHGFTIRSIVSRFAPGEYNLAHGPRNASITIMNMTDKDMKITSYNKMSV

SEQ ID NO: 76347 - protein, 404 aa, Arabidopsis thaliana
MDEGNLDGTANDGVHPKPPPGSENGAGESGSENRPQFSSSNEPPRKTDQPSSSSASASASPSLFLSLPLEIISMILARVPKRYYPILCSVSKNMRSLVRSPEIHKARSLLGKDYLYIGFIDENYRPVYDYWYTLRRIENSTTENLFESIEFPYPSEPNRFSMNAVGPKIFFISESCTPSSRLSIFDTRFGELRQGPCLLVKRGYNCVGLVGGKVYVIGGYQDDEIAAESFDLNTQTWEAAPIPDEKESHRWICKANVSFDRKVCALRSREGMTCYDTRDGSCQRSEMPNDQWSRVGLCVIDNVLFVYFSRFGLMWYDSKLMLWRVVYGFDLDDARSVGIGEYYGKLAFIWEKPSLNVSESKEIWCRMIGLLRSEVGIHGAAEPSQLVEIVPNGYRMCHCLSLSG

SEQ ID NO: 76348 - protein, 257 aa, Pseudomonas putida
MQLKDAQLFRQQAYINGEWLDADNGQTIKVTNPATGEVIGTVPKMGTAETRRAIEAADKALPAWRALTAKERSAKLRRWFELMIENQDDLARLMTTEQGKPLAEAKGEIAYAASFIEWFAEEAKRVYGDTIPGHQPDKRLIVIKQPIGVTAAITPWNFPAAMITRKAGPALAAGCTMVLKPASQTPYSALALVELAHRAGIPAGVLSVVTGSAGEVGGELTGNSLVRKLSFTGSTEIGRQLMEECAKDIKKVSLELG

SEQ ID NO: 76349 - protein, 496 aa, Pastinaca sativa
MIGVWCMLLAYTLVSIGRIRAKATRKLPPGPFPLPIIGNIHKLGKHPHKSLANLAQVYGPIMRLKLGHMTTVVISSSTTARQVLRKQDIAFSNRALPNAVRALDHNKYSAVWLPVGSQWRGLRKIMSMNLFTANKLDANQHLRSQKVHDLIRYCEKCSQSGEAVDIGGAAFLTSLNLMSNTIFSKDMIDSYENSEAKVFRDLVWNIMVEIGKPNLVDYFPLLQWMDPQGIKRRLAYNFDTLIKLFDVMVDERLELNGPQNSRDVLDELLKLVNTDEIDKSHIQHMFLDLFGAGTDTSSSTVEWAMSEILRKPATVLVKAKAELDQVIGNGKIVEEADISKLDYLRCIVKETLRLHPPAPLLVPRQVQEEVELCGYTVPKNSQVLVNAWAIGRDPMLWENPLSFQPERFVDSEIDINGHGYELIPFGAGRRICPGMPLAMRMVPIMLGSLLNCFDWKLQGGIAPEDLNMEDKFGLTLAKLHPLRVVPTSRPTHLFAF

SEQ ID NO: 76350 - protein, 267 aa, Populus trichocarpa
MLQHMHSVLLLLLLVFAFCISNSNFTVNGENAPAPSPTSSSIPKSPSSSSPSPSTTSPPSSPSKSPATSPSTSPPTLPVSPSKSPATSPSPSTSLPTIPVSPSKSPATSPSPSTSLPTIPVSPSKSPATSPSSSTSPPSPTVSPPTPSPNAAAPSGSPPASSPAVSTPVTAPTLAPLGAPPMSTEGPVTAATPEASASIPSSSATPAEAPMVFPSSSSPPSPSTESSMSPETAKVPSVNDESGSRSLYEVGVILSGLVGGAALALAI

SEQ ID NO: 76351 - protein, 466 aa, Rhizobium leguminosarum bv. viciae 3841
MSTTLLSVDGLSPKLAHLSDLVDRYASPEFAVAHGGRVQTIAAGHYTVHGLSRHVRLGEFVAHKSATGIHLGEVVRVEPELIYVCPIEPGEPIGIHDTVIRKGAFRISPTDSWCGRTVNSLCEPIDGLGPITEGLDRRSISNTAPPSMTRKRVETGFKTGVRAIDIFSPLCLGQRLGIFAGSGVGKSTLLSMLARADAFDKVVIALVGERGREVREFIEDTLGSNMKKAIAVVATSDESPMLRKMAPLTAVTIAEHFRDKGENVLFIVDSVTRFAHAIREVATASGEPPIARGYPASVFTELPRLLERAGPGPEGAGTITAIISILVDGDNHNDPIADSTRGILDGHIVLQRSLAEEGRYPPIDPLASISRLARKAWTPDQEKLVSRLKVLIHRFEETRDLRMIGGYRQGADPDLDMAIKQVPIIYDVLKQSPGDRDSLDAFADLAGALKAAAGMGNQGAPIQRRG

SEQ ID NO: 76352 - protein, 388 aa, Oryza sativa
  misc_feature (173)..(173): Xaa can be any naturally occurring amino acid
MLPQQQQQQKQQAAALMPPSMYAMPPPPPLHHHHHPLLAAAPPQQQGKPILTGNLPPGFDTSTCRSVYVGNVHVQVTEALLREVFQSTGLVEGCKLIRKEKSSYGFVDYYDRRSAALSILTLNGKQIPEVTDSALFAFFSGYSSCSDARVMWDQKTGRSRGYGFVSFRNQQVXGQWLGSRQIRCNWATKGASNGEQQTSDSKNVADLTNNLTEDGKEKANEDAPENNPQYRTVYVGNLAHEVTQDVLHRLFHALGAGAIEEVRIQLGKGFGFVRYSNHAEAALAIQMGNGRILGGKPIKCSWGNKPTPPGTTSAPLPPPAAPSVTAADLLEYQRSLALSKMVSSQALMQAQAQQHLKQAMGMGAGVSQAMYDASFPNVGPSQQQLMYY

SEQ ID NO: 76353 - protein, 128 aa, Psychrobacter arcticus 273-4
MAYSDQVIDHYENPRNVGNLDKNAKNVGTGMVGAPACGDVMRLQIQVDDNGIIEDARFKTYGCGSAIASSSLVTEWLKGKSLDQAGEIKNSDIAEELALPPVKVHCSVLAEDAIKAAISDYKGKHIPA

SEQ ID NO: 76354 - protein, 300 aa, Physcomitrella patens subsp. patens
MDFLLGGVSAAVSKTSAAPIERIKLLVQNQDEMIKQGRLAEPFKGVVDCFKRTISEEGVFALWRGNTANVIRYFPTQALNFAFKDHFNKLFGMKKDRDGYWWWFAGNLASGGAAGACSLFFVYSLDYSRTRLANDSKSSKKGGGERQFNGLIDVYKKTLASDGVAGLYRGFVISCVGIVVYRGLYFGMYDSLKPVLLVGTLQDNFFASFMLGWSITIGAGLASYPLDTVRRRMMMTSGAAVKYKSSMDAAQQIVVKEGYKSLFKGAGANILRAVAGPGVLSGYDQLQIIFFGKTYSGGGG

SEQ ID NO: 76355 - protein, 571 aa, Candida albicans
MPEDYEKYRMGSSNESHQKSVQPISSSISKSNKKTKHQTDFVQDSDIIEASSINDEFGEVKRDLKARHVSMIAIGGTIGTGLFISTGSLLHTTGPVMSLISFLFVTTICFSVTQSLGEMATYIPISGSFAQFVTRWVSKSCGAANGWLYWFSWAVTFGLELSVVGQVIQFWTDAVPLAAWISIFFVILTIFNFFPVKFYGEVEFWIASIKIIAVFGWIIYAFIMVCGAGKTGPVGFRYWRNGYAWGDGILVNNNGKYVAAFVSGLINSIFTFQGSELVAVTAGEASPRALRSAIRKVMFRILVFYVLCMLFMGLLVPYNDPKLTQDGGFTRNSPFLIAMENSGTKVLPHIFNAVIVTTIISAGNSNIYSGSRILYGLAQAGVAPKFFLRTNKGGVPFFAVAFTAAFGALGYLACSSQGNKAFTWLLNITATAGLISWGFISVSHIRFMKTLQRRGISRDTLPFKAFFMPFSAYYGMVVCFIVVLIQGFTVFWDFNASDFFTAYISVILFVVLWVGFHFFFYGFGKDSFKMSNILVPLDECDIDSGVRDINDAEFDIPPPKNAWDKFWANVA

SEQ ID NO: 76356 - protein, 707 aa, Mesorhizobium loti MAFF303099
MSFRERLQSWRYNLVPDHLVGEILTKRWTDNAIPFLALVVTLATFGSIIPGFFKLNALQESTRQLGEFSMVVTGMTVVMLGGGIDLSVGSIFALSCFSAVYVFFILEQSIWLALAASLATGLIFGAINGYLVGYLRLRAFLTTLVTFIFGRALFDILVTTYAADVQLSTATSDVLDFIGDSTFWGLSVSVWLAIILAIVTHIALTRSRPGWHVLAVGGSRRSAHNAGIRVRRTVFMTYVFSGFCASIGGFLIACRLSGAGPGTGLNLEIMALTAAVVGGVSLGGGRGSVIKGLMGAIIVLTMTNGLIRLGYGTGTNQMVLGIMLAVAVTIDIRWLKNRHKVLNEVYVAPVYLKMGETQSAVPGSGTPYELDNRLSAADHIGLGELEGPEDVILDRDDHLYCGTRHGEIVRFFAPDYVKSEVFAHIGGFPLGLAFDKSGNLISCVGAMGLYSVSPQREVKRLSAETARSWTSIVDDARLRDPNDCDIAPDGRIYFTDSTKRYDAHDWALDSIENRATGRLLVYDPKDGSTKTLLDGYRYTNGVCMAHDGKSLFFAESWACRVHRYWLEGPKAGTAECVIRDMPGYPDNINRASDGNYWMAWLGMRTPSFDLSLRHPDMRKRMTRRLPQDEWLFPNINTGGVVKFNEKGGIVEAMGDLSGGAHPMVTSMREHKGYLFVGGILNNRVGRYKISGADPNWTSPASYWGAKP

SEQ ID NO: 76357 - protein, 336 aa, Dechloromonas aromatica RCB
MSYQVTVQPSGKQFAAEADETLLDAALRQGLTLPYGCKDGACGACKGKVVSGTVDHGKAQAHALKDDEKAAGQTLYCCAKAQSDLVIECKQVSSAGDIPVKTLPSRIEKLEKLAPDVIELQLRLPASERLQFWAGQYIDILLKDGKKRSYSLANAPHDDALLQLHIRHVPGGLFTDQVFSTMKVRDILRFNGPHGTFYLREDSKKPMILLAGGTGFAPIKAIVEHAIAEQCERPMFIYWGAKARVDLYQNALPEQWTAEHGSIKYVPVLSEPASGEWAGRSGFVHQAVLADFADLSGYQVYACGAPVMIEAAKRDFMARGLPEEEFFADAFTFSTN

SEQ ID NO: 76358 - protein, 296 aa, Dechloromonas aromatica RCB
MQKILIVGSGDVARRILSRLARRACVYALLRDAARAAEWRAAGAVPVLADLDDRGSLQRIAGLADVVLHLAPPPGEGRRDTRTRNLLAALGKAKSLPRQLIYVSTTGVYGDCGGAQIDETRRLNPESARAGRRVDAERCLRDWGARTGVLVSILRAPGIYAADRLPLERLQKGTPALLGEDDGYTNHIHANDLAAACIAALRNGRGNRVYNVVDDSDLKMAEYFDRVADAFALPRPPRISRREAEKTLSPVQMSFMRESRRIGNQRLKKELKLRLAYPTVDVGIAESLARRNACSS

SEQ ID NO: 76359 - protein, 513 aa, Arabidopsis thaliana
MAAAAFGQLNLEEPPPIWGSRSVDCYEKLEQIGEGTYGQVYMAKEIKTGEIVALKKIRMDNEREGFPITAIREIKILKKLHHENVIHLKEIVTSPGRDRDDQGKPDNNKYKGGIYMVFEYMDHDLTGLADRPGLRFTVPQIKCYMKQLLTGLHYCHVNQVLHRDIKGSNLLIDNEGNLKLADFGLARPYSHDHTGNLTNRVITLWYRPPELLLGATKYGPAIDMWSVGCIFAELLNGKPILPGKTENEQLNKIYELCGSPDESNWPGVSKMPWYNQMKSSRPLKRRVREIYRHFDRHALELLEKMLVLDPSQRICAKDALDAEYFWTDPLPCDPKSLPTYESSHEFQTKKKRQQMRHNEEAAKKQKLQHPQQQHSRLPPQQHGVGQSHAAPLWPAGPNHPMNNNAPPPQIPAGGHYYGGKPRGGAPVPNRYPPSGNQTGGYNNQSRGGYSSGAYPPQGRGAPYGAGPRGPSGGYGVGPPNYSQGGGQYGGSGGSGRGQNPMGGARNQQYGWQP

SEQ ID NO: 76360 - protein, 137 aa, Zea mays
  misc_feature (91)..(91): Xaa can be any naturally occurring amino acid
PFPRANGGGEIRFEGPPGKVVILSSHLGRPKGFTPRFSLAPLVARLSDFLDIQVQKADDVIGPEVEKLVAALPNGGVLLLENVRFYKEEVXNDPEFAQKLASVADLYVNDAFGTAHRAHASAEGVYKFLKPSVAGSF

SEQ ID NO: 76361 - protein, 571 aa, Arabidopsis thaliana
MQMEANDCQEEHKFTLDNYHVVEQVRRGKSSSDFVVLHDIEDKKYAMKKICLAKHTDKLKQTALQEMKLLSSLKNPYIVHYEDSWIDNDNNACIFTAYYEGGNMANAIKKARGKLFPEERIFKWLAQLLLAVNYLHSNRVVHMDLTCSNIFLPKDDHVQLGNYGLAKLINPEKPVSMVSGISNSMCPEVLEDQPHGYKSDIWSLGCCMYEITAHQPAFKAPDMAGLINKINRSLMSPLPIVYSSTLKQMIKLMLRKKPEYRPTACELLRNPSLQPYLLQCQNLSPIYLPVFPIKPVNSPKDKARRNSLPGKFGKERVSREKSEVSRSLENLYPFWTNTETGSSSSSQPASSTNGAEDKLETKRIDPSCDTLKISEFTSQKSDESLIDPDIAVYSTETPAEENALPKETENIFSEESQLRDVDVGVVSAQEVACSPPRAIEEAETQEALPKPKEQITVPISSVAHSSTEVAAAKDHLSGSLEGDKAKMVKLTASEMSSVLSKLTKLGPPQSKERADALECLLEKCAGLVKQEKYEELAGLLTPFGEDGVSARDTAIWFAKTLLSSDKLNQGT

SEQ ID NO: 76362 - protein, 261 aa, Saccharomyces cerevisiae
MTKFIGCIDLHNGEVKQIVGGTLTSKKEDVPKTNFVSQHPSSYYAKLYKDRDVQGCHVIKLGPNNDDAAREALQESPQFLQVGGGINDTNCLEWLKWASKVIVTSWLFTKEGHFQLKRLERLTELCGKDRIVVDLSCRKTQDGRWIVAMNKWQTLTDLELNADTFRELRKYTNEFLIHAADVEGLCGGIDELLVSKLFEWTKDYDDLKIVYAGGAKSVDDLKLVDELSHGKVDLTFGSSLDISGGNLVKFEDCCRWNEKQG

SEQ ID NO: 76363 - protein, 639 aa, Escherichia coli W3110
MNKFIAAEAAECIGCHACEIACAVAHNQENWPLSHSDFRPRIHVVGKGQAANPVACHHCNNAPCVTACPVNALTFQSDSVQLDEQKCIGCKRCAIACPFGVVEMVDTIAQKCDLCNQRSSGTQACIEVCPTQALRLMDDKGLQQIKVARQRKTAAGKASSDAQPSRSAALLPVNSRKGADKISASERKTHFGEIYCGLDPQQATYESDRCVYCAEKANCNWHCPLHNAIPDYIRLVQEGKIIEAAELCHQTSSLPEICGRVCPQDRLCEGACTLKDHSGAVSIGNLERYITDTALAMGWRPDVSKVVPRSEKVAVIGAGPAGLGCADILARAGVQVDVFDRHPEIGGMLTFGIPPFKLDKTVLSQRREIFTAMGIDFHLNCEIGRDITFSDLTSEYDAVFIGVGTYGMMRADLPHEDAPGVIQALPFLTAHTRQLMGLPESEEYPLTDVEGKRVVVLGGGDTTMDCLRTSIRLNAASVTCAYRRDEVSMPGSRKEVVNAREEGVEFQFNVQPQYIACDEDGRLTAVGLIRTAMGEPGPDGRRRPRPVAGSEFELPADVLIMAFGFQAHAMPWLQGSGIKLDKWGLIQTGDVGYLPTQTHLKKVFAGGDAVHGADLVVTAMAAGRQAARDMLTLFDTKAS

SEQ ID NO: 76364 - protein, 244 aa, Streptococcus pyogenes M1 GAS
MEIKGKNIFITGSTRGIGLAMAHQFASLEANIVLNGRSAISEELVASFTDYGVTVVTISGDVSEASEAKRMVNEAIESLGSIDVLVNNAGITNDKLMLKMTEEDFERVLKINLTGAFNMTQSVLKPMIKARQGAIINVSSVVGLTGNIGQANYAASKAGMIGFTKSVAREVAARNICVNAIAPGFIESDMTGVLPEKMQEQILSQIPMKRIGKAQEVAHLASFLVEQDYITGQVIAIDGGMTMQ

SEQ ID NO: 76365 - protein, 359 aa, Chlamydomonas reinhardtii
MQLQQKALRLQSTFPTRVSRVALVPKAVAAPEKAAVKMNIATDVTELIGKTPMVYLNKVATGTHAKIAAKLEIMEPCCSVKDRIGYSMISSAEKEGLITPGKTVLVEPTSGNTGIGLAFIAAARGYKLILTMPASMSLERRILLRAFGAELVLTDPAKGMKGAVAKAEEILASTPDAFMLQQFQNPNNPKVHYETTGPEIWSATDGKVDILVSGVGTGGTITGTGRYLREKKSDVQLVAVEPAESPVLSGGKPGPHKIQGIGAGFVPAVLDTALISEVVQVSSDDAIDMARRLALEEGLMVGISSGAAVQAAIKVASRPENEGKLVVVVLPSFGERYLSSVLFQQLRDEASKMTFEPSA

SEQ ID NO: 76366 - protein, 381 aa, Vitis vinifera
MACSVAVNNSPVFSPSSSLFCKTSVSSPETLTRHHHVSSPSSPSSPFRLRLPKSLTGLRPCKEGPASSSSSSAAAAAASASASSPTVLKRKRPARLDIPIASLSFPAPVPVGEGCREAVEDERDGYYSVYCKRGRREAMEDRYSAVVDLQGDHKQAFFGIFDGHGGAKAAEFAAQNLKNNILDEVVRRGDDEIEESVKHGYLNTDSDFLKEDLRGGSCCVTALIRNGKLAVSNAGDCRAVMSRGGIAKALTSDHRPSREDEKSRIEKLDGYVDCYHGVWRIQGSLAVSRGIGDRHLKQWVTAEPETKILAIQPDYEFLILASDGLWDKVTNQEAVDISRPFCIGVDKPDPLFACKKLVDLSVSRGSTDDISVMLIRLGQYI

SEQ ID NO: 76367 - protein, 176 aa, Wolbachia endosymbiont strain TRS of Brugia malayi
MYRIVSSNILKYKNCEPKIDESAFIAGDSHIVGKVEIGREASIWFNCVIRGDIGSIKIGDGTNIQDGTVIHVDRNPGGDTIIGDMVTVGHFCMLHACTVHDKALIGMGSIVMDHAIVESEAMVAAGSLVTHRKVIKSGEMWAGRPAKFFKKISDEEVKYITQSAQNYIMLMKKYKN

SEQ ID NO: 76368 - protein, 352 aa, Chlamydomonas reinhardtii
MLCGCGGAKQVSRVALVPKAVAAPEKAAVKMNIATDVTELIGKTPMVYLNKVATGTHAKIAAKLEIMEPCCSVKDRIGYSMISSAEKEGLITPGKTVLVEPTSGNTGIGLAFIAAARGYKLILTMPASMSLERRILLRAFGAELVLTDPAKGMKGAVAKAEEILASTPDAFMLQQFQNPNNPKVHYETTGPEIWSATDGKVDILVSGVGTGGTITGTGRYLREKKSDVQLVAVEPAESPVLSGGKPGPHKIQGIGAGFVPAVLDTALISEVVQVSSDDAIDMARRLALEEGLMVGISSGAAVQAAIKVASRPENEGKLVVVVLPSFGERYLSSVLFQQLRDEASKMTFEPSA

SEQ ID NO: 76369 - protein, 580 aa, Acidovorax sp. JS42
MSSSLLHRWFPFLSWPRPTSALLQGEFWAGMTVGLMLVPQGVAYAALAGMPLVTGIYASLVPALVAVLWSSSTRLGVGPTALTSLLIGASITGLAEPGSAHWVTLAVWMALLSGLLQLLLGVVRFGWLLNLVTSPVLGGFTQAAALLILASQLPDLLGLRTSWSALAVSPSLHHFDLRALAFGLGSLGCLVLARRWRSSFPAAIVVIALAALISWAMGYADADGAVIGHLPSGLPTLYWPGWLSWEEMGALVMPVMVVTLVSFLETASSAKVEHHQGGTRWNENQDLIAHGMAKISSGLCGSFATSASFSRSAINLYAGAKSGWATLFALVLVLATLLWLTPALYHVPQPVLAAVVVTAVTSLIKPAGMFRLWRVSRVETAIGLVTFGLTLATAPRMYWGVLVGLLMNLSHFLYQRLHPRIIEVGLHPDGSLRDRHLWQLPPLAPELLALRMDAELDFASANALERRVTDELAQRPSIRHLCLFALPINRIDVTGVEAFIRLRTLLQSHGGTLHVTGIKLPVQHTLDNAGALAPGPNFALYRTDAEAIAALQRLAPPDAGKPASAPQSDTSGPAQPLPKL

SEQ ID NO: 76370 - protein, 481 aa, Mesostigma viride
MTAIETKRIGSITQIIGPVLDAKFPPGQMPNIYNALIVKAKNEAGEDLSVTCEVQQLLGDNQVRAVAMSATDGLMRGLEILDTGAPLSVPVGEITLGRIFNVLGEPVDGLGDVVAKTKSPIHRNSPTFIELDTKLSIFETGIKVVDLLAPYRRGGKIGLFGGAGVGKTVLIMELINNIAKAHGGVSVFGGVGERTREGNDLYMEMKESKVINEENLSSSKVALVYGQMNEPPGARMRVGLTALTMAEYFRDVNNQDVLLFIDNIFRFVQAGSEVSALLGRMPSAVGYQPTLSREMGTLQERITSTKQGSITSIQAVYVPADDLTDPAPATTFAHLDATTVLSRNLAAKGIYPAVDPLDSTSTMLQPWIVGEEHYGTAQRVKQTLQRYKELQDIIAILGLDELSEEDRLVVARARKIERFLSQPFFVAEVFTGSPGKYVSLADSIKGFTMILNGELDSLPEQAFYLVGNIEEAIAKAATLKE

SEQ ID NO: 76371 - protein, 272 aa, Nostoc punctiforme PCC 73102
MTIKFGLIGGGVMGEALLSRLIARGIYQSSEVIVSEPLPSRLDFLQQQYGVSVTTDNSEVFTQAKEVVFLAVKPQVFSAIAQELADIDIINREQSPLIISILAGVPLNQLEAAFVQLPVIRAMPNTPATVGAGITAICLGAYTNTKHHQIAQQVFSAVGEVVEVSEGLMDAVTGLSGSGPAYVALLVESLADGGVSAGLPRAIANQLALQTVLGTAKLLYETKMHPAELKDRVTSPGGTTIAGIAKLEQAGFRSALIEAVKAATERSQELGK

SEQ ID NO: 76372 - protein, 162 aa, Populus trichocarpa
MAPIAVGDVLPDGKLAYFDEQDQLQEVSVHSLVAGKKVILFGVPGAFTPTCSLKHVPGFIEKAGELKSKGVTEILCISVNDPFVMKAWAKSYPENKHVKFLADGSATYTHALGLELNLQEKGLGTRSRRFALLVDDLKVKAANIEGGGEFTVSSADDILKDL

SEQ ID NO: 76373 - protein, 222 aa, Nostoc punctiforme PCC 73102
MNSSISERIVSIRSSLPTSVKLIAVSKQVPVEAIRFAYSAGIRDFAESRIQEAASKQAELHDLPDITWHFIGHLQSNKAKKAIEQFPWIHSVDNLKLAQRLDQLAQQLRVSPQVCLQVKILPDPNKSGWSVPELLADLPTLDQYKNLQIQGLMTIPPSGLNNPEILNVFNLNRELAKKIQEQNWSHIKMQQLSMGMSGDYELAVQAGATMVRLGTILFGDRS

SEQ ID NO: 76374 - protein, 433 aa, Neisseria gonorrhoeae FA 1090
MPSEHQHTSSLLNFDRTHLLHPYTSMTDPLPVYPVKRAEGVFIELADGTRLIDGMSSWWCAIHGYNHPVLNQAVENQMKQMAHVMFGGLTHEPAVELGKLLVGILPQGLDRIFYADSGSVSVEVALKMAVQYQQARGLTAKQNIATVRRGYHGDTWNAMSVCDPETGMHHIFGSALPQRYFVDNPKNRFDDEWDGADLQPVRALFEAHHVDIAAFILEPVVQGAGGMYFYHPQYLRGLRDLCDEFDIVLIFDEIATGFGRTGKMFACEHAEVVPDIMCIGKGLSGGYMTLAAAITSQKVTETISRGEAGVFMHGPTFMANPLACAVACASVKLLLSQDWQANIRRIESILKGRLKAAWDIRGVKDVRVLGAIGVIELEKGVDMARFQADCVAQGIWVRPFGRLVYLMPPYIISDGILTKLADKTVQILKEHSK

SEQ ID NO: 76375 - protein, 459 aa, Emericella nidulans
MSNLPVEPEFEQAYKELASTLENSTLFEQHPEYRRALQVVSVPERVIQFRVVWENDKGEVQINRGYRVQFNSALGPYKGGLRFHPSVNLSILKFLGFEQIFKNALTGLNMGGGKGGSDFDPKGKSDSEIRRFCTAFMTELCKHIGADTDVPAGDIGVTGREVGFLFGQYRRIRNQWEGVLTGKGGSWGGSLIRPEATGYGVVYYVQHMIKHVTGGKESFAGKRVAISGSGNVAQYAALKVIELGGSVVSLSDSKGSLIVKDESASFTPEEIALIADLKVARKQLSELATSSAFAGKFTYIPDARPWTNIPGKFEVALPSATQNEVSGEEAEHLIKSGVRYIAEGSNMGCTQAAIDIFEAHRNANPGDAIWYAPGKAANAGGVAVSGLEMAQNSARLSWTSEEVDARLKGIMEDCFKNGLETAQKFATPAKGVLPSLVTGSNIAGFTKVAEAMKDQGDWW

SEQ ID NO: 76376 - protein, 476 aa, Physcomitrella patens subsp. patens
MGADLFGSFAESTCAALVVSSISSFGNDKNFVAMCFPLLISSAGILVCLLTTLVATDIMSVKGVKEIEPTLKRQLVISTVLMTVAIFLISWFGLPETFTINVVGHEAKVVKNWHIFFCVGSGLWAGLIIGFVTEYFTSNAYTPVQDVADSCRTGAATNIIFGLALGYKSVIVPVFAIAVAIYLSFSLAAMYGIAVAALGMLSTLATGLAIDAYGPISDNAGGIAEMAGMSHEVRERTDALDAAGNTTAAIGKGFAIGSAALVSLALFGAYVSRAGIASVDVIQPKEFVGLIVGAMLPYWFSAMTMKSVGKAALAMVEEVRRQFRTIPGLMEGTTKPDYKRCVKISTDASLKEMIPPGALVMLTPLIVGTLFGVETLAGLLAGALVSGVQIAISASNTGGAWDNAKKYIEAGASEHAKSLGPKGSDAHKAAVIGDTVGDPLKDTSGPSLNILIKLMAVESLVFAPFFAANGGWLFRQ

SEQ ID NO: 76377 - protein, 523 aa, Chlorella sorokiniana
CRPPSSPSLSWPPGLRSPALPRAVACARGRSAKRDVAAKRLRSRSPRMDATTGDFTALQKAVKQMATKAGTEGLVHGIKNPELRQLLTEIFMKDPEQQEFMQAVREVAVSLQPVFEKRPELLPIFKQIVEPERVITFRVSWLDDAGNLQVNRGFRVQYSSAIGPYKGGLRFHPSVNLSIMKFLAFEQIFKNSLTTLPMGGGKGGSDFDPKGKSDAEVMRFCQSFMTELQRHISYVQDVPAGDIGVGAREIGYLFGQYKRITKNYTGVLTGKGQEYGGSEIRPEATGYGAVLFVENVLKDKGESLKGKRCLVSGAGNVAQYCAELLLEKGAIVLSLSDSQGYVYEPNGFTREQLQAVQDMKKKNNSARISEYKSDTAVYVGDRRKPWELDCQVDIAFPCATQNEIDEHDAELLIKHGCQYVVEGANMPSTNEAIHKYNKAGIIYCPGKAANAGGVAVSGLEMTQNRMSLNWTREEVRDKLERIMKDIYDSAMGPSREYNVDLAAGANIAGFTKVADAVKAQGAV

SEQ ID NO: 76378 - protein, 139 aa, Triticum aestivum
  misc_feature (39)..(39): Xaa can be any naturally occurring amino acid
  misc_feature (72)..(72): Xaa can be any naturally occurring amino acid
KAGGAHPEESKKARWCISAIVPRGYHGGVASENGGPSGXVERWRNSGRCECGGWDLGCPIRVLSNDGGGSSXPPEDGAKSVELSPAGARSGGEPAVRLVSLAEGLYILYFDAGVVSPLQCFAAGVAVVHSQAPQLHPKL

SEQ ID NO: 76379 - protein, 535 aa, Brassica napus
SFKDKTYEGNNNNLPEENSITITHVSSVHSPTTEQDFPKEDNNNNKSPVLVLPVKEPFMRRNMDNQAYYVLGHKTPNIRDLYTLSRKLGQGQFGTTYLCTEVATGVDYACKSISKRKLISKEDVEDVRREIQIMHHLAGHKNIVTIKGAYEDPLYVHIVMEVCAGGELFDRIIQRGHYTERKAAELTKIVVGIVEACHSLGVMHRDLKPENFLLVNKDDDFSLKAIDFGLSVFFKPGQIFKDVVGSPYYVAPEVLLKHYGPEADVWTAGVILYILLSGVPPFWAETQQGIFDAVLKGDIDFESDPWPVISDSAKDLIRKMLCSNPSERLTAHEVMRHPWICENGVAPDRALDPAVLSRLKQFSAMNKLKKMALKVIAESLSEEEIAGLRAMFEAMDTDNSGAITFDELKAGLRRYGSTLKDTEIQDLMEAADVDNSGTIDYSEFIAATIHLNKLDREEHLVSAFQYFDKDGSGYITIDELQQSCVEHGMTDVFLEDVIKEVDQDNDGRIDYGEFVAMMQKGNAGIGRRTMRNSLN

SEQ ID NO: 76380 - protein, 435 aa, Halobacterium salinarum
MTMASKSDSTHDESGDEAADSTEPESALETARRQLYHAASYLDIDQNIVERLKYPKKVHEVTIPIERDDGTVEVFTGYRAQHDSVRGPYKGGLRYHPDVTRDECVGLGMWMTWKCAVMDLPFGGAKGGVAVNPKELSPEEKERLTRRFTQEIRDVIGPNQDIPAPDMGTDPQTMAWLMDAYSMQEGETTPGVVTGKPPVVGGSEGREEAPGRSVAIITQLVCEYYDQPLDETTVAVQGYGSVGANAARLLDKWGATIVAISDVNGAMYEPDGIDTASVPSHDEEPEAVTTYADTVISNEELLTLDVDVLIPAALGNVITKENAEAIAADLVVEGANGPTTSTADSILADRDVAVIPDILANAGGVTVSYFEWLQDINRRAWSLERVNDELEAEMQAAWRAVKDEYENRDVTWRDAAYIVALSRIAEAHEARGLWP

SEQ ID NO: 76381 - protein, 294 aa, Bordetella pertussis Tohama I
MSERVLLAGCGDLGVRVARRLLARGDQVWALRRQPPPAEDGGLRWIAADLTQPATLAGLPDGLTQVVYLPAPGAHDPARYREIFVDGLRHLRDALDTAALRRTLFVSSSAVYGEHDGQWVDEHTPPGPLGFNGRSLLEAERSLDAWPGQAVVLRLAGLYGPGRLQLLERLRAGQARAPVDPPHWANRIHIDDAAAAIAHLLRLPAPEKLYLGCDDTTLPLHELYAALATLAGAPPPGEGPAPAQVGSKRLCNARLRASGLQLQWPDSRAGYAALLDGKATLQATIHTTTKRSIP

SEQ ID NO: 76382 - protein, 306 aa, Bifidobacterium longum NCC2705
MKQIPLIIDTDPGIDDAVAIALAVFNPRFDVRLITTVAGNVSIEATTTNALKLMAYYGKDVPVARGAAEPLIRQLDDASDIHGKTGMEGFDFPEPKTELLLDKHAVEAMHDEIMASAEPVTVMPIGPLTNIALLLKTFPEVKSRIERIVLMGGSVTRGNKGVMAEFNIFVDPEAAKIVLTSGLDITMATLDAGLGTVIPPEKTAQLKDMGKVGLMAHDLFQRYRKRSFGTGLKMYDACAVACLLEPDLFDMTKAFVDVEIAGELTAGCTVVDLKGYLKREPNATVTTGVHADRFCDWFMDGIAHCA

SEQ ID NO: 76383 - protein, 322 aa, Bifidobacterium longum NCC2705
MSASCLDLLDHLHGSVSVVGSMNVDYTVVTERLPKPGETVNGGPLTLLPGGKSANQASAAARIGAQVRMFGAVGEDTNADFLLEHLRDAGVDTSHIAAVAGPSGTTVITVDANGENTIVYSAGSNGEVSVDYVQQSSDALVAADVLGLCLESPMETVTACARLCHDAGLKVLLNDSPFVAELPAELIEASDILLVNEHEMAQLLDIAEPDDDDWDGLDWSDVARQMHDFGFNQAIITLGGDGSVVIDGDDIYRIAPVAVEAIDTTGCGDAFMGTVLAGLASGHALADSAQLASYVSAYAATGFGAQASYGTAAQIRERFGAK

SEQ ID NO: 76384 - protein, 168 aa, Triticum aestivum
  misc_feature (110)..(110): Xaa can be any naturally occurring amino acid
  misc_feature (119)..(119): Xaa can be any naturally occurring amino acid
  misc_feature (131)..(131): Xaa can be any naturally occurring amino acid
  misc_feature (143)..(143): Xaa can be any naturally occurring amino acid
  misc_feature (153)..(153): Xaa can be any naturally occurring amino acid
MEHKETGCQSREGPILCVNNCGFFGSAATMNMCSKCHKEMAMKQEQAKLAASSFDSIVNGGDAAKEHLAAGNTAVAVAHVEAKTLITAQPADIAGPSEAAMENPKGPSRXCSTCRKRVXGLTGFNCRCGNXYCATTVTPDKHXCKFDYRAAAXDAIAKATVVEGENVK

SEQ ID NO: 76385 - protein, 205 aa, Thermosynechococcus elongatus BP-1
MGSNYQNQQNSDEQPWEEEDFAEEMEQLRLYDDEGRFLDCYVEFRLNVQGETYALLRPVDYPVEIFAVVAENDEEETLVPLEEEEIDQVFDTARAILEEQNLTLKRTALTLTVAGELPDLDEDEILTVEVEADDGIEEYQPLGSSFFYEAREYSVYTPLSPTLYVARLVPGQEPQLLSPHEFQHLQPLLEQHLVTHLLEEEDWED

SEQ ID NO: 76386 - protein, 314 aa, Colwellia psychrerythraea 34H
MPDMKIFAGNATPELAKKIANRLYMPLGDAKVGSFSDGEISVEINENVRGADVFIIQSTCAPTNNNLMELIVMIDALRRASAGRITAVIPYFGYARQDRRVRSARVPITAKVVADFLSSVGVDRVLTVDLHAEQIQGFFDVPVDNAFGTPILLDDMQNRELDNPVVVSPDIGGVVRARAVAKLLDDADLAIIDKRRPKANVAQVMHIIGEVEGRDCIIVDDMIDTGGTLAKAAEALKEHGAKRVIAYATHPVLSGNAAQNLRESVIDEVVVTDSIPLSDEIKALKMVRQLTLSGMLSEAIRRVSNEESISAMFD

SEQ ID NO: 76387 - protein, 472 aa, Xanthomonas campestris pv. campestris str. ATCC 33913
MHRHVHEPEILADPAAFEAAEHWRQRDLAVVWHPCTQMREHPHTLPLVPIARGDGAWLIGHDGRHYLDAVSSWWTNLFGHAEPRIGAAIAQQAGRLEQVMLAGFTHAPAVQLAERLLAIAPRQPDRAPLAKVFYADNGSAGVEVALKMAFHYFHNRDEHRRTRFIALENGYHGETIGALSVGDIPLYRRVYAPLLLESIFAPSPDAYLAEPGQSAEDYALQAADALQHLLEQSPGEICALILEPRVQCAGGMRMYHPAYLRRARELCDAHGVFLIADEIATGFGRTGTLFACEQAGVMPDLLCLSKGLTGGFLPLSAVLATQQLYDAFLDDSRERAFLHSHSYTGNPLACAAALATLQIFADDDIIARNQRTAAHMTQLAAQIGEHSAVADVRQAGMIVAFELTQGGDKRTPFPAAARVGLQAYRAALARGVVLRPLGDVLYWMPPYCVDDAQLALLADTTRHAIAKAVACA

SEQ ID NO: 76388 - protein, 391 aa, Oryza sativa Indica Group
MQHQQRMKQAAAAAQQQQMMQQALLMQQQQAAAVAAAAQQQQAPLFPPHHPHPGLLAAPQIEPIVSGNLPPGFDSSTCRSVYVGNIHLQVTDSLLHEVFQSIGPVEGCKLIRKEKSSFGFVDYYDRRSAAIAIVSLNGRQLDARVMWDQKTGRSRGFGFVSFRNQQDAQNAINELNGKWLGNRQVRCNWATKGANAGEEKQNTDSKGMIELTNGSSEGGKDNANEDGPENNPQYTTVYVGNLPHDVNSNDVHRFFHSLGVGSIEEVRVTRDKGFGFVRYSTHEEAALAIQTGNGQLIGGRQIKCSWGSKPTPPGTASAPLPPPAPTPFNPGMSATDLLAYERTLALSKMAANPALMSQHAALKQAAAMGMGAGASQAIYDGGYQSANAVFY

SEQ ID NO: 76389 - protein, 81 aa, Thermosynechococcus elongatus BP-1
MNQSEILEKVKAIVADQLSVDPEKVVPEASFAEDLNADSLDSVELIMALEEEFGVEIPDEEAEKLKTVQDVLDFINNKVAA

SEQ ID NO: 76390 - protein, 215 aa, Haemophilus influenzae R2846
MNQSILSPFGNTAEERVLNAINAFKNGTGVLVLDDEDRENEGDLIFPAETITPEQMAKLIRYGSGIVCLCITDERCQQLNLPPMVEHNNSVNKTAFTVTIEAAKGVSTGVSAADRVTTIQTAIADNAVPTDLHRPGHLFPLRAANGGVLTRRGHTEASVDLARLAGFKEAGVICEITNDDGTMARTPEIVEFAKKFGYSVLTIEDLVEYRLAHNI

SEQ ID NO: 76391 - protein, 223 aa, Carboxydothermus hydrogenoformans Z-2901
MFGWYRRLKRDIQVVFERDPAVKSVWEVLLCYPGFHAIQFHRIAHFFYKKRWFVLARFISQISRFLTGIEIHPGAKIGEGLFIDHGMGVVIGETAEIGDNVTIYQGVTLGGTGKEKGKRHPTIGNNVVISAGAKILGSFKVGDNSKIGAGSVVLKEVPPNSTVVGVPGKVVIRDGKRVDEEIDLRHDLLPDPIAEMLMCMHRKIERLEKRIAELEEERKRENL

SEQ ID NO: 76392 - protein, 322 aa, Prochlorococcus marinus subsp. marinus str. CCMP1375
MPIANDITSLVGQTPLVRLNRLPKAFGCKAEVLAKLESFNPTASVKDRIAGAMVVEAEKQGTIKPGETVLIEPTSGNTGIALAMVAAAKGYRLILTMPDTMSTERRSMLRAYGAELQLTPGKDGIQGAINLAKELVASISHSYLLQQFDNPANPQIHEATTAEEIWSDCEGKLDGLIAGIGTGGTITGCARVLKARNPALKIYAIEPSSSAVLSGKEPGPHSIQGIGAGFIPKVLDISLIDEVIEINDQEAMEAGRKLAKEEGLLSGISSGAALAAALKIGKRPEMENKRLVVVFPSFGERYLSTSMFNNLSTSQPKKDGYI

SEQ ID NO: 76393 - protein, 440 aa, Wolbachia endosymbiont strain TRS of Brugia malayi
MEYEQWKEILSAIDKETDLSKDNVIAKIKEKLKALDSSTYEEWKETNFDVNHLFAVKYGLLHLAVHNNLKNVVNALFGVEGIDVNAVDKDKHTSLHLAVEKGHIGIVNSLLEVKADVNVEDENGKTPLYTAVQFGCKGEIEVLIGKMMIGALIRAGANVNAEDKDKCTPLHFAARCGRKEIVQTLIEAGANVNAANEDKRTPSHIATQFCRKEIVKVLVEAGADVRAADKYGITPLHFADGAETVKTLIGAGANVNVVDKDKRTPLHWVKGAETAETLIEAGVNVNTIDKGKRNPLHMAARCSCEGVIKTLIGKRADLLSKNNDSKIPSNFNKSHYIIRRVKSLWSEERMKRLDQQSKVSFVVFGLTILFGTATATTLFVTETIAFGPYPIIGTVVIVAAAAWVVSCAADKILEPSTKIDEMKAVQVDENMQKAPLNLST

SEQ ID NO: 76394 - protein, 537 aa, Oryza sativa Indica Group
MELGLGMGMGLGDPPADYGSIAAVGLFVALICVCIVVGHLLEESRWMNESITALIIGLGTGGVILMVSSWKHSRILVFSEDLFFIYLLPPIIFNAGFQVKKKQFFRNFMTITLFGAIGTLISFSVISLGSLGLISRLNIGSLDLGDYLALGAIFSATDSVCTLQVLNQDETPFLYSLVFGEGVVNDATSVVLFNAMQNFDLANFSSVKFLQFIGNFLYLFATSTFLGVAAGLLSAYIIKKLYFGRHSTDREVSIMMLMAYLSYMLAELLDLSGILTVFFCGIVMHAFATLSFIAETFLFLYVGMDALDMEKWKIVGETYSPMKSIALSATILFLVLVARAAFVFPLSFLANLTKKTEEGKISIKQQVTYMMWVIQVIIWWAGLMRGAVSIALAYNKFTRSGHTQLPSNAIMITSTITVVLFSTMVFGLLTKPLIRLLVPARHLNRESSALSDPPSPKSFLDPLILNGSDADLEIGVGIRRPTSLRLLLASPTRSVHHYWRKFDNAFMRPVFGGRGFVPFVPGSPTERSVPLLQGNEN

SEQ ID NO: 76395 - protein, 328 aa, Wolbachia endosymbiont strain TRS of Brugia malayi
MKIRVGINGLGRIGRSVLRAIHEVGKYNEQIEVVAVNGSLSTEQHAHLIRYDSVHGKFNGDIGFNESENWISTNGKKFSLYRERNPENIPWDVDVVLECTGAFNKRAEAAKHNTGKVIVSAPVSDADITIVYGVNNDMLKKEHKVISAGSCTTNCLAPVVKVLHFNLDMKSGFMTTVHAYTNDQNVLDGNHRDLRRARACGLSIVPTTTGAAKTIGSVIPELKGKLDGTAIRVPVANVSMVDLKFTTDKKVTAKEINEIFKNSVNDVLSICKEPLVSIDFVHNPYSAIVDLAGTYVTGDICRVAAWYDNEWAFSLRMLDIALLCYNRI

SEQ ID NO: 76396 - protein, 469 aa, Erwinia carotovora subsp. atroseptica SCRI1043
MIVPVIMAGGSGTRLWPLSRALYPKQLLALHSDVTMLQATISRLAGFESEAPLVICNEAHRFIVAEQLRELRCEGKIILEPCGRNTAPAIAVAALQAMRLAPDVDPILLVLAADHVIENEDAFTQAVNQAQPLTALGKLITFGIVPTEAHTGYGYIRRGISVNDAAFTVDCFVEKPNASTAEAYVSSGDYYWNSGMFMFKASVYLNALKEHRPDIFAACEQACANSREDLDFTRLDEAAFTDCPDDSVDYAVMEKTSDAVVIPLAAGWSDVGSWSSLWGILEKDESGNVNIGEVIALDSHNNYISSDSALVATIGINDVVIVNTGDALLVAAKDRSQDVKKVVDRLKESNLHHYREHPESFRPWGKISNIDSGDHYQVKKIIVHPGHGLSLQQHFHRAEHWVVLVGTAKVNIDEKEFFLSENQSTFIPPGAVHTLENPGVIDLVMIEVRSGHYLADDDIVRLQDRYGRI

SEQ ID NO: 76397 - protein, 310 aa, Rhodopseudomonas palustris CGA009
MMSNNMPRHFLDLTELPTSELRNMLSAAVAMKAKRKANADGEKPLAGKTLAMIFDKPSTRTRVSFDVGMRQLGGESIMLTGAEMQLGRGETIADTARVLSRFVDIIMIRILNHEALLELAANATVPVINGLTRKSHPCQVMADVMTFEEHRGPIKGRTIAWTGDDNNVLASFAHAAQRFEFKLNIATPPQLSPSKALRDWIKASGAAITIGTDPEEAVRGADCVVTDTWVSMGDKDGEHRHNLLKPYQVNAKLMSLAHKDAIFMHCLPAHRGEEVTDEVIDGPQSVVFDEAENRLHAQKGILAWCLGAVA

SEQ ID NO: 76398 - protein, 490 aa, Debaryomyces hansenii
MAPLQAIRKYDYLVIGGGSGGVASARRAASYGAKVLLIELKFNKMGGTCVNVGCVPKKVMWYAGDLAEKRHHLKSYGLSTTDDKVKYGDFDWSTFKDKRDAYVKRLNGIYERNLKNEGVDYIYGFAHFANSNGDVEVTLTGDQELSFLEEGKEFKKDEKLVFAGSKTLIATGGYAINPPNVEGHELGTTSDGFFELQKQPKSVAVVGAGYIGVELSGIFKALGSETHLVIRGDTVLRSFDESIQNSITDYYTDKLGVNIIKQSGSVSKVEKIDGDRKKITLGNGQVLEVDELIWTMGRKSLINIGLDKVGVTLNDKQQVDVDQFQQTANPNIFSLGDVIGKVELTPVAIAAGRRLSNRLFSGDKAFENDHLDYSNVPSVIFSHPEAGSIGLSCKEAKEKYGEDQIKIYKSKFNAMYYAMMEDDSLKSPTSYKVVCAGEDEKVVGLHIVGDSSAEILQGFGVAIKMGATKKDFDSCVAIHPTSAEELVTMK

SEQ ID NO: 76399 - protein, 473 aa, Clostridium tetani E88
MSADTSTKGGGMKKTLSLWNFFTIGFGAIIGTGWVLLVGDWMIIGGGPIAAMIAFLIGSLFLLPIGAVFGELTSAIPISGGIVEYVSRTFGNKPSYFTGWFLALGNGILCPWEAIAISSLVGEFIPALKVIPLYEVMGATVYLPPLLISLAFAIYVIRLNFKGASEAAKLQGFLTKLLLAGMVIAMIISLFRGGPKNLQPIYQPKASNARSIWAGILPVLVMTPFFYAGFDTIPQQAEEASEDLDWNKFGKVISMVLIASGIFYVICIYSFGTIVPWQKFVTYTIPALTILSVIGLKIFSKVMMLIAIMGPLGPMNSFFGATARILLAMGRKGQLPEKFKELDKNNGTPKTANILMATLTIIGPFLGKNMLVPLTNVSSLAFIFACFMVSLACLRMRRTEPNIKRPYKVPGGKVGIILACMSSLIIIGLLVIPGSPASLNFVEWMVVLTWFLIGFALMLIRGKKVETKDSGAN

SEQ ID NO: 76400 - protein, 227 aa, Haemophilus influenzae R2846
MELVFIRHGFSEWNAKNLFTGWRDVNLTERGVEEAKAAGKKLLDKGYEFDIAFTSVLTRAIKTCNIVLEESHQLWIPQVKNWRLNERHYGALQGLDKKATAEQYGDEQVHIWRRSYDISPPDLDPQDPNSAHNDRRYANIPSDVVPNAENLKLTLERALPFWEDQIAPAMLSGKRVLVVAHGNSLRALAKHIIGISDAEIMDFEIPTGQPLVLKLDDKLNYVEHYYL

SEQ ID NO: 76401 - protein, 75 aa, Salmonella enterica subsp. enterica serovar Paratyphi A str.
MASDIILKLSQKVNALLARDDVDGVVITHGTDTLDETAYFLNLTVKSDKPVVFTAAMRPASAISADGARTARAGV

SEQ ID NO: 76402 - protein, 447 aa, Oryza sativa
MGPTMIEPFATKRGSKSAGKPVFPDKPHKPPTLRAPRAPRGTRPKTTLEFDPETQRRAVIYRQAVHECVLPLSRPPSSRRRRRRKRTPMALRGGHAAAAAGVSSGSEDDDEEAGFSRSYFLAKEKEPSSGKKRARAAGKLSDLNLVDEQVLRASLAEIPPKHEREVEALTRSYKEQYRNWLFELRCGFGLLMYGFGSKKMLLEDFASTTLSDFTVIVVNGYLPSINLKQEVLVILWRTIDFYIKALNSAKFSALLPFQVIVTIAEIFWEQTKLKRKRQTATRSQLQPFASQSIDDIISFLNNQTSDNGDDNVCLLIHNIDGPALRDAESQQYLAQVSCCPQVHVVASVDHVNAPLLWDKKMVHTQFKWSWYHVPTFAPYKVEGMHFSSLYTKCRERFLVSSQVTLNSHLTEFKDHDLVKIRKHSDGQDCLHIPLVSDALEKLLQELT

SEQ ID NO: 76403 - protein, 339 aa, Nostoc punctiforme PCC 73102
MFGLIGHLTSLEHAQAVAQELGYPEYADQGLDFWCSAPPQIVDSIIVTSVTGQQIEGRYVESCFLPEMLASRRIKAATRKILNAMAHAQKHGINITALGGFSSIIFENFKLEQFSQVRNIKLEFERFTTGNTHTAYIICKQVEEASKQLGINLSNATVAVCGATGDIGSAVTRWLDARTDVQELLLIARDQERLKELQGELGRGKIMGLTEALPQADVVVWVASMPRGVEIDPTTLKQPCLLIDGGYPKNLATKIQYPGVHVLNGGIVEHSLDIDWKIMKIVNMDVPARQLFACFAESMLLEFEKLYTNFSWGRNQITVDKMEQIGRVSVKHGFRPLLV

SEQ ID NO: 76404 - protein, 446 aa, unidentified prokaryotic organism
MEYAVSVESFLSSLQRHNPHQPEYLQAVREVFTSLWPFIERNPAYREQALLERLVEPERIIQFRVSWVDDRGQVQVNRAFRVQFNSAIGPYKGGMRFHPSVNLSILKFLGFEQTFKNALTTLPMGGGKGGSDFDPKGKSQGRIMRFCQALMTELYRHLGPDTDVPAGDIGDGGREVGFMAGMMKKLSNNTACVFTGKGLSFGGSLIRPEATGYGLVYFTDAMLQRHGLGFEGMRVAVSGSGNVAQYTIEKALELDARVITVSDSGGTLVDEDGFTTEKLAHLAEIKNQRYGRVADYAAERGLTYLAGQQPWNVPVDIALPCATQNELDLEAARVIRNGVKAVAEGANMPTTIQATDAFLDAGVLFAPGKAANAAGLATSGLEMAQNAARIGWRAEKVDVRLQHIMADIHHACVEYGGEGKQTHYVHGANIAGFVKVAEAMLAQGVL

SEQ ID NO: 76405 - protein, 268 aa, Brassica napus
MAKFFINQAKQYAAARPNYPIQLFEFIASKTPCHDLAWDVGTGSGQASRSLAGIYKNVIATDTSSKQLEFAAKLPNVRYELTPPVMSLSEIEQLVAPESSVDLVTVAQALHWFDLPTFYSNVKHVLKKPDGVFAAWCYTNPEVNAAVDEVFRRFYKEKLGPYWDKARRLVEDGYKGIEFPFEKIMDESTESQTFPVRFVTEREMGIEEFLTYLRSSSAYQTAKDKGVELLTAEMEGEFVGSWREDGEEKKVVRFPIYLLIGRVGGDRV

SEQ ID NO: 76406 - protein, 245 aa, Neisseria gonorrhoeae FA 1090
MGGQKTHFGFSTVNEDEKAGKVAEVFHSVAKNYDIMNDVMSAGLHRVWKHFTIHTAHLKKGDKVLDIAGGTGDLSRGWAKRVGKEGEVWLTDINSSMLTVGRDRLLNEGMILPVSLADAEKLPFPDNYFNLVSVAFGLRNMTYKDAALKEMYRVLKPGGTLLVLEFSKIYKPLEGAYDFYSFKLLPVMGRLIAKDADSYQYLAESIRMHPDQETLKQMMLDAGFDSVDYHNMSAGIVALHKGVKF

SEQ ID NO: 76407 - protein, 472 aa, Moritella sp. PE36
MKTLHLSWMAFFITFVVWFNAAPLMLAIKDSMGLTTEEVKTLLILNVALTIPARVIIGMLTDKYGPRIVYSTLLAVCSIPCFMFALATTFEQLAIARFMMGLIGAGFVVGIRIVSEWFPANELGTAEGIYGGWGNFGSAAAAFTLPTVALLFGGEDGWRYAIAITGLMSLLFSVVYYFNVTDTPKGATYFRPKKGGAMEVTSKGDFYLLLFMKLPMYLTLGLLAWKLLQISMFTETTTNAIYIGLAVLYVFDCWKTYQVNSDIFVNDVPEIERYKFKQVAVLNVLYFSTFGSELAVISMLPLFFAETFGLGMAEAGMVAASYAFMNLMSRPGGGWISDRFGRKKTLLILTAGLAVGYYAMSQITAAWSLPLAIATAMACSFFVQAGEGAVFAAVPMIKRRLTGQIAGMTGAYGNVGAVFYLTLYSIVSTQMFFYAIAITAVIGFMALFLMEEPKGHIAEVDEDGKVTLINVS

SEQ ID NO: 76408 - protein, 366 aa, Nocardioides sp. JS614
MTVTAAVSREKGAPLVVEELELDAPRSTEVRVRMVGSGICHTDAVARDRIYPVPEPSVFGHEGSGVVEEVGSDVRGVQVGDHVVLGPSYCGKCTFCRSGEPMYCENGFPELFGCRRHDGTTAFSKDGEMVGSHFFGQSSFATHANVTENSVIVVDKDAPLELLGPLGCGLNTGAGAVLNEMRPAAGSSIVVFGTGAVGFAALMAAAAVSCSTIIGVDIHDSRLELARELGATHTINSSSQDLHAELEKITGGRGVNYALDTTARSSVVRDAADALGKRGVLIAVGAAAPGDEVSFEVGNSLVKGWTFKTVIEGSAVPQVFIPRLVDLWKQGKFPFDKLVKTYSLHDINTGFEDSASGAVIKPVVAY

SEQ ID NO: 76409 - protein, 439 aa, Bacillus cereus E33L
MAVENITMPQLGESVTEGTISKWLVNVGDHVNKYDPLAEVMTDKVNAEVPSSFTGIVKELIAGEGDTLAVGEVVCVIQVEGADEVAATAVEEKTKEEPKAEVATPEKAPKAKQPTDGKPRFSPAVLKLAGEHNVDLDLVEGTGANGRITRKDILKLVESGNIPQAGAAKNEEAVAAVVEARPEAPKAAPVAQKVEAAKPVSVPTMPGDIEIPVTGVRKAIAANMLRSKHEAPHAWMMIEVDVTNLVSYRNSIKGDFKKREGFNLTFFAFFVKAVAQALKEYPQINSMWAGDKIVQKKDINLSIAVATEDELFVPVIKHADEKTIKGIAREITELAGKVRTKSLKADEMQGGTFTINNTGSFGSVQSMGIINYPQAAILQVESIVKRPVIMENGMFGARDMVNLCLSLDHRVLDGLICGKFLGRVKEILENTSENNTSVY

SEQ ID NO: 76410 - protein, 391 aa, Physcomitrella patens subsp. patens
QVFNWKKSKLGWEANPKEYAKMISFAGRISQPQLAADLFDEMEKRGIKKTAVSFNALIHSYGRNNEAHKALQLFEDMKATNDCQPTLVTYNTLISMYSRMGATEEMKKLFLDCKEAGFSPDRHTYNALIWGYMRAGQLSQMEETFNELQAGECKADVITYNAQIIGYARANAVNKMEAVFSSMQAAGIPINAMVGEILIEVYSRTKHFEKMENALKIMDVTPGVQYGSRVHSMVIESYADANKLDEMEAAISRMFQNKRMFSSPKSLHALIMAYSRAGEYGRLAKTMEVVKGAGWILQSSIYNILISEYGKGGHLDRMEQVFREMMDASCPPSFETFQYMIDAYEANNNEAEVDRILDLMRKAGCEPKSNVMPTSDRMWTDDEIFGGKIRR

SEQ ID NO: 76411 - protein, 370 aa, Triticum aestivum
MAASSPASSGKAASDSSAPPPAPSPVVSNGNGTPQKPPPVAGFDMPKPNLRGLNKPKCIQCGNVARSRCPFQCCKSCCYKAQNPCHIHVLKQNNTLPEKTPPAPIPLSDQPSTNSPLTGSSSRLSSLQKLPHHFLNSIRTRKSLAKKDIASINKWRFMKLKEHMQGDIDVENEAYDRYTQNIGLLEETFYLKEDSAGEHETEATSSEEMMEIMVSEAKVRLKSDCANAAGFKERIATVLDQKLKKLQERNSAYEDDNSSDQNLDDHTKPVKLNIKQQTVRNAKTNELLGKLTKAQSEDDLKPCLNIMAQLFGKEIASSSMGTSNKSSDQESTPAVAPSYSFPKLTTRLEVDENMMSKINELSSLSQVVQL

SEQ ID NO: 76412 - protein, 163 aa, Methylobacillus flagellatus
MKVIDPCTLVLFGASGNLSRIKLMPGLFRLDQAGRLPEKMAILSVGRSQVSREDWLADIKSMLDAKFPKGYDQAVFKRFIERHHYHANPPDDPSSFTRLKETLSDEAIFPQNLAYFLSVRPSDFAAIVDQLASVGLTEEGKYWRRVVVEKPFGTDLKSAQELQ

SEQ ID NO: 76413 - protein, 347 aa, Medicago sativa
MWCVVLLVVLGGLPFSSDAQLSPTFYSKTCPTVSSIVSNVLTNVSKTDPRMLASLVRLHFHDCFVLGCDASVLLNNTATIVSEQQAFPNNNSLRGLDVVNQIKTAVESACPNTVSCADILALAQASSVLAQGPSWTVPLGRRDGLTANRTLANQNLPAPFNSLDHLKLHLTAQGLITPVLVALSGAHTFGRAHCAQFVSRLYNFSSTGSPDPTLNTTYLQQLRTICPNGGPGTNLTNFDPTTPDKFDKNYYSNLQVKKGLLQSDQELFSTSGADTISIVDKFSTDQNAFFESFKAAMIKMGNIGVLTGTKGEIRKQCNFVNSNSAELDLATIASIVESLEDGIASVI

SEQ ID NO: 76414 - protein, 79 aa, Physcomitrella patens subsp. patens
MAPDEEKMTRRSPLDFPIEWDRPRPGRRADIFPQFSPMKTPLPPPLPADPPEEDEEEEEKKEEEEENNPDEPEKPDVSF

SEQ ID NO: 76415 - protein, 101 aa, Arabidopsis thaliana
LWIEGHSNSFMLSSATMVLSPAETTTGAPLIGVRASAGFPANGKSSCNMDFRLEERGRETCVLVRAPIVNTQDETLGYIPDLSDDEWQCGADCLIRPRCCP

SEQ ID NO: 76416 - protein, 182 aa, Thermosynechococcus elongatus BP-1
METCCFGHPAMSIDLSRIPAQPKPGVVNVLVEIAGGSRNKYEFDKEMKVFALDRVLYSAVVYPYDYGFIPNTLADDGDPLDGLVMMDEPTFPGCVIPARPIGMLEMIDSGDRDEKILCVPVDDPRYAEVKSLKDIAPHRLEEIAEFFRTYKNLQKKVTEILGWQDVDAVQPLVEKCIKAYKG

SEQ ID NO: 76417 - protein, 515 aa, Lactobacillus johnsonii NCC 533
MSLLTVKNLSQTFIDKTLYEDANFVLNKEDHMGVTGQNGVGKSTLIKILTGEITQDNGEVKWQNKIHVGYLDQYAKLEEGIELKEFLQTAFSDLFDKEKELNELYVRYGENGDEALLEKAGKIQTLLEEKEFYDIDTKIDRVATGLGLADLGYSRDVSKLSGGQRSKLILAKLLLQNPDVLVLDEPTNYLDVNHIDWLADYLNNFEGAFIVVSHDYDFLGRITNCIIDIDFGTITRYTGDLKHALRQKEADRESYLKAYANQQRKIQKTEAYIRKNKAGSRSKSAKSREKQLAKMEILTPPQNNKKAHVLFPYVDTASNLLLQTQDLVIGYEQALVKSAFNFSVGNGEKVAVTGFNGIGKTTLLKTLLGKLKPIYGNFELSSTAKLAYFQQDLAWPNKNMTPLQYLQEEFPRLRPRELRQALARMGLTAQQAMSPLKELSGGEQEKVKLAKMQFEPSNLLFLDEPTNHLDIATKDSLRKAIVEFNGGVIIVSHERDFFRGNWVDKTIDIEKMNNE

SEQ ID NO: 76418 - protein, 193 aa, Chromobacterium violaceum ATCC 12472
MPFNLPILLTWLRVALIPICVAVFFLPDSILLLHSRNAVGAGIFALAAATDWLDGYLARKLGQTSAFGAFLDPVADKLIVAAALILLVQLGRTEGWMAMIIIGREITISALREWMAGMGSRSSVAVAYIGKLKTAAQMLAITLLLYDGALVPGLDARGLGNFSMYVAVILTLWSMIYYLQMAAKEFAGKKIDV

SEQ ID NO: 76419 - protein, 298 aa, Erwinia carotovora subsp. atroseptica SCRI1043
MTSLKAIIPVAGLGMNLLPVTKAIPKEMLPLVDRPVIEKIVNECVRAGIKEIVLVTHASKNAIENHFDTSFELESLLEERAKRQLLAEVQSICPKGVTIMNVRQGETLGLGHAVSCARPIIGDNPFVVVLPDVVLDESTADQTQENLALLISRFEETGRSQVLVKHRPYEVLPEYSVVDCEAQLVNPGDASAITSMIEKPEAPSETGSDLSAVGRYVLTADAWSLLDKAEPGAWGRIQLTDVIADMIATQQVDAVQMSGKNFNCGRKLGYAQAFVSYGLRNPEFGAEFKESIKALLKK

SEQ ID NO: 76420 - protein, 479 aa, Dunaliella salina
MATVQEYIDKHQLQKKTEDVLNIAVKSKPDEPLSFLAKELLRMAPSEILKVVGRQIIDSRGNPTVEADVHTHKGMFRAAVPSGASTGIHEAVELRDGDKTKFLGKGVQKAVESINTIISPALKGMDPKNQSEVDQKMIDLDGTPNKAKLGANAILAVSLATAKAGAAEKEVPLYRHIADLAGNPKLYLPVPAFNIINGGSHAGNALAMQEFMILPTGASSFSEAMRMGTEVYHTLKGIIKAKYGQDATNVGDEGGFAPNIQSNDDGLSLVTDAIEKAGYTGKVKIGMDVAASEFITEDKMYDLNLKQQPNDGSHKKTAAQMLEMYKEFCTKYPVISIEDPFEQDDWEPAKSLTAENICQVVGDDMLVTNPIRVKRGIEQKAVNSLLLKVNQIGSLTESIEAVRMSKEAGWGVMTSHRSGETEDCFIADLAVGLSTGQIKTGAPCRSERNAKYNQLLRIEEELGENAVYAGEKWRFIEWQ

SEQ ID NO: 76421 - protein, 468 aa, Erwinia carotovora subsp. atroseptica SCRI1043
MSKQQIGVVGMAVMGRNLALNIESRGYSVSIFNRSSDKTDEVIAENPGKKLVPSYTVEEFVESLEKPRRILLMVKAGEATDKTIESLKPYLEKGDILIDGGNTFYKDTIRRNRELSAEGFNFIGTGVSGGEEGALKGPSIMPGGQKEAYDLVAPILEQIAARADGEACVTYIGSDGAGHYVKMVHNGIEYGDMQLIAEAYALLKQALNLDNDELATTFSEWNKGELSSYLIEITADIFKKKDEEGKYLVDVILDEAANKGTGKWTSQSSLDLGEPLSLITESVFARYLSSLKDQRVAASKVLTGPTAQPFGGDKAEFVEKVRRALYLGKIVSYAQGFSQLKAASDENSWDLNYGEIAKIFRAGCIIRAQFLQKITDAYEQKADIANLLLAPYFKKVADEYQQALRDVVSYAVQQGIPTPTFSAAIAYYDSYRSAVLPANLIQAQRDYFGAHTYKRTDKEGVFHTEWLE

SEQ ID NO: 76422 - protein, 271 aa, Acidovorax sp. JS42
MSITIKDAQGIAGMREACRLASEVLDYIAPHIKPGITTAEIDRLGAECMAAQGTVSATIGYQPPGYPPYPGHLCTSVNHVVCHGIPNDKPLKKGDIVNVDVTVITKDGWYGDNSRMYLIGECSIAAKRLSQLTFESMWLGIQQVKPGARLGDIGHAIQKFAEGHGLSVVREFCGHGIGQKFHEDPQVLHYGRPGTGEELVPGMTFTIEPMLNLGKRDIKELGKDGWTIITKDHSLSAQWEHTVLVTETGYDVLTLSAGSPALPAFVTATTT

SEQ ID NO: 76423 - protein, 573 aa, Chlamydomonas reinhardtii
MTDPKGQDLDAEKQHAATLHNAEDTLCSAVQDETAEDLRPRNVIVRFFQFLASFMIPGLGMFCEAYFVFAVGNLSALWKVEYKNCWKGIGCPVKLSESITYTQVCGIIFGQLFLGFFADRIGRKWGSVATAGTMVVGAILIISSAGPTENALWAMFTAVQFIFGIGVGGEYPVASASANERAESSAALQKRRGETVVLVFSMQGWGNVVNTAVIIAIMAGFGQYGAPYSNHALEVTWRLSYAIGLIPLISILLYRIFRLRESAVWTKKREALQAMGGSEAKGVQWRKFGLLMYYYWHRNFGTAMSWFVWDFAFYGNKLFQGTFIKIINPSASLIQVLEWTLLNSSVALVGYYFAAFTVDKPWMGRMRMQVMGFAWMFVLFLICAVHYDQLRTPKYIHTFQFLYYFSSFWGQFGPNATTWLLPAELAPTEVRSMCHGFSAAVGKAGALVAGVVFGLVDGRTKFWISAFCGLAGVILTLITIPDVTGLDLREGDKRWLAILDGHHHLYHGDAIKPRNLSLIERLLGYGKNYQADTSNDGAYSATTTSASAAMAMKGAEMVPPHKQQPTATIAIAK

SEQ ID NO: 76424 - protein, 309 aa, Salmonella enterica subsp. enterica serovar Paratyphi A str.
MSKKIAVIGECMIELSQKGADVQRGFGGDTLNTSVYIARQVDSAALAVHYVTALGTDSFSQQMLEAWQHENVDTSLTQRMENRLPGLYYIETDDTGERTFYYWRNEAAAKFWLESEQSAAICEALATFDYLYLSGISLAILSPTSRVKLLSLLRECRANGGKVIFDNNYRPRLWTSREETQQVYQKMLDCTDIAFLTLDDEDALWGKQPVEEVIARTHAAGVQEVVVKRGADSCLVSIQGEALIDVPAVKLPKEKVIDTTAAGDSFSAGYLAVRLTGGSATDAAKRGHLTASTVIQYRGAIIPHDAMPQ

SEQ ID NO: 76425 - protein, 419 aa, Acidovorax sp. JS42
MTSYQHIQIPPQGQKITVNADMSLNVPHQPIIPFIEGDGTGMDITPVMLKVVDAAVAKSYGGQRKIHWMEVYAGEKSTKVYGPDVWLPEETLHAVRDYVVSIKGPLTTPVGGGIRSLNVALRQELDLYVCLRPVRYFKGVPSPVREPEKTNMVIFRENSEDIYAGIEFEAESDKAKKLIKFLQEEFGVKKIRFPETSGIGVKPVSREGTQRLVRKAIQYAIDNDRPSVTLVHKGNIMKFTEGGFRDWGYELAAQEFGAQLIDGGPWMRIKNPRTGKDITIKDSIADAFLQQILLRPAEYSVIATLNLNGDYISDALAAQVGGIGIAPGANLSDSVAMFEATHGTAPKYAGKDYVNPGSEILSAEMMLRHMGWTEAADLIISSMEKAIQSKKVTYDFARLMDGATQVSCSGFGQVMIDHM

SEQ ID NO: 76426 - protein, 545 aa, Chlamydomonas reinhardtii
MGAHCTRSGTWSRFFLFLASFMIPGLGMFCEAYFVFAVGNLSALWKVEYKNCWKGIGCPVKLSESITYTQVCGIIFGQLFLGFFADRIGRKWGSVTTAATMVVGAILIISSAGNTERALWAMFTAVQFIFGIGVGGEYPVASTSANERAESSAALQKRRGETVVLVFSMQGWGNLVNTAVIIAIMAGYHQYGAPYSNHALEVTWRLSYAIGLIPLIGILLYRTFRLRESAVWTKKREALQAMGGSEAKGVQWRKFGLLMYYYWHRNFGTAMSWFVWDFAFYGNKLFQGTFIKIINPSASLIQVLEWTLLNSSVALVGYYFAAFTVDKPWMGRMRMQVMGFAWMFVLFLICAVHYDQLRTPKYIHTFQFLYYFSSFWGQFGPNATTWLLPAELAPTELRSMCHGFSAAVGKAGALVAGVVFGLVDGRTKFWISAFCGLAGVILTLITIPDVTGLDLREGDKRWLAILDGHHHLYHGDAIKPRHLSLIERLLGYGKNYQADSSSDVQYSATTTSSSAAMAKRAAEMSSPKQSFKKQNSGNAIIPVTN

SEQ ID NO: 76427 - protein, 572 aa, Chlamydomonas reinhardtii
MAGLDAEKAHEKSLHHAEDSLASAVKDENEEVQHRNPIVRFFLFLASFMIPGLGMFCEAYFVFAVGNLSALWKVEYKNCWKGIGCPVKLSESITYTQVCGIIFGQLFLGFFADRIGRKWGSVTTAATMVVGAILIISSAGNTERALWAMFTAVQFIFGIGVGGEYPVASTSANERAESSAALQKRRGETVVLVFSMQGWGNLVNTAVIIAIMAGYHQYGAPYSNHALEVTWRLSYAIGLIPLIGILLYRTFRLRESAVWTKKREALQAMGGSEAKGVQWRKFGLLMYYYWHRNFGTAMSWFVWDFAFYGNKLFQGTFIKIINPSASLIQVLEWTLLNSSVALVGYYFAAFTVDKPWMGRMRMQVMGFAWMFVLFLICAVHYDQLRTPKYIHTFQFLYYFSSFWGQFGPNATTWLLPAELAPTELRSMCHGFSAAVGKAGALVAGVVFGLVDGRTKFWISAFCGLAGVILTLITIPDVTGLDLREGDKRWLAILDGHHHLYHGDAIKPRHLSLIERLLGYGKNYQADSSSDVQYSATTTSSSAAMAKRAAEMSSPKQSFKKQNSGNAIIPVTN

SEQ ID NO: 76428 - protein, 457 aa, Clostridium tetani E88
MKMKKSLTKITGITLLTFFISLTNFSITARAAEQKVRTPQSIKEEINNSMKSGKAVKEDDINELAPLEFPEINTRSITKDNNYPIILVHGFMGYGRDELLGYKYWGGVVDLQEKLNNSGHKAYTATVGPVSSNWDRACELYAYIVGGTVDYGAAHAKKFGHSRYGRTYPGLYKNISNKNKIHLIGHSMGGQTIRTLTQLLSQGSQEEINYKQENLSPLFQGGNHWIHSVTTISTPNDGTTLSDLMPAGELLSSAFGALGTITGNNGIFNSLYDFKLDQWGLKKQEGESQRKYIKRVLDSDIWKRTKDIATYDLSTKGAEELNKWVKAQPDVYYFSWTTQATKESALTGHSIAQIGPMNPLLYVPANLMGKYSRNEPNLPIINKEWFPNDGVVNCISQNGPKLGSSDIIEQYDGTAKKGRWNAMPLIINTDHMDITGTFGNVKDWYIDYAKILNKLPE

SEQ ID NO: 76429 - protein, 262 aa, Cryptococcus neoformans var. neoformans JEC21
MPMPDEHIHPTATGLAKKVVDAHQDPQDLVFWSGWFCPFNQRIWIALEERKIPYQYHEVNPYKKEEAFLKLNPLGLVPTVEIKTAEGSKSLYESDVLVEFLEDLYPPSEEHPSIFPSDPYEKSWVRLNIQHVSKKIIPNYFKLQQSQTESDQVAARKELISALRTYAKRIKGPYFAGEQWTAVDGTLAPFIRRLYILEKHRNFDEKAVGDGWWEYRERLMTRDSLKNTCSEDQYYEEILGRYLKNEAQSEVAKATRAGQSLP

SEQ ID NO: 76430 - protein, 556 aa, Chlamydomonas reinhardtii
MADVKALDAEKAHEKTLQHAEDSLCSAIKDVDEDVRPRNPIVRFFQFLGSFMIPGMGMFCEAYFVFAVGNLSALWKVEYKNCWKGIGCPIKLSDSITYTQVCGIIFGQLFLGFFADRIGRKWGSVTTAATMVVGAILIISSAGPTERALWAMFTAVQFIFGIGVGGEYPVASTSANERAESSAALQKRRGETVVLVFSMQGWGNVVNTAVIIAIMAGYHQYGAPYSNHALEVTWRLSYAIGLIPLIGILLYRIIRLRESAVWTKKREALQAMGGSEAKGVQWRKFGLLLYYYWHRNFGTAMSWFVWDFAFYGNKLFQGTFIKIINPSASLIQVLEWTLLNSTVALVGYYFAAFTVDKPWMGRMRMQVMGFAWMFVLFLICAVHYDQLRTPKYIHTFQFLYYFSSFWGQFGPNATTWLLPAELAPTELRSMCHGFSAAVGKAGALVAGVVFGLVDGRTKFWISAFCGLAGVILTLITIPDVTGLDLREGDKRWLAVLDGHHHLYHGDAIKPRHLSLFERLLGYGKNYQASDSGSEDGYSANTTIKATDLPPPPAVQK

SEQ ID NO: 76431 - protein, 283 aa, Bacillus thuringiensis serovar konkukian str. 97-27
MIRVGYLGPEATFTNMAVSRFFPEAEHVPYRTIPDCMDAAANGNVDYAVVPLENAIEGSVNITVDYLVHEQPLSIVGEITVPIQQHLLVHPQYAEVWEEVYAVHSHPHAIAQCHKFLNEELKGVTARDMTSTSAAAQYVKEHPEEKIAAIANEAAAEKYGLTIVRRSIHTHKNNHTRFLVLHKKKKAILPNNGENRGEKTTLMITLPADYAGALYQVLSAFAWRKLNLSKIESRPMKTGLGNYFFLIDVDKAYDDVLLPGVTMELEALGFSVTVLGSYSSYWL

SEQ ID NO: 76432 - protein, 139 aa, Chlamydomonas reinhardtii
MASSDGVKLDKSTPDSVWKTLLNAEEFHILRQKGTERAGTGKYNKFYEEGTYKCAGCGTPLYKSETKFNSGCGWPAFYDEIPGAVDRHVDNTFGMRRVEITCANCGGHLGHVFEGEGFPTPTDQRHCVNSVSIKFDPKP

SEQ ID NO: 76433 - protein, 309 aa, Francisella tularensis subsp. tularensis SCHU S4
MMKMNFIQKYFAIIVIAGVILAISIPSIFIPLKPYITYLLAAIMLIIGLHLQAKDFVKVANLKGKLLVILFLKLTVTSIAAFIIGKLFGLSLTALIGLVIVGACPGGTASGVMALLARANISLVVSLTFLTTLLAPIFMPLIIYFFFSKSIKLDWFGMFETMAIIVIVPIVLGILISKFTKLNDSTLKKISNIPILLIMLIVMVVTALNKDTMMLVPTDIILSVIILSIFANIFGYLIGRVLGLDIDSRLALLFEFSILDVGLGIVIALAFFGNQAAIAATFYAIWQNIIGPIIVNLVNICRNTKFKSS

SEQ ID NO: 76434 - protein, 688 aa, Oryza sativa Japonica Group
MAAGRHGGYRDYEARERELDAEASRRSKEQQHHHHPSGRHQRGDSDPRCEADRRRDGGRSRGGRELSNGYGHRRSPPPRSRLSARLGDREPGEVLSGSASDDSGGRPHRARENGVSSSSRDGESVVAASASSPSKKRKFSPIIWDRDSPKPMHSDVAKGKKAVDSVPTELPLPPPPPLPPQDHIPERLAVEKSPMDVEPAVASESPEQLQEHAESRVMEEEEEYSTMRNISTSRWAGANDDEEEGAPHRKKKSASPADSAELGQRKKALSPELGEVVASDISGGRTMSRSSDSGRLGADENEDLEVDKDDYMDVDRDDDGNSDIANHQSGMDSEYEVRRSETPEPVKPPHRCINMLQGCRSVDEFERLNKINEGTYGVVYRARDKKTGEIVALKKVKMEKEREGFPLTSLREINILLSFHHPSIVDVKEVVVGSSLDSIFMVMEYMEHDLKGVMEAMKQPYSQSEVKCLMLQLLEGVKYLHDNWVLHRDLKTSNLLLNNRGELKICDFGLSRQYGSPLKPYTQLVVTLWYRAPELLLGTKEYSTAIDMWSVGCIMAELLAKEPLFNGKTEFEQLDKIFRTLGTPNEKIWPGYAKLPGVKVNFVKQPYNRLRDKFPAASFSGRPILSEAGFDLLNNLLTYDPEKDFMPTFPALNALDRRTKRYLKSPDPLEEQRLKELQGNIGNRGLFG

SEQ ID NO: 76435 - protein, 413 aa, Triticum aestivum
  misc_feature (118)..(118): Xaa can be any naturally occurring amino acid
SARGFTVDDRGNIYVADAMNMAIRKISDTGVTTIAGGKSMRGGHMDGPSDDAKFSTDFEIRYVSSSCSLLVIDRGNQAIREIPLQPDDCEYQDEAGFPLGVALLFAAGFFGYMLPSVXYSDLVGSEISTMQEPQTPPRPSNASIPPYQPYQPYQQPFKPSFRPPLIPNEDEAGKHEAEEGFFTSMGKLMGGAKSSVADMFSRKKRPARQHHQQHQQRRANPWPVQESYAIPHEETPPPLDSRGPTPQKNYGFVTTEPEKAHHVRHGQPYLGGWDARGPQPPPEQQQVYPHHHHQQLQQHRQQLEQQVYRQQQQHRQPPEQQAYHLQQHQHQQRRQPEQQMYQLQQHRQYSSGPQTFYEQSCETTNEVVFGAVQEVDSKRRMVEIKAVNYGDTFYEQYGMRYRNNYIGYNSNNY

SEQ ID NO: 76436 - protein, 397 aa, Moritella sp. PE36
MSEFKEFSLLESIIDRVSLKGYKQPTPIQKECIPALINGNDLLGIAQTGTGKTAAFSLPIINNFGRNKIDINAKSTRSLILTPTRELASQIMQNIDDYADGLGLKTKVVYGGVGRQNQVDSIALGLDILVATPGRLLDLIKTDDINFKALEVFVLDEADTMLDMGFFKDVQRIISKLPKNRQTLLFSATMPAEIEILADAILTDPTKIQITAETVTIERINQSVYHLEKSNKVPLLLNILEKSHYKKVLIFCKTKPGADIIVEALEEASITAASLHSGKTQAVREEALQNFKDSNLSVLVATDVAARGIDVDNITLVINYNLPEDPRNYIHRIGRTARAGKSGIAISFAVENDITLLNSIEKSIGKAIPVATEQPFHKEFSKVPKKVKKKVKKRNRR

SEQ ID NO: 76437 - protein, 295 aa, Oryza sativa Japonica Group
MPRTSVVESPGCPPLRALTTDILGLIKVVEARTKPAGVAKVVETWGAPDAPRAVLAASLADRAVDPVLAVARKNGVVELLNPLNGETLAGVNAAAGRAAPADSSAEEDPLATLHLFRRHALDSSMLGTFLACTEKGKAYVKSVAKENASSDMAVGPSSSWDVSNSGTVQFSSVDAGESYAMFGGKGIEVNLWDITSCSKIWSAKSPRGNSLQIFTAPWFTAGTFLCKDDHRKIVACTNNHQVRLYDTASQRRPVISVDFRESPIKAVAEDPNGHAVYIGTGRGDLASFDMRTGII

SEQ ID NO: 76438 - protein, 879 aa, Listeria monocytogenes EGD-e
MRKFVYQFSEGSKEMKNLLGGKGANLAEMTNIGLPVPPGFIISTDACNDYTANNKHLSEAIFDEVKIHLAELEKQTGKIFGFAENPLLVSVRSGAPFSMPGMMDTVLNLGLNDQAAEGLANLTGDARSAYDSYRRFIQMFGDVVFEIPSYHFEQALSRIKKANDYRLDTELTATDLSELIDAYKLIFSQATGTDFPQDPLEQLRLAIIAVFDSWMNPRAVIYRRLHDIDASFGTAVNIQAMVFGNTGETSGTGITFTRNPSTGEKKVFGEFLLNAQGEDVVAGIRTPEPISALEERMPTVYKELLHTCELLENHYLDMQDIEFTIEKGKLYVLQTRSGKRTAKAAIQTAVDFVQEGKITRQEAIMRVETKQLHQLLHPTFDESALKNGQVIATGLPASPGAATGQIFFAAKEAVQATERGIPVILVRNETSPEDIEGMARSNAILTAHGGMTSHAAVVARGMGKCCIAGCAELTINEKEKTIILPTGDTLHEGDALSLDGSSGKVYLGEIALREAQIGGHFDELMAWADTEKRLMIRVNADTPPDFKKALLFGAEGIGLCRTEHMFFDEKRIHYVRQMILAESLSERESVLTTLKEMQKADFSELFRIADGRAVNIRLLDPPLHEFLPKTKQEIEQLASAMNRTVPQITKRINELSEANPMLGHRGCRLAITFPEIYRMQTEAIIESAVTLHDEGIDVHPEIMIPLIATKSELSYIKKEMKHAIHTIFDRERVMLPYDIGTMIEIPRACVTADEIAEEAEFFSFGTNDLTQLTYGFSRDDATKFLADYYEKDILSKDPFVSIDKNGVGALVEMAVTRGRMTSEHLKMGVCGEHGGDPESIQFFHQLGLTYVSCSPYRVPIARLAAAQAALAEKHLIPTI

SEQ ID NO: 76439 - protein, 99 aa, Hypericum perforatum
QFPVGRVHRLLKTRVSANGRVGATAAVYTAAILEYLTAEVLELAGNASKDLKVKRITPRHLQLAIRGDEELDTLIKGTIAGGGVIPHIHKSLINKSSKE

SEQ ID NO: 76440 - protein, 123 aa, Dechloromonas aromatica RCB
MAISKEDILEAVGSLTVMELNDLVKAFEEKFGVSAAAVAVAGPAGAGAAAAEEQTEFTVMLTGAGDKKVEVIKVVRAATGLGLKEAKDLVDGAPKAVKEGVSKADAEALKAQLEAAGAKVEVK

SEQ ID NO: 76441 - protein, 363 aa, Leptospira interrogans serovar Copenhageni str. Fiocruz L1-130
MMKAFLVLDNGTIFEGESFGYETESVGEIVFNTSMAGYQEILTDPSYCNQIITLTYPMIGNYGIHPDNMESSKIQASGLIVKEYVDLPSNFKSEKTLSQFLKEYKIPAIQGIDTRKLTRFIRTNGSPNGGIFVASEYSPSFLEKVKSFPGIINADLAEVVTTSSKYIFGTHTGKKFKLAVYDYGVKTNILRLLDANGFAVTVYPAKTPSEEIMKEGTDAFFLSNGPGDPAPLDYAIASTQKIMEKRYPLFGICLGHQIIGLSLGKKTEKMKFGHRGGNQPVKNLETGQVEITSQNHGFAVIDDQKQDEPISFLNLNDHTVEGILKSGYPLLTVQYHPESAPGPNDSRYLFQKFYDLVEKTKKG

SEQ ID NO: 76442 - protein, 317 aa, Triticum aestivum
  misc_feature (265)..(265): Xaa can be any naturally occurring amino acid
  misc_feature (276)..(276): Xaa can be any naturally occurring amino acid
  misc_feature (292)..(293): Xaa can be any naturally occurring amino acid
  misc_feature (295)..(295): Xaa can be any naturally occurring amino acid
  misc_feature (301)..(301): Xaa can be any naturally occurring amino acid
  misc_feature (308)..(309): Xaa can be any naturally occurring amino acid
  misc_feature (312)..(312): Xaa can be any naturally occurring amino acid
LYFVPRRIVACEKILEEEKVHQKLTIGEYPLYLVPLDEDVLSLELDYSLQEPRVRGDTSSVWHVAKAIHKLEFAFGVIPNIRAKGVASTKAAELLNHMQLEDPVSMDNMGIPEIDTVILLDREVDMVTPMCSQLTYEGLLDEMLEIHNGSVEVDASIMGAQQDGKKVKVPLNSSDKLYKEIRDLNLHVVVQVVRQKATSIQQDYAEVKSTNTQSVSELKDFVKRLHSLPEIARHVNLAQHLQSFAAKPAFHARVEIEQIILEAQXYETCYEYIEEXIQKPEPIGNGTSPSKXXSXKKGGFXKKNFGPXXGKXQIANL

SEQ ID NO: 76443 - protein, 83 aa, Hypericum perforatum
PGMVTTDLLMSGANTKQAKFFINVLAEPADVVAEYIVPSIRSVPANGSTKPTCIRFLTGIKAYTKIFSRIAFGARRNRFVVEE

SEQ ID NO: 76444 - protein, 217 aa, Wolbachia endosymbiont strain TRS of Brugia malayi
MVQATYASISLPGISSVEDVLEDARFGKLFILVDDENRENEGDLIVLAEKLKPEHVAFMVRYGTGIVFLAMTRLHMGRLGLEFMRRSNIDEKLTPHTAFTTSIDARYGIATGVSAHDRTHTILTAIDGKSTQDDIITPGHVFPIIANDGGVLARNGHTEASVEIAKLIGYNHAAVGCELVNDDGSMMRLPELLKFAEQHNIKLTTIDKLIRYIKKLS

SEQ ID NO: 76445 - protein, 135 aa, Coffea arabica
IQHPLETYMDQDPLSPPESYPMPDTGLYHSENATYNGYAGKSVEEKRESLAVTRNTLDLFSSILNSEDDQKPAKNELTDSMLENCKQSLPVIQGIVESTVDDEGLLFEALSIHDELQQIISRYQQMEDPLVPITS

SEQ ID NO: 76446 - protein, 503 aa, Erwinia carotovora subsp. atroseptica SCRI1043
METVSNFIQGAIASSNSQRYAAVYNPATGEQIRQVVMSDKAEVEQAIASAAAAFPAWSKHSPLRRARVLFRFKALLEERMDTLARLISQEHGKVYSDAVGEVTRGLEVVEFACGIPHLQKGEHSANVGTGVDSHSLMQPLGVCVGITPFNFPAMVPMWMFPIALATGNTFVLKPSEKDPSFSLLLAQLLKEAGLPDGVFNVVQGDKEAVDVLLTDPRVQAVSFVGSTPVAEYIYQTASAHGKRCQALGGAKNHCILMPDADMDMAASAIMGAAFGAAGERCMALSVVVAVGDDTADALHQRLSAQIKAMRVGPGLVDGQENEMGPVISAPHRAKIADYIQSGVDQGATLRIDGRTLSVQGHPQGYFIGPTLFDNVTPEMKIYQEEIFGPVLSVVRVPDYQTAVTLINNHEYGNGTAIFTRDGETARQFCEEVQAGMVGVNVPIPVPMAFHSFGGWKRSIFGPLNVHGSDGVRFYTRMKTVTSRWPASVRLEHHTSSFIMPTLE

SEQ ID NO: 76447 - protein, 153 aa, Triticum aestivum
MEHKETGCQSREGPILCVNNCGFFGSAATMNMCSKCHKEMAMKQEQAKLAASSFDSIRQRWRCRRKNTLLLGSTAVAVAHVEAAMENPKGPSRCSTCRKRVGLTGFNCRCGNLYCATHRYSDKHECKFDYRAAAMDAIAKANPVVKAEKLDKI

SEQ ID NO: 76448 - protein, 349 aa, Arabidopsis thaliana
MVKGTKRKIAIETIQKRDSLRVTCTKRRKGLYSKASQLCLLSDAQIAILATPPSSESDVSFYSFGHSSVDAVVSAFLSGKRPVSAPKDNKETREDVGICLTRKNLGLGFWWNDESLVRSENPQEISEAIGSMWTLLSNLKELRADEACVNDHKDLKKNEKSDVHGTQDQTLIFQSASAVCCIPENLNDITQEPNQTLDIQSSSSAICCVPDKSPEIFNEITEEQDQILSICETFCVTDNNNNNNNNAALPEVNLYYNQDMAIDQLIDFNTPFESSIDDWFSDNTTHQETTSASILNDVGVDDQVSVDTNPFSYFQSLEDADLVFQRCLDGDNLRFSDCFNDFANTIAAV

SEQ ID NO: 76449 - protein, 336 aa, Zea mays
  misc_feature (202)..(202): Xaa can be any naturally occurring amino acid
MAEIPVIDLRLAGSSRPPPPTNPNASEPGRRGAAAMAEIPVIDLRLAGSSPDESARLRAACERLGCFRVTGHGAPAGLLADMKAAVRALFDLPDDAKRRNADVIPGSGYVAPCPANPLYEAFGLLDAAAPADVDAFCARLDAPPKVRETVKTYAEKMHDVIVGVAGELATSLGLGLEEHSFQDWPCQFRINRYNYTQETVGXSSGVQTHTDSGFLTVLQEDECVGGLEVLDPATGEFVPVDPVAGSFLVNIGDVGTAWSNGRLHNVKHRVRCVAPVPRISIAMFLLAPKDDRVSAPEALVDAGHPRRYKPFNYDDYRRLRLSTGEHAGEALARMAA

SEQ ID NO: 76450 - protein, 272 aa, Streptomyces violaceoruber
MTTATATATATPGTAAKPVALVTGATSGIGLAIARRLAALGARTFLCARDEERLAQTVKELRGEGFDVDGTVCDVADPAQIRAYVAAAVQRYGTVDILVNNAGRSGGGATAEIADELWLDVITTNLTSVFLMTKEVLNAGGMLAKKRGRIINIASTGGKQGVVHAVPYSASKHGVVGLTKALGLELARTGITVNAVCPGFVETPMAERVREHYAGIWQVSEEETFDRITNRVPLGRYVETREVAAMVEYLVADDAAAVTAQALNVCGGLGNY

SEQ ID NO: 76451 - protein, 179 aa, Zea mays
  misc_feature (163)..(163): Xaa can be any naturally occurring amino acid
MASAALICGTEQWKALQAHVGAIQKTHLRDLMADADRCKAMTAEYEGIFLDYSRQQATGETMEKLLKLADAAKLKEKIEKMFKGEKINSTENRSVLHVALRAPRDAVINSDGVNVVPEVWSVKDKIKQFSETFRSGSWVGATGKPVTNVVSVGIGGSFLGPLXVHTALQTDPEAAECAK

SEQ ID NO: 76452 - protein, 530 aa, Arabidopsis thaliana
MENDVKENLEEEEDRLLPPPPPSQSLPSTDSESEAAFETNEKILIVDFESPDDPTTGDTPPPFSWRKLWLFTGPGFLMSIAFLDPGNLEGDLQAGAIAGYSLLWLLMWATAMGLLIQMLSARVGVATGRHLAELCRDEYPTWARYVLWSMAELALIGADIQEVIGSAIAIQILSRGFLPLWAGVVITASDCFLFLFLENYGVRKLEAVFAVLIATMGLSFAWMFGETKPSGKELMIGILLPRLSSKTIRQAVGVVGCVIMPHNVFLHSALVQSRKIDPKRKSRVQEALNYYLIESSVALFISFMINLFVTTVFARGFYGTEKANNIGLVNAGQYLQEKFGGGLLPILYIWGIGLLAAGQSSTITGTYAGQFIMGGFLNLRLKKWMRAVITRSCAIVPTMIVAIVLNTSVASLDVLNEWLNVLQSVQIPFALLPLLTLVSKEEIMGVFKIGPILQRIAWTVAALVMIINGYLLLDFFVSEVDGFLFGVTVCVWTTAYIAFIVYLISHSNFFPSPWSSSSIELPKRVSVSNS

SEQ ID NO: 76453 - protein, 310 aa, Neisseria gonorrhoeae FA 1090
MKIANSITELIGNTPLVKLNRLTKGLKAEVAVKLEFFNPGSSVKDRIAEAMIEAAEKAGKINKNTVIVEATSGNTGIGLAMVCAARGYKLAITMPESMSKERKMLLRTFGAELILTPAAEGMAGAIAKAQSLVDAHPDTYFMPRQFDNEANPEVHRKTTAEEIWNDTDGKVDVFVAGVGTGGTITGVGEVLKKYKPEIEVCAVEAGASPVLSGGEKGPHPIQGIGAGFIPTVLNTKIYDSIAKVPNEAAFETARAMAEKEGILAGISSGAAVWSALQLAKQPENEGKLIVVLLPSYGERYLSTPLFADLA

SEQ ID NO: 76454 - protein, 534 aa, Cryptococcus neoformans var. neoformans JEC21
MSLPKHISTSLSQIDQLYDTVNKRFNSGVTLPLAYRLYNLKQLAYLIKDNETLIQAAIEKDNGKGPFDATLGDIWPTLNEIDLAVKNVKKWMKDESRTGDAILAMKSMPSRVKKQPKGVALILATWNYPWQLALCPLVGAISAGCTAVIKGSEHAPTSSALLADLLPKYLDPEGYAVVLGEVEQAQALLAKPWGHILYTGSAVVGKIVAEAAAKTLTPTTLELGGKSPVIVASDADLKIAARRMFSIKQMTGGQICVAPDYVLCVKDKVDEFISICKTTLDEFFPPSPSPQSLLNNQSASSFLRSPADFSRQLSYIQTAEKAGKLVYKGEMDEQTKRMGISLIRLNENGEGEEGGVMVDEIFGPVLTIIPVDSIEAAIAYVNARPKPLSLYVCSSKRSVFEDIITKTTSGSATWNDFGIATLSRNIPFGGVGESGWGSYHGKDGFNTFTHHKAVLEIPYLFEPLMSLRYPPMSILAKRIMPFLMFSGIHFSRPKSVEHEQRALRRRKWGSRLVWFGVILVGALVGGKLIVGKGY

SEQ ID NO: 76455 - protein, 212 aa, marine gamma proteobacterium HTCC2080
MIHDRPPQDMSNLGLIPMVIEQTSRGERSFDIYSRLLKERVIFAVGPVEDNMANLIVAQLLFLESENPDKDIHLYINSPGGSVTAGLSIYDTMQFVKPDVSTMCLGQAASMGAFLLSGGASGKRYILPNARTMIHQPSGGAQGQATDIDIQAKEILIIRERLNRLMAEHTGQPLEVIERDTERDRFMDAEQSQSYGLVDHVVNNREVVAEDS

SEQ ID NO: 76456 - protein, 249 aa, Coccidioides immitis RS
MARKFFVGGNFKMNGTQKSITDIITNLNSANLDPNTEVVISPPSLYLILSRSLADPKIGVASQNVFDKPMGAYTGELSVEQLQDCGISWTLVGHSERRVILKEDDDFAARKTKSAIDGGLSVILCVGETLEEREADKTVDVVTRQLGAVASRLSAQDWSKLVVAYEPVWAIGTGKVATTEQAQEVHAAVRKYIAESVSPSVAENLRIIYGGSVNEKNCKELAKQADVDGFLVGGASLKPAFVDIVNARL

SEQ ID NO: 76457 - protein, 329 aa, Acinetobacter lwoffii
FDRCLVATGASPAVPPIPGLKESPYWTSTEALVSDTLPERLAVIGSSVVALELAQAFARLGSQVTILARNTLFFRDDPAIGEAVTAAFRAEGIEVLEHTQASQVAHMDGEFVLTTTHGELRADKLLVATGRTPNTRSLALDAAGVTVNAQGAIVIDQGMRTSNPNIYAAGDCTDQPQFVYVAAAAGTRAAINMTGGDAALDLTAMPAVVFTDPQVATVGYSEAEAHHDGIETDSRTLTLDNVPRALANFDTRGFIKLVIEEGSHRLIGVQAVAPEAGELIQTAALAIRNRMTVQELADQLFPYLTMVEGLKLAAQTFNKDVKQLSCCAG

SEQ ID NO: 76458 - protein, 78 aa, marine gamma proteobacterium HTCC2080
MSSIEDRVKKIVAEQLGVKEDEVRTEASFVDDLGADSLDTVELVMALEEEFETEIPDEEAEKITTVQLAINYINENLA

SEQ ID NO: 76459 - protein, 438 aa, Moritella sp. PE36
MSKGTHRYISNLTKDTYALILAGGRGSRLHELTDWRAKPAVFFGGKFRIIDFPLSNCINSGIRRVGIATQYKSHSLIRHVNRGWGHFKKELSESVEILPASQRYGNDWYSGTADAVFQNIDIIRAEMPKYVMILSGDHVYRMDYGDLLAKHVENGADMTVCCIEVPTEEAAGQFGVMTVDQDNRVKRFDEKPAQPNEIPGKPGQCLASMGNYVFNTEFLFDQLEKDATRTTSDRDFGNDIIPAIIEDHQVFAFPFSDPDSDQQPYWRDVGTLDSFWEANMELVTPEPQLNLYDSNWPIWTYQEQLPPAKFVFDNDERRGMAVDSTVSGGCIISGSTIRKSLLFSNVHVHSYSTIEESVILPGADIGEHCQLRRTIVDSKCVIPAGLIVGHDKAQDLANGFRVSPKGITLVTSDMLKRMAEKDAKAALEKAAKQTAELV

SEQ ID NO: 76460 - protein, 247 aa, Bacillus sp. SG-1
MIIKNEQELQSMKVIGRIVAFIRDEMKNAAKPGMTTKELDELGASLFEQHGAISAPKQEYDFPGFTCISVNEEVAHGIPGERIIQEGDLINIDVSGSKDGFYADTGISFVVGDGDEKLLDLCEAVKKSFDAGLKKIKAGAKLNGIGKAVHNEARKNGYTVIKNLTGHGVGKSLHEEPAHIMNYFDPWDNGLLADGMVIAFEPFVSTKAEEIVQESDGWTFVTEDKSSVAQIEHTIIVTKGEPIILTL

SEQ ID NO: 76461 - protein, 184 aa, Physcomitrella patens subsp. patens
MASVVAASSAVAPAAAFVAASSSGVSTSEATSVKAFSGLKSTTLFSGNARKLSSVQNGSRVQCMQVWNPIGMTKFETFSYLPPLSDDAIAKQVEYMIQQKLIPCLEFDVNSNGVSRVNNSSPGYYDGRYWTMWKLPMFGCQDSAQVLREIEECKKTFPGCYVRVLGFDNVKQVQICGFLVARPN

SEQ ID NO: 76462 - protein, 279 aa, Bacillus cereus E33L
MSIQNISFLGAGSIAEAIIGGLLHANVVKGEQITVSNRSNETRLQELHKKYGVKGTHNKKELLTDTNILFLAMKPKDVAEALTPFKEYIHHNLLIISLLAGVSTHSIRNLLEKNIPIIRAMPNTSAAILKSATAISPSKHATKEHIQTAIALFETIGLVSVVEEEDMHAVTALSGSGPAYIYYVVEAMEEAAKEIGLKEDVAKSLILQTMIGAAEMLKASEKHPSILRKEITSPGGTTEAGIEVLQEHKFQQALISCITQAAQRSHNLGKTLEQLTKEK

SEQ ID NO: 76463 - protein, 630 aa, Listeria monocytogenes EGD-e
MKQLKVENLTKTYGEKSLFENISLTITEGERIGLIGVNGTGKSTLLQIISGSESGDKGTVTKAKDYTIGYLAQDPAFNEEDTVLAAVFDGDTAALRAMRKYEEVLLAMSLDAENTKLHDAYTAASQEMDASAAWDMNTEAKTILERLGITDLTAKISALSGGQRKRVGLAQVLIETPDLLILDEPTNHLDFQSIRWLEEYLNRFKGAVLLVTHDRYFLDRVTNHMVELDRGSAYRYVGNYEKFMESKAIRMENEVRESEKNKNLYRKELAWMRRGPQGRATKQNARQDRFHDLEKKVKIKTDDSELAIDFVTSRLGKDVFELKNLEKRFDEKQVLQDFSLIIQPGERLGITGNNGTGKSTLLNMLAGKLAPDAGEVVTGQTVQIGYYTQQNEEMDPDMRMIAYLQEAGEQVTTSGGEVISVSAMLERFLFPPNSHGKKIGSLSGGEKRRLFLLRILMERPNVLLLDEPTNDLDTQTLTVLEDYLESFNGTVITVSHDRYFLDKVVNKLLVFRAIGEVEIFYGEYSDYLKELEAKGKPAKSMKKMANTSVEKSSPEKKEKVKLTYQEQLEWDGIEDAISKLEKDIESLNETLEQTGADFTKAAEISGFITAKETELEQMMERWEFLSQYAE

SEQ ID NO: 76464 - protein, 579 aa, Physcomitrella patens subsp. patens
MGPGYDDGTHFDSGAAQNLAIIGVNDHGLKPAPRKKKKVVKRWRDEWAETYKWAYVAVHEGSHRIFCSVCKEYGRKHRRNPYGNEGSRNMQMSALEEHNNSLLHKEALRLQMASRDRGMGIVERPLYVKGMLLKIDVAVSILAAILRRDPHEVEFIQSIQEVVHSLEPVLAKVPQYVHVFERLVEPERVTIFKVPWVDDKGEAHVNRGFRVQFNQALGPYKGGLRFHPTVNLSVVKFLAFEQTLRNSLSSLSLGGGQGGSDFNPKGKSENEIMRFCYSFMEELYRHIGPNQDTPSGDIGVGQREIGYLFGQYRRLTSQYEGILGPKGIQWGASNLHSEATGYGVVYYAKEVLASLEKDLKGLRCVVSGAGKVALYAVEKLIAFGAIPVTVSDTSGYILDEGGFDRVKLGFIREIKAHNKCLRDYTKNYSSAKYFEDMKPWTVKCDVAFPCATQNELNHVDALSLINVGCQVIIEGANMPCTAEAIDVFRKSKVWFGPGKAANAGGVTIQGLEMSQNNSCAQWTAEEVDTRLEEVMKDIYQKSVKAAQDYGIGNPEALLDGANIASFLRVAQAMLEQGCV

SEQ ID NO: 76465 - protein, 424 aa, Burkholderia vietnamiensis G4
MPSHADSPAVHHAGSLTIFQGAALYIGAVLGTGVIALPALAAEVAGPASLLAWAALVVLSGPLAATFAALGARYPDAGGVSTYARRAFGPKAAAIVGWCFYFAVPAGAPAAAMFGGAYVAAVIGGGHTTVVVTAAALIAAVSAANAFGVTVSGRMQLVLSALLVTLLLAAVLASAPHARPENLQPFAPHGWLAVGQAAALLVWSFAGWEAITHLAAEFRRPAHDMPRSAGIAVVVVGFLYLSVAAASVTVLGPSAGASGAPLAELIARGIGGHAQVLAAAAALLLTLGTMNAYFAGAAKLGAALGRDGALPAWLAQGSQVGGVPRRSLGVIAALAAAALAATAFSDVGPKPLVLVSSGCFVMVYGLGAAAALKLLPRASAAYRCAWVSLIAVAGLFLTTGWYLFFPLLLAGAALLYLRLARRRA

SEQ ID NO: 76466 - protein, 467 aa, Leptospira interrogans serovar Copenhageni str. Fiocruz L1-130
MSAEFDVVVIGAGPGGYVCAIRCAQLGFKTAIIEKRKTLGGTCLNVGCIPSKALLDSSEEYHKTLHKLEVHGISVGKVDLDLNKLMNRKDQIVKEVTDGVDFLMNKNKIKRYEGFGKVLSAGKVEVAFNDGKKETLSAKHIVVATGSVPIDIPGLTVDGKNIITSDHAIDVRKLPKKMIIIGAGVIGLELGSVWGRLGTSVTVVEFLPGLISNVDRQMGSLLERSLTSQGMEFLFEHKVKGATTTKNGVKVQIEDSKGESKDLEADVVLVAVGRRPFLEGVGLEEVGVAFTQRKRIQVDAHFKTSVPGIYAIGDAIDGPMLAHKAEEEGVALAELLAGQSGHVNYNAVPYVIYTWPEMAWVGKGEEELKAAGIEYKVGKSLFRPNARSKAMNEAEGQVKILADKKTDKLLGAFVFGPRASDMVAELAVAMEFGASAEDIARSFHAHPTLSEVIKEAAMAVDKWAIHA

SEQ ID NO: 76467 - protein, 232 aa, Triticum aestivum
MVGMAVVGQWTLCVASPSPRVKSATCNSNSCPTTVNLRSELSAFRPQFRLFSRVSPTRRRRLCASSSADSGIFLPHLVASMEQVEETYIMVKPDGIQRGLVGEIISRFEKKGFKLIGLKMFQCPKELAQEHYKDLSAKSFFPSLIEYITSGPVVCMAWEGVGVVASVRKLIGKTDPLQAEPGTIRGDLAVQTGRNIVHGSDSPENGKREIALWFKEGELCGWDSALAKWLRE

SEQ ID NO: 76468 - protein, 176 aa, Haemophilus influenzae R2866
MADFNQILTPGDVDAGIINVVNEIPEGSCHKIEWNRKVAAFQLDRVEPAIFAKPTNYGFIPQTLDEDGDELDVLLITRQPLATGVFLEAKVIGVMKFVDGGEVDDKIVCVPADDRDTGNAYNSLADLPANLIKQIEFHFNNYKALKKPGSTKVTHWGDVEEAKEVIRESIKRWNER

SEQ ID NO: 76469 - protein, 421 aa, Leptospira interrogans serovar Copenhageni str. Fiocruz L1-130
MSVEIKVPEMGESITEATIANWVKKEGESVKQDEILLELETDKATMEVPAPSSGVLQKIHKKAGETVKVKEIIGLIDSSATASSPSPSASAPTNSAQTTQTSGNGTINETLPPAVRKLIEDNGLNPASITGSGKNGQITKEDVLKAIETKATSSVSNASVNVGTPAAVKATLTLPEIPKAVPAARRTDLPRENVVPMTRLRKVIAERLVSAQHNAAILTTFNEVDMSAVMELRNRYKDKFKEAHNVSLGFMSFFTKAAIHALKTIPAINAEIRGSDIVYKNYYDIGVAVGGPKGLVVPVVRDADLLSFAGVEQEIIRLANRVKDGKIELAEMEGGTFTISNGGIYGSMMSTPILNPPQSGILGLHNIVKRAVVVNDQIVIRPMMYLALSYDHRIVDGKEAVTFLVKVKEAIEDPSRLLLEL

SEQ ID NO: 76470 - protein, 232 aa, Triticum aestivum
MITPRYFCDTIEYSSYASNALGALPYGRPAGGRTSDSSGRPGRYGNRSGYFDETREEYVEIPSDSGITFNEQPKMKALEIAERTRDAILSGKFDQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRSRSDIQTPGLANVAATVMNLHGFQAPADYETTLIEVVD

SEQ ID NO: 76471 - protein, 573 aa, Burkholderia vietnamiensis G4
MTTLNRFKSSAAVLVTAAGLGFVPAAPAWAKAPQPALLTSSAVAVADQYSADAAEQIFKEGGNAIDAAVAIAFTLAVTYPEAGNIGGGGFMTIYKDGKPYFIDYRERAPLAATKDMYLDKNGNVVEGMSLYGPRAAGVPGTVAGMWEAQKRFGKLKWKQVLAPAIHYARDGFVVDEQLAQRGVDASKEFGGKTNFDKYFSTMKAGENFQQPDLADVLARIANDGANGFYKGKTAELIAASMKTGDGNGLITTEDLAQYRAVWRQPVQAKWNGYDVITAPPPSSGGIGLVQLLKMKADLKQDFAGVKLNSPQYIHLVAEIEKRVFADRAQYLGDPDFYKVPIARLIDDAYLAKRAAEVNPSRISDTKSVQPGLGTSMPEKAETTHFSVVDKWGNAVSNTYTINGYFGSGVIADGTGIVLNDEMDDFSAKPGVANMFGVVGSDANAIEPNKRPLSSMSPTIMTKNGKVSLVIGTPGGSRIFTSIFQVINNIYDFRMPLKDAVAAMRFHHQLLPPNTIYWEPYRPIEGELAAQLEARGYTLKGQDFSGDIQVIKIDGRTPEAMADPRGRGVTRIIR

SEQ ID NO: 76472 - protein, 323 aa, Acidovorax sp. JS42
MQVAAARKIVVMGTGGTIAGSSAVQGANVGYTAGQIGVEQLLAAVPGLVQAAGGALVAEQVVQLDSKDMGFDAWARLAGRCAAHLADPAVAGVVITHGTDTLEETAWLLHNLLDTTAKPAVLTCAMRPATALAPDGPQNLLDAVTLAADPSARGVLMAAAGVVHGAREVSKVHPLRLDAFDSGDAGPLGWMEAGRVRWARGLAPQVEQPAHGALVPILPDAAWPRVEIVLSHAGADGALVDWLVEKGVHGLVVAATGNGTLHHALEAALARAVEAGVQVRVASRCPQGRMMDLTGTPWRDADGLSPVKARVSLVLELMQSANS

SEQ ID NO: 76473 - protein, 513 aa, Arabidopsis thaliana
MEALNSILTGYAVAALSVYALWFYFLSRRLTGPKVLPFVGSLPYLIANRSRIHDWIADNLRATGGTYQTCTMVIPFVAKAQGFYTVTCHPKNVEHILKTRFDNYPKGPMWRAAFHDLLGQGIFNSDGDTWLMQRKTAALEFTTRTLRQAMARWVNGTIKNRLWLILDRAVQNNKPVDLQDLFLRLTFDNICGLTFGKDPETLSLDLPDNPFSVAFDTATEATLKRLLYTGFLWRIQKAMGIGSEDKLKKSLEVVETYMNDAIDARKNSPSDDLLSRFLKKRDVNGNVLPTDVLQRIALNFVLAGRDTSSVALSWFFWLVMNNREVETKIVNELSMVLKETRGNDQEKWTEEPLEFDEADRLVYLKAALAETLRLYPSVPQDFKYVVEHDVLPDGTFVPRGSTVTYSIYSIGRMKTIWGEDCLEFRPERWLTADGERFETPKDGYKFVAFNAGPRTCLGKDLAYNQMKSVASAVLLRYRVFPVPGHRVEQKMSLTLFMKNGLRVYLQPRGEVLA

SEQ ID NO: 76474 - protein, 168 aa, Zea mays
GVNKDNVGKFISGYLAQGIPQKDPLKGLAQKGGGQPGKFSPKRGPKTRPHFKGGPCGKPGGKPSLGAFFPKGGGDYVSCPPFRGPNARPTPTQGLFLGRPPLGNRNAPRWGKGGPPELLQNPAFLTLLGAGAKKTPIPRPFFPPPRKTSQPPPGSKTCFSKPPPISVF

SEQ ID NO: 76475 - protein, 711 aa, Haemophilus influenzae R2866
MKQLFATTSRGFEELLKVELTELGAQEAKVVQGGVHYQADDETLYRTLLWSRLASRILFPLIETKIYSDLDLYAAVSGFNWLAQFDERVTFFVDFNGTNQEIRHTQFGAMRVKDGIVDYFERQGKARPDVDKIQPDVRIHAYLNRENLVISLDLSGEALHLRGYREDAGQAPLRETLAAAIVMRSGWQVGSPLVDPMCGSGTLLIEAAQIEAKIAPQLYRLHWGFDFWKAHNQSAWEKVKNEAIELAEEKQREIQPHFYGFDLDHRVLKKAQKNAQNAGVSHLIKWQQADVAALKNPRLNEVGTVICNPPYGERLGTTPALIALYSVFGQRLKKEFCGWNVSVFSSESTLLDCLRMRASRQFKAKNGPLDCVQKNYQVSERKSDAITDEKELEFNRTSEVAPDFANRLQKNIKKISKWAKQQELDAYRLYDADLPEYNLAVDRYADYIVVQEYAAPKNIDENKARQRLLDAVTATLQVTGVETNKLILKVRQKQKGTNQYEKLANKGEYFYVNEYGAQLWVNLTDYLDTGLFLDHRLTRKMIGELAKGKDFLNLFAYTGSATVHAALGGAKSTTTVDMSNTYLNWAEQNLILNDIEGKQHKLIQADCLQWLEKCDRQFDLIFVDPPTFSNSKRMEESWDVQRDHVKLMSNLKRVLSNNGTIVFSNNKRGFKMNLVALEELGLSAVEISHKTLPLDFERNKQIHNCWMIQHI

SEQ ID NO: 76476 - protein, 146 aa, Arabidopsis thaliana
MEVYFQRLKLLYIVFGTESLESLPEDKLILRGLKFYGFHGVLPEERELGGLFIVDINLWLSLKKAIESDNLADTVSFADTFRLVKKIVEGPPRNLYETVADDIASEMLETFPKINVIRVKFGKPNPSLVNSTVDFLGAELFRKRNH

SEQ ID NO: 76477 - protein, 366 aa, Lactobacillus johnsonii NCC 533
MSLTAGIVGLPNVGKSTLFNAITKAGAEMANYPFATIEPNVGMVEVPDSRLARIQELIPAKKIVHTTFEFTDIAGLVKGASKGEGLGNKFLENIRQTDAIVHVVRAFDDDNITSVTGKVDPEEDINTINLELAIADLDAVNRRIGKVQKVAQQGDKEAKAELAVLNKLKPVLEEGKAARSIDFNEDEQKIVKGLFLLTSKPVIYVANIAESSMADPESDKYYQIVKKHAESENAEALGISAATEEEIASMDEDERKEFLEMEGVEESGLDRLIKAAYHILGLRTFFTAGGPETRAWTFHEGMKAPQVAGVIHSDFERGFIRAEVVSFDDLNELETMQKVKEAGKLRLEGKDYVVQDGDIIEFRFNV

SEQ ID NO: 76478 - protein, 311 aa, Streptococcus pneumoniae TIGR4
MHEIYLAGGCFWGVEEYFSRVPGVTDAVSGYANGRGETTKYELINQTGHAETVHVTYDAKQISLKEILLHYFRIINPTSKNKQGNDVGTQYRTGVYYTDDKDLEVINQVFDEVAKKYDQPLAVEKENLKNFVVAEDYHQDYLKKNPNGYCHINVNQAAYPVIDASKYPKPSDEELKKTLSPEEYAVTQENQTERAFSNRYWDKFESGIYVDIATGEPLFSSKDKFESGCGWPSFTQPISPDVVTYKEDKSYNMTRMEVRSRVGDSHLGHVFTDGPQDKGGLRYCINSLSIRFIPKDQMEEKGYAYLLDYVD

SEQ ID NO: 76479 - protein, 795 aa, Pyrococcus abyssi GE5
MAEKKEVKLKVASAYQRDVGRGIVRLDRKTMRELGISPGDVVEIIGTKNTAAIAWPAYPEDEGLGIIRMDGTIRKNAGVGLGDEVTVRKAEVREAKKVTLAPTEPIRFGRDFVEWLHERLVGRPVVRGDYIKVGVLGQELTFVVTATQPSGVVQITEFTDFNISEKPVKEVEKRMTTGVTYEDIGGLKDVIEKIREMIELPLKHPELFEKLGIEPPKGVLLYGPPGTGKTLLAKAVANEANAYFIAINGPEIMSKYYGESEERLREVFKEAEENAPAIIFIDEIDAIAPKRSEVTGEVEKRVVAQLLALMDGLKSRGKVIVIGATNRPDAIDPALRRPGRFDREIEVGVPDRQGRKEILQIHTRGMPIEPDFRKDDVLKILEDFKREGKFTKIIDKAIEEVNKSKEEEIPQVLKKIDAELYDEVKTRLIDKLLDELADVTHGFVGADLAALAREAAMAALRRLIREGKIDFEAETIPREVLDELKVTRRDFYEALKMVEPSALREVLIEVPNVHWDDIGGLEDVKQELREAVEWPLKYPEAFKAYGITPPKGILLYGPPGTGKTLLAKAVATESQANFIAVRGPEILSKWVGESEKNIREIFRKARQAAPTVIFIDEIDAIAPRRGTDVNRVTDRIINQLLTEMDGIQENAGVVVIAATNRPDILDPALLRPGRFDRLILVPAPDEKARFEIFKVHTRGMPLADDVDLKELARRTEGYTGADIAAVCREAAMIAMRRALEKGIIKPGMKASEIRRLAKVTMKDFEEALRKIGPSVSKETMEYYRKIQEQFKQARG

SEQ ID NO: 76480 - protein, 467 aa, Vigna radiata
MRLLSTIATCNSHGQDSSYFLGWQEYEKNPYDELHNPKGIIQMGLAENQLSFDLLESWLAKNPDVAGFKRDGKSIFRELALFQDYHGLPSFKKALVDFMSEIRGNKVTFDPNHIVLTAGSTSANETLMFCLAEQGDAFLLPTPYYPGFDRDLKWRTGAEIVPIQCTSSNNFQITEPALKQAYEEARKRNLRVKGVLVTNPSNPLGTTMSRSELNLLVDFIKEKKDTHLISDEIYSGTVFSSPGFVSVMEILKERNDTEEIWNRVHVVYSLSKDLGLPGFRVGAIYSENDTVVAAATKMSSFGLVSSQTQYLLSAMLGDKKFARNYIVENQKRLKRRQRMMVSGLQKAGISCLESNAGLFCWVDMRHLLHSNTFEAEMELWKKIVYQVGLNISPGSSCHCTEPGWFRVCFANMSEETLTLAMKRLKNFVVESTCTQRSALFNGTSKRKSLTKWVFRLSSRDHREQEER

SEQ ID NO: 76481 - protein, 469 aa, Arabidopsis thaliana
MLPCLLVVLHRIYDYIVEILEISDLTFSFKGPWFAGMDTLLTVDPANIHHMMNSNFSNYIKGSDFKEVFDVFGDGIITTDSELWKNLRKSYQEMLHHQAFQSFSLSTTRSKLKDGLVPLLNHFAEEGTTVDLQDVLGRFTFDTILILITGSDPRSLSIEMHEDELAKALDVVGEGIFFRHVKPKFLWKLQNWMGFGHEKKMIEANATFDRVCAKYISDKRGEIIRSQRFSDISYGEPEDLLSSFMKLDTTKYNLLNPSDDKFLRDTILAFILAGRDTTASALTWFFWLLSENAQVVSKIRQEIINTNPSKNGNGQENLDKLVYLHGALCEAMRLYPPVSFGRKSPIKSDVLPSGHKVQANSKIIICLYALGRMRAVWGDDALEFKPERWVSDKGSLRHEPSFKFLSFNSGPRTCLGKHLAMTQMKMVAVEILHNYEIKVIKGQKIKPVLGFILSMKHGLRITITKRCPY

SEQ ID NO: 76482 - protein, 423 aa, Corynebacterium glutamicum ATCC 13032
MENPSLRELDHRNIWHPYAAPGVRNRLVTKTDGVFLTLEDGSTVIDAMSSWWSAIHGHGHPRLKAAAQKQIDTMSHVMFGGLTHEPAIKLTHKLLNLTGNSFDHVFYSDSGSVSVEVAIKMALQASKGQGHPERTKLLTWRSGYHGDTFTAMSVCDPENGMHSLWKGTLPEQIFAPAPPVRGSSPQAISEYLRSMELLIDETVSAIIIEPIVQGAGGMRFHDVALIEGVATLCKKHDRFLIVDEIATGFGRTGELFATLSNGLQPDIMCVGKALTGGFMSFAATLCTDKVAQLISTPNGGGALMHGPTFMANPLACAVSHASLEIIETGMWQKQVKRIEAELIAGLSPLQHLPGVADVRVLGAIGVIEMEQNVNVEEATQAALDHGVWIRPFGRLLYVMPPYITTSEQCAQICTALHAAVKGK

SEQ ID NO: 76483 - protein, 160 aa, Glycine max
MDCKKRVRDDSDESILESPEAKRLRDDLLEFFDDADDAASTQDLDSVMKSLQEEISGVTSDYGESQAQIGYLLEASDDDLGLPPAGNSSAPQEKNVEAELVRVASDSSGIGELWEFEDQIPRYDSFDLGMGFGYECDATEYAAFGELFDHSDVYYDSWRQ

SEQ ID NO: 76484 - protein, 209 aa, Brassica napus
PNSSKGGIGFQAIAEALGLAAVKAAVAITAIIAGGRLLLRPIYKQIAENRNAEIFSANTLLVILGTSLLTARAGLSMALGAFLAGLLLAETEFSLQVESDIAPYRGLLLGLFFMTVGMSIDPKLLLSNFPVVIGTLGLLILGKTILVVVMGKLFGISVISAIRAGLLLAPGGEFAFVAFGEAVNQGIMSPQLSPLLFLVVGISMAITPW

SEQ ID NO: 76485 - protein, 332 aa, Francisella tularensis subsp. tularensis SCHU S4
MQKNILVLGAGAWGTALALQLAYRGHNVRINSWKAEHNEQMLKDNNNHKYLPSIEKFPSRLKAIQDWQANIIEFDSILVATPSSGFKNTILELKECILPQQNIISATKGFCHDSYALLSEIAEDILPTTKFALLTGPSFAKELANQLPTAVVVASKDINYARYVQELFSNENFRCYTTTDIIGAQVGGAVKNVLAITAGIAAGMEFGVNAHAALITRGLAEIKKLGLKLGANSETFIGLSCLGDLLLTCSDNQSRNRRFGLYLGQGMTIQQALKEVNNVVEGYFTAKAVYNLAKKHNVEMPLVFATYRILYEAADPRDIVKELMTRQLKNEN

SEQ ID NO: 76486 - protein, 331 aa, Acinetobacter lwoffii
VMFDRCLVATGASPAVPPIPGLKESPYWTSTEALASDTIPERLAVIGSSVVALELAQAFARLGSKVTVLARNTLFFREDPAIGEAVTAAFRAEGIEVLEHTQASQVAHMDGEFVLTTTHGELRADKLLVATGRTPNTRSLALDAAGVTVNAQGAIVIDQGMRTSNPNIYAAGDCTDQPQFVYVAAAAGTRAAINMTGGDAALDLTAMPAVVFTDPQVATVGYSEAEAHHDGIETDSRTLTLDNVPRALANFDTRGFIKLVIEEGSHRLIGVQAVAPEAGELIQTAALAIRNRMTVQELADQLFPYLTMVEGLKLAAQTFNKDVKQLSCCAG

SEQ ID NO: 76487 - protein, 251 aa, Burkholderia mallei ATCC 23344
MSKQRIKRVIGNWKMHGRLSGNEALLDEVAQGAQAVPEHVGIGVCVPFPYLAQARARLHGGRVAWGAQDVSAHEQGAFTGEVAAGMVAEFGAAYAIVGHSERRAYHGESNEIVAAKAQRALAAGLTPVVCVGETLAEREAGATEQVVGVQLDAVLAVLSQDEAARIVVAYEPVWAIGTGRSATAEQAQQVHAFLRGRLAAKGAERVSLLYGGSVKADNAAELFGQPDIDGGLIGGASLKSGDFLAICRAAQ

SEQ ID NO: 76488 - protein, 393 aa, Pseudomonas aeruginosa UCBPP-PA14
MRYSDFTQRIAGDGAAAWDIHYRALARVEQGEEILLLSVGDPDFDTPAPIVQSAIDSLLAGNTHYADVRGKRALRQRIAERHRQRSGQAVDAEQVVVLAGAQCALYAVVQCLLNPGDEVIVAEPMYVTYEAVFGACGARVVPVPVRSENGFRVQAEEVAALITPRTRAMALNSPHNPSGASLPRATWEALAELCTAHDLWMISDEVYSELLFDGEHVSPASLPGMAERTATLNSLSKSHAMTGWRVGWVVGPAALCAHLENLALCMLYGSPEFIQDAACTALEAPLPELEAMREAYRRRRDLVIECLADSPGLRPLRPDGGMFVMVDIRPTGLSAQAFADRLLDRHGVSVLAGEAFGPSAAGHIRLGLVLGAEPLREACRRIALCAAELLGQA

SEQ ID NO: 76489 - protein, 413 aa, Triticum aestivum
  misc_feature (266)..(266): Xaa can be any naturally occurring amino acid
RRSARRRPFIAAGAASIAFSVLTVGFSADLGRLFGDDIVPGSTRFGAIIVYLIGFWLLDVGNNATQGPCRAFLADLTENDPRRTRIANAYFSLFMALGNILGYATGAYNGWYKIFPFTITESCTVSCANLKSAFLLDIIILAITTYVSVVTVQDNPTFGSDEAAPPSSHEEEAFLFELFGSFKYFTMPVWMVLIVTSLTWIGWFPFILFDTDWMGREIYRGSPEIVADTQKYHDGVRMGSFGLMLNSVVLGITSIGMEKLCRKWGXAGLVWGVSNIIMALCFVAMLIITYVAQNLDYGPSGAPPTGIVAASLIVFTILGAPLSVTYSIPYAMAASRVENLGLGQGLAMGILNLSIVIPQIIVSLGSGPWDQLFGGGNAPSFWVAAAASFVGGLVAILGLPRARLGPKKKTTQR

SEQ ID NO: 76490 - protein, 470 aa, Pseudomonas aeruginosa UCBPP-PA14
MADGKERLQLTRALASRHIFMLSLGGVIGTGLFMGSGVTINQGGPAGAVLAYLVAGVLMYLVMVCLGELSVQMPVSGSFQAHATRFIGPATGFMIGWVYWMSWASTVGLEFTAAGMLMTRWFPEVPVWLWSGFFVVVLFSLNALATRAFGEAEYWFAGIKVAAILVFIVVGGLVIFGGIELKSGAPAPMFSNLVGERLFPNGLSAVFAVMMTVVYAFQGCEIMGVAAGETERPEKSIPRAVRNVVFRVLIFYVLAIVVLSAIIPWQQAGLVESPFVQVFDMVGIPYAADLMNFVILTAILSVGNSGLYASTRILWAMSRTGMAPRGLSKLSARGVPLYALLITLCFALLSLLTSVIAADTLFMVLMAVSGMSGTVTWIVIAYAQYRFRREHMASGGTVAELKYAAPLFPLVPLACIAVCCSLFVFLALDPTQRPSLYWGFGFIAACYLAYYVVRRRQPQGLGDPALGRAG

SEQ ID NO: 76491 - protein, 255 aa, Bacillus cereus E33L
MSDYVVVKCGGSMLDQLNDVFFDCIKKLQQKYKVVIVHGGGPEIDAQLKDCNINVEKRDGLRVTPKEVMDVVQMVLCGSTNKKLVMNLQKHNLRAVGCSGCDGNLLQVQPVSEEIGYVGEVRYVETALLKGLINMNYIPVIAPVGINDNEIYNINADTAAAGIAAALSAKELIFITDVDGVLHEGKLVKKTDEFEIVNFIENGVITGGMIPKVQAAIASLKMGVQKVSIVNGMKDFTEVTGECIGTTVTRGVSIA

SEQ ID NO: 76492 - protein, 152 aa, Triticum aestivum
  misc_feature (100)..(100): Xaa can be any naturally occurring amino acid
MASEQTFIMIKPDGVQRGLIGEVISRFEKKGFYLKGLKLQNVEKSFAEQHYADLSSKPFFAGLVEYIVSGPVVAMVWEGKSVVSTGRKIIGATNPLASEXPGTIRGDFAVDIGRNVIHGSDSVESARKEIALWFPEGIAEWRSSQHNWIYEA

SEQ ID NO: 76493 - protein, 316 aa, Bacillus cereus E33L
MSTVQVPKLNTKDLLTLEELTQEEIISLIEFAIYLKNNKQEPLLQGKILGLIFDKHSTRTRVSFEAGMVQLGGHGMFLSGKEMQMGRGETVSDTAKVLSQYIDGIMIRTFSHADVEELAKESSIPVINGLTDDHHPCQALADLMTIYEEVNTFKGIKLAYVGDGNNVCHSLLLASAKVGMHMTVATPIGYEPNEEIVKKALAIAKETGAEIEILHNPELAVNEADFIYTDVWMSMGQEGEEEKYTLFQPYQINKELVKHAKQTYRFLHCLPAHREEEVTGEIIDGPQSIVFEQAGNRLHAQKALLVSLFKNVEEPS

SEQ ID NO: 76494 - protein, 254 aa, Zea mays
  misc_feature (133)..(133): Xaa can be any naturally occurring amino acid
MAKLMNKLVDSFEHDEILDVGCVRAVLAELVLTFLFVFTGVSAAMAAGSDGKPGDAMPMATLAAVAIAHALAAGVLVTAGFHVSGGHLNPAVTVGLMVRGHITKLRAVLYVAAQLLASSAACVLLRFLEAGRXPVHALGRGISPMQGLVMEVILTFSLLFVTYAMILDPRSQVRAIGPLLTGLIVGANSLAGGNFTGASMNPARSFGPALATGDWTNHWVYWIGPLLGGPLAGFVYESLFLVHKMHDPLLNGEI

SEQ ID NO: 76495 - protein, 151 aa, Gloeobacter violaceus PCC 7421
MRIKLVAVGRLREEAYERACAEYARRLAAYARLELVEVRDARIADSRAGLLKEGQALLDQLHPGEHAVLLDSGGKQFTSVELADWLENHTVQEPVFIVGSSHGVAPMVRERAQMVWSLSKLTFPHELARVIVLEQLYRAVTILAGHPYHHG

SEQ ID NO: 76496 - protein, 329 aa, Bacillus thuringiensis serovar konkukian str. 97-27
MIDNFWRDLPRPFFVLAPMEDVTDVVFRHVVSEAGRPDVFFTEFTNSDSYCHPEGMKSVRGRLIFTEDEQPMVAHIWGDNPEYFRQMSIGMAELGFKGIDINMGCPVPNVASRGKGSGLILRPDVAAELIQAAKAGGLPVSVKTRLGFKELSEWEDWLTHIFKQDIANLSIHLRTREEMSQVDAHWELIPEIKKLRDRIAPNTLLTINGDILDRKMGLELAEKYGIDGVMIGRGIFKNPFAFEKEPREHSSKEHLDLLRLQLDLQDQYAEVLPRSITGLHRFFKIYVKGFPGAAELRNQLMSTKSTDEVRTLLNKFEASVSETQGSETV

SEQ ID NO: 76497 - protein, 571 aa, Magnaporthe grisea 70-15
MADEKGTVGSGTLPTYGASPDASHQDMAMDGREENFYTRNGLNLESFKCRSYGQGIVELDRSMKKRHLHMIAIGGSIGAGFFVGSGAAFAKGGPGAVFIDFAIIGVMMFNVVYALGELAVMYPVSGGFYTYSVRFIDPSWGFAMGWNYVFQWAVVLPLELTVCGLTLNYWEGTQAVPLWGWILIWWFAIIIINIFGTLGYAEEEFWSSCLKLSAIVIFMIIAFVLVLGGGPKGGKYDSYWGARHWYEPGAFQNGFKGFCAVFVTAAFSFSGTELVGLAAAESANPAKALPGAIKQVFWRITLFYILGLFFVGLLVSSTDDRLLSSNPYADGTSPFVIAAKDAGLVGFDHFMNVIILVSVLSIGVSCVYGGSRTLTALAQQGYAPKVFTYVDKSGRPLASVFVIIACGALAFLNLDAGAEKVFSWLLSLSGLAALFTWGSICLAHIRFRQAWKAQGHTLDEIPFQAALGVTGSWIGLILCVLVLIATFYSALFPYNKPGVGTAESFFQEWLSVPVILFFWACGYIWKREGGLKLEQIDVDTGRREHDWDQINAYKAELAAMPSWKRFVKKIF

SEQ ID NO: 76498 - protein, 160 aa, Triticum aestivum
ISTVIKNMGSTLGACGDLNRNVLAPAAPYVRKDILFAQETAENIAALLAPQSGAYYDLWVDGEKIMSAEEPPEVTKARNDNSHGTNFPDSPEPIYGTQYLPRKFKIAVTVAGDNSVDILTNDIGVVVVSDSAGEPVGFNLYVGGGMGRTHRIETTFPRLA

SEQ ID NO: 76499 - protein, 604 aa, Zea mays
MEVTIAEKKPRAAGDGGGLVERLPEALLVEVLARVDVDGACSAAASCRSLYAAANAVLPALTSIDLSAFAPSNAILSRILAGNGAVRSLTVNCSLLDDSAASVIARGSLRDLSLLKCSFSMSFFVALGGACHDLRSLKLEMAVCPYTLYPCLAPVYVGCVHLETLWVKFPLLDPLTTFRSYKAGSPLIPSNIKDLLLQPVSHSRAKTVFLKTTSLNKHITDNLESLSLVLDMVTDELVMLITSNVHKLSELCLEDEPDTQPNLPEDLTNVGLQALGLCHNLKHLSLTRRSYDFRRVNDFGILMLADGCKQLRTIRLGGFSKVSDAGYAALLHSGKDLKKFEVSNGWCLSDLACLDLDKAAPNITEVRLLNCALLTSDTAISLAPCTNLKVLDLSGCKSIADSGLVSISQLPNLTLLDLAGADITDVGLSALGNGRCLISSLCLRGCRRISSNGIASLLCGAGTINKTLVSLDIGNVPRISCRAVTVIAKNCEQISSLCLRNCLLITDSSLEVLGSMGCDSSKCPLRMLDLAYCSKLSRNFLRHFEPPLFRGLRWLGIGKNVAQRRGCSLTIAEVLERKPGLTICCNACDMGCRNKCHPDIRFLQ

SEQ ID NO: 76500 - protein, 467 aa, Bacillus licheniformis
MRNTIGVIGLGVMGSNIALNMASKGEQVAVYNYTRDLTDQLVQKTGGQTVKPYYELEDFVQSLEKPRKIFLMVTAGKPVDSVIDSLVPLLEEGDVIMDGGNSHYEDTERRYDSLKAKGIGYLGIGISGGEVGALKGPSIMPGGDRDVYEKAAPILTKIAAQVEGDPCCVYIGPKGAGHFVKMVHNGIEYADMQLIAEAYTFLREKLLLPIDEIADIFDTWNQGELKSYLIEITAEILRKKDERTGAPLIDVILDKTGQKGTGKWTSLQAIDNGIPSSIITESLFARYLSSLKDERTAAENVLAGPETEERPLDQNVWIDRVRQALYMGKVCAYAQGFAQYKMTSDLNGWHLPLKDIALIFRGGCIIRAQFLNLISEVYDKQPDLSNLLVAPDFAEKLKEYQSGLRKVVCEGISSGISFPCLSTALSYYDGYRTGRSNANLLQAQANYFGAHTYERTDMEGVFHTDWY

SEQ ID NO: 76501 - protein, 153 aa, Glycine max
  misc_feature (44)..(44): Xaa can be any naturally occurring amino acid
MENGGSKGDVPEDANAHCPGTQSEEAGKADSCAGCPNQQICATXPKGPDPDLVAIAERMATVKHKILVLSGKGGVGKSTFSAQLSFALAEMDHQVGLLDIDICGPSIPKMLGLEGQDIHQSNLGWSPIYVESNLGVMSIGFMLPNPDDAVIWR

SEQ ID NO: 76502 - protein, 448 aa, Bradyrhizobium japonicum USDA 110
MRLSQNVWRTIRMDAAIEPKVQRRKTFRVRNFLSTLGPGLITGASDDDPSGIGTYSQAGAQLGFGIGWTMLLSYPLMAAIQEISGRIGRVTGHGIAGNVCRNFGAAWVWSLVGLLFVANTINIAADLGAMADALKLLIGGPGIAYVVLFGTLSVLAQIFFNYDRYVSVLKWLTLSLFAYVIALAVVKVPWEEALKGVLIPRVSWDAAFLTTLVAILGTTISPYLFVWQSSQEAEEQRIDADKKPLKKDSSDAPEEFRRIRLDTMIGMAFSNLIALSIIVTTAATLHAQGKTDIESSAQAAEALKPIAGPFAELIFALGIVGTGLLAIPVLAGSTAYAIGEGRRWKVGLSRKPKEAIAFYSVLALSGFCGIGLNFTPIDPIKALYWSAVVNGVLAAPVMVLLMVLVRRPKVMGKLVVTGPLYWLGWAATAAMALCIVGMVATMFMGSSS

SEQ ID NO: 76503 - protein, 262 aa, Rhodococcus sp. RHA1
MLELKTPREIAAMDVTGTFIAELLDDLEHRAVPGVNLLELEERARQLIAQRGATSCYWDYAPSFGRGPFRNVICLSVNDAVLHGLPHDYVLQNGDLLSMDIAVSIDGWVADCARSIIVGDPRPEDERLIAATEKALTAGIAAAVPGNRLGDISAAIGAVAAEYGYPVNTEFGGHGLGRTMHEDPHVSNTGRAGRGLTLRPGLTLALEPWFAAGTDKIVYDPDGWTIRSADGSRTSHSEHTIAITDGPALVLTRREHVAASAL

SEQ ID NO: 76504 - protein, 221 aa, Brassica napus
MESFALHSLSTTATSASFSHHPSRQSLLRRISSRSPPSSISLRSHSVKPLAFPLLKPIHRFSTRIAAAPRDDSPPPPPSPQPPQGAKLVPLILSLSVGLILRFAVSVPEGVTPQGWQLLSIFLATIAGLVLSPLPVGAWAFIGLTASIVTKTLSFSAAFSAFTSEVIWLIVIPFFFARGFVKTGLGDRIATYFVKWLGKSTLGLSYGLTLSEALIAPAMPS

SEQ ID NO: 76505 - protein, 464 aa, Francisella tularensis subsp. tularensis SCHU S4
MALAKTLKPRHIELIALGGIIGSCFFLGTGYVLAEVGPAAILAYILAGIIVYAVTLCLAELTANSPNSGSFIYYTAKYVSPAIACGMGWSYWLNWIIYIPSECIAGGIIMHTFLPAVPTYMWATLFGLFITIINLTKVKIFGEIEFWLALVKIIALGLFSVIAILIFFDIIQNNTGGVLGGTYIVSDGGFFPKGKLILITTMVILLVNFQGSEIIGLAASESNNAEKQMPRIAKHVAIRIVGLYVIPVFLLATIFPWQKMSLSDSVFATALQYYHLDKFAAVFAFVVLVAAFSCANSGFYAAVRSLYGLSRARMAPSIFRKLNSLAIPHFAVYISIIAVWTFLILSFKLSASAAFTNLLAMSGFTATICWICICWSQYNFRKQLIRRNATDKILFKAPLFPYISLFGIWIQVLCLVLTLFNDELRGAFYFGAPAMIIPCCIYFFVSKKKNTKIVQRTISLKKVF

SEQ ID NO: 76506 - protein, 209 aa, Glycine max
TNPVGVPSGKDSAAFQSSGLQCTPHEADALPPAASEKHDSVELGLQDAKSFPEKKDISHAKSSASETDTKRAKQQFAQRSRVRKLQYIAELERNVQALQAEGSEVSAELEFLNQQNLILSMENKALKQRLENIAQEQLIKYLEQEVLEREIGRLRALYQQQQQPPQTQPQQQPSGSHRRSNSRELESQFANLSLKHKDTNSGQDPALRI

SEQ ID NO: 76507 - protein, 396 aa, Francisella tularensis subsp. tularensis SCHU S4
MQLSRRVKAMQASPVRKLVPYSIQAEKQGKKVYHLNIGQPDIKTPNEFMDAIRACDKETIAYSIASGEPSLIKAISKYYKRFDMDFAEDEILITNGGSEALIFAAIATCNAGDEILVPEPFYTNYNGFTTAVDVSIRPITTKAEEGFHLPSKEEILACVTDKNRAIMISNPGNPTGVVYTKQELETLAEVAKEKDLFIISDEVYREFTYDGLVCTSFGNIKGVEDRVIIVDSVSKRYSACGARIGSLCSKNKEFIKEATKLCQARLCVPTLEQIGAAALYEVSEDYLKEVNTEYQKRRDITFEALSKMDNVVCEKPTGAFYVIAKLPIDDAEKFALWLLTDFEDNRETVMISPAGDFYATKGLGKDEIRIAYILEEKSLRRALELLDKAIKAYNSK

SEQ ID NO: 76508 - protein, 525 aa, Arabidopsis thaliana
MKEPLQKKKVVVRHLPPSLSQSDLLSQIDPRFADRYNWVSFRPGKSSYKNQKYSRAYVSFKAPEDVYEFAAFFNGHVFVNEKGAQFKAIVEYAPSQRVPKPSDKKDPREGSISKDPDYLEFLKVIAQPVENLPSAEIQLERREAEQSGASKAAPIVTPLMEFIRQKRATVMGPQQQGLSDIRRGGRRTRVVSANKPSPRPSKRNSEKKKYVEKESSKNVPRKTTADVSSSKPDYRQSNSSGKELPGNETAAIIDSSPPGIALTMDSGKKKILLLRSKDRDNPDNPPPQPEQHIDTNLSRNSTDSRQNQKSDVGGRLIKGILLRNDSRPSQSSTFVQSEQRVEPSEAENYKRPSRPANTRAGKDYHTSGTISEKQERRTRNKDRPDRVMWAPRRDGSEDQPLSSAGNNGEVKDRMFSQRSGEVVNSSGGHTLENGSARHSSRRVGGRNRKEEVVIGEEANVDPKTIIRYLIYSLNICFMIVVTFQAKYMSHSTGFCPSMGIYRSQSKWGSNIINITWVLETFGPTL

SEQ ID NO: 76509 - protein, 173 aa, Ehrlichia ruminantium str. Welgevonden
MNLDNVTSGNNVPKEINVIIEISQNSYPVKYEFDKKKNLFCVDRFLPTSMYYPCNYGFIPHTCAGDGDPVDVLVASRFPITNGVLICARPVGVLVMHDEGGEDIKVLAVPVNKVDQYYSSIQNYTDFPVSFLNSISHFFTFYKKLEEDKFVSVEGWKDISAAETFISNALLSK

SEQ ID NO: 76510 - protein, 406 aa, Triticum aestivum
LYRTSLYKKAGWYRSGIPGISSTHASATCCAVLCRFLLAPLAVWIFLAYKYMKTRIIIDAVEKFLRIQQMIGPARYSYTDIVAVTSHFRDKLGQGGYGSVYKGVLLPGGVHVAVKMLEGNSNCNGEDFISEVSTIGRIHHVNVVRLVGFCSEEMRRALVYEYMPNGSLDKYIFSTEKSFSWDKLNEIALGIARGINYLHQGCDMQILHFDIKPHNILLDSNFVPKVADFGLAKLYPRGDSFVPLSAMRGTVGYIAPEMISRSFGVISSKSDVYSFGMLLLEMAGGRRNADPNMGSSSQAYYPSWVYDQLTQEEAGEISPVAADMHELEKKLCVVGLWCIQMRSRDRPTMGEVIEILEAGADGLQMPSRPFFCDEGHIHVEDSYQFTSELTAVSEEEFSAVSEEDDV

SEQ ID NO: 76511 - protein, 222 aa, Coccidioides immitis RS
MNIVEWAFGKRLTPAERLRKHQRALEKTQRELDRERIKLENQEKKLVQDIKKNAKNGQIGACKIQAKDLVRTRRYIQKFYSMRTQLQAISLRIQTVRSNEQMMQSMRGATILLGSMNRQMNLPALQRIVMEFERENEIMDQRQEMMDDAIDEATGLDDEEEGEEIVKEVLDEIGVDLGQALGETPTGLQTTGIQEGRIAQAVGGGGTAEDDDLQARLDSLRR

SEQ ID NO: 76512 - protein, 462 aa, Bacillus cereus E33L
MTFSKSTTDKPSYTYEELSEKNKAYVWHPFTQMKDYLEEDPVIIERGEGRKLYDVNGNEYWDGVSSIWLNVHGHQVPELDEAIREQLNKIAHSTMLGLANVPSILLAEKIIEVVPEGLKKVFYSDSGSSAVEIAIKMAFQYWQHKGKPKKQRFVTLKEAYHGDTIGAVSVGAIDLFHQVYSSLLFEAIKMPYPYTYRSPYGNDKAEIVKKHLEEMEELLKDKHEEIAAIIVEPLMQGAGGMITMPKGYLRGLRNLCTKYNVLFITDEVATGFGRTGKMFACEHENVTPDILTAGKGLTGGYLPVAITVTTDEIYNAFLGGYEEQKTFFHGHSYTGNPLGCAVAIANLELYEKTNLIEEVARKTEYVAMQLDELFACKHVGDIRQCGLMVGIELVKNKETKEAFEWTERVGVQVCKRSRELGMILRPLGNTIVFMPPLASTIDEIDEMLRILYKAISDITEGE

SEQ ID NO: 76513 - protein, 634 aa, Gloeobacter violaceus PCC 7421
MSNENLFFQAFIYLAAAVVSVPIAKRLGLGSVLGYLLAGVAIGPFVLGLVGKEGEDVMHFAEFGVVMMLFLVGLELQPSLLWRLRVPILGMGGLQVIGTALVAGAIALVFGLSWQMSLAVGLILAMSSTAIVLQTLNEKGVMKSEAGQSAFSVLLFQDIAVIPILALLPLLATGKATEVSLQAAAGDLIFVAAGGASGPTAALPAWQQALLVIALLGGIVLVGRFLMQPVFRFIASTRLREIFTATALLLVVGVALAVQAVGLSPALGTFVAGVVLAENEYRHELETDIEPFKGLLLGLFFIAVGASINFNLLFEQPLLILGLVIGLAVVKFSVLLALGQFFRLQLSQSFLFAFALAQGGEFAFVLFSFATQNRVLTPEVAEPLVAVVALSMVMTPLLMILHDRLVQPRFVLTEPEREPDAIDENENPVIIAGFGRFGQIVGRMLMANGCKVTILEVDPSQIDMLRRFGFKLFYGDATRIDLLHAAGAQQAKLLVIAIDDREKSLEMVDLVRKHFPHLKILARAIDRRHAYELIRRKVDVVERETFGSAVEMGVGALKLLGERSYRAQRIASTFKANDEKMLYEMAELEEEERLVAVRSRRQAEELERVLRAEDRELTRDVERAWDVSDLRKEA

SEQ ID NO: 76514 - protein, 318 aa, Ehrlichia ruminantium str. Welgevonden
MLISAGIHSTDLAKRISELTCIKLVKSYTSNFADQELNVEVEEIQSNKNKHIIIIHTIGFPVHDNLIELLLLIDALKRALSPNRITLIVPYCCYTRQDRVMYRNLNNINIVSALSAKVIANILKTINVNNMIFIDLHSNQLAGFFDTEITNLNPNSIFIDAIIEKFTMENLVIVSPDHGALNRTRTFAYTLAKQYNLKHEIQVAVIDKYRTKPGVSEVMNIIGNVENKECIIIDDIVDSGGTLCNAASALKNNGALQVSAYITHGVLSNNAIAKITNSQLNTLTITDTVNHCSINTPKIKVLSIDKFLSDYILHNLTN

SEQ ID NO: 76515 - protein, 496 aa, Nocardioides sp. JS614
MSLGITAPTDAISMDMQMLIGGNWVDALGEERIPVESPSTMTTIGSVPRARSVDIDRAVVAARQSFPAWRDTPPRQRGRLLARIADALEPLAEELARTISTENGNAIRTQSRGEVAFSVDVFRYFGGIASEAKGETIPLGSTVLDYSRREPFGVVGAIVPWNAPLQLSAMKIAPALAMGNTIVLKVAEDAPLAVLRLAEVANQVLPAGVLNVIPGYGDEAGEALIRHADVDKLTFTGSTAIGSHVMATAAERIVPVSLELGGKNPQIVFPDADNDEVARGAIMAMRFARQGQSCTAGSRLFVHSSIFDSYLDRFVGALRELRVGDPLDEASDIGAIVNRKQFDKVCGYISEGIESNSTVLLGGLPPSDGPLANGYYVTPTVLSQVDPAWRLAREEIFGPVVCAIPWTDEEEVLELANRSHYGLSAFIWTSNLGAALRAAHAVESGWVQVNQGGGQVLGQSYGGFRRSGIGREFSLEGMLDSYTHRKHVSINLAPIG

SEQ ID NO: 76516 - protein, 577 aa, Zea mays
TRLWQLATSRLSVLLSSSAVCSTSTYQFLKNYEDLAIFILAGEAFCGFEASEFRQKLKTVCLNYMVSFHRQNVYALKMVLEKESWTIMSAEASQIISLAGLTGDGAALCSPTSRSPKLPINCYHGTTTANSGKEKLGFASWLVIENPFSFKLENGSAESPKSNMLVDSSASNNHGNGNNSSLDEENEDLLADFIDEDSQLPSRTPKAKIVKGHSLHWKDGDISSQTGSSLSLLRMMDQYARLMQKLEIVNVELFKGISQLFGIFYHYIYETFGNQDKSQSSKPLPDHQSSRLKAALSKITQDSDQWTKPNTVSYSPSSPLSKNSTFGQMDVMPTAPPSSMFTSYGLKERCAAAETLSLVARILNRSRAHLNSVLSKNNSSVVEEFFRTLVDSVPDLTEHIHRTSARMLLHIDGYPDKIANAKWEVKELGIEHNGYVDLLLGEFKHYKTRLDHGGISRELQHLLLEYGVESISEVLVEGLSRVKRCTDEGRALMSLDLQVLINGLQHIVASNVRPKLQTVDTFIKAYYLPETEYVHWARSHPEFSTSQVVGLVNLVATMKGWRRKTRLETVEKIEAGP

SEQ ID NO: 76517 - protein, 445 aa, Gossypium barbadense
MAATIVSVKARQIFDSRGNPTVEVDVETSNGIKARAAVPSGASTGIYEALELRDGGSDYLGKGVSKAVANVNTIIGPALIGKDPTEQTAIDNFMVQQLDGTQNEWGWCKQKLGANAILAVSLAVCKAGAEVKKLPLYKHIANLAGNSKLVLPVPAFNVINGGSHAGNKLAMQEFMILPVGASSFKEAMKMGVEVYHHLKSVIKKKYGQDATNVGDEGGFAPNIQENKEGLELLNTAIAKAGYTGKVVIGMDVAASEFYGTDKTYDLNFKEENNDGKQKISGDALKDLYKSFVAEYPIVSIEDPFDQDDWEHYSKLTKEIGEKVQIVGDDLLVTNPKRVAKAIAEKTCNALLLKVNQIGSVTESIEAVKMSKQAGWGVMASHRSGETEDTFIADLSVGLATGQIKTGAPRRSERLAKYNQLLRIEEELGAKAVYAGASFRAPVAPY

SEQ ID NO: 76518 - protein, 272 aa, Bacillus thuringiensis serovar konkukian str. 97-27
MNKQIGFIGCGNMGIAMIGGMINKNIVSPNQIICSDLNVSNLKNASDKYGITITTNNNEVANSADILILSIKPDLYTSVINQIKDQIKNDVIVVTIAAGKSIKSTENEFDRKLKVIRIMPNTPVLVGEGMSALSFNEMVTEKDIKEVLTIFNIFGQTEVVNEKLMDVVTSISGSSPAYVYMFIEAMADAAVLDGMPRKQAYKFAAQAVLGSAKMVLETGIHPGELKDMVCSPGGTTIEAVATLEEKGLRTAIISAMKRCTKKSMEMSSLTSK

SEQ ID NO: 76519 - protein, 326 aa, Bacillus thuringiensis serovar konkukian str. 97-27
MIKDSSVQVEGQEKVYLDQWVAHYRTYAAKGRSASYIPALGEINVSQLGICIVKPDGTMIKAGDWEVPFTLQSISKVIGFIAACLSRGISYVLERVDVEPTGDAFNSIIRLEIHKPGKPFNPMINAGAITIASLLPGTSVQEKLESIYVLIEKMIEKRPAINEIVFQSEWETAHRNRALAYYLKENGFLESDVEETLEVYLKQCSIEINTEDIALIGLILAHDGYHPIRKEQVLPKEVARLTKALMLTCGMYNASGKFAAFIGLPAKSGVSGGIMTLVPSKSKKDVPFLDGCGIGIYGPAIDEYGNSLPGIMLLEHIAKEWDLSIF

SEQ ID NO: 76520 - protein, 393 aa, Listeria monocytogenes EGD-e
MDLPLSKRVKGVAPSPTLAITAKAKQMKQEGIDVIGLGAGEPDFNTPQNIIDAAIESMNKGFTKYTPSSGIIELKQAIVDKLKKDQFLNYETNQIFVGTGAKHVLYSAFQTILDPGDEVIIPVPYWVTYPEQVKLAGGIPVFVETGFDADFKISAADFEKAITKKTKAIVLNSPNNPSGMCYTKEELIAIGEVAEKHQIYILSDEIYEKLYYGNKADLVSIASLSDRLYDLTIVINGVSKAYSMTGWRIGYAAANKEIIAGMSKLADHLTSNPTANAQYAALEAYVGSQEVPEKMYQAFEERMERFYPELNSIPGFKPKKPDGAFYFFIEVKEAAHKKGFQDVDAFVAALLEEAKVAVIPGSGFGMPDYIRLSYATNPDLFQEAINRIKSFMK

SEQ ID NO: 76521 - protein, 1043 aa, Oryza sativa
MGRFGDGGERAWGGGDFLGAWGGLRLDDRAAGRGGVPVDLCGAAGLLEVRVPVPGVGRGPGGEPWAAQFVSPLPWALSAGGSAVPRAAAGDHRGAGPSPPVGCAGEAAFGRAPRLPCGARPSAARALGKSCCNAACTEGMCKELQQELEHLNLGLVEYGYVAALEARPTLTDQVRAAQVNDPEIAELKKKMRVGRARDFHEDEHGTIWLGERLCVPNDKELKDLILTEAHQTQYSIHPGSTKMYQDLKEKFWWVSMRREIAEFVALCDVCQRVKAEHQRPAGLLQPLQIPEWKWEEIGMDFITGLPRTSSGDYVYLRVTPLRGVHRFQTKGKLAPRFVGPYKILERIGEVAYQLELPSNMLGIHDVFHVSQLKKCLRVPEEQADSEHIDIQEDLTYGEKPVRILETSERRTRNKVTRLVRAVEDACGVVFPLQTKRDTVQRQQRGHGHAVAMWPACGHTAAARPGRGHGRPSRPCGGMAGGDHARPDGGGTARSTGGARPCGGDSQARSAGGARPCVGEVQMWSTAVLRGGVAAMHSAASAAAGGGSRRRRAAAMRAACDGAVRGRGQRRRATAPCGARRARGGAVRSTAGGGSRQCAWWPGMAAHGATPCGGVASGSRRSRRGCAVRCRGAAMYGADGQWPVMELRQSAFAGDSESADSAAAAPPAGRLTRPPPPPPPSSSQPLPVPAPRTTAERLGSLREMRRVWWVCGLGYWVQGFRCFPWLALNFHLTRGLGLTPAALQLVQNAGNLPLVAKPLFGVLSDAVYVGRAHRLPYISIGALLQLMAWGTLAVIPVTGDTFPTQMACILIGNLGASVTEVVSDAVVTEFSRTQKAGVLQSYAFIILAAGSLLGNLSGGYVLLRTQEPKTMFSAFSILLGLQLALSLSTKETLPSSHRNWNICHVRTSLSDNLRKQFSNLRTAISEEQIFYPLMWIMTSFAVVPILSGTMFCFQTQYLKLDPSVIGLSKVVGQVMVLSLTVLYNKYLKKIPLRRLVAGVQTMYALAVLSDLVLVKQVNLMLGIPNEIHVLCFSALAEAIAQFKQ

SEQ ID NO: 76522 - protein, 216 aa, Aspergillus oryzae
MDANMNNLLKWSIQNSTTQQSDAPNASNNTADSSARGLTPEMLSALFGGPSDADLMKAAMEALHSDEVDLENKLIAFDNFEQLIESIDNANNLEPLGLWTPLVELLQHEEAEMRRMAAWCIGTAVQNNEKAQDKLVVFNAVPKLVTMSTTDSNPATRKKAVFALSSAVRNYQPAMDELVKHLPEGYSQGEKVDAGDMDAVDAIMDRLRAHPVPSSA

SEQ ID NO: 76523 - protein, 208 aa, Lactobacillus johnsonii NCC 533
MDLLLVRHGVSEHNTSDVISGGTSNPNLSQAGVKQVEEVSKLIDNSKLDRVYASPLIRAKRTAQILTDFQKEIITDDRLREMNFGSWDGQHAEELKIKYPDAFDDLGTINSKYAEYAENGETFSQVADRVEEFLSEIQPDANDKTIMIVCHGFVIRSLIARWFKLKIEDVMTVRNVSFTELHFEKNDIERPRLMTFNRTEPLYYGIKR

SEQ ID NO: 76524 - protein, 212 aa, Arabidopsis thaliana
MPGPVIEEVNEEALMDAIKEQMKLQKENDVVVEDVKDGDEDDDDVDDDDDEIADGAGENEASKQSRSEKKSRKAMLKLGMKPVTDVSRVTIKRSKNVLFVISKPDVFKSPNSETYVIFGEAKIDDMSSQLQAQAAQRFKMPDVASMIPNTDGSEAATVAQEEEDDEDVDETGVEAKDIDLVMTQAGVSRPKAVKALKESNGDIVSAIMELTT

SEQ ID NO: 76525 - protein, 159 aa, Escherichia coli
  misc_feature (1)..(1): Xaa can be any naturally occurring amino acid
  misc_feature (105)..(105): Xaa can be any naturally occurring amino acid
  misc_feature (112)..(112): Xaa can be any naturally occurring amino acid
  misc_feature (124)..(124): Xaa can be any naturally occurring amino acid
XRIGHGFDVHAFGGEGPIIIGGVRIPYEKGLLAHSDGDVALHALTDALLGAAALGDIGKLFPDTDPAFKGADSRELLREAWRRIQAKGYTLGNVDVTIIAQAPKXLPHIPQXRVFIAEDLGCHXDDVNVKATTTEKLGFTGRGEGIACEAVALLIKATK

SEQ ID NO: 76526 - protein, 251 aa, Bacillus thuringiensis serovar konkukian str. 97-27
MRKPIIAGNWKMNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFDLVAGQVTKALAGLTEEQVKATVIAYEPIWAIGTGKSSSSADANEVCAHIRKVVAEAVSPEAAEAVRIQYGGSVKPENIKEYMAQSDIDGALVGGASLEPASFLGLLGAVK

SEQ ID NO: 76527 - protein, 293 aa, Pyrococcus abyssi GE5
MRFDVICMGNLNYDIVFLMEKFPGIHEKVNAKGVFTGLGGSAGNTATWLAKLGLKVGFIGAVGNDDFGRLHLEFFREIGVDTSGIKVVNDATGIAVTMVKGEDKRIVKYPGANRWKEVNTEYLKRARHLHLSSNPIELIREAVEKAKELGLTVSFDPGEMEVPRDVEKELDILMMNEDEFKAKYGSLDRIKDVKARIAIATLNGGGALVRDEKGEVHEVRGLSAKAIDTTGGGDAFNAGFLYGFLSGWDVVNSAKLGMLLAYLTVQEVGARSAVRPLDEIKKIAQELKLNLPI

SEQ ID NO: 76528 - protein, 334 aa, Zea mays
CACPQETSSAQYILQQYLAASGGHKLLASLRSTYAMGKVRMVATEFETAGRLTKNRSAGRGGEPGRFVLWQMAPEMWYIELAVRGSKVHAGCNGKLVWRHTPWLGAHSAKGPVRPLRRALQGLDPLTAASMFARARCIGERKVNGEDCFILKLSTDPEILKARSEGHAEIIRHVTFGYFSQRTGLLVHIEDSHLTRIQSGAGGDAVYWETTISSSMEDYRPVDGIVVAHSGRSAVTLFRFGEVAMSHTKTRMEEVWSIEEVAFNVPGLSMDCFIPPTDIKSGSVGEAMELAHGERSRAGPPPPPPGCRAKVAALGKAEEGKVAWGGGTVLENQN

SEQ ID NO: 76529 - protein, 394 aa, Bacillus thuringiensis serovar konkukian str. 97-27
MNKKSIRDVDLKGKRVFCRVDFNVPMKEGKITDETRIRAALPTIQYLVEQGAKVILASHLGRPKGQAVEELRLTPVAARLGELLGKDVKKADEAFGPVAQEMVAAMNEGDVLVLENVRFYAGEEKNDAELAKEFAALADIFVNDAFGAAHRAHASTAGIADYLPAVSGLLMEKELEVLGKALSNPERPFTAIIGGAKVKDKIGVIRHLLDKVDNLIIGGGLAYTFVKALGHEIGLSLCEDDKIELAKEFMQLAKEKGVNFYMPVDVVITEEFSETATTKIVGIDSIPSNWEGVDIGPKTREIYADVIKNSKLVVWNGPMGVFEMTPFSQGTKAVGQALADAEGTYSVIGGGDSAAAVEKFGMADKMSHISTGGGASLEFMEGKELPGVVCLNDK

SEQ ID NO: 76530 - protein, 180 aa, Glycine max
  misc_feature (12)..(12): Xaa can be any naturally occurring amino acid
  misc_feature (16)..(16): Xaa can be any naturally occurring amino acid
  misc_feature (18)..(18): Xaa can be any naturally occurring amino acid
MYAAGFYSYSIXALIXWXTRRSDFGVSMSHHVATVILIVLSYIFRFARVGSVVLALHDASDVFLEIGKMSKYSGAETMASFAFILFVLSWIILRLIYYPFWILWSTSYEVLLTLDKEKHRVDGPIYYYVFNSLLYCLLVMHIYWWVLIYRMLVKQIQARGKVSEDVRSDSEDEDAHEHED

SEQ ID NO: 76531 - protein, 290 aa, Triticum aestivum
MHPTRRELYLMVDLQAAGLVISSGRPGRWAREHIIGLRPMMYSRTRAGFTLNIIDTPGLIEGGYINEQAVEIIKRFLVEKTIDVLLYVDRLDTYRMDTLDEQVIRAITNSLGKAIWRRTLVVLTHAQLSPPDGIDYNDFLARRSESLLRYIRSGAGIGKREYADFPLPIALAENSGRCKTNENGAKILPDGTPWIPNLMKEITIVVSNGSKYIHVDQKLIDGPNPNNRWKKYIPLILAVQYFFVVKGIRRAIHSDISNGKLDDWEQRYRDLVGSGNPVDQKVSSSRNPKA

SEQ ID NO: 76532 - protein, 397 aa, Bacillus cereus E33L
MFHRIEEALEDLKQGKVVIVCDDENRENEGDFIALAEYITPETINFMITHGRGLVCVPITEGYAERLQLEPMVSHNTDSHHTAFTVSIDHVSTTTGISAHERATTIQQLLNPASKGADFNRPGHIFPLIAKEGGVLRRAGHTEAAVDLAQLCGAEPAGVICEIINEDGAMARVPDLLQCAKQFDIKMITIEDLIAYRRHHETLVTREVEITLPTDFGTFQAIGYSNSLDTKEHIALVKGDISTGEPVLVRVHSECLTGDVFGSCRCDCGPQLHAALAQIEREGKGVLLYMRQEGRGIGLLNKLRAYKLQEEGFDTVEANEKLGFPADLRDYGIGAQILKDLGLQHLRLLTNNPRKIAGLQGYDLTVTERVPLQMPAKEENKTYLQTKVNKLGHLLNL

SEQ ID NO: 76533 - protein, 216 aa, Gloeobacter violaceus PCC 7421
MKAVLFDAVGTLFGVRGSVGEIYSAIARTFGVKSDPEAIEKHFCVAFAARRSPNADARPWWRSVVAQTFTDTDFPDFEAYFERVWSHFATAEPWFVYPETVGVLAELRSRSLVLAVVSNFDERLYPVLEALGLRGYFQVVAISTEVGHAKPDPRLFTHALQRLGCSVDEAIHVGDSTEDVIGAKAAGIRVFKVDRSGAAGADTINSLARLLEMDYF

SEQ ID NO: 76534 - protein, 117 aa, Brassica napus
IVFHSVIIGISLGASPSVSTIKPLLVAITFHQLFEGFGLGGCISEAKFGVKKIWIMVLFFALTAPAGIGIGIGVSEIYNENSPMALKVSGFLNAAAAGILIYMALVDLVAPLFLRTR

SEQ ID NO: 76535 - protein, 506 aa, Burkholderia vietnamiensis G4
MIRTLRQVPDPALPRILPVILAGGSGTRLWPLSREQFPKQLIELTSNESPLSATARRLNGIANASLDDTLLLVCSEQHRTLSAAQVTDRAAPARILLEPAPRNTAPALTLAALDASAFADDPVLAVMPADHVIVDVGAFQDAIARAARYAEEGAIVTLGVLPRRAETGYGYIQVGAPRNGCHGSQGGYSIGRFVEKPDEALAERYLQSGDYWWNSGIFVTRASVWLKAIRALAPAIHASCEAAWRAGIAEDPFFRIDAAAFDACPSDSIDYAVMERLPEHGELGIEGIVVPLAAGWSDVGTWDAIWEIMPKDDHGNVARGPIVFEDTQDSFVRSEGRLVACVGMRDVVVIETPDAVLVANKHDVQRVKNIVARLKNDRRPQAIEHRKVQRPWGHYDSIDLGERFQVKRIVVEPGKRLSLQMHYHRAEHWIVVRGTARVTRGSETFLLSENESTYIAVGEVHRLENPGRIPLEIIEVQSGDYLGEDDIVRFDDQYGRPVDALPAEQA

SEQ ID NO: 76536 - protein, 293 aa, Zea mays
  misc_feature (52)..(52): Xaa can be any naturally occurring amino acid
MGKDDVVQSGAGGGEFAAKDYTDPPPAPLVDAAELGSWSLYRAVIAEFIATXLLFLYVTVATVIGYKHQTDASASGAGADAACGGVGVLGIAWAFGGMIFVLVYCTAGISGGHINPAVTFGLFLARKVSLVRALLYMVAQCLGAVCGVGLVKAFQSAYFDRYGGGANSLASGYSRGAGLGAEIVGTFVLVYTVFSATDPKRNARDSHVPVLAPLPIGFAVFMVHLATIPVTGTGINPARSLGAAVVYNKDKPWDDHWIFWVGPLLGAAIAAFYHQYILRAGAIKALGSFRSNA

SEQ ID NO: 76537 - protein, 152 aa, Triticum aestivum
  misc_feature (65)..(65): Xaa can be any naturally occurring amino acid
  misc_feature (80)..(80): Xaa can be any naturally occurring amino acid
  misc_feature (110)..(110): Xaa can be any naturally occurring amino acid
  misc_feature (114)..(114): Xaa can be any naturally occurring amino acid
  misc_feature (126)..(126): Xaa can be any naturally occurring amino acid
MSAYCGKYADELIKNAAYIGTPGKGILAADESTGTIGKRLSSINVENVEENRRALRELLFCCPGXALQYISGVILFEETXYQKTKDGKPFVDVLKEGSVLPGIKVDKGTXEVVXTDKETQPRHDDXGKRCAKYTRPCPFAIGCVPRWPNNLQ

SEQ ID NO: 76538 - protein, 175 aa, Zea mays
  misc_feature (109)..(109): Xaa can be any naturally occurring amino acid
MATADHEATDDSSGGPLLVWDCGSMLYDSYELTAFKRQLDAAVLSSSRSLSMPHLTASVATTSLPTTDVQQQQGRRRRRRRLPALLRRLFSRVLPAAAIPSHRGAGRAXWTGDDRTGSPWSGALTSIPEEQSSSSPEMAESPVVEPAQSKLRKTQSERFIGSKAAAPMVQFDVVL

SEQ ID NO: 76539 - protein, 289 aa, Glycyrrhiza uralensis
MEGKEQDVSLGANKFPERQPIGTAAQTQDDGKDYKEPPPAPLFEPNELTSWSFYRAGIAEFVATFLFLYITILTVMGVNRSESKCKSVGIQGIAWAFGGMIFALVYCTAGISGGHINPAVTFGLFLARKLSLTRAVFYMVMQCLGAICGAGVVKGFEGKTLYGKYNGGANFVNSGYTKGDGLGAEIVGTFVLVYTVFSATDAKRSARDSHVPILAPLPIGFAVFLVRLATIPITGTGINPARSLGAAIIFNKDRGWNDHWIFWVGPFIGAGLAALYHVVVIRAIPFKSK

SEQ ID NO: 76540 - protein, 437 aa, Thermosynechococcus elongatus BP-1
MSIATMTDSPIWQPFTQMKTADPPLKVVRAQGACLELSDGRQIIDAISSWWVTLHGHSHPVLAKALYGQAQTLEHVIFAGFTHEPAEQLAQLLCAHTPGGLQRVFFSDNGSTAVEVALKMAYQYWQRRDQPQRSRFIGFAGGYHGDTLGAMTVGQSSPWWQPFQPLLPPLTILPYPATYPEDPEVDTKEAQAIAQLETTLKTDPDAYAALFIEPLVQGAGGMRMCRPQFLRAVSEVAKAYGVLVVYDEVMTGFGRTGALFACEKAGTQPDLLCLSKGLSGGCLPIAVTLTTEEIYQAFYADDPARAFFHSHSYTGNPLACAVSVASFQLLLAHPEAYQGLEARHWQCQQRYLADVSHLKQFRTCGTIAAMELETEASYFSDLVPQLRRRFIELGVLLRPLGNTLYILPPYCISDAELATVYRAIRQVAIEVAEGYFA

SEQ ID NO: 76541 - protein, 748 aa, Klebsiella pneumoniae subsp. pneumoniae MGH 78578
MLTRLREIVEKVASAPRLNEALDILVTDVCQAMETEVCSVYLADNDRRCYYLMATRGLKKPRGRTVALAFDEGLVGLVGRLAEPINLADAQKHPSFKYIPAVKEDRFRAFLGVPIIQRRQLLGVLVVQQRELRQFDESEESFLVTLATQMAAILSQSQLNALFGQYRQTRIRALPASSGVAIAEGWMDVSLPLMEQVYEASTLDTASERERLTGALEEAANEFRRYSKRYAAGAQKETAAIFDLYSHLLSDARLRRELFAEVDKGAVAEWAVKKIIEKFAEQFAALSDGYLKERAGDLRTLGQRLLFHLDDSIQGPNTWPARIILVADELSATTLAEVPQDRLAGVVVRDGAANSHAAIMVRALGIPTVMGADIQPSLLHGHTLIVDGYRGELLVDPEPVLLQEYQRLISEENELSRLAEDDLQRASELKSGERVKVMLNAGLSPEHEEKLGSFVDGIGLYRTEIPFMLQSGFPSEEEQVAQYQGMLQMFNSKPVTLRTLDIGADKQLPYMPISEENPCLGWRGIRITLDQPEIFLIQVRAMLRANAATGNLSILLPMVTSLEEVDEARRLIDRASREVEEMIGYAIPRPRLGVMLEVPSMVFMLPQLASRIDFISVGTNDLTQYLLAVDRNNTRVASMYDSLHPAVLRALAMIAHDAERFGIDLRLCGEMAGDPMCVTILIGLGYRHLSMNGRSVARVKYLLRRIDIEEAQELSRRSLDAQMTAEVRHQVAAFMERRGLGGLIRGGR

SEQ ID NO: 76542 - protein, 550 aa, Zea mays
MAATVRRAASSVLSRFLLTKPSPSPASAAGNKSALLGAGAAALHRFSTAPASAAAAAEEPIQPAVEVKHTQLLINGNFVDAASGKTFPTLDPRTGEVIARVAEGDSEDIDRAVAAARRAFDEGPWPRMTAYERCRVLLRFADLIERHAEEVAALETWDNGKTLAQAAGAEVPMVARCVRYYAGWADKIHGLVAPADGAHHVQVLHEPVGVAGQIIPWNFPLLMFAWKVGPALACGNTVVLKTAEQTPLSALYVANLLHEAGLPEGVLNVVSGFGPTAGAALCSHMGVDKLAFTGSTGTGQIVLELAARSNLKPVTLELGGKSPFIVMDDADVDQAVELAHQAVFFNQGQCCCAGSRTFVHERVYDEFVEKSKARALKRVVGDPFRDGVEQGPQIDGEQFNKILRYVQSGVDSGATLVAGGDRVGDRGFYIQPTVFADAKDEMKIAREEIFGPVQTILKFSGVEEVIRRANATPYGLAAGVFTRSLDAANTLSRALRAGTVWVNCYDVFDATIPFGGYKMSGVGREKGIYALRNYLQTKAVVTPIKNPAWL

SEQ ID NO: 76543 - protein, 188 aa, Vitis vinifera
MHYFWKKKLALIWCEAACHHKEVFESRFKHILRRFIWKIMFSFPYKALPYRTWVPTTGGGSSAGPSSATIEPSDGPMNPGVGMKDVTCVTKMVSENAVIVFGRRGCCMCHVVMRLLLGLGVNPTVFEVDEEDEAAVVDELSRDAKEGRPQFPAVFMGGQLFGGLERVMATHISGELVPILKKAGALWL

SEQ ID NO: 76544 - protein, 490 aa, Convolvulus arvensis
  misc_feature (1)..(5): Xaa can be any naturally occurring amino acid
  misc_feature (10)..(10): Xaa can be any naturally occurring amino acid
XXXXXTTSGXEVSAVEKKNLGRIVKIIGPVLDVAFPPGKMPNIYNALVVQGRDNEQTNVTCEVQQLLGNNRVRAVAMSDTDGLMRGMAVINTGAPISVPVGGSTLGRIFNVLGQPVDNLGPVDTNTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDVLPEQAFYLVGNIDEATAKAMNLKT

SEQ ID NO: 76545 - protein, 392 aa, Arabidopsis thaliana
MSSPEKKRKTTKKPSPTPQSTTPNPSLPDDLVVSCLARVSRLYYPTLSLVSKSFRSLIASPDLYKTRSLLGRTESCLYVCLQEKDSDPNPRWFTLCLKPNRTLTNDITEKKKKKKKKKKMSSGYVLAAIPVLHSRPAYWSGLVAVGSNIYNIGGPIDKAHSSIVSVLDCQSHTWHEGPGMRVERRYPAANVVEGKIYVTGGCKDCSNSSNWMEVFDPRTQTWESVSSPGAEIGGCSIHKSAVVEGEILIANSHGLIYKPKEGRWERMKWDMDIGWVWYSYCVVENVLYYYYKGVFKWYDTMARLWRDLKGVKGLPRFARCGGKMADYGGKMAVFWDKIVTSDDGCKNKMILCAVIALERRNSEEIWGKVEWHDAVLTVPLSYEVVYALSPTV

SEQ ID NO: 76546 - protein, 148 aa, Brassica napus
RHEEKNSVATKGSGSSSFESNMGARINFSEPKPAATETALLMILEKFFAVILNLPKVNRRLADVLETLSSSQPRCPQLYIYSSADRVIPAGQVESFIVEQRKAGHEVRACNFISSPHVDHFRSNPELYTAELNHFMDNFVLACCNHSS

SEQ ID NO: 76547 - protein, 332 aa, Sulfolobus solfataricus P2
MSSDDLSLYFNEIVNNVNFRIKNFVKSNFKTLEEASFHLFTAGGKRLRPLVLVSSSDLIGGDRERAYKAAAAVEILHNFTLVHDDIMDNDGLRRGLPTVHVKWGEPMAILAGDYLHAKAFEALNEALKGLDGNTFYKAFSIFITSIEIISEGQAMDMSFENRLDVTEEEYIQMIKGKTAMLFSCSAALGGIINKANDDVVKKLTEYGLNLGISFQIVDDILGIIGDEKELGKPIYSDIREGKKTILVIKTLSEATEDEKKILVSTLGNKEAKKEDLERASEIIRKHSLQYAYDLAKKYSDLAIENLREIPVSNKTAEKALKYLAQFTIQRRK

SEQ ID NO: 76548 - protein, 249 aa, Glycine max
KIVSIADLIRYRRKRDKLVDRRTRGLIERAGAALIPTMWGPFTAYCYRSLLDGIEHIAMVKGDIGDGQDVLVRVHSECLTGDIFGSARCDCGNQLALAMQQIEAAGRGVLVYLRGHEGRGIGLGHKLRAYNLQDDGRDTVEANEELGLPVDSREYGIGAQMLRDLGVRSMKLMTNNPAKYIGLKGYGLTVSGRIPLLTLITSENKRYLETKRVKMGHIYAMEFNGQLSTHDSGNDNATRVDDSNTVTGL

SEQ ID NO: 76549 - protein, 278 aa, marine gamma proteobacterium HTCC2080
MSKRLEGKVAVITGAASGIGAATAQRFKDEGCLLVLADIQSELGLDFAKQLGDHVYFEACDVSIETDVERVVNRAILEFGKLDIMFNNAGIVGAKGPIDLTPADEWRATTDILINGVFYGVKHAAAIMKKQRSGSIINMSSVAGVMGGLAPHAYTTAKHAVVGLTTSASAELCTHNIRVNAIAPFSMATPMVADAHLKNHLATDEVEKTLAANSPLPGRAGTALDVANAALWLGSDESGYTSGLTLTTDAGVTTGSMVRRPNYEDYVPMQREAGSQGL

SEQ ID NO: 76550 - protein, 312 aa, Bacillus cereus E33L
MCINLLCKLYICFDFLVKSCSNKVVAYKKCNNERETTVHIPTTTLHNGVKMPMIGLGVYKAKEGDEVKQAVKTALEVGYRSIDTATVYENESGVGEAVRESGIPREDIFITTKVWNDDQGYEETLEAFEKSLKKLQMDYVDLYLIHWPIRGKYVDTYRALEKLYEEGKVRAIGVSNFHKHHLELLLPNCKIKPMVNQVELHPMLTQFELRNFCQGEQIQMEAWSPLMRGGEVFQHPIIQAIATKYEKTPAQVILRWDIQSGIVTIPKSVTPSRIQENFSIFDFSLTEEEMTQINTLNRNLHVGTNPDKYDTL

SEQ ID NO: 76551 - protein, 390 aa, Pasteurella multocida
MKKITIAGAGYVGLSNAVLLAQHHNVTLLDIDQNKVDLINNKISPISDEEIENFLQNKSLSIVATTNKEAALKDADFVIIATPTDYNTETGYFNTSTVESVIEQTLLINSLTTIIIKSTVPVGFTEKMREKFHTKNIIFSPEFLREGKALHDNLFPSRIIVGSTSYQAKVFADMLIQCARKKDVTVLFTHNTEAEAVKLFANTYLAMRVAFFNELDTYASLHHLNTKDIINGISTDPRIGTHYNNPSFGYGGYCLPKDTKQLLANYAYVPQNLIEAIVKSNETRKRFIAHDVLNKKPKTVGIYRLIMKSGSDNFRASAILDIMPYLKENGVEIVIYEPTLNQQAFEDYPVINQLSEFINRSDVILANRSEPDLNQCSHKIYTRDIFNVDA

SEQ ID NO: 76552 - protein, 394 aa, Aquifex aeolicus VF5
MRKGLASRVSHLKPSPTLTITAKAKELRAKGVDVIGFGAGEPDFDTPDFIKEACIRALREGKTKYAPSAGIPELREAIAEKLLKENKVEYKPSEIVVSAGAKMVLFLIFMAILDEGDEVLLPSPYWVTYPEQIRFFGGVPVEVPLKKEKGFQLSLEDVKEKVTERTKAIVINSPNNPTGAVYEEEELKKIAEFCVERGIFIISDECYEYFVYGDAKFVSPASFSDEVKNITFTVNAFSKSYSMTGWRIGYVACPEEYAKVIASLNSQSVSNVTTFAQYGALEALKNPKSKDFVNEMRNAFERRRDTAVEELSKIPGMDVVKPEGAFYIFPDFSAYAEKLGGDVKLSEFLLEKAKVAVVPGSAFGAPGFLRLSYALSEERLVEGIRRIKKALEEI

SEQ ID NO: 76553 - protein, 547 aa, Listeria monocytogenes EGD-e
MTLKSGFDYMNNPLLNKGTAFSKEERASYQLDGLLPPIIETIEQQAVRIETQIENLETPLHKHRLLTNLYNENRTLYYYVVTKNVTDYLPIIYTPTIGDAVIQYHKDYTAPDEALFVDAFAPEKLSASIKNYAKNNPNIDMIVITDGEGVLGIGDWSVNGVKIAVGKLAVYTVAAGLAPDRVLPVVIDAGTNNETLLNDPLYLGNKRPRLSESEYDAFIASFVNVMKEVFPKAILHWEDFGRANASRILHNYRDKICTFNDDIQGTGAMVVAAVLATIQVSRIPLSEQKIIIFGAGTAGIGIADQLSAQLMRETGLPFEKAKKHFYLVDRKGLVLDNMTDLTTGQKKYAHPSAEWSNVPTDTLENLVEAVHPTMLIGCSGVTGAFKESIVKKMTQYTERPAILPLSNPTKLAEATASDLIQWTDGKALIVTGSPSKPVEYQNTTYEIGQANNALLYPGLGLGALVTRAKYITDDMLAAASMAVAEQISPNKAGAALLPHVRTLRETSRAVAIAVANQAIKENIHQVELTNVIEAIELEMWQPIYKGV

SEQ ID NO: 76554 - protein, 362 aa, Sesamum indicum
MDLINSLLNFVVPPASLLMLAFTWPTLFFITTCEWLYNTYLNSENMENKVVLITGASSGIGEQIAYQYAKRGANLVLVARREHRLRGISENARRLGAPNVLIMAADVVKEEECRRFINETINYYGRVDHLVNTVSLGHTFYFEEASDSSVFPILMDINFWGNVYPTYVALPYLRESNGRIIVNASVENWLPLPRMSLYSAAKSALINFYETLRFEVKNEVGITVATHGWIGTEMTRGKFMVEEGAEMQWKEEREVHVTGGPVEEFAKQIVSGACRGDPYVKYPSWYDIFFLYRVFAPKVLDWTFRFLLTNGGARRTSFIGTGRPLLETSSPRRSAVMEGSSPRRLPPGPLTFSPAFQQQKSE

SEQ ID NO: 76555 - protein, 235 aa, Triticum aestivum
  misc_feature (212)..(212): Xaa can be any naturally occurring amino acid
MASLRSLTASLRWVAPARGVAAVRYSSSSTSAIAYKALRRRSAPLPVRDNPPAWSAQSAVSNILYETPVPSTVPPKRHILNCLVQNEPGVLSRVSGILAARGFNIDSLVVCNTEVEDLSRMTIVLTGQDGVVEQARRQLEDLVPVWAVLDYTAAALVQRELLLAKINILGPEYFEELLNHHCEIAAGEYDVHNAHEAIERSISDTAKDFHPXQLAVSQALRHKHEHLKFITYFAH

SEQ ID NO: 76556 - protein, 474 aa, Rhodococcus sp. RHA1
MSEVLDRTKIYIDGSWIDSQGTGRIDVVNPATEDVIAVVAEGTADDVDRAAKAARAAFPAWSALSGKERGEYLRKAAALIQERLDDFTALVSRDMGMPLGFAKPVQIGMPLANLAAFAELAATYDFDAHEVGNSLIVREPIGVVGAITPWNFPLHQVVLKVGGALAAGCTVVLKPTEVAPLATYALADIFDEIGLPAGVFNLVSGFGPVVGEAIAGHPEVDMVSFTGSTRAGKRVAVVAAETVKKVALELGGKSANVILDDADLTKAVTDGVAKCFLNSGQTCSALTRMLVPAGKVDEAAAIAAKVAQNYSVGDPTAATSVLGPLVNSNQLKRVRGYIEQGISEGAHAVLDGRETGQESGYFVGPTVFSGVTEDMTIAKEEIFGPVLSIIGYQDEDDAVRIANATEYGLAAGVWSGDQDRADRVARQLRAGQVEVNGGAFNTNAPFGGYKQSGIGREAGVLGFEEFLEIKSIQR

SEQ ID NO: 76557 - protein, 517 aa, Saccharum hybrid cultivar
MARGDGELELSVGVRGAGAAAADHVAPISLGRLILAGMVAGGVQYGWALQLSLLTPYVQTLGLSHALTSFMWLCGPIAGLVVQPLVGLYSDRCTARWGRRRPFILTGCILISLAVIVVGFSSDIGAALGDTKEHCSLYHGPRWHAAIVYVLGFWLLDFSNNTVQGPARAMMADLCGHHGPSAANSIFCSWMALGNILGYSSGSTNNWHKWFPFLKTNACCEACANLKGAFLVAVVFLVICLAVTLIFAKEVPYRGNENLPTKANGEVEAEPTGPLAVLKGFKNLPPGMPSVLLVTGLTWLSWFPFILYDTDWMGREIYHGDPKGSNAQISAFNEGVRVGAFGLLLNSIILGFSSFLIEPMCRKLGPRVVWVTSNFMVCVAMAATALISYWSLKDYHGYVQDAITASTNIKAVCLVLFAFLGVPLAILYSVPFAVTAQLAATKGGGQGLCTGVLNISIVIPQVIIALGAGPWDALFGKGNIPAFGVASGFALIGGVVGVFLLPKISKRQFRAVSAGGH

SEQ ID NO: 76558 - protein, 242 aa, Vibrio fischeri ES114
MFTSKEGQSVPQVTFPTRQGDAWVNVTTEELFKDKTVIVFSLPGAFTPTCSSSHLPRYNELHSVFKENGVDDILCVSVNDTFVMNAWKADQEAENITFIPDGNGEFTDGMGMLVEKNDLGFGKRSWRYSMLVKNGVVEKMFIEEDVPGDPFKVSDADTMLNYLAPEHKEQESITVFTKPGCPFCMKAKQNLIDKGLNYEEVVLGKDATTVSLRAITGRTTVPQVFIGGKHIGGSEELEAFLA

SEQ ID NO: 76559 - protein, 284 aa, Wolbachia endosymbiont of Drosophila ananassae
LEHRKGTRKIKNLPSVLGVEAVGVIEKLGKKISDGLKVGDRVGYCTAPPGAYCEKRIIHQKYLIKIPDDISDEVAAAVLFKGMTAHYLVNQSYKVRPGAFVLVHGANGGLGQIICQWAKDKKGVVIGSVSSDEKMKIALQSGCTYAINYNDKDFVSKIMEITQNRGVGAVYDPIGYATSKLSFESLGRFGIYVSYGQISGNAPISFSLLSSRSLFATGTLIYHYKHDRFTLVLTTMEIFEMIRKKLLTVRINKKYKFDEIIQAHRDMENRKTSGLNIIKISQIN

SEQ ID NO: 76560 - protein, 512 aa, Salmonella enterica subsp. enterica serovar Paratyphi A str.
MTNNPPSTRIQPGEYGYPLKLKARYDNFIGGDWVAPADGEYYQNLTPVTGQPLCEVASSGKKDIDLALDAAHKAKDKWAHTSVQDRAAILFKIADRMEQNLELLATAETWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEVIGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSGTQMGAQVSHGQLETILNYIDIGKKEGADILTGGRRKELDGELKEGYYLEPTILFGKNNMRVFQEEIFGPVLAVTTFKTMEEALEIANDTQYGLGAGVWSRNGSLAYKMGRGIQAGRVWTNCYHAYPAHAAFGGYKQSGIGRETHKMMLEHYQQTKCLLVSYSDKPLGLF

SEQ ID NO: 76561 - protein, 325 aa, Pseudoalteromonas tunicata D2
MTRLISFGEILIDMLPADSRCTQFLAIAGGAPANVAVGFAKLGGQAFFAGGLATDGFAPILQNALHDYGVDTRYLVAVANSQTAMAVVTLDDLGERSFSFYRHNTADIQVNLAHFSAIHWQDDGIFHFCSNTLTDDTIAKVTYQLIQQAQKNQQLISFDVNLRPALWQKPTEIGSYVEQCFQWVDVIKLSQDELTHLAKLKGVNESDYLAGILHQGVKVIVLSNGPLPAKIVTQTETISLAAPTINAIDTTAAGDSLIAGFLFELSTFAKQQQLTLNQSLRNIACLQQALQFGLHCGALTCAQKGAFPALPELSAVLAFVESAKN

SEQ ID NO: 76562 - protein, 196 aa, Triticum aestivum
HDRTSLYKKAGWYRSGIPGISSTHASVYKGFEGLGTIVDVGGGVGATVGAITAAYPAIKGINFDLPHVISEAQPFPGVTHVGGDMFQKVPSGDAILMKWILHDWSDEHCATLLKNCYDALPAHGKVVLVECILPVNPEATPKAQGVFHVDMIMLAHNPGGRERYEREFEALAKGAGFKAIKTTYIYANAFAIEFTK

SEQ ID NO: 76563 - protein, 393 aa, Zea mays
MEHLRWRPTVNERDFIECALQSDLRVDGRHSFDFRKLKITFGREDGSSEVQLGETHVMGYVTVQLVQPYRDRPNEGTLAIFTEFSPMADPSFEPGRPGELAIELGRVIDRGLRESRAVDMESLCVVAGKHVWSVRVDLHILDNGGNLIDAANIAALAALSTFRRPECTVGGDDGQQVTVHDPEVRDPLPLTIHHMPIAVTFAYFGEGNIVVLDPTYKEEAVMGGRMTAIVNSNGDVCAIQKAGGEGVMSSVIMQCLRIASVKAADITSKIKKAVDSYTTEKALKKVKRLPTSVPQKINVTNVTMDGKGDGELEKQSMQMHSDVQQISKDPPTMVKASSREDAQPMTESSNAEVNTSSAVAAGESESHEIGSPKSLKDAIKPKHKRKKKKSDRS

SEQ ID NO: 76564 - protein, 123 aa, Pseudoalteromonas tunicata D2
MKILVVDDMPLMRHVLTNMLRKLHYDDIVEATNGEQAFLFMQQQHFDLVITDLHMPKLDGKSLLCRIRDDKLLSTTPVLMVTCEDSAQTVREIIAAKVSGFMIKPFSLNVLADQLKKIAKVAI

SEQ ID NO: 76565 - protein, 375 aa, Arabidopsis thaliana
MNEEEAPSEQKKTLSLVPSPTTNLFLPDDILLSSLSRISRLYYPTFSLVSKSFRSLIASPELYQTRSILGRTESCLYVSLRLLNDSNLRWYTLCRVPDRKLTNFSGGHLLVPILSRYAPPAHWSSVVAVDYNIYAIGGPINDAPSSSVSVLDCQCEKWREAPSMRVARNYPTATVLDGKIYVAGGCEDCTSLDCIEVFDPKTQTWDSVASPGTERCERLVYKSVGIEGKYHLFGGAGHVAYDPKEGRWDSVGMDMEMGRTWVSYCVINNILFYYNDREFKWYDYKGRFWRKLMGLERLIKFLCYSRVNLAAYGEKMAVLWDTFVPSSSKNKMIWCAEITIERHDIYEICGKTEWFDVVLRVPKSYELVHVLAATV

SEQ ID NO: 76566 - protein, 346 aa, Pyrococcus abyssi GE5
MYRVAVIKGDGIGPEVVDSAIRVVNSVTDRIRFYEFEGGFEVFKRIGSPISEDDLKEIRKMDAILFGATTTPFNVPGYRSLIVTLRKELDLYANLRIIPDLSNGKEIVIVRENTEGLYARDGIGFSDRAIDFRIITLEGARRIAKFAINLAKERNSFITFVHKANVLKGDRFFREIVLEIAEREGVEVREAIIDSFMIKLVKNPWDHGVILTENMFGDIISDLATIHAGSIGIVPSGNYGDEIALFEPIHGSAPDIAGKGIANPIGAILSAAMMLDYLGLNGKVVWEATRRYVRYGNLTPDMGGTATTSEVTKGIISEIYSFDPFDIDEIWVEEIRLGRIPLTLWR

SEQ ID NO: 76567 - protein, 66 aa, Sulfolobus solfataricus P2
MLIPIRCFTCGSLIADKWQSFITRVNAGENPGKVLDDLGVKRYCCRRMLLSHVDIINEVIHYTRPI

SEQ ID NO: 76568 - protein, 248 aa, Pyrococcus abyssi GE5
MIQMRVIKVGGSVVPMLDKILDTSSLHGNSIIVHGGSRYVDEMARKLGVKVERLVSPSGVMFRRTTRRVLDVYVAALMRANRELVSFLRERGIDAIGVSGLDGVVLAKRKKLVKAVVNGKVIAIRDDYSGVIKSINVTLLKNYLKVGIPVIASIAYDPEENVPLNVDGDKVAYHVAIAMKAKELRFLSDTAFLIDGNVVERIPLEDFDEYLRYAGGGMKKKLMMARKALESGVKKVVIEGLNGRTVIS

SEQ ID NO: 76569 - protein, 468 aa, Myxococcus xanthus DK 1622
MTQGSSRLAAVPPSFDAKALVEKQRARFETRATLPLAWRREQLQVLERAARKYEAEILAALQSDLSKSPEEAYLTEVGSIYGELKDALKNVKAWMAPRKGAAPLAIQPARVWQYSDPLGVTLIISPWNYPYQLAIAPLIGALAAGCTAVLKPSELSPATSAVLARMLKEAFPEDVVAVVEGGAEESRALLDERWDLIFFTGGPQVGRVVAEAAAKHLTPTVLELGGKSPCIIDKSADLEVTARRIAWGKYLNAGQTCIAPDYVLIPPELKGRFTELVQKAVTDFYGANTRESRDYGRIISSRHFERVSKLAQDGTVAFGGERDADSRFFAPTVIIDAPLSSPLMQEEIFGPLLPVVDCPSIDEAIRFVRARPKPLALYTFSKDAAVNERVLTETSSGGAVANDVCVHFAAKGLSFGGVGESGTGGYHGQASFDAFSHRKGVVKRPFLLDLKLRYPPYTGKLGLFKRFL

SEQ ID NO: 76570 - protein, 266 aa, Ehrlichia ruminantium str. Welgevonden
MSNFNSDITIYSKEDFQYMRNAGRLAAKVLDFIIPYVQPGVSTNKLNDLCHDFIIDSGAIPAPLGYRGYPKSICTSKNFVVCHGIPDDLPLKDGDILNIDVTVILDGWYGDTSRMYWVGEPSIKAKRLCEATYNALNVAIAQVFPGQKLNQIGLAIEREIKKYGYSIVRDYCGHGLGRVFHDKPSVVHYYDENDPVVIREGMFFTIEPMINLGKHHTVLSKEDGWTVRTRDFSLSAQFEHSLGVTENGVEIFTLSPKNLHYPPYVC

SEQ ID NO: 76571 - protein, 440 aa, Coccidioides immitis RS
MALAASDPPGLYKGRSPRSFSETNVAPHSKRRRARSVFRCWGNFCLKHTWVIPLVLLTVILSAYAVNPNDSNPIHQLIFLSYPLPPETPDGPVMYGKGPADMAFVVFYTIVLSFTREFLMQRMIKPLARRCGIKGKAKTSRFMEQFYTAVYFAIFGPYGLYVMSRTKIWYFNTTAMFEGFPHKTHTADFKAYYLLEASYWAQQAIVLVLQLEKPRKDFKELVGHHIVTLALIALSYRFHFTYIGLAVYITHDVSDFFLATSKTLNYLDSAIMGPYFAMFIAIWIYMRHYLNLRIIWAVLTEFRTVGPFELNWETQQYKCWISQYITFALLSALQAINLFWLFLILRIAKRYLLNNIRQDERSDNEEEEEEVEDTPHSDKTNNGSTTVPTILLNGNSPTSVRRRNADKENEVSNGVTNGRATGSTAHSHAESSTPTMNGKK

SEQ ID NO: 76572 - protein, 538 aa, Pseudomonas aeruginosa UCBPP-PA14
MIAGNDGVGGIVFDNYPVAYLVGNLALAVILLDGGLRTRVSSFRVALWPALSLATLGVLVTTGLTGIAAAWLFDLHWMEGLLIGAIVGSTDAAAVFSLLGGKGLNERVTATLEIESGSNDPMAVFLTVTLIEMLASGQTGLSWGFVLHLVQQFGLGALLGLGGGWLLLQLINRMHLAGGLYPLLVISGGLLVFALANAVGGSGILAIYLCGLLLGNRPIRSRHGILHMLDGMAWLAQIGMFLVLGLLVTPHDLWPIALPALALALWMILVARPLSVLIGLIPFRAFHDREKAFIAWVGLRGAVPIILAVFPLMAGLPNAQLFFNVAFFIVLVSLLVQGTSLPWAARLLRVVVPPDPAPISRAGLEIHPTSEWELFVYHLNKEKWCIGAALRELKMPGGTRIAALFRGTELLHPSGSTILEADDILCVIGHEHDLPALGKLFSQAPDRGLGARFFGDFVLEGDAQLSAVASLYGLKLDGIDGEQALGRFIAHEIGGEAVIGDQVEWNGLTWTVAALEGNRIRKVGVKFPEGRPGPGLFL

SEQ ID NO: 76573 - protein, 424 aa, Pasteurella multocida
MTQFNTISVIGLGYIGLPTAAVFAQHHVKVIGIDINEHTVNTINQGKIHIVEPDLEQVVQQCVNKGDLKASLIPEPADAFLIAVPTPFKGNNYEPDLSYIKSACKMISPVLKKGDLIVLESTSPVGATEKMAIWLSELRPDLTFPQQLGELSDIRIAHCPERVLPGHVMRELIENDRIIGGMTPKCSQMAVDLYKIFVKGDCIVTDSRTAEMCKLTENAFRDVNIAFANELSIICDKLGINVWELINLANRHPRVNILQPGCGVGGHCIAVDPWFIVNKTPELAKLIHTARLVNGSKPEWVINQVNNAVIGALQKNPNKPLQDIKIACLGLAFKPDIDDLRESPALKITEKLAEKYPNQILTVEPNIEVLPNKLNGQNINLIDLNQSLKIADILVILVDHKEFKTIKIENKNIRVIDTKGIFKR

SEQ ID NO: 76574 - protein, 417 aa, Gloeobacter violaceus PCC 7421
MTFTAQAHRTLTPAAVERLRADFPILRQTVYGKPLVYLDNAATTQKPQAVLDAIAALYTGYYSNIHRGVHHLSQLSTEAHEQARIKVQQFINAQSDREIVFVRGCTEGINLVAQTFGRERVGPGDEIVISAMEHHSNIVPWQMLCQEKGAILKVAPIDDRGEIILEAFEQLLGERTKLVAVVHLSNALGTINPVARLIELAHTRGIPVLVDGAQAVSHIAVDVQALDCDFYVFSGHKLYAPTGIGVLYGKAELLEAMSPWQGGGDMIRSVSFEKTIYSDLPYKFEAGTPDIAGAIALGVAVDYVQHIGLEAIAGYEQELLDYATEALSAIDGVKLIGTARDKASVLSFVLAGVHPHDIGTILDRKGIAVRAGHHCAQPVMQRFKVPATARASFAFYNTRAEVDALVAAIQQVQEMFS

SEQ ID NO: 76575 - protein, 402 aa, Ehrlichia ruminantium str. Welgevonden
MSEVQVRAENLGGESILEAPIRVSVKIGDSIKQGDVLFIIETDKTSLEIVSPVDGTVSKVFIADEEIIERDQLLCTINVGELSHIVQSQTQDPKTDNGNIINDDIQTFIQKKDAPSAVKIMAENSIDKNQINGSGIGGRITKSDVLDHINVVSKDHSVLSEQCSITSHEKREERVKMSKIRQVIAARLKESQNTAAILTTFNEVDMKNVMDLRVQYRETFEKKYGVKLGFMSFFIKAVVLALKELPVINAEISGNEIIYKHYYDIGIAVGTDKGLVVPVMRDADKMSCAELELTLASLGKKAREGKLEVSDMAGATFTITNGGVYGSLLSTPIINPPQSGILGMHSIQKRPVVVNDNSIEIRPMMYIALSYDHRIVDGQGAVTFLVRVKQYIEDPSRMFLEI

SEQ ID NO: 76576 - protein, 172 aa, Ehrlichia ruminantium str. Welgevonden
MNIFNYMQIMPNISVDAFVAPTAVIIGDVCVSDKCSIWYNSVLRGDVGQIVIGVGTNIQDGTIIHVDRKYGNTNIGKKVTIGHGCILHACEIQDYVLVGMGSIIMDNVVVEKNAMVAAGSLIVRGKVVKTGELWAGRPAQFLRMLSSDEIEEISKSADNYIELASDYITGKL

SEQ ID NO: 76577 - protein, 247 aa, Triticum turgidum
MACRFLLVALLLVVAPLAPADARDIPATATAKTAKTTATTTTTKSVAAVVAAPATATAKTTTTTAMTTTSAKSVGVAAAAPAGLGDQKTFLGSGLGGGYGGGVGGFAGAGGVGGLGGAMGGIGGVLGGVGGGVGGIGGVGGLAGVGGVGGLGGAGGGVGGLGGAGGLGGLGGGGAGGLGGLGGGSGGLGGLGGGSGGLGGLGGGGGGLGGVGGGGGGLGGLGGGGGGLGGGGLGGGAGGLGGGCIHP

SEQ ID NO: 76578 - protein, 532 aa, Oryza sativa Indica Group
MARGGSGGGRWRRLNVRPDLASDQEGTRTLNLTVLRRLDPAVADILIIAAHVVLYSFDDNIHQWCELSLLIVVSDTRAIPKELNQVTIRWDIALLNVDVHIDVAFAVPFTEFWGNTQPRFQFIVMNRKNTENLTEDLLGGFEYQVQVPYIMYHNAADEITGIWFYDPQECEQVGYLFSRIQKAFSRVSPKAKVSVTESEYEKPEVVPAVPSNEDTLKQPTSSIMLLDNAKYDFLSALLKGAACVGATMDEASAVQSNKSVGMVHSSTHASPHAIPPQSPAIQSNKSFGMVHSSTQAPLAIPPQSPAIRSNKSVGMIHSSTHASPFDIPPQSPAVQSNKSVGMIHSLTHASHLAIPPQSPALHGLHPSQISAVPVMPHDAHRSSSTSTIQPTSLANPLFFPPMPSLQTASHAASSLCSAAPLHPPITVQQLQSAPLHQPFSLPTASSIQPPYGMPLLQPFPPPNPSPFLTSGVSYGRPVITRDQLKDVLLSLCQPCKLAPIFAQPLLGPHDSGVLYPLNDFMVSSVNHSFLLA

SEQ ID NO: 76579 - protein, 232 aa, Triticum turgidum
MARQGKGEGEGGQKMTMIYAMVARGTMVVAEHTAYTGNFRDIAAQCLHKLPAGDSRFTYTCDGHAFTFLLHQGYAYCVVATESAGREVPLAFLERIKEEFNKRYAGGKAATATANSLTKDFGPRLKEQMQYCMDHPEEVSRLSKVQAQVSEVKGIMMENIDKVIDRGEQIEGLVTRTEQLHDHALDFRTEGTRIRRRMWYQNMKIKLIVAGIVVAIILIIVLSICHRDHCKS

SEQ ID NO: 76580 - protein, 440 aa, Achromobacter denitrificans
MSAAKLPDLSHLWMPFTANRQFKANPRLLASAKGMYYTSFDGRQILDGTAGLWCVNAGHCREEIVSAIASQAGVMDYAPGFQLGHPLAFEAATAVAGLMPQGLDRVFFTNSGSESVDTALKIALAYHRARGEAQRTRLIGRERGYHGVGFGGISVGGISPNRKTFSGALLPAVDHLPHTHSLEHNAFTRGQPEWGAHLADELERIIALHDASTIAAVIVEPMAGSTGVLVPPKGYLEKLREITARHGILLIFDEVITAYGRLGEATAAAYFGVTPDLITMAKGVSNAAVPAGAVAVRREVHDAIVNGPQGGIEFFHGYTYSAHPLAAAAVLATLDIYRREDLFARARKLSAAFEEAAHSLKGAPHVIDVRNIGLVAGIELSPREGAPGARAAEAFQKCFDTGLMVRYTGDILAVSPPLIVDENQIGQIFEGIGKVLKEVA

SEQ ID NO: 76581 - protein, 167 aa, Arabidopsis thaliana
MSSGIGSLVKVIFKNFDVIAGPMISLVYPLYASVRAIESRSHGDDKQWLTYWALYSLIKLFELTFFRLLEWIPLYPYAKLALTSWLVLPGMNGAAYLYEHYVRSFLLSPHTVNVWYVPAKKDDDLGATAGKFTPVNDSGAPQEKIVSSVDTSAKYVGHSAFDDAYIY

SEQ ID NO: 76582 - protein, 147 aa, Listeria monocytogenes EGD-e
MEQTYVMVKPDGVERGLIGEIVTRIEKKGLKIVAGKLMQIDRELAEKHYAEHIGKSFFEDLIGFITSGPVFAMVLEGDDAIATARRMMGKTNPLEADPGTIRADYAIHTNRNVIHGSDSPESAQREIQLFFAPDEILSYQKAVDTWI

SEQ ID NO: 76583 - protein, 142 aa, Wolbachia endosymbiont of Drosophila ananassae
MTLIPIVVEQTSRGERAYDIYSRLVKERIIFVTGPIEDNMASVIVAQLLFLESENPDKDICMYINSPGGVVTAGLSIYDTMQYINPDVSTLCIGQAASMGSLLLAAGTKGKRYSLPHSRIMIHQPSGGYHGQATDIEIHANE

SEQ ID NO: 76584 - protein, 473 aa, Nicotiana tabacum
MASRIVLQQQNRGEAVPGAVKQKRNMAPEGRNRKALGDIGNVATGRGVEGKKPLPQKPVAVKVKGAIVAKVPPVRKPAQKKATVKPNPEDIIEISPDTQEKLKENMQRTKADKDSLKQKATLTSTLTARSKAACGLSKKPKEQIVDIDAADVNNELAVVEYVEDVYSFYKLAENETRVHDYMDSQPEINDRMRAVLIDWLVEVHQKFELNPETLYLTINIVDRYLAVKTTSRRELQLVGISAMLIASKYEEIWAPEVNDFVCISNKSYTRDQVLAMEKEFLGQLEWYLTVPTPYVFLARFIKASPPDSEIKNMVYFLAELGLMNYATIIYCPSMIAASAVYAARHTINRTPFWNETLKLHTGFSESQLIECARLLVSYHSAAATHKLKVIYKKYSSPERGVVSLLTPAKSLLAASSSSVSSGRSDLAKSTKAAATSSSPMVVVGCQRCHMYVMVTEADPRCPQCKSTTTRKMT

SEQ ID NO: 76585 - protein, 113 aa, Clostridium estertheticum subsp. laramiense
DVVVCPTFLCLDAVIKATKGTNIKVGAQNMFFEESGAFTGEISPGMLEDIGVDYVIIGHSERRQYFNETDEAVNKKLKAAYSHNIIPILCVGETLSDREGNITEKVLASQVKL

SEQ ID NO: 76586 - protein, 113 aa, Clostridium subterminale
DVVVCPTFLSLPAVIEECKGSNIMVGAQNMHFEESGAFTGEVSPLMLKELGVKFVIIGHSERRQYFNETDETINKKLKAAFTHEITPILCVGESLQQRELGITEEVLGAQIKQ

SEQ ID NO: 76587 - protein, 113 aa, Clostridium subterminale
DVVVCPSFIALQKVRELTKGTNIKVGAQNMHFEENGAFTGEVSAPMLKSLDIDYVIIGHSERREYFNETDETVNKKIKKAFEYGILPILCVGETLSEREGNTTEAKLECQVEK

SEQ ID NO: 76588 - protein, 104 aa, Vitis vinifera
MNTDFWASRLAAAKRQYALQHHHNSSQLDRLSIDDFEVEDEARPDFPCPYCYEDYDIASLCSHLEDEHSCESRVTVCPICSVKVARDMLSHITLQHGHLFKISL

SEQ ID NO: 76589 - protein, 487 aa, Burkholderia vietnamiensis G4
MTIKHWIDGREVASRDTFTTLNPATGDVIADVASGGDAEVDAAVRAAKAAFPKWANTPARERAKLMCRLAELIEKHVPMLAALETQDTGLPIAQTSKQLIPRAAENFNFFAQVCVQMNGRTYPVDDQMLNYTLYQPVGVCALVSPWNVPFMTATWKTAPCLALGNTAVLKMSELSPLTADQLGRLALEAGIPPGVLNVVHGYGATAGDALVRHSDVRAVSFTGGTVTGKRIMERAGLKKYSMELGGKSPVLIFDDADFDRALDASLFTIFSINGERCTAGSRIFVQRTIYDRFVQAFAQRANRLVVGDPADPATQLGAMITRQHWEKVTGYIRLGEQEGARVVAGGAQAPAGLAAHLRNGNFVRPTVFADVDNRMRIAQEEIFGPVACLIPFDDEDDGLRLANETSYGLASYLWTQDVGKVHRLARGIEAGMVFVNSQNVRDLRQPFGGVKESGTGREGGEYSFEVFAEIKNVCISMGSHHIPRWGV

SEQ ID NO: 76590 - protein, 113 aa, Clostridium oceanicum
DVVVCPTYVCLSEVLKETEGSNVAVGAQNMHFEESGAFTGEISPKMLEEMGVKYVILGHSERRQYFNETDETVNKKVKKAFEHNLLPIVCCGETLEQREGNITEDVLGMQIKI

SEQ ID NO: 76591 - protein, 606 aa, Vitis vinifera
MLDPQSAAVKAVSVIGCGYDLSTDIRLSGCKSGPSFSRLIDLDQALTRDLVLPGGIIVPDVSSSIKCDKGERTRFRSDVLSFNQMSERFNQDLSLSGKIPSGLFNSMFDFKVCWQKDAGAAKGLAFDGWFITLYNIELVRSQISLSEDIKREVPSSWDPDALAGFIEKYGTHIVVGVKMGGKDVIHIKQLQSSNLQPTEVQKLLKQLADERFSEDVNGNFISNPIEFSGKLKQERSVAWDLPVALANAIRPSVISHSKNDDLLSIQVRRGGIDNGQSHKQWLSTISQSPNVISMSFVPITSLLSGVRGSGFLSHAINLYLRYKPPIEELHQFLEFQLPRQWAPEYGDLPLGPRRKKQASPALQFTFMGPKLYINTEKVNSGNRPVTGIRLYLEGRKSDHLAIHLQHLATLPKSLQLSDDHSYEPIDESVKRGYLEPVKWSIFSHVCTAPVEYNGACIDDYATIVTKAWFEVNIVGMKKVLFLRLGFSMVASAKLRRSEWEGPSTSSRKSGVMSMLISGRFSTGLTPPVKPTKVDLNSAVFPGGPPTPARPPKMSNFVDTKERVRGPEDPPGYWVVTGAKLCMESSRITLKAKYSLLTIMSEDSLLM

SEQ ID NO: 76592 - protein, 273 aa, Salmonella enterica subsp. enterica serovar Paratyphi A str.
MPCEELEIVWKNIKAEARALADCEPMLASFYHATLLKHENLGSALSYMLANKLASPIMPAIAIREVVEEAYAADPEMIASAACDIQAVRTRDPAVDKYSTPLLYLKGFHALQAYRIGHWLWNEGRRALAIFLQNQVSVSFQVDIHPAAKIGRGIMLDHATGIVVGETAVIEDDVSILQSVTLGGTGKTSGDRHPKIREGVMIGAGAKILGNIEVGRGAKIGAGSVVLQPVPPHTTAAGVPARIVGKPGSDKPSMDMDQHFNGIHHTFEYGDGI

SEQ ID NO: 76593 - protein, 317 aa, Pyrococcus abyssi GE5
MIESFRESFGRTLVEIGRKNKDVIVVDADVKNSTKTVYFENQFPDRFIQVGISEQDMIGTAAGLAIAGKIPIVSAFAAFLMRAWEQIRNTIARDNLNVKIVATHSGFSDFLDGSSHQCLEDIALMRVLPNMKVVVPADAYATRALLYEIVEDHGPAYMRLGRDFAPRVYEDGDEIKLGKANILRDGSDILFVASGVMVSVALEVAENLKGVGIDAGVLDMHTVKPLDERTLINLARKVNLVITLEEHTIFGGLGGAVAEALSEKMPRRVIRIGSTTFGRSSRDYLSLLDRYGLSVNKVYSKVLEVVKNEDDEVLEGV

SEQ ID NO: 76594 - protein, 486 aa, Pseudomonas aeruginosa UCBPP-PA14
MKSLDDLDFDNRFARLGDAFSTEVLPDPIAEPRLVVASPAALALLDLPAETSDEALFAELFGGHKLWSEAEPRAMVYSGHQFGSYNPRLGDGRGLLLGEVINQAGEHWDLHLKGAGQTPYSRMGDGRAVLRSSIREFLASEALPALGIPSSRALCVIGSSTPVWREKKESAATLLRLAPSHVRFGHFEYFYYTRQHDQLKQLAAFVQEHHFADCNAAERPYAAMFRQVVERNAELIARWQAYGFCHGVMNTDNMSILGITFDYGPYAFLDDFDANHICNHSDDAGRYSFSNQVPIAHWNLAALAQALTPLVEVDELRASLDLFLPLYQAHYLDLMRRRLGLGVAAENDQALVQELLQRMQGSAVDYSLFFRRLGEETPERALASLRDDFVDREAFDRWAEAYRRRVEEEGGDQESRRRRMHAVNPLYVLRNYLAQQAIEAAEQGDYTEVRLLHQVLSRPFEEQPGMERFTRRPPDWGRHLEISCSS

SEQ ID NO: 76595 - protein, 206 aa, Oryza sativa Japonica Group
MEKSIPCIFGVLTCDDMDQALNRAGGKAGNKGAEAALTAEEGYLALEGVYRNHGGSQVQSCSGNLHFYDYHVVYSFSYKVQSCSGNLHFYDYHVVYSFSYKVPVLYFQGHQSGGQLLTLDEIKEDLPSLSLKLLGESRWTFITREEHPHFSRPWFTLHPCGTSDCMKLLLEGMQDKDQQVRYLPAWLTVVGQAVGLKIPLGLHCNS

SEQ ID NO: 76596 - protein, 160 aa, Corynebacterium glutamicum ATCC 13032
MTNPIIPRVGIATDAHQIEAGKPCWIACLLFEGVDGCEGHSDGDVVAHAIVDALLSASGLGDLGSFVGVGRPEYDGVSGTQLLKEVRELLSAHGYVIGNVAAQLVGQTPKFGPRREEAQQVISEIIGAPCSLSATTTDHMGFTGRSEGRASVATAVVWKA

SEQ ID NO: 76597 - protein, 138 aa, Euglena longa
MDKLSEFCSKFVENVMKMTVNQLNKVTKELAKKITIDSNFKSVTDNNSVIESSKEITENKVIEKLEFNIILESFISSQRIKLIKTLRDLISIGLKEAKDLIETLPKTIYEGVSKEFAEETKKTLEESGASVIITENII

SEQ ID NO: 76598 - protein, 561 aa, Oryza sativa Japonica Group
MDARTSAVTSERCWDLAGGENDPQETPGKKSLPRWIAKRRRTTTRRFEKPAAAPPSPAAGSGVCPASCTGASCSPSWPSTGPARVSGDAVGGVAAGYYWKDVQRVQPSAAQFYQGFVSAPWVVKPIWGLLTDVVPVAGYRRRPYFLLAGVIGASSMLTLSLHRKLGIMPAILALTAQSAGAAVADVTVDALVAQNSITHQPLAADMQSLCGFSSSVGALLGFSISGLLVHSMGSQGALGLLSIPSALVFLAGVLLKERRVTDFDYKQVHRKFYKAIQSMGATLKCAEVWRPCVYMYVSLSLSLDIQAGMFYWYTDPIVGPGFSEEFIGLVYSVGSIGSLLGVLLYQISLKDCPFRGVLFWGQVLSSLAGMLDLIMVTRLNTRIGIPDYVFAVIDNSVSQMVGRLKWLPLLVLCSKLCPPGIEGTFYALLMSIQNAGLLMSGWWGGLMLQLLNVTRTEFSNLWVAVLIRNLSRLLPLMLLFLVPQSDQNSMLLPAEMLQDNESTEARKGGQDTAEFSVLVADDSSCHALNVAVEDERIKVVDAGTGTVELIPLMNELQDRGS

SEQ ID NO: 76599 - protein, 334 aa, Vitis vinifera
MSSRAVVFFFFALLSFSGICLRSASADNEEEDPGLVMNFYKDTCPQAEDVIREQVRLLYKRHKNTAFSWLRNIFHDCAVQSCDASLLLDSTRRSLSEKETDRSFGLRNFRYLDTIKEAVERECPGVVSCADILVLSARDGIVSLGGPHISLKTGRRDGRKSRAEILEEYLPDHNESMSVVLDRFAAIGIDTPGLVALLGAHSVGRTHCVKLVHRLYPEVDPVLNTDHVEHMLHKCPDAIPDPKAVQYVRNDRGTPMKLDNNYYRNILDNKGLLIVDHQLATDKRTKPYVKKMAKSQDYFFKEFARAITILSENNPLTGTKGEIRKQCSVANKHH

SEQ ID NO: 76600 - protein, 414 aa, Magnaporthe grisea 70-15
MGQTLSEPVVEKASARGEDDRFLYGVSAMQGWRISMEDAHTTVLDLLANDAEAAKQHKGKLAFFGVFDGHGGDKVALFSGDNIHKIVQNQDTFKSGNYEQALKDGFLATDRAILNDPKYEDEVSGCTACVGLLTDDKIYIANAGDSRSVLGVKGRAKPLSFDHKPQNEGEKARITAAGGFVDFGRVNGNLALSRAIGDFEFKKSAELAPEQQIVTAYPDVVVHDMGDDDEFLVIACDGIWDCQSSQAVVEFVRRGIAAKQALEKICENMMDNCLASNSETGGVGCDNMTMIIIGFLRGRTKEECGYDVDMDQSKGKTFGIGGYKGRVIFLGDGTEVLTDADDNAMFESEKQDLDSQVAKTGSSEDDGTTEDQTNKKEGTTDGKADKGTKDASEEAEAKAENIDAAVKKDEDIKV

SEQ ID NO: 76601 - protein, 212 aa, Aquifex aeolicus VF5
MLKLIVVRHAESEWNPIGRYQGLLDPDLTERGVEQARRLAKALKKENIQVLFSSPLKRTFKTAKIIGEEIGLEPIPEERVIEIDHGKWSGLLVEEVKQKFPKEFEKWLKEPHRVKFEGGESLLDVFKRVKNFLEFLLKNYNEKTVAVVSHTVPIRCLYCAVLDIDLSKFWSFGCDNASYSVVYLDSEGRNVIQKLNITCHLGDLYVEAHKAL

SEQ ID NO: 76602 - protein, 521 aa, Triticum turgidum
MMVERWAGFGSAAATVIFLWPVVQKYVPPTFRLYLTAWAAKLAACFNPYLQITISEYGAERFQRSDFFLAVEAYLSDACARRARKLKAELVKDSKNLRVTVDDHEEVTDDFSGTTIWWYASKRQSKANVISIYPGEDERRFYQVVFHRRHRDLVVDSYLPFVLGEGRAVTVKNRQRRLFTNNASRNWNPYRSKSVWSHVAFEHPATFDTLAMHPDEKEAIVDDLMAFQESKDYYAKVGKAWKRGYLLYGPPGTGKSTMIAAMANFLDYDVYDLELTAVKNNTELRKLFIETTGKSIIVIEDIDCSIDLTGKRRKDKKASSDKDSDDDDKPKLPMDPEKDDATKVTLSGLLNFIDGLWSACGGERIIIFTTNHKEKLDPALIRRGRMDKHIEMSYCRFEGFKVLAKNYLDVIKHELFGEIQQLLEETNMSPADVAENLMPMSKKKKRDPDLCLSGLVKALKQAKEDAAAAAAKAKEEEEAKEAEAKKVKEKEEAEVKKVNEENKGKDKAPKEANGDIKEGDK

SEQ ID NO: 76603 - protein, 185 aa, Ehrlichia ruminantium str. Welgevonden
MVGYFRSTLPNLLTILRVLAIPAIVCSFYIQNDSSNYIAFIIFIFACITDFFDGYLARIWQTQSKFGRLFDPIADKLIVSATLIMLVYIGKVTKLTIIPVVIIICREILISGLREFLISMNFKIPVIKLGKVKTFIQMAAIAMLMLDYSIILYVADIILYIAAGLTVYSAYLYICVALRQIYSQE

SEQ ID NO: 76604 - protein, 329 aa, Corynebacterium glutamicum
MKLLVTGGAGYVGSVRAAVLLEHGHDVTIIDNFSTGNREAVPADARLIEGDVNDVVEEVLLEGGFEGVVHFAARSLVGESVEKPNEYWHDNVVTALTLLDAMRAHGVNNLVFSSTAATYGEPDVVPITEDMPTQPTNAYGATKLSIDYAITSYAAAFGLAATSLRYFNVAGAYGNIGENREVETHLIPLVLQVATGHREKIFMFGDDWPTPDGTAVRDYIHILDLAKAHVLALESNEAGKHRIFNLGSGDGYSVKQVVEMCREVTGHPIPAEVAPRRAGDPATLIASSEKAKQELGWTPEHTDLRTIVEDAWAFTSALGDRSHAAKKKA

SEQ ID NO: 76605 - protein, 390 aa, Pasteurella multocida
MKKITIAGAGYVGLSNAVLLAQHHNVILLDIDQNKVDLINNKKSPITDKEMEDFLQNKSLTMMATPDKEVALKNADFVINATPPDYNTETGYFNTSTVEAVIEQTLSINPQAAIIIKSTIPVGFTENMREKFNTPNLIFSPEFLREGKALYDNLYPSRIIVGSTSYQAKVFADMLTQCARKKDVTVLFTHNTEAEAVKLFANTYLAMRVAFFNELDTYASLHHLNTKDIINGISTDPRIGTHYNNPSFGYGGYCLPKDTKQLLANYADVPQNLIEAIVKSNETRKRFITHDVLNKKPKTVGIYRLIMKSGSDNFRASAILDIMPHLKENGVEIVIYEPTLNQQAFEDYPVINQLSEFINRSDVILANRSEPDLNQCSHKIYTRDIFGGDA

SEQ ID NO: 76606 - protein, 338 aa, Listeria monocytogenes EGD-e
MTQKKVAILGAGSWGTGLALVLADNNHKPVIWGNLDKIVNEINESHTNSHYLPDIILPTEVKATLSLDEAIDGAEIVVIAIPTNAMRIVCKQLNEALKEPTILVHVSKGIEPETNLRMSEVIEEEIDAAKRKALVVLSGPSHAEEVALRHPTTLCASCKDLSAAEIVQDRFINNNLRIYTNDDVIGAEIGGALKNIIALGAGISDGLGYGDNAKAALMTRGMAEITRLGVAVGSNPQTFYGLTGIGDLIVTCTSVHSRNWRAGNMLGKGENLDEVLEKMGMVVEGVRTAKAVHGWAKKLDIDMPITESIYAILFENKDAREAVDLLMGREKKIEKESF

SEQ ID NO: 76607 - protein, 269 aa, Gossypium arboreum
MAAIIESGWLYLITHFSDFQLASLGSFFLHESVFFLSGLPFIYLERAGLLSKYKIQTKNNSLAAQEKCITRLLLYHIGVNLPLMIASYPFFRFMGMKSSLPFPSWKVVLSQIIFYFILEDFVFYWGHRILHTKWLYKHVHSVHHEYATPFGLTSEYAHPAEILFLGFATIIGPAITGPHLITLWLWMTLRVLETVEAHCGYHFPWSLSNFLPLYGGADFHDYHHRLLYTKSGNYSSTFVYMDWIFGTDKGYRKLKALKRDGVEEEAKQT

SEQ ID NO: 76608 - protein, 320 aa, Listeria monocytogenes EGD-e
MAKVALITTGGTIASKKTASGKLASGELSGEELAALCQLPTEIQIDIYSTFQLPSMHITLPDLISLKQLIESIFMDETYDGIVVTHGTDSLEETAYFLDLAVTDARPIVVTGSQRAPEEPGTDAYVNIRHAIYTACEINLRQAGTVVVFNERIFAARYVKKVHASNIQGFSAFGFGYLGIIDNDQVFLYQKPLEHECFDIRLDLPEVVVIKCYIGADGLFIDAAIDSGVSGIVLEGVGRGQVAPKMMPAIIRALDAGIPVVITTSAEEGNVYTTYDYEGSTFDLYNRGVILGKDYDSKKARMKLMVLLASQEEINQTNFR

SEQ ID NO: 76609 - protein, 449 aa, Haemophilus influenzae R2866
MSKVASLDAFLTKVAQRDGYQPEFLQAVREVFTSIWPFLEANPKYRSEALLERLVEPERAFQFRVAWTDDKGQVQVNRAFRVQFNSAIGPFKGGMRFHPSVNLSILKFLGFEQIFKNALTTLPMGGAKGGSDFDPKGKSDAEVMRFCQALMTELYRHVGADTDVPAGDIGVGGREVGYLAGYMKKLSNQSACVFTGRGLSFGGSLIRPEATGYGLIYFAQAMLAEKGDSFAGKVVSVSGSGNVAQYAIEKALSLGAKVVTCSDSSGYVYDPNGFTTEKLAALFDIKNTKRGRVKDYAEQFGLQYFEGKRPWEVQVDIALPCATQNELELSDAQRLIKNGVKLVAEGANMPTTIEATEALLAADVLFGPGKAANAGGVATSGLEMAQSSQRLYWTAEEVDAQLHRIMLDIHANCKKYGTIEGQENINYVVGANVAGFVKVADAMLAQGVY

SEQ ID NO: 76610 - protein, 498 aa, Rhodococcus sp. RHA1
MPDPTTLDDWTRLAATITPRRELFIDGAFRPAKSDETFDSINPATGELLARVAAADAPDVDAAVRSAREAFDSGVWSRSPASHRKRVLLRLAELILEHRHELALLDSLDMGKLVVEALTVDVPSAADLFRFYAEALDKIGGEIAPTDPGSLALVSREPLGVVGAVVPWNFPLDLAVWKLAPALAAGNSVVLKPAEQAPLSVLRLAELAAEAGLPDGVLGVVPGFGATAGAALGLHPDLDVLAFTGSTATGKRFLRYAADSNLKQVWLECGGKSPNLVFADADLDEAVEKAVFGAFYNQGAVCSANSRLLVEESVAEQVTEALVRRASSIRPGNPLDPASTLGAIVDENHARTVTGFIDRARSEGRVLLGGNKTTVDARGSFVEPTIFADVAPTAEVVTREVFGPVLTVQTFTDEAEAVRMGNDSIYGLAASVWTENLNRAHRVSAALRAGTVSVNTVDAISAQTPFGGFKQSGFGRDLSLHATDKYTGLKTTWIRLRQ

SEQ ID NO: 76611 - protein, 475 aa, Streptococcus mutans
MTKQYKNYVNGEWKLSENEIKIYEPASGAELGSVPAMSTEEVDYVYASAKKAQPAWRALSYIERAAYLHKVADILMRDKEKIGAILSKEVAKGYKSAVSEVVRTAEIINYAAEEGLRMEGEVLEGGSFEAASKKKIAVVRREPVGLVLAISPFNYPVNLAGSKIAPALIAGNVIAFKPPTQGSISGLLLAEAFAEAGLPAGVFNTITGRGSEIGDYIVEHQAVNFINFTGSTGIGERIGKMAGMRPIMLALGGKDSAIVLEDADLELTAKNIIAGAFGYSGQRCTAVKRVLVMESVADELVEKIREKVLALTIGNPEDDADITPLIDTKSADYVEGLINDANDKGATALTEIKREGNLICPILFDKVTTDMRLAWEEPFGPVLPIIRVTSVEEAIEISNKSEYGLQASIFTNDFPRAFGIAEQLEVGTVHINNKTQRGTDNFPFLGAKKSGAGIQGVKYSIEAMTTVKSVVFDIK

SEQ ID NO: 76612 - protein, 113 aa, Clostridium botulinum
DVVVCPTYVCLPAVLEEVKGSNIKVGAQNMHFEESGAYTGEIAPKMLEELGVHYVIIGHSERRQYFNETDETVNKKVKKAFEHNLIPIVCCGESLEEREGNITEKVLEGQIKV

SEQ ID NO: 76613 - protein, 365 aa, Ralstonia solanacearum GMI1000
MRILVLPCDGIGPEIVGAAMEVLRSADSVFKLDLAFDYDDVGFTSLEKYGTTLRDEVLAKAKTYDGVILGTQSHADYPAPDKGGRNVSAGFRIGLDLYANVRPARTRPFLTSNMREGRTMDLVIMREATEGFYPDRNMTKGWAELMPSPDMAISLRKITRHCSERIARRAFELAMKRKKKVTAIHKANSFHMTDGLFLECVRDVARDFPEVRLDDLLIDASTAHLVRAPERFDVLVATNFYGDIISDLASELSGSLGLAGSMMASDTHCCAQAQHGSAPDIAGQDKANPVSMILSVAMLIQWMGEHHQNPAYLAAAQAMEAAVDSVLENPATRTPDLGGNCGCKAFGQLVAKVIQAVRVPSSSGT

SEQ ID NO: 76614 - protein, 407 aa, Azoarcus sp. EbN1
MALIVQKYGGTSVGNPERIKNVARKVAKFQAQGHKVVVVVSAMSGETNRLIALTKEVATHPDARELDVVVSTGEQVTIGLLCMALHDIGVKAKSYTGGQVRILTDSAHTKARILNIDEAPIKKDLDEGNIVVVAGFQGVDEHGNITTLGRGGSDTTGVALAAALKADECQIYTDVDGVYTTDPRVVPEARKLDTITFEEMLELASLGSKVLQIRSVEFAGKYKVKLRVLSSFQEEGEGTLITVEEDQNMEQPVISGIAFTRDEAKLTVLGVPDKPGIAYQILGPVADANIDVDMIIQNIGHDGTTDFSFTIPRGELDKTAKVLEGVKAHIGARAIEADKAMAKVSVVGVGMRSHPGVASKMFRTLAEEGINIQMISTSEIKISVVIEDKYLELAVRVLHKAFGLESA

SEQ ID NO: 76615 - protein, 414 aa, Emericella nidulans
MSFANMFNKLSGQPESYEKKSLYRFGRTLGAGTYGIVREADCSSGKVAVKIILKRNVRGNERMVYDELDLLQKLNHPHIVHFVDWFESKDKFYIVTQLATGGELFDRICEYGKFTEKDASQTIRQVLDAVNYLHQRNIVHRDLKPENLLYLTRDLDSQLVLADFGIAKMLDNPAEVLTSMAGSFGYAAPEVMLKQGHGKAVDIWSLGVITYTLLCGYSPFRSENLTDLIEECRSGRVVFHERYWKDVSKDAKDFILSLLQVDPAQRPTSEEALKHPWLKGESASDRDLLPEIRAYIARSRLKRGIEIIKLANRIEALKMQEEDEEDIPSAVDVQASEASDKSGLSPFPALSTENSNTHPASTGNGESGGTKKRSLSKIARGAIFREVVLAKVREMKENEEREKVERERRERAHS

SEQ ID NO: 76616 - protein, 113 aa, Clostridium sporogenes
DVVVCPTYVCLPAVLEEVKGSNIKVGAQNMHFEENGAYTGEIAPKMLEELGVHYVIIGHSERRQYFNETDETVNKKVKKAFEHNLIPIVCCGESLDQREGNITEKVLEEQIKV

SEQ ID NO: 76617 - protein, 695 aa, Oryza sativa Japonica Group
MARSGRERRDQEEEAAVVSVERVFEGRVVPGWKEQVTLRALAVSALLGAMFSVIVMKLNLTTGIIPSLNVSAGLLGFFLLTSWTKLLDKAGVASVRPFTRQENTVVQTCVVACSGIAFSDADLCTGGTGGFGSYIFAMSDRISDQSGEARDEHNIKNPSLGWMIGFLFIVSFLGLFSVVPLRKIMIIDYKLIYPSGTATAHLINSFHTPQGAKLAKMQVKMLGKFFVMSFSWGFFQWFYTGGDGCGFMSFPTLGLEAYRNKFFFDFSATYVGVGMICPYLVNISVLLGGVMSWGIMWPLIEHKKGDWYPADLKPSSLRGIVGYRVFISISLILGDGLYNFLKVMTRTTTALVMQVRAMMSEPTLPVSGGGGQTPEETFDDKRRTELFLKDQIPNWLALSAYVVIAVVSIATVPRIFHQLRWYHVAVSYVVAPVLAFCNAYGCGLTDWSLATTYGKLAIFTVGAWADASDGGIIAGLAACGVMIGIVSTASDLTQDFKTGYMTLASPRSMFVSQVIGTAMGCVIAPSVFWLFYKAFHDIGMPGSEYPSPNALVYRNMAILGVQGLGSLPKHCLDLCIGFFVAAIAVNLARDLAAPKVARFLPLPMAMAIPFYLGPYFGIDMCIGSLIRFVWDRLDGARAKAFAPPVASGLICGDGIWTLPQSVLALAGVKPPICMKFLSRTTNIKVDAFIAKLPSS

SEQ ID NO: 76618 - protein, 220 aa, Oryza sativa Japonica Group
MGQQSLIYAFVARGTVILAEYTEFTGNFTTIASQCLMKLPASNNKFTYNCDGHTFNYLVEDGFTYCVVAVESVGRQIPIAFLDRVKDDFTKRYAGGKAATAAANSLNRDFGSKLKEHMQYCVDHPEEISKLAKVKAQVSEVKGVMMENIEKVLDRGEKIELLVDKTENLRSQAQDFRQAGTQVRRKMWLQNMKIKLIVLGIIIALILIIILSVCHGFKCK

SEQ ID NO: 76619 - protein, 206 aa, Prunus persica
HGTEVAVKILMEQDFHAERFKEFLREVTIMKRLRHPNIVLFMGAVTKPPNLSIVTEYLSRGSLYRLLHKPGATEALDEKRRLNMAYDVAKGMNYLHRRNPPIVHRDLKSPNLLVDKKYTVKVCDFGLSRLKANTFLSSKSAAGTPEWMAPEVLRDEPSNEKSDVYSFGVILWELATLQQPWGNLNPAQVVAAVGFKNKRLEIPRDL

SEQ ID NO: 76620 - protein, 534 aa, Zea mays
MGTGGVALVAAALAVVLVTRLWTALAHLVWRPYAVARAFARQGIRGPPYRVLVGNGKEVQAMRAATSGDTLDLASHDYIARVMPQYRAWVSLYGKVFLTWSGSTPALFVGSHDMVKRVLFDKAGLYGKTDPGPTILSLMGRGLVFTDGDDWSRHRRVVHPAFAMDKLKSMTGAMAACAAEVIRGWEARAAASGDRGEVTVEVGQQFTELTADVISHTAFGSSYRQGKEVFLAQRELQFIAFASINSGMRVPGTQYAPTKANVRRWQLERTVRGTLMAIIDERLAAAKEAKGYGSDLLGLMLEANAGDGGGKRQQQAMSMDEIIDECKTFFFAGHDTTSHLLTWAMFLLGTHPEWQQRLREEVVRECGGAEVPLSGDALNKLKLVTMVLYETLRLYGAVPLIARRATAGADLCGVKVPKGTLLLIPIAMLHRDEEVWGADAGAFNPLRFRDGMGRAATHPNALLSFSLGPRSCIGQDFAMLEAKATLALILRRFAFRVAPEYVHAPADFLTLQPSKGLPVVLKLLEPAVLVTSSG

SEQ ID NO: 76621 - protein, 467 aa, Triticum aestivum
  misc_feature (124)..(124): Xaa can be any naturally occurring amino acid
MERKSAILMNRYELGRMLGQGTFAKVYHARSLATNQSVAIKVIDKEKVLRVGMIDQIKREISIMRLVRHPNIVQLHEVMASKTKIYFAMEYVRGGELFARVAKGRLKEDAARKYFQQLIGAVDXFCHSRDVYHRDLKPENLLVDEHGNLKVSDFGLSALKECQKQDGLLHTTCGTPAYVAPEIINKKGYDGEKADIWSCGVILFVLLAGYLPFQDSNLMEMYRKISKGDVRHPQWFSSDARKILSRLLDPNPNTRITMDKLIEHPWFKKGYKPAVTLGTPTPRASKDLNDVQAAFSTDHKDGEGNRAEQPNGPLKPASLNAFDIISLSKGFDLSGLFEKDQEQKSNSRFMTQKPASAIVSKLEQIAETESFKVKKQDGLVTLQGSKEGRKGQLAIDAEIFEVTPSFYVVEVKKSAGDTLEYERFCKMGLRPSLKDICWNGPSEEKLPSVSESVPPTPSSKSTKRNVI

SEQ ID NO: 76622 - protein, 281 aa, Burkholderia mallei ATCC 23344
MTSRLETVALPGGERVPKLGQGTWEMGERPAKRAAEIAALREGVDLGMTLIDTAEMYGDGATETLVGDALADVRERLFIVSKVLPHHASRGGVVAACEATLKRLRTDRVDLYLLHWRGSIPLAETIAGFEALRDAGKIRYWGVSNFDVDDMEALVAEAGGAVCATDQILYNLARRGPEFDLLPWLARREMPAIAYSPIDHMRLPKRTALDEIARERGVSPTRVALAWVLGQPNVLAIPKAGSVEHVRDNRAALDLVLGEEELARLDAQFKSPRGKRPLEML

SEQ ID NO: 76623 - protein, 658 aa, Vitis vinifera
  misc_feature (117)..(117): Xaa can be any naturally occurring amino acid
  misc_feature (120)..(120): Xaa can be any naturally occurring amino acid
  misc_feature (324)..(324): Xaa can be any naturally occurring amino acid
MAAGRVGVSRRNDFYNRDRDRDRGVTGRNGFDSLSRVSSDVGGRRNVFRVRIGEKELGKLSSGRKIGSQMVDSETSEVDNGVKMNCDRKRKFSPIVWBAEKEVRISSKNGVVSMSTXLSXPKLLGEVVSDEVVAVHSDADRIQCLQSSIIESHVVSGSAETAVVEPPACLSSLMPGQRCGRSGEEVEHLEEEVVCSWNIATSRWASESDSPREKCFSDNGNMPKRSKMSSPMDSPSRTLLDGKASSPESGEFQREDSEGDRAESSVTDEVGIFIGRAGGEECSGNELDNNDCMEINDGEDETRVDYQSGLDSEDGNEVHLPVEXLPPPQRSVNMLQECRSVFEYDRLNKINEGAYGVVYRARDKKTGEIVALKKMKMKIAETDGFPMSALREINILLSFHHPSIVDVKEVVMDDFGTVYMVMEYMEHDLKRLIELKKRSFSLSEVKGLMLQLLEGVQHLHHNWVLHRDLKTSNLLLNDNGELKICDFGLSRQYASPSKPYTQLVVTLWYRAPELLLGTKQYSTAIDMWSVGCIMAELLAKEPLFQGKTELDQLDKIFKILGTPNKTIWPGVSNLPGFKANFVKQPYNLLRKKFPATSFTGFPVLSDSGFDLLSKLLTYDPEKRITAEAALDHDWFHEVPLPKCEGFMPFFPAQHAQDR

SEQ ID NO: 76624 - protein, 512 aa, Burkholderia mallei ATCC 23344
MDKTKQPPRAAKRCCRATLLAAAAFACCCGSYAAAQEAASAAPSTTTQPRDEAPLSAPLQVVQDAISAGTADVSANASADADVAMPLAEVAPPCSAPGACGAELRLAGGMGGNGEGAGAGGIGSGGDNAGSGRGSSGGANDGNGAIGAAGIGVGGTTGSTAGGTAATGRGNSVGNASGGGTSGGGASGHGTSGRGAAGGGASSGGASGGGTSGGGASSGGASGGGASGGGASGGGASGGGASGGGASGGGASGGGASGGGASGGGASGGGASGGGASGGGTSGGGASGGGASGGGASGGGASGGGTSGGGTSGGGASGGGTSGGGTSGGGTSGGGTSGGGTSGGGTSGGGTSGGGTSSGAGHGGHGGGTGGGGNSGGHGNGNGGGASGGSGSGNGHGSGNGGGNGNGGGGGNGGGSGNGTGNGGNNGGGHGNGSSGGGTSGGNGHGNGGGTSSGSGNGGGNGNGSGHGNGGHGNGGGHGNGNGSGGAGNGGANGVGSGNGGHGNGGGHGNGR

SEQ ID NO: 76625 - protein, 130 aa, Sulfolobus solfataricus P2
MNAMSKASYVKFEVPQDLADKVLEAVRKAKESGKIKKGTNETTKAVERGQAKLVIIAEDVQPEEIVAHLPLLCDEKKIPYVYVSSKKALGEACGLQVATASAAILEPGEAKDLVDEIIKRVNEIKGKTSS

SEQ ID NO: 76626 - protein, 947 aa, Oryza sativa Japonica Group
MPSVSRAVCVQRASGNNGRRCRDGAAAAGRRSVVAQRARHGKPEVAIRSGSGGSARGGHCSPLRAVAAPIPTTKKRVFHFGKGKSEGNKAMKDLLGGKGANLAEMASIGLSVPPGFTVSTEACQQYQAAGKTLPAGLWEEIVEGLQWVEEYMAARLGDPARPLLLSVRSGAAVSMPGMMDTVLNLGLNDEVAAGLAAKSGDRFAYDSYRRFLDMFGNVVMDIPHALFEEKLEAMKAVKGLHNDTDLTATDLKELVAQYKDVYVEAKGEPFPSDPKKQLQLAVLAVFNSWDSPRAIKYRSINKITGLKGTAVNVQTMVFGNMGNTSGTGVLFTRNPSTGEKKLYGEFLVNAQGEDVVAGIRTPEDLDAMRDHMPEPYEELVENCKILESHYKEMMDIEFTVQENRLWMLQCRTGKRTGKGAVKIAVDMVNEGLVERRTALKMVEPGHLDQLLHPQFENPSGYKDKVIATGLPASPGAAVGQIVFTAEDAEAWHAQGKDVILVRTETSPEDVGGMHAAVGILTARGGMTSHAAVVARGWGKCCVSGCSSVRVNDASKIVVIEDKALHEGEWLSLNGSTGEVIIGKQPLCPPALSGDLETFMSWVDEVRKLKVMANADTPEDATTARQNGAEGIGLCRTEHMFFASDERIKAVRQMIMASSLELRQKALDRLLPYQRSDFEGIFRAMDGLPVTIRLLDPPLHEFLPEGHVEDMVRELCSETGAAQDDVLARVEKLSEVNPMLGFRGCRLGISYPELTEMQARAIFEAAITMTNQGIQVFPEIMVPLVGTPQELGHQVDVIRQIANKVFTDMGKTIGYKVGTMIEIPRAALVADEIAEQAEFFSFGTNDLTQMTFGYSRDDVGKFLPIYLSQGILQHDPFEVLDQRGVGELVKLATERGRKARPNLKVGICGEHGGEPLSVAFFAKAGLDYVSCSPFRVPIARLAAAQVLL

SEQ ID NO: 76627 - protein, 190 aa, Pyrococcus abyssi GE5
MILIVNNRDSFVWNLAEYASLFDEVKVVPNTITSQEVKKLDPDGIIISPGPGHPRDRREVGNSPEIVLEAEVPVLGVCLGHQIIATVFGGEVARVKPRHGKASPIKHDGEGIFRGIKNPFMGGRYHSLAVVEVPKGFKVTAISLDDNVIMGIRHKKKPIEGVQFHPESVLTEWESREGVKMIKNFVEMTR

SEQ ID NO: 76628 - protein, 575 aa, Sulfolobus solfataricus P2
MMELNELRETIYKYALQNAVKHNGKAETGPVMSKIIAERPELRSNAREIVKIIKEIIEQVNSLTLEQQLTEIKAKYPELLEEKKHEEKRKVLPPLPNVKGQVVTRFAPNPDGPLHLGNARSAILSYEYAKMYNGKFILRFDDTDPKVKRPILDAYDWIKEDLKWLGIKWEQELYASERLELYYKYARYLIEKGYAYVDTCDSSIFRKFRDSRGKMKEPECLHRSSSPESNLELFEKMLGGKFKEGEAVVRLKTDLSDPDPSQIDWVMLRIIDTAKNPHPRVGSKYWVWPTYNFASIIDDHELGITHVLRAKEHMSNTEKQRYISEYMGWEFPEVLQFGRLRLEGFMMSKSKIRGMLEKGTNRDDPRLPTLAGLRRRGILPDTIKDVIIDVGVKVTDATISFENIAAINRKKLDPVAKRIMFVKDAEEFSVELPESLNAKIPLIPSKQEMNRTIIVNPGDKILIESNDAEDNSILRLMELCNVKVDKHNRKLIFHSKTLDEAKKVNAKIVQWVKSNEKVPVMVEKAERDEIKMINGYAEKIAADLEIDEIVQFYRFGFVRVDRKDENMLRVVFSHD

SEQ ID NO: 76629 - protein, 484 aa, Corynebacterium glutamicum ATCC 13032
MTATFAGIDATKHLIGGQWVEGNSDRISTNINPYDDSVIAESKQASIADVDAAYEAAKKAQAEWAATPAAERSAIIYRAAELLEEHREEIVEWLIKESGSTRSKANLEITLAGNITKESASFPGRVHGRISPSNTPGKENRVYRVAKGVVGVISPWNFPLNLSIRSVAPALAVGNAVVIKPASDTPVTGGVIPARIFEEAGVPAGVISTVAGAGSEIGDHFVTHAVPKLISFTGSTPVGRRVGELAINGGPMKTVALELGGNAPFVVLADADIDAAAQAAAVGAFLHQGQICMSINRVIVDAAVHDEFLEKFVEAVKNIPTGDPSAEGTLVGPVINDSQLSGLKEKIELAKKEGATVQVEGPIEGRLVHPHVFSDVTSDMEIAREEIFGPLISVLKADDEAHAAELANASDFGLSAAVWSKDIDRAAQFALQIDSGMVHINDLTVNDEPHVMFGGSKNSGLGRFNGDWAIEEFTTDRWIGIKRS

SEQ ID NO: 76630 - protein, 490 aa, Gerbera jamesonii
  misc_feature (1)..(7): Xaa can be any naturally occurring amino acid
XXXXXXXSGSGVSTLEKKNLGRIAQIIGPVLDVAFPPGKMPNIYNALVVKGRDTVGQPINVTCEVQQLLGNNRVRAVAMSATDGLTRGMDVIDTGAPLSVPVGGATLGRIFNVLGEPVDNLGPVDTSTTFPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYEIAQQVKQTLQRYKELQDIIAILGLDELSEEDRLTVARARKIERFLSQPFFVAEVFTGSPGKYVGLAETIRGFQLILSGELDGLPEQAFYLVGNIDEATAKAMNL

SEQ ID NO: 76631 - protein, 291 aa, Paracoccus marcusii
MRRDVNPIHATLLQTRIEEIAQGFGAVLQPLGAAMAALSSGKRFRGMLMLLAAEASGGVCDTIVDAACAVEMVHAASLIFDDLPCMDDAGLRRGQPATHVAHGESRAVLGGIALITEAMALLAGARGASGTVRAQLVRILSRSLGPQGLCAGQDLDLHAAKNGAGVEQEQDLKTGVLFIAGLEMLAVIKEFDAEEQTQMIDFGRQLGRVFQSYDDLLEVVGDQAALGKDTGRDAAAPGPRRGLLAVSDLQKVSRQYEASRAQLEGMVGSKRLQAPEIEALLERVLPYAARA

SEQ ID NO: 76632 - protein, 231 aa, Aegilops tauschii
MARKGEGAGPNPPATTMIYAMVARGTLVVAEHTAYTGNFRDIAAQCLHKLPAGDSRFTYTCDGHTFTFLLHQGYAYCVVATESAGREVPLAFLERIKEEFNKRYAGGKAATATANSLTKDFGPRLKEQMQYCMDHPEEVSRLSKVQAQVSEVKGIMMENIDKVIDRGEQIDGLVTRTEQLHDHAMDFRTEGTRLRRRMWYQNMKIKLIVAGIVVAIILIIVLSICHRDHCK

SEQ ID NO: 76633 - protein, 97 aa, Oryza sativa
  misc_feature (24)..(24): Xaa can be any naturally occurring amino acid
  misc_feature (58)..(58): Xaa can be any naturally occurring amino acid
MRWMGHDIQARQLRLFRHAPETTXKTVIWNGPMGVLEFDKFAGGTEAFAKMLADLSGXGVTTIIGGGDSCAAVVKVGVAYVMCHILTGGGASLELLE

SEQ ID NO: 76634 - protein, 396 aa, Rhodospirillum rubrum ATCC 11170
MKTLSSHAVSDALTGWRDRLLTNDRFQYWAMRLPGLRTIARRRARSLFDLCAGFVYSQVLDACVRLDLLPVLAEGPQTATVVAERIALPVEGARRLLEAAVSLDLVERRRGGRFGLGALGAAMLGNPAVLAMVRHHGLFYQDMRDPVALLRGEAGETALSRYWAYARSQAPDELAEPAVSDYSALMSASQALVADEILDAVPLGNARCLMDIGGGEGGFMAAVLGRYPKIRGIVFDLQSVADRAADRLDAAGFEPRVRVAGGDFRVDPLPTESDVMTLVRVVHDHDDDTVRALLAAAHRALPDSGLLIVAEPMADTPGAEPMGAAYFGFYLLAMGSGRPRSRATLTEMLREAGFADVRMAKTRNPLLTQVLVARKAAPASLAAVGAKVPQAAGDCK

SEQ ID NO: 76635 - protein, 782 aa, Debaryomyces hansenii CBS767
MSQSFPVASDLNATWSFIQPGLEFILGAQGDQGVTSKMYMNCYTAIYNYCVNKSRHGSANTPVSAVSGNNSYSLAGAEIYAKLDEYLVQFITSLKKDPLDSFLEFYVKRWTRFTIGAGYMNNVFDYMNRYWVQKERSDGRRDVFDVNTLSLLKWKSHLFNNNADRLIDEVLDQIEKQRNNEIVDTNYISTAIKSLVYLGIDIQDLKKPNLVVYIKHFEHKFLQKTAEYYSKESAKFLSQHNVVDYMKKCDTRLSEEVSRSNNYLDNHTKKFLLETLNTVLIKDHAQAMYDQFLRLLEQDEIDHIQIMYKLLARVPSTLQPLADTLEKYIKDEASKAIEEIKNPSEDIEDPSKQSADAKSSKRTTAGLVSPKAYIHTLISIYIKFNDIVTVAINKDPIFIKSLDNACRYFVNKNSIAIPTPKSNCKTPDLLARYADGFLKATSRESDIIGMTPDNLMIIFKFIDDKDAFEEHYRRLLAKRLINNNTKSDELEESIIQKLQEENSLEYTSKMTKMFQDMKSSEDLKVNVREELGQTDNQVKDFTPLILAQSMWPFKHLDDYKLKLAPELMPSFNKVQEIYNKKHTGRQLQWLWNHGKSEVKANLSRKGKPPFLFTVSNVQLMILLAFNKSNTFSFKELFDTVGVAKHTFEAHLLPFTKYKLIDQSPPGAELFNKDDTKFTIVEEYKSKKLRVNFVSSIKTEQKQEEENTNKEIDESRRNYLSACIVRIMKARKQMKHNELVNDVATQSLSRFRAKIIDIKRVIDYLIEKEYLRRIDNDTYEYLA

SEQ ID NO: 76636 - protein, 289 aa, Rhodospirillum rubrum ATCC 11170
MDVRQHIDNVLEATMTRADLPDAPPLLAKAMRHAVFPGGGRLRPRLTLAVAAACGNDLPAAADAAAAAIELLHCASLVHDDLPCFDDAHSRRGQASVHVAYGEPLAVLAGDALIVMAFQGLASGLAMVPERLPLLLGIVADAVGMPAGICAGQAWESEPTVKLAEYQRAKTGALFAASTMAGAAAAGREARSWRMLGECLGEAYQVADDLRDVAADPAELGKPVGRDAALGRPNAVGHLGIVGAVRRLESLVADAVASVPDCAGAGALRALIHKEAERFLPKELARYAA

SEQ ID NO: 76637 - protein, 228 aa, Zea mays
MNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNAQTMAWILDEYSKFHGYSPAVVTGKPVDLGGSLGRDAATGRGVLFATDALLAEHGKGIASQRFVIQGFGNVGSWAAQLITEA

SEQ ID NO: 76638 - protein, 297 aa, Triticum aestivum
  misc_feature (54)..(54): Xaa can be any naturally occurring amino acid
  misc_feature (61)..(61): Xaa can be any naturally occurring amino acid
  misc_feature (75)..(75): Xaa can be any naturally occurring amino acid
  misc_feature (84)..(84): Xaa can be any naturally occurring amino acid
PLTVPNLPGFRDQPCPVPHILGVGHVTPTLEWLPPGVNPPGLAFPPDKNHDPFXDFFAGNXRSRAKFGRVGTLTXCDTLAAHMXGNVYVQFREEEQAVAAHNALQGRFYSGRPIIVEYSPVTDFREATCRQFEENSCNRGGYCNFMHVKQIGRELRRKLYGGRSRRSHGRSRSPSPQHRRDNRDRGGDFRRDGRDEYRGGGGGYRGGDGGDGGGYRGGGGGGYRGGDGGGYRGGGGGGYRGGGRGGGGGRHDRYDDGPRRRYGGSPPRRGRSPPARENSEERRAKIEQWNREREEKK

SEQ ID NO: 76639 - protein, 550 aa, Fulvimarina pelagi HTCC2506
MPSPSQTKIAAPASGSVVEQTPQPTEHVVDLFIIGGGVNGCGIARDAAGRGYSVTLAEMNDLASATSSKSTKLFHGGLRYLEYFEFSLVREALHEREVLLKAMPHIAWPMRFVLPYNSKMRFETDTPASKLLSTIMPWTKGRRPAWMIRLGLFIYDAMGGRTILPGAKSVDLDRDPAGVPLKDEFKTAFEYSDCWVEDSRLVALNARDASARGARIMTRCKVNRADREDGHWVVETENTENGERRTFHARMLVNAGGPWAADVIARSSRANDEHSVRLVRGSHLVVPKLFDHDKAYFLQGEDGRIIFVIPYETDFTLIGTTDQEHADPEEKPETSTKERDYLLSFVNRYFEKSLEAEDVVWDYSGVRPLFDDGASSATAATRDYVLKLDRNGAPLLNIFGGKITTYRRLSEGALSHIDEALGRKTRSWTAGAALPGGDFGVDETEALVKRLKADHPFLTDRWARRLTKAYGTEASALLGAAKTVSDLGRDFGANLTEAEVKWLMDREFARTAEDVVWRRSKLGLRLDAKEIAALDRFMASRGDSLANAAE

SEQ ID NO: 76640 - protein, 125 aa, Bradyrhizobium sp. BTAi1
MVVEALQKMRDNRVRSVLVIDDGVLVGIVTQGDCAIKVLLPGLDAKQTQVGQVMTANPVTVKPDHPLDGCMAMMSQRGFRHLPVLDAGKVVGVISIGDVVKNIIRDLEHNVDDLMGFIMKDGPGG

SEQ ID NO: 76641 - protein, 261 aa, Arabidopsis thaliana
AETEGVVFGYKGKNGPNQWGHLNPHFTTCAVGKLQSPIDIQRRQIFYNHKLNSIHREYYFTNATLVNHVCNVAMFFGEGAGDVIIENKNYTLLQMHWHTPSEHHLHGVQYAAELHMVHQAKDGSFAVVASLFKIGTEEPFLSQMKEKLVKLKEERLKGNHTAQVEVGRIDTRHIERKTRKYYRYIGSLTTPPCSENVSWTILGKVRSMSKEQVELLRSPLDTSFKNNSRPCQPLNGRRVEMFHDHERVDKKETGNKKKKPN

SEQ ID NO: 76642 - protein, 1102 aa, Cryptococcus neoformans var. neoformans B-3501A
MSGRPFKRESWRPTKRPPTFAAAAQQPPLSSANALPARTWGGTPVPTAPKRFERDPSSNVKEEAHLSRWDDKGSNDGKWDQRDWDQRDDRSRYGNSGNGKRRQSPSRQPDSTRDERFSSARRSYSPPVPAPSPANPSNYPATRRPLPPAQPPASHHHTRARRPSPDYGTSGPAAKKRKGGARKRDSPDYGVGSREDAASSYRRSPSPLSNRSRSRTRSRSRSPAPSHHSQSNSYSLPKTQTHTYTPSQSHRKRSPSPSMSDRQSSSGRWSKRDRYNNHQYGKYDKDDRNGKFDSRDNGWENEGNRNWRDRDTDRDGHRRDRGMGDRGGRRDKDWRQDKGYVYDRRDRERDRDRERDRDRDRDRGSGWQASRRDRDYPPIGPRGYTSSASQLRHDYQTAPSPPHSAHVQAPPPPSDFYDRRRDSPDSYGHQNHSHGQRQGRSPIQDREYPSRSNFVTNANANSILGTSTTRKWGESGRYLYEQSYQPPSTVSRATSVSRDYSPSPQHSYALPAATSDTVPLPVHPPAPLESSFQSLPDTAGPTAELQTRTSPVKISFGQPSGGAVKKGWKSISPKKKARVSLFDEDEEEIQGAKGEKEDKKEVMPEKEQDIMGEALPHPDTLIHRLTLASTRYTTLLTSLSAPLRAAFDSFSTLPSSPPPPPIDLFLDEYLGRKARDDEVKRVEEVWDAKKEWEREEEMGRRYLEEVGKGGRVEGVNVAPAEPGGARVSPAAVVVAPKPEPELAPIPVSGTELQAPAPGAEPHPQTQKVPIPLPPAATLVYQKLAAVGEGTYGKVYKALSLITHQPVALKRIRMENEKDGFPVTAMREIKLLQMLQHENVLRLVEMVVERGGVYMVLEYMEFDLTGLLAHPEIKFSPANIKSLSHQMLSGLSYLHRQSILHRDMKGSNILVNSRGELKLADFGLARVYAKKRREDYTNRVITLWYRSPELLMGETIYGPEVDMWSAGCIILELYTTKPIFQGSDELNQLEVIYALLGTPTEAEWPSVKELPWYELVKPKEEIGSKFRTSFAKWLSPAALDLVEGLLFYDPSQRLLADSALQTDYFLMEEPKMEKPTQLEGMGEHHEMSAKAERKRRRMEEGGE

SEQ ID NO: 76643 - protein, 150 aa, Vitis vinifera
MCLMYYHFPLSPFRLIAFLEPQMGLRLGFIFLHLGFALVVESFSFADDSWDDSQIQLVDGTQVNATDGFAPCDGAVGDCINEDDEMMMDSETNRRSLAQRRRYISYGALRRNQVPCNRRGRSYYNCRRGGRANPYRRGCSVITKCHRFTD

SEQ ID NO: 76644 - protein, 424 aa, Nitrosomonas europaea ATCC 19718
MQFQDIRLAVVGLGYVGLPLAVEFGRKRSVVGFDINQRRIDELKNGNDFTLETTREELAAAKYLTYTTNIDDLRDCNCYIVTVPTPIDEHKRPDLTPLIKASETVGKVLKKGDIVIYESTVYPGCTEEDCVPVLERVSGLKFNQDFYCGYSPERINPGDKEHRVTTIRKVTSGSTSEVADLVDELYNEIITVGTHKAESIKVAEAAKVIENTQRDLNIALINELALIFNKMGIDTEAVLKAAGSKWNFLPFRPGLVGGHCIGVDPYYLTHKAQAIGYHPEIILAGRRLNDSMGTYVVAQLVKAMTKKRIQVEGARVLVMGLAFKENCPDLRNTRIVDIVAELKDYNCVVDVYDPWVSLQEAQHEYGITPIGTPKPGSYDAIILAVAHHQFKDMGASAIRALGKPDAVLYDLKYVLDPQGADLRL

SEQ ID NO: 76645 - protein, 335 aa, Nitrosomonas europaea ATCC 19718
MKVLITGSAGFIGSTLALRLLERGDTVIGIDNHNDYYDPKLKEDRLARFADHPDYTHLRLDLADREGIKTCFETYKPQRVVNLAAQAGVRYSIENPLAYIDSNIVGFAHILEGCRHNDVEHLVYASSSSVYGANTMMPFSVHHNIDHPLSLYAASKKSNELMAHTYSHLYNLPTTGLRFFTVYGPWGRPDMALFKFTRAMLAGEKIPVFNYGKHRRDFTYVDDIVEGVIRVLDQPARSNPAWSGANPDAGTSLAPWRVYNIGNNSPVELMDYIAALEKALGKKAEMEMLPLQPGDVPDTYADVSDLVEQFDYKPATPVEQGIANFVTWYRNYFNL

SEQ ID NO: 76646 - protein, 439 aa, Glycine max
  misc_feature (41)..(41): Xaa can be any naturally occurring amino acid
  misc_feature (103)..(103): Xaa can be any naturally occurring amino acid
  misc_feature (279)..(279): Xaa can be any naturally occurring amino acid
  misc_feature (430)..(430): Xaa can be any naturally occurring amino acid
MDSACATLNGRHLAKVSEGIGRNRTSGFWGESTRGSVNTKXLSVQSCKTSRTNRNLRNSKPGSGIARAVLTSDIDEDSMAFQGVPTFEKPEVDPKSVASIILXGGAGTRLFPLTGRRARVSYVSAPPHRLIDIPMSNCINSGIRKIFILTQFNSFSLNRHLSRAYSFGNGMTFGDGFVLAATQTPGEAGKKWFQGTADAVRQFIWVFEDAKNKNVEHILILSGDHLYRMDYMDFVQRHVDTNADITVSCVPMDDSRASDYGLMKIDKTGRIIQFAEKPXLQLLRWKCSSCNDFGSEIIPSAVNEHNVQAYLFNDYWEDIGTIKSFFDANLALTEQPPKFEFYDPKTPFFTSPRFLPPTKVEKCKIVDAIISHGCFLRECSVQHSIVGVRSRLESGVELQDTMMMGADYYQTEYEIASLVAEGKVPIGVGXNTKIRNCII

SEQ ID NO: 76647 - protein, 483 aa, Methylobacterium extorquens
MMEAPLKRSRRTKIVATLGPASDTPEMIEKLFHAGADVFRINMSHLAREKLPERIEVIRTIEREGKRPIGILVDLQGPKLRLGTFVGDAAVLENGQTFVLDSDPTPGDTDRVFLPHPEILSALEPSHGILIDDGKLRLIVTEVSEGRAVTRVEVGGRISNRKGVSLPHTALPVPAMTEKDRGDLEAGLAAGADWIAVSFVQRPEDVAEVKKVAAGRALVMAKIEKPQALTRLDEIIEISDGIMVARGDLGVEMPLEQVPGVQKRITRVARRLGKPVVVATQMLESMITSPVPTRAEVSDVATAVYEGADAVMLSAESAAGDFPVEAIGTMNRIAEQVERDALYWSILMAQRSEPEPTASDAIAAAAHQIVEALSLRSIMAWTHSGSTVLRLARARPNASVIALTPKRETARRLTMAWGVHPIVTKDASDVDDMAFRAAKFAVRERFAEIGDRVIIVAGVPFGIPGATNMVRIAFVTREHAERA

SEQ ID NO: 76648 - protein, 329 aa, Vitis vinifera
MDWGRVTAVEAADEWMADLSKLYLGLRFSHGAHSRLYHGVYEEQPVAVKVIMVPDEEENGALASKLEKQFNGEVSCLSRLHHQNVIKFVAAWRRPPVFVVITEYLSEGSLRAYLHKLEHKSLPLEKLITIALDIARGMEYIHSQGIIHRDLKPENVLVTKDFHMKIADFGIACEEAYCDSLADDPGTYRWMAPEMIKHKSYGRKVDVYSFGLILWEMVAGTIPYEDMAPIQAAFAVVNKNLRPVIPVDCPPAMRALIEQCWSLHPDKRPEFWQVVKVLEQFKSSLALDGTLNLVRYATCQDHKKGLLHWIQKLGPVHHNTSSMPKPKFT

SEQ ID NO: 76649 - protein, 181 aa, Triticum aestivum
MAPTVMASSATSVAPFQGLKSTAGLPVSRRSNGASLGSVSNGGRIRCMQVWPIEGIKRFETLSYLPPVSTEALLKQVDYLIRSKWVPCLEYSKVGFIFREHNASPGYYDGRYWTMWKLPMSGCTDATQVINEVEEVKKEYPDAYVRIIGYENMRQVQCVSFIAFKPPGCEESGKAYTAHSR

SEQ ID NO: 76650 - protein, 619 aa, Exophiala dermatitidis
MFNATQHRGNPNMGPAPPGQPNHRLNEIMDSLRAEFENQSRASEQVENQVAQQIQEMELIRNKVYQLEQNQLKMKQEYEAEIRMLRHELELRGGPQVQSHLTGPPQHGGPAQAPPSLGHGQGGLFSGIMANQGQGGPGLAPPPEQPPQQQQHPLQPPPAAGQPQGPPQPPNSFPGYQQGPTLNGYAPQPQPPTNSPGLGKNRTMAARGGPGPATPQQHPNQPQPMPYQNDRGRHPRIPRPVPPGGDMQHGHRHQMPGLPNVGNVLADLNPDDLPEHLKRTGPNGEWHAVFNPNVPRTLDIQLLHNLVHESVVCCVRFSNDGKYVATGCNRSAQIFDARDGRKVCELLDESVQDKDGDLYIRSVCFSPDGKLLATGAEDKRIRVWDIENKRIRTTFDGHEQDIYSLDFSRTGRLIASGSGDKTVRLWDIESNQQVMVLSIEDGVTTVAMSPDGRFVAAGSLDKSVRVWDCSTGYLIERLEGPQGHKDSVYSVAFSPSGRELVSGSLDKTIKMWELTPQRNLIPSTAKDGKCIRTFEGHKDYVLSVCLTPGGEWVMSGSKDRGVQFWDPTTGNAQMMLQGHKNSVISVAPCPTGQLFATGSGDMKARIWQYTTWRGAHQGI

SEQ ID NO: 76651 - protein, 422 aa, Pseudomonas aeruginosa UCBPP-PA14
MSDLKTAALEYHAQPRPGKLSVELTKPTATARDLSLAYSPGVAEPVREIARDAELAYQYTGKGNLVAVISDGTAILGLGNLGPLASKPVMEGKGVLFKRFAGIDVFDIEVDAESPQAFIDTVKRISITFGGINLEDIKAPECFEIERALIEQCDIPVFHDDQHGTAIVTAAGMLNALELAGKKLEEAKIVCLGAGAAAISCMKLLVSMGAKVENIYMIDRKGVIHAGRDDLNQYKSVFATETDKRTLADALEGADVFVGLSGANLLEPEDLKRMAPNPIVFACSNPDPEIKPELAHATRNDVIMATGRSDYPNQVNNVLGFPFIFRGALDVRATRINEEMKIAAALALRDLAKQPVPEDVCAAYGVDKLEFGREYIIPKPMDKRLITVVSDAVAKAAIETGVATLPYPKNYPLKSVDEVFNG

SEQ ID NO: 76652 - protein, 195 aa, Marinibacillus marinus
MIICKTPREIEIMREAGKIVALTHQELQKHIAPGITTKGLDEIADRFIRQHDAVPSFKGYNGFRGSICASVNEELVHGIPGNRTLVDGDIISIDIGANYKGYHGDSAWTYPVGSISTDTQKLLDVTEESLFLGLKEAKPGERLSNISHAIQTFVEDNGFSIVREYVGHGVGQDLHEAPQIPHYGPPNKGPRLKPG

SEQ ID NO: 76653 - protein, 185 aa, Magnetospirillum magnetotacticum MS-1
MTNQTIAYQGEPGANSHIICSQAYPGWTALPCATFEDAFAAVSEGKAALAMIPIENSIAGRVADIHHLIPTSRLHIVAEHFLPIHFQLMVLPGTRAESLTSVHSHIHALGQCRRIIRRLGLRAVVAGDTAGAAREVAEAGDPTRAALAPALAAEVYGLDIIARDVEDEAHNTTRFVVFSPETSSR

SEQ ID NO: 76654 - protein, 638 aa, Vitis vinifera
MDDMNLIQQRHHLVVRELGEEIDLEIGPGDDDPSFANTPLIGGPPREPSAEEHDESKQVVMVSQLSSEDQDASKMQPVKRKKKVVKRWREEWADTYKWAYVDVKEGTARIFCSVCREYGRKHRRNPYGNEGSRNMQMSALEEHNNSLLHKEALRLQMASKDKIIVDKPIYVKALMSKTAGSIVEAALKRDPHEVEFIQSVQEAVHALERVIAKNSHYVNIMERLLEPERMILFRVPWVDDRGETHVNRGFRVQFNQTLGPCRGGIRFHSSMNLSIAKFLGFEQELIVKCSLNSFFPNVSEKQNSKECLVTIQTRRGRQVEVILIRKEKIMRFCQSFMNELYRYLGPDQDLPSEEMGVGPREMGYLFGQYRRLAGHFQGSFTGPRIFWSGSSLRTEATGYGLVFFAQLMLADMNKELKGLRCVVSGSGKIALHVTEKLLAYGALPITVSDSKGYLVDEDGFDYMKISFLREIKSQQRSLRDYSKTYARSKYYDEAKPWSERCDVAFPCASQNEIDQSDAINLVNSGCRILIEGSNMPCTPEAVDVLRKANVLIAPAMAAGAGGVAAGELELNHECNLMHWSPEDFESKLQEAMKQTYQRALKAAADFGYQKESPEALVHGAAISAFLTIAQGMTDQGCV

SEQ ID NO: 76655 - protein, 211 aa, Brassica napus
  misc_feature (172)..(172): Xaa can be any naturally occurring amino acid
  misc_feature (187)..(187): Xaa can be any naturally occurring amino acid
MVKKICCIGAGYVGGPTMAVMALKCPEIEVSVVDISEPRINAWNSDKLPIYEPGLDDVVKQCRGRNLFFSTDVERHVFESDIVFVSVNTPTKTQGLGAGKAADLTYWESAARMIADVSKSSKIVVEKSTVPVRTAEAIEKILTHNSKGIEFQILSNPEFLAEGTAVKDLYNXPDRVLIGGRGNAAGXKAVSLRDVYAHGSSGRIICTNSVS

SEQ ID NO: 76656 - protein, 450 aa, Actinobacillus pleuropneumoniae serovar 1 str. 4074
MSHLSVAKFGGTSVANFDAMTSCANIVTSDANTRVVVLSASAGVTNYLVELANGCEKERREEILDAVRTIQYNIIEKLQNQSEVSAEIDELLQHIAALAESASLATSNALTDELICHGEMMSTKIFTQLLKERNFPAVWVDVRDIVATNSNYGKAAPNDEKTQQQSDAIIKPLIAAGNVVITQGFIGRDDEGKTTTLGRGGSDYSAALLAEVLNANDVLIWTDVPGIYTTDPRVVPNAQRIDTMAFNEAAEMATFGAKVLHPATLLPAVRSNIPVYVGSSKAPEQGGTWVTRDPQPRPTFRAIALRRNQTLLTLSSLSMLHAQGFLANVFAILAKHKISVDVITTSEVSVALTLDKTGSASSGADMLSKELLDELNAYCHVQVEHDLALIAIIGNNLHTQAGVAKQLFHTIENFNIRLISYGASTNNVCTLIKNDEADEVVRALHAGLFE

SEQ ID NO: 76657 - protein, 219 aa, Oryza sativa Japonica Group
MEWAYYGSGYSSSGTPSPVGGDGDEDSYMTVSSAPPKRRAGRTKFKETRHPVYKGVRSRNPGRWVCEVREPHGKQRIWLGTFETAEMAARAHDVAAMALRGRAACLNFADSPRRLRVPPLGAGHEEIRRAAVEAAELFRPAPGQHNAAAEAAAAVAAQATAASAELFADFPCYPMDGLEFEMQGYLDMAQGMLIEPPPLAGQSTWAEEDYDCEVNLWSY

SEQ ID NO: 76658 - protein, 421 aa, Bradyrhizobium sp. BTAi1
MMRKAVSPIWHPFTQHALQPEMTPVARGDGAYLITRDGRRIIDAIASWWVVTHGHCHPPIVRAIQEQAGQLDQVIFAGHTHEPAEQLAAGLLDLVPPTLAHVFFSDSGATSVEVALKMALGYFRNIGEPRTRIAVMQHSYHGDTIGTMSVGARGVFNAAYEPLLFDVAVVPFPAEGFEQATLDALAATCERDRPAAFIVEPLVLGAGGMLMYPAALLREMHRICKASGVLFIADEVMTGWGRTGTLFACEQAGIAPDIACYAKGLTGGAMPLAVTLCSADIFEAHYSTDRRRTFFHSSSYTANPIACAAACANLALWRQPEAHARISAVAAAQERSVARFREDERFSDVRRCGTITALDLHADDEGYLADIGPKLQAFFRDSDILLRPLGHTIYVMPPYCVTAADLEAIYATIDAAVDHVI

SEQ ID NO: 76659 - protein, 340 aa, Prochlorococcus marinus str. MIT 9313
MSRCVVVTGAAGFIGAALVQRLLAQGDRVIGIDNLNDYYDPSLKRARLAQVEAASLKASWTFYPIALEDGAAIEELFKAEKPEVVVNLAAQAGVRYSLENPAAYIQANLVGFGHILEGCRHHGVQHLVYASSSSVYGGNRNLPFHEQQPVNHPVSLYAATKKANELMAHTYSHLYGLPATGLRFFTVYGPWGRPDMAPMLFAKAILAGEPIKVFNYGKMQRDFTYIDDIVEGLLRCCDKPATANLGFDPRNPDPATAAVPHRLFNIGNSQPIELMHFIEFLENSLGREAVKDFQPMQPGDVMATAADTSALEAWVDFRPSTPIAEGVECFSQWYRSFYEV

SEQ ID NO: 76660 - protein, 703 aa, Rhodospirillum rubrum ATCC 11170
MPARMFFLAPMAQDVGLTSVALGLARALQRDGIKVGFAKPIGHAEADGEPGDPSSHFARSLCLLEAPESIAFARAEDQVRRGDLAALMEEVVTLVDGLRASHDAVIIEGLIPGADTQVAGRLNAEMARALGADLIPVLSGAGRDGADLAEAIALARRQYDGAQNAAFAGVLINKVSPSHGAELRGDLERAVGERLPILATIPFETRLQSPRLADVVRGLGLTVEHEGALAQTRVREIVIAARSVENIIERLRPGALVVTPVDRIDIVLAATLASLRGVPLAGVLLTCGGSLPDTVASLVLSARPEGLPILSTPADTYATASRLSRLSGHVGADDHAQMEEVIDFIAEQIATAPLRRRIGEPGEVRMSPPAFRNRLIQSARRAAKRIVLPEGDEPRTLQAAIACHAKGIARCVLLGHPAQVRQVASAQGLEIPADLEILDPELVRGRYVEALVEMRRAKGLTALQAAAQLEDTVVLGTVMLALGEVDGLVSGAVHTTASTVRPALQLIKTAPGASIVSSVFFMLMPDQVLVYGDCAINPNPTAEQLADIAIQSADSALAFGIEPRVAMISYSTGSSGVGDDVEKVRAATALAKLKRPDLMIDGPMQYDAASVESVGRQKAPDSPVAGRANVFVFPDLNTGNTTYKAVQRSANVVSVGPMLQGLRKPVNDLSRGALVDDIVYTIALTAIQADQGADPMAEKVAAE

SEQ ID NO: 76661 - protein, 508 aa, Xanthomonas campestris pv. campestris str. ATCC 33913
MPSSVRDACVKFRGFYREAIMKERQRRTKILATLGPATDPPGVLDALFKAGVNVVRLNFSHGDPSGQAKRAAEVRAAAVRVGAEVGILADLPGPKIRIERFAGGKIKLTMGDRFDLVADINAPAGDQHQVGVSYLGLPQDVTAGDVLLLDDGLVQLQVTDVQGARIVTTVLNDGVLSDRKGLNKQGGGLSLGALTERDKELIGIVAKIGVDFIAVSFCRNAQDMHDARQIAQQHGCDAQLVSKIERTEAIENLVEIVEASDVVMVARGDLGVEIGDAELPGLQKKIIRESLAQNKVVITATQMLQSMVESPIPTRAEVLDVANAVIDGTDAVMLSAETAAGAYPVRAVEAMARICLGAEHQFEFDTDFEAAQRNLQRADQAIAMATMFLSEHIGLGGVVALTESGGTPRYLSRFRSNMPIYAFTRHDGARRQMAMMRGVFPIGFDSRGLTPREAARAAIRLLVENERMGPGDRVVFTSGEHMETHGATNTLRLLEVGEDGRASGLGEL

SEQ ID NO: 76662 - protein, 300 aa, Zea mays
  misc_feature (237)..(237): Xaa can be any naturally occurring amino acid
MYAAAPSSSRVAAAAAAFFIVISLSPQLLVRPFGASTTVHWAAAQELDEEDFSYRRNAGNGPARWGLIRREWATCNVGLLQSPIGLSDTLAGLADRSGRLGRSYRPAAASLVNRGHSIMVRFNSNPGGVVIDGVAYRLRQMHWHAPSEHAINGRRYALELQMVHQSDTNRYAVVSQLYRISRRRPDRTIHRLERYIRRIARRKNHEELIDEEVDPRRPVSRSTAYYKYTGSFTTPPXCTEGVTWVVAHQTRRVTRRQVRLLRNAVHDGTRSNRRPLQEANGRAITFYYTSPAHGRGANGD

SEQ ID NO: 76663 - protein, 144 aa, Zea mays
  misc_feature (30)..(30): Xaa can be any naturally occurring amino acid
MESGLVASHRLRVPPPSASAGHHHLIRHRXPTPRWPLRPSASVSRAAAAVPAPGDDASPKFLGVETKTIKKIVPLGLMFFCILFNYTILRDTKDVLVVTAKGSSAEIIPFLKTWVNLPMAVGFMLLYTKLADVLSKEALFYAVI

SEQ ID NO: 76664 - protein, 472 aa, Mycobacterium intracellulare
MSRRGKIVCTLGPATNSDELILALVEAGMDVARLNFSHGDYADHKAAYERVRVASDATGRAVGVLADLQGPKIRLGRFATGPTYWADGETVRITVADCEGSHDRVSTTYKKLAEDAAVGDRVLVDDGKVCLVVDGIEGDDVICTVVEGGPVSNNKGISLPGMNVSAPALSEKDIEDLTFALDLGVDLVALSFVRSPADVELVHEVMDRVGRRVPVIAKLEKPEAVDNLETIVLAFDAIMVARGDLGVELPLEEVPLVQKRAIQMARENAKPVIVATQMLDSMIENSRPTRAEASDVANAVLDGADAVMLSGETSVGKYPMAAVRTMSRIICAVEDNSTAAPPLTHVPRTKRGVISYAARDIGERLDAKALVAFTQSGDTVKRLARLHTPLPLLAFTAWPEVRSQLAMTWGTETFIVPMMTSTGGMIRQVDKSLLELGRYKRGDLVVIVAGAPPGTVGSTNLIHVHRIGEDDV

SEQ ID NO: 76665 - protein, 361 aa, Pyrococcus abyssi GE5
MQAVLLAGGMGTRLLPLTIYRPKPMIPFFNKPLMEYMVNNLVEVGVDEIIVLVGYLKEKIIEHFGDGKEFGVEIKYSNGENVKFGTAGALKRAEKFIEGTFIVASSDVLTNLDFKSLLEFHAKKGGIATMALTKVEDPSPYGVAVLDDEGKILYFKEKPRREEAPSNLVNAGIYVFEPEILDLIPKGKPFDFSLNLFPKMLEEGIPIYGFPFDEYWNDVGRPSTYLQATEDVFLGKLKLPQISVGRLKGNVERGGSLFTGSRCILRNPKVSGFAVLGDNVEIGRDVKIERSVIFSNVTIEDGAEIREAIIGENVYIGKGVTIEPGSVIGDNSIIEEHSRIGANVKIWADSRVGRESIILPD

SEQ ID NO: 76666 - protein, 499 aa, Trametes versicolor
GIGPVADLTITNAAVSPDGFSRQAVVVNGGTPGPLITGNMGDRFQLNVIDNLTNHTMLKSTSIHWHGFFQKGTNWADGPAFINQCPISSGHSFLYDFQVPDQAGTFWYHSHLSTQYCDGLRGPFVVYDPNDPAADLYDVDNDDTVITLVDWYHVAAKLGPAFPLGADATLINGKGRSPSTTTADLSVISVTPGKRYRFRLVSLSCDPNYTFSIDGHNMTIIETDSINTAPLVVDSIQIFAAQRYSFVLEANQAVDNYWIRANPNFGNVGFTGGINSAILRYDGAAAVEPTTTQTTSTAPLNEVNLHPLVATAVPGSPVAGGVDLAINMAFNFNGTNFFINGASFTPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPTYDARDPSDQ

SEQ ID NO: 76667 - protein, 168 aa, Saccharomyces cerevisiae
AVKGLGKPDQVYDGSKIRVGIIHARWNRVIIDALVKGAIERMASLGVEENNIIIETVPGSYELPWGTKRFVDRQAKLGKPLDVVIPIGVLIKGSTMHFEYISDSTTHALMNLQEKVDMPVIFGLLTCMTEEQALARAGIDEAHSMHNHGEDWGAAAVEMAVKFGKNAF

SEQ ID NO: 76668 - protein, 442 aa, Arabidopsis thaliana
MGICFSAEDQHYQFSQQQNYPKKTTPGKKAAVYLMKSDCEDVVGKVSGSGSGGGGLPLAPKNIKDLQSNPGYENVDIFTYEEMKIATKQFRPDYILGEGGFGVVYKGVIDESVRVGFKSTKVAIKELNPEGFQGDREWLAEVNYLGQLSHPNLVKLIGYCCEDDHRLLVYEYMAMGSLEKHLFRRVGCTLTWTKRMKIALDAAKGLAFLHGAERSIIYRDLKTANILLDEGYNAKLSDFGLAKDGPRGDQTHVSTRVMGTYGYAAPEYVMTGHLTSRSDVYGFGVLLLEMLLGKRAMDKSRACREHNLVEWARPLLNHNKKLLRIIDPRMDGQYGTKALMKVAGLAYQCLSQNPKGRPLMNHVVEVLETLKDDGDAQEEVMTNLHSRGKSVTLYEASSDSQGTRDGNGQRRRRPESGRSKSEAAVDTEKYVSTLSEPDTTKI

SEQ ID NO: 76669 - protein, 483 aa, Ehrlichia ruminantium str. Welgevonden
MSIPVTVAYGDGIGPEIMEAVLLILSEAKSGLVIETIELGHNLYKKEWSCGIAPSSWDSIHRTKVLLKSPTMTPQGQGHKSLNVTLRKKLGLYANVRPCISYHPVIKTKYPNLNVVIIRENEEDTYTGIEHRLTGDTYQCLKVITRSGSERICNYAFQYAMTHNRKKVTCLVKDNIMKMTDGIFHKSFSKIAEGYPSIISDHYIVDIGMARVATNPENFDVIVTTNLYGDIISDIVAELSGSIGLAGSANIGDNYAMFEAVHGSAPDIAGKNIANPSGLLSAAIQMLVYLKKFNEAELIHNAFLKTLEDGIHTADIYQDNISKEKVSTMDFAKAVVENFGQSPCHIQKPVLSIMNSTSGTTSVPYVYQPSYSDKILVGVDVTIGCDVIDLNLNQLIVDLRNIKHDQLELVLVHSKGLEIWPDESSTVNLSYVDQICCRFYMKCKSEITNDHVNQLLLELDKKKINVVKMEKLYLYDDQPGFFT

SEQ ID NO: 76670 - protein, 221 aa, Triticum aestivum
MSRRGDWVYENHGGTCVAIAGADYCVVAADTRLSVGYSILTRDHSKICDLADKCVLASSGFQGDIKALHKNLAARELLYQHQHNKRMSCPAMAQLLSNTLYYKRFFPYYAFNVLGGLDSEGKGCVFTYDAVGSYERTGYSAQGTGSTLMMPVLDNQLKSPSPLLLPARDAVTPLSESEAIDLVKDVFASATERDIYTGDKLEIVVINKAGTKREYIELRKD

SEQ ID NO: 76671 - protein, 130 aa, Corynebacterium glutamicum ATCC 13032
MADRIELKGLECFGHHGVFDFEKEQGQPFIVDVTCWMDFDAAGASDDLSDTVDYGALALLVAEIVEGPSRDLIETVATESADAVMAKFDALHAVEVTIHKPKAPIPRTFADVAVVARRSRKSMAAGRSNA

SEQ ID NO: 76672 - protein, 143 aa, Ehrlichia ruminantium str. Welgevonden
MLERTLSILKPDVVKRNIAGQVNSYIENSGLKIIIQKMCLLTRYQAEKFYEIHKSQVFFVPLINFMISGPVVVQVLEGENAISLYREIMGATDPKKANSGTIRGDFAENIDANCVHGSDSLENAIREIRFFFSEYELLSLYEC

SEQ ID NO: 76673 - protein, 578 aa, Lolium perenne
MAMAISSLLRPWPLAMATMMVLIIQAQGITRHYDFNVQMANVTRLCGTKSIVTVNGQFPGPELIAREGDRVHVRVTNHVAHNMSIHWHGIRQLTTGWADGPAYVTQCPIQTGQTYVYKFTVTGQRGTLWWHAHISWFRATVYGAIVILPKLGVPYPFPAPHEEVPVIFGEWWAADTEDIMSKALKVGGAPNISDAYTINGLPGPLYNCSAKDTFKLKVTPGKTYLLRLINAALNDELFFSVANHTLTVVEVDAVYVKPFTVKTLVISPAMTTNVLLTTSPVYPNANFYMAAAPYSVIRPGTYDNTTVAGILEYHKPGSPSTPGLDKTLPLFKPTLPFFNDTKFVTSFTTKLLSLASKQYPAAVAQSVDRRFFFTIGLGTLPSPKNMTCQGPNGTQFAAAVNNVSLVLPSMALLQSHFTGLSRGVYASNSPAMPLSPFNYTGTPPNNTHVATGTRLLSLPYTTSVELVMQDTSVLGIESHPLHLHGYNFFVVGQGFGNYDPTNDPAKFNLVGPVERNTVGVPAGGWVAIRFLADNPSVWFMHCHLEVHTTWGLRMAWPVQTGPKPNEKLLPPPSDMPKC

SEQ ID NO: 76674 - protein, 324 aa, Magnetospirillum magnetotacticum MS-1
MPVVIYPGSGTGAWEATIVNTLSSGDRVLMFETGHFATLWRQMAARWGIEVEFVPGDWRHGVDPALVEAKLAEDRSHAFKAVMVVHNETSTGVTSRIPAIRKAIDAAGHPALLLVDTISSLGSVDYRHDEWGVDVTVSGSQKGLMLPPGLGFTAISDKARAAGRSNTLPRSYWDWEEMLKPNANGYFPYTPATNLLYGLREAVAILLEEGLDAVFARHQRLAAATRAAVEAWGLEVLCRNPDEYSPVLTAVMMPDGKGADAFRALVLEKFDMSLGAGLSKLSDTIFRIGHLGETNDLTLMGALSGVEMGLAAAGVPHRRGGVLA

SEQ ID NO: 76675 - protein, 511 aa, Geobacillus stearothermophilus
MSKKPVALIILDGFALRDETYGNAVAQANKPNFDRYWNEYPHTTLKACGEAVGLPEGQMGNSEVGHLNIGAGRIVYQSLTRINIAIREGEFDRNETFLAAMNHVKQHGTSLHLFGLLSDGGVHSHIHHLYALLRLAAKEGVKRVYIHGFLDGRDVGPQTAPQYIKELQEKIKEYGVGEIATLSGRYYSMDRDKRWDRVEKAYRAMVYGEGPTYRDPLECIEDSYKHGIYDEFVLPSVIVREDGRPVATIQDNDAIIFYNFRPDRAIQISNTFTNEDFREFDRGPKHPKHLFFVCLTHFSETVAGYVAFKPTNLDNTIGEVLSQHGLRQLRIAETEKYPHVTFFMSGGREEEFPGEDRILINSPKVPTYDLKPEMSAYEVTDALLKEIEADKYDAIILNYANPDMVGHSGKLEPTIKAVEAVDECLGKVVDAILAKGGIAIITADHGNADEVLTPDGKPQTAHTTNPVPVIVTKKGIKLRDGGILGDLAPTMLDLLGLPQPKEMTGKSLIVK

SEQ ID NO: 76676 - protein, 482 aa, Prochlorococcus marinus str. MIT 9313
MAAFPIRNICCIGAGYVGGPTMAVIADRCPQIQVTVVDLNEARIEAWNDLDLSKLPVYEPGLDAVVERARGRNLTFSTHVDAAIAAADMVFISVNTPTKTKGLGAGQASDLRWVEACARQVAQSAQGHTIVVEKSTLPVRTAEVVRSILEAAQRQAVDGELPISFSVLSNPEFLAEGTAIRDLESPDRVLIGGENPVAIQSLAEIYGHWVPVEKILLTNLWSSELSKLTANAFLAQRISSINSVAALCERTGADVREVARAIGSDTRIGSKFLQAGPGFGGSCFQKDILNLVYLCRHFGLPDVADYWENVVALNTWQQHRISRLVVQKLFGTVTGKRLALLGFAFKADTNDTREAPAIRIAHDLLEEGAQLAIYDPKVDPQQIAFDLQLSASSPPDVQAGPTRAALSGEGTWWSGTSVADTVAGADAALILTEWHEFRQLDWVTLAPLMRQPAWVFDARAVVDPEVVKSSGLMLWRVGDGAV

SEQ ID NO: 76677 - protein, 937 aa, Oryza sativa
MLKQKDLMVISYSCSAGTKLTWILSLLLILVAATQVHGVSPPGFLNVDCGLTNRSTYNDTDTTLTYVSDREFVESGKSYDIMAQYMADATNEQEKTLRSFPDGQRNCYTLPTNSSKKYLIRATFTYGNYDGLNSSEKGSLFIFGLHIGVNFWTTVNLTKWDPSSTVWKEVITVAPDKSVSVCLINMGSGTPFISTLDLRPLQDTMYPFVNASTSVSYFSRIRFGSVDEYITRFPTDQYDRFWEGWVFTMHTFPWVNKSSNGKVAELPNIDTFGLPPAILGSASTINGNFSWLNISVSASNSLATDLELLPVFHFVELGNNGSKRIFDIYNVDEPQALFSNFSPPSFLSSMFHNWFLRKGRRAYFQLRKTPDSQLPPLINAYEVYSRVQVENFTTASSDVDSMKTIKEKYMVIKNWNGDPCSPREYIWNGLTCTYPNGGQNPRIVEINLSGSGLQGELEISFMKMSSLKKLDLSHNNLTGTIPDYQVNSLTVIDLSNNQLNGSIPDSILQRYKAGLLELRLEGNPICSKVRASYCGNKKNTRTRILLISVLVPVTSLLVVLFIFWRLCWKGKSRKSEEEDYDMYEEETPLHIDIRRFTYAELKLITNNFQSIIGKGGFGTVYHGILENNDEVAVKVLVETSIAESKDFLPEVQTLSKVHHKNLVALVGYCQNKKCLALVYDFMPRGNLQQLLRGGYDSLNWEERLHIALDAAQGLEYLHESCTPSIVHRDVKTPNILLDKNLVAKISDFGLSRAFNAAHTHISTVAAGTLGYLDPEYHATFQLTVKTDVYSFGIVLLEIVTGQPPVFMDPQTVHLPNWVRQKIANGSVHDVVDKKLLDQYDATHLQTVIDLAMNCLENASIDRPSMTEVVSVLKVCLPISSERQSATSTPRKKNVMDAEIPRQFQLMISGASTTSYEGSSFQSGYTGGVSEISHISGR

SEQ ID NO: 76678 - protein, 236 aa, Gloeothece sp. KO68DGA
MFGSLPVRERRGSPSEASISEPRTSRPNLFQSLRQDFQIIFERDPAARNWLEVVCCYPGLHALAIHRISHKLWHHNIPFIPRFLSHIARLFTGIEIHPGAAIGQGVFIDHGMGVVIGETAIVGDYCLIYQNVTLGGTGKETGKRHPTVGNHVIVGAGAKVLGNLDIGNHVRIGAGSIVLRSVPSDCTVVGVPGRIISRSGRGCPLEHGKLPDVEGQIIRTLLDRIEELEQKIQKLH

SEQ ID NO: 76679 - protein, 348 aa, Prochlorococcus marinus str. MIT 9313
MAELLITGGAGFIGSHTCLVLLEAGHRLVILDNFSNSSAIASKRVAELAGVAAQERMLVLEGDIRNSNDLDRAFNSMENGIAAVVHFAGLKAVHESVQLPLKYWDVNVAGSRCLLEAMQRHNCRTIVFSSSATLYGYPEQIPIPETTRVQPINPYGQSKAAVEQLLDDLACSEPGWRIARLRYFNPVGAHSSGCIGEDPKGIPNNLFPFVSQVAVGRRAELQVFGADWPTPDGSGVRDYIHVMDLAEGHRAALEVLQREEPQLLTLNLGSGKGHSVLEVVQAFEKASGQPVPYSINQRRAGDAACSVADPRLAAERLGWYTQRSLSDMCRDSWNWQKANPQGYSQKQQ

SEQ ID NO: 76680 - protein, 281 aa, Oryza sativa Indica Group
MEQVVNAVLDLVVPPASMVMLAFAWPTLSFLRGVEWVVKTLTVENMQNKVVLITGASSAIGEQIAYEYARRNANLVLVARREHRLFAVRENARALGAGQVLVIAADVVKEDDCRRLVGDTISFFGQLNHLVNTVSLGHDFCFEEAGDTVAFPHLMAAKAAVIDFYESLRYEVGDEFKPRDGNLPRGAGDPPSTRPYGAGGGYKFHPAGPSGRGPGIMRGRGRVAIPTRGYLRGPEVCSPVDKNYEKEAHKGLNYISTCVYVYLGIRLPRMHITTNCAFVIY

SEQ ID NO: 76681 - protein, 947 aa, Pneumocystis carinii
MILKILLTLTLYWIYLVRVRCETVPVDFENNDYYHFHFSEDVDIEEFSRAIGFKYHMKVEYLDNHHIFFIEKSVLEDEIKEKIENYFSLEKGRNAINGFNSDKLFYYEKQKLVKRENRALIRDDIYFDNQDLYNDEVVNNVVKDPMGDQAEKPTENQAENRAENLTQKLEEIKKQLNISDPCFDKQWYLFNTKDPGVDINVTGVWLQGITGKNVTVAIADDGLDYTNQDLAPNYNANASYDFDSKDFNPKPEKPDESHATKCAGEVAAARNTLCGLGVAYESNISGIRFLSSSHAFILEKDAVSYKPDVNHIYSCSWGPSDNGDVAMPMFPTTYSAIIKGIKEGRNGLGSIYVFGSGNGGHFDDCNYDGYANSPYTVTIASIDSEDKNLYFSESCPCILASTYSGGEKGYIYTTDVGTTNCTTEHSGTSASTAIAAGIIALISPNLTWRDVQALIVETAVPFNMKEYEWDKLHSGRYYNNFFGYGKLDAYRMVEKAKTFKTLNAQTMFSTQLIHVNMKFPEPSRRITSSFYIHRGYPKHYNFKSLEYVGVSFYYKHRIRGSLEFKITSPSGVTSKLTRVRFRDNKSGTFRWIFTTVKHWGEGIVGKWTIDVRDKNMWDEQGYIFNWQLHFFGESIDSNKVPVLSYPFTHKQPTTTPPPDPDATPPPDPDANLQPDSNADPQPQPDVKPLPSSDLEPQPSSDPGSPPSSDSESPPSSEPGYQPPSKPGPQPPSEPPPQPPLDPRPPSKPYPNPPSDPSSQQDPDTSLSSNLTSTSSSEPPPLPPPPPPAPTPPPPAPTPAPPPPPPPPPSRPEPQPQPRPEPQPQPPKPPQPEPPAPPPKPQPEPPAPPPKPQPEPPAPPPKPQPEQKPTSITSSTSTTSSSKTKISTIRKASSTKTSSTTKTSTRPSPTKGTSTGSGASHLSFFEKRHLLLQMILLLFFFLFLGYSF

SEQ ID NO: 76682 - protein, 400 aa, Gloeothece sp. KO68DGA
MRDCIYLDNNATTQIDEEVLGAMMPYLTLYYGNPSSMHTFGGQVGKAVKTAREQVASLLGAEASEIIFTSCGTEGDNAAIRAALTAQPNKRHIVTTEVEHPAVLNLCRHLEKQGYTVTYLSVNSQGRLDLDEVQASLTGNTALVSIMYANNETGVVFPVEQVGQIAKEYGALFHVDAVQAVGKIPLDMSNSTIDMLTLSGHKIHAPKGIGALYVRKGVRFRPLMVGGHQERGRRGGTENVAGIVALGKAAELAQSHLENIAYERQLRDYLEHSILTLIPDTVVNGHPTERLPNTTNIGFKYIEGEAILLSMNQYGICASSGSACTSGSLEPSHVLRAMGLPYSVLHGSIRFSLSRFTTQDEIDRVIEVLPDTITRLRAMSPFSSDDATWLQEQEKAALAK

SEQ ID NO: 76683 - protein, 301 aa, Picea sitchensis
MVVAEQKQQQRQLDSTPLRLALTCASAIVAETSTFPIDTTKTRLQLRIESSSALKRQGSLQTALGIARQEGITALYKGLPPALVRHTFYTTIRIFSYEQLRDTAASGHQENPLSLLSKALIGGLSGIIGQVVASPADLIKVRMQADGRMVNPRYSGLADAFAKIVRAEGVAGLWRGVLPNVQRAFLVNMGELACYDQAKRAIVGRGICGDNVVAHTLASMMSGLSATALSCPADVVKTRMMNQAGEEYRGSVDCLVKTVRKEGVMALWKGFFPTWARLGPWQFVFWVSYEEFRSIAGLSSF

SEQ ID NO: 76684 - protein, 293 aa, Gloeothece sp. KO68DGA
MWEYTDKVMEFFYNPRNQGTITEKGEGQAITTGEVGSIACGDALRLHLKVDEKTEIILDARFQTFGCASAIASSSALTELLVGKTLDEALSLTNKEIAEFLGGLPEEKMHCSVMGQEALEAAIFNYRGIPLDNHEDDEGALICRCFGVSDTRIRRIVLENNLTTAEQVTNYVKAGGGCGSCLADIDDLIAEVMHERETAVAVATEVVKAKSEPKPLTNIQKITLIQQVLEEEVKPALAQDGGDCDLFDVDGDLVKVVLKGACGSCASSTQTLKIAIEARLRDRISPELTVIAV

SEQ ID NO: 76685 - protein, 462 aa, Mesembryanthemum crystallinum
MGEQELLLQQQIKEDRNVSRETEMKHPALQGKYELGRVLGQGTFARVYHARNLVTGNSLAIKVVAKDKVIKVGMMEQMKREISVMKRVKHPNIVQLHEVMASKSKIYLAMDLVRGGELFSKVSKGGKLDEDVARSYFKQLISAVDFCHSRGVYHRDLKPENLLLDEHGNLKITDFGLSASFENEDHHQTLLRTSCGTPHYVAPEVISRKGQQGYHGAKSDIWSCGIILFVLLAGFLPFHDDNIIRMYRKVFKGDFTCPSWLSSQARDLITRLLDINPATRITVSEIMQSDWYCMDTSSMTAVTTDEFDLDHNNNNNNNSNYNNIHHHKKEPEMLNAFHIISLSQGFDLSPLFEEKHREERQDMRFATTKSASTVVSRLEEVAAKAGKFIVKKFCGDSVVRLQGQERGRKGKLAIAAEIMSVSPSLLVVEVKKDNGDTLEYNQFCTKQLRPALKDIVWTCPSS

SEQ ID NO: 76686 - protein, 233 aa, Picea sitchensis
MEACGEEGQVKLLGNTRSSFVVRVRIALALKGIHYEFIEENTPTKSQLLLQSNPVHKKIPVLIHNGRPVCESMIIVQYIEETWDTKAPNLMPKDPYDRAIARFWTAFVEDKLVLSILGVFNGHGEQQLKAAEESVANFLLLEEVLQTTGKAYFGGDEIGLVDISLGGILVFTKTLEKVTNIVLIDTDKMPQLSAWVDRFSNADGVKEVLPDRGEIFELITGWRAKLTSPPAGN

SEQ ID NO: 76687 - protein, 197 aa, Vibrio fischeri ES114
MNECKKHKVWECIVREAREQSEQEPMLASFYHATIIKHENLAAALSYILANKLATASMPAMAVREVVEEAFASDPTITDAAACDICATVTRDPAVSMYSMPLLYLKGYHALQGYRVSNWLWKQGRVALATYLQNEISVACQVDVHPAATIGKGIMFDHATGIVIGETAVVENDVSILQDVTLGGTGKECGDCHPKIP

SEQ ID NO: 76688 - protein, 443 aa, Rhodospirillum rubrum ATCC 11170
MKQILALNAFDMSDAPTLSDSAQRLLAKRKALFGAASVLFYDKPLELVRAEGCWLFDEAGERYLDVYNNVPSVGHCHPHVVAAVADQLAKINTHTRYLNEAIHRYAERLVATLPPSLSNITFTCTGSESNDLALRLASHYSGGRGVIVTETAYHGNTAAVTEVSPSSARDHALAPHVRVVRAPDSYRVAPEALAARFAGDVAAAIADLADHGITLSALLVDSIFSSDGVYADPAGFLAEAVAVVHRHGGLFIADEVQPGFGRTGSALWGFQRHGVTPDIVTMGKPMGNGLPMGGVATRPEILDAFCAEVGYFNTFGGSPAAGAAGSAVLDVIEGEGLMANAEAVGAYLRESLGALAKRFPVIGDVRGAGLFDAVELVSDPEAKTPSPELASAIINGLRQRHVLIGAAGPFGNILKVRPPLCFTRDQVDILGAALEEVLTEIAP

SEQ ID NO: 76689 - protein, 343 aa, Vibrio fischeri ES114
MVTMTTQTDYSDISMTVLGAGSYGTSLAISLARNGAKVILWGHEEAHMNRLEADRANEEFLPGVAFPPSLIMSTDLEKSVQASRDLLVVVPSHVFGLVLGNVKPFLRDDSRICWATKGLEPETGRLLKEVAVEALGESHSLAVLSGPTFAKELASGMPTAIAVASPDKEFVKDLQEKIHCSKTFRVYANNDFTGMQLGGAVKNVIAIGAGMSDGIGFGANARTALITRGLAEMTRLGVALGAEAETFMGMAGLGDLVLTCTDNQSRNRRFGLALGQGGDVDSAQEEIGQVVEGYRNTKEVWLLANRMGVEMPIVEQIYQVLYQGKDARVAAQDLLARDKKSES

SEQ ID NO: 76690 - protein, 211 aa, Zea mays
MKPAVEAEADERAAEEMAPKKAAAAKKAAEEVEVEEVVDGDEAVDGEGDGDEDDDGEGGDEEDDDEEVDGEEKEAAGVVEISDEDDDDGDGEADDDDDDDGDDDDDDDEDSDDEEEVDGEDDQEEELGTEYLVQPLGRAEDEEHSSDFEPEENGEGADDEEIDEEDDDGEDSVKAQTSTKRKRSGDEEEEDDDDGDDDGDDDDDGRPPSKR

SEQ ID NO: 76691 - protein, 259 aa, Nitrosomonas europaea ATCC 19718
MIWPSVDMASIHIETTGNGPDLVMLHGWAMHSGVWDGVVESLSQRFRLHQVDLPGHGASRDCALDSLDQMTEVIADRLPGRYSVCGWSLGGQVAIRLALQAPERVQQLVLVASTPCFVRRADWPWGMEDSTLTLFMENLARDYTQTLNRFLTLQVSGSEDQARVLAWLRKSILRGQPPTPATLQAGLKILQTSDLRAELNQVSQPVLLIHGRNDVITPAGAADWMQQHLPRARLVLFPHCGHAPFLSFPEQFVSCFDAL

SEQ ID NO: 76692 - protein, 331 aa, Herminiimonas arsenicoxydans
MNITILGAGAWGTALAMSLADRHSVMLWGRDAAVMQEAEQRRENTVYLPGFRLPDSLSLSSDFSAAIAHVGTDGLLLVATSLAGLRPLAMQLQPYAIPNIVWLCKGFEADTHLLPHQIVREVLGNDIPAGALSGPSFAQEVAQGLPCALAIASDNAALRELVVSAVHGPSMRIYSTDDVIGVEVGGAVKNILAIATGIIDGLKLGMNARAALITRGLVEITRFGVALGGRTETFMGLAGMGDLILTCTGDLSRNRKVGLGLAQGKKLEQIVTELGHVAEGVRCAQAVRSLAAERGIDMPITNAVAAVLFDGDLPREMVGRLLARDARNEMA

SEQ ID NO: 76693 - protein, 312 aa, Vitis vinifera
  misc_feature (274)..(274): Xaa can be any naturally occurring amino acid
MATASLGSSTLQSQINGFGVNKLQRSSLFQPTSFTFSRRKFSSTVKASARVDKFSKSDIIVSPSILSANFAKLGEQVKAVELAGCDWIHVDVMDGRFVPNITIGPLIVGALRPVTDLPLDVHLMIVEPEQRVPDFIKAGADIVSVHCEQSSTIHLHRTINQIKSLGAKAGVVLNPATPLSTIEYVLDVVDLVLIMSVNPGFGGQSFIESQVKKISDLRRICAEKGVNPWIEVDGGVGPANAYKVIEAGANALVAGSAVFGAKDYAEGMDSVNLXESERDVTCPSREQHIDIFMYCQMSWYFLVDLSGLGDGT

SEQ ID NO: 76694 - protein, 343 aa, Arabidopsis thaliana
MMEVEGSMNRAPDQSSFLRSRRSKALYQFKQQKLPACKPVLTPISVITVFMLMGFVFIPIGLITLRASRDAIEIIDRYDVECIPEEYRTNKLLYITDSSIPKNCTRYLKVQKYMKAPIFIYYQLDNYYQNHRRYVKSRSDQQLLHGLEYSHTSSCEPEESSNGLPIVPCGLIAWSMFNDTFTFSRERTKLNVSRNNIAWKSDREHKFGKNVYPINFQNGTLIGGAKLDPKIPLSDQEDFIVWMRAAALLSFRKLYGGIEEDLEPGKVVEVNLMNNYNTYSFSGQKKLILSTSNWLGGRNDFLGITYLVVGSSSIVISIIFMLLHLKNPRPYGDNSWNKKSLSS

SEQ ID NO: 76695 - protein, 396 aa, Candida albicans SC5314
MNFLRKRRSSEDEDDDDILNNDPTSSIHKSRKPPNTAFRQQRLKAWQPILTPKSVIPLLILIAIIFTPLGIAIIYTTYNVQDLIVDYSKCNEASNSYENIPNKYTRYHFRGHSANPNFQWRFENNNTCVIQFNLAQDLKGPVYLYYKLTNFYQNHRKYVESYDLEQLRGEALSSDDVTDNCKPLKHRVYNGEEKLIYPCGLIANSYFNDTISNPVLLNTRNGDNNETYIFSDKGISWPSDRSHKFKKTQYSPDEVVPPPNWDEMYPNGYTKDNMPDLQTWEHLQNWMRTAALPSFYKLYGQNTTQSMSSGIYQISIKMNYPVEIFGGSKSIVITTNTIFGGRNMSLGVIYIIVAVVALVLGIAFLLQYLIKPRKMGDHDYLQDSNGGDITTYRDQL

SEQ ID NO: 76696 - protein, 343 aa, Petunia x hybrida
YAGGFTLEYIEAVTQNYRTLIGEGGFGSVYRGTLPDGEEVAVKVRSATSTQGIREFNNELNLLSAITHENLVPLLGYCCENDQQILVYPFMSNGSLQDRLYGAAAKRKTLDWPARLSIALGAARGLLYLHTFSERSLIHRDVKSSNILLDQSMCAEVADFGFSKYASQEGDSGTSLEVRGTAGYLDPEYYSTQHLSAKSDVFSFGVVLLELLTGREPLNINRPRNEWSLVEWAKPLIRNSRVEEIVDPAIKGGYHGEALWRVVEVALSCTETYSTYRPCMADIVRELEDALIIENNASEYLKSLDSFGGSHRFSIERSIVLPPIKSQIEPSSLLSEPAPPQPR

SEQ ID NO: 76697 - protein, 498 aa, Oryza sativa Japonica Group
MSRRHARPLLPLLRRHLHRSATVHRSPAPAPPDGIPSSSSAPPDPAAARWPSSWSPAAPPLHSFAASHLREAVSPIAAAILALPGVDPDPLPALVEHNFPTLLAVSPLASLELLSLLRPNPQLGLAVFSSRRTLSPPATLPEFVLAISLAGRARDPAAAARLFAEASTAYCPDQALYNALMSSYMHSGLADRCIEAFHTLERDPRCGPPNADSYNILIALFGRSLLVDHMEATLLSLDASGHPRTIGTYNAIIAGYLTAWMWEKMESVFDEMVSGHVAPDKTTYLLMLRGYAHAGMIYKMELAYERARQHVGQVDMVHIRAMICAYCKFKHVDRIQKIEELLQKLGPDDYRPWLAVLLIRAYAQEGLVERMEQWIAEALERNTIVTTVQVMRSIITSYFQCDAVDKLAHFIRQAEEAGWKLCRSLYHCKMVMYGKQHRLPEMHGVLDEMEFFRFDRTKKTFWIMYKAYVSSGRMAEANTILCMMGKHGFGFPRGGYIQ

SEQ ID NO: 76698 - protein, 158 aa, Corynebacterium glutamicum ATCC 13032
MSIEVTVEIPKGSRNKYEIDHETGKVYLDRYLFTPMAYPLDYGYIDHTLGEDGDPLDALVILPESVFPAVVVKSRIIGVFKMTDEAGGDDKLLSVLDDPRYDHIQDISDVSDFLKDEIEHFFVHYKDLEKGKHVDGSGWGDKAEAEKIHAEAIDRYKA

SEQ ID NO: 76699 - protein, 279 aa, Oryza sativa Japonica Group
MEKPEWSMDDFEIGKYIGEGKFGKVYLAREKQSGYVVALKVTFKAKLDKYRFHAHLRREIEIQHGLDHPNVLRLFAWFHDAERVVLVLEYAARGELYKLLRTVRRFSERTAATYVASLAGALAYCHKKQVIHRDIKPENLLLDIEGRLKIADFGWAVRSNAKRHTLCGTIDYLAPEMIEKKAHDHAVDNWTLGILCYEFLYGSPPFEAAEQDDTLRRIVKVDLSFPSTPYVSADAKDLICKLLVKDSNKRLSLDDIMKHPWIVKNADPSGSCSDQKART

SEQ ID NO: 76700 - protein, 471 aa, Oryza sativa Japonica Group
MARFILSLLELGVSATVHLLFGLYVFSTAVAADISQAAAASGCLLLRRPAAPGLVNVAAAGEEEERRGAAPVVLDGSPPPIVLVHGIFGFGKGRLGGLSYFAGAEKKDDRVLVPDLGSLTSIHDRARELFYYLKGGQVDYGEEHSKVFGHTRFGRTYDTGHYPVWDEQNPVHFVGHSAGVQVVRVLHQMLADKAFPGHDTSEDWVLSLTSLSGALNGTTRTYYDGMLAEDGRSMKSICLLQLCRIGVIVYDWLDIPWLKNYYNFGFDHFEMSWRKVGLSGLIDLLLGHTGPFASGDWILPDLTIQGSLTLNSTLRTFPNTFYFSYATKRTRKLFGITVPSSVLGIHPMLFLRVLQMCMWRHPQNAPLPYKGYRDEDWEDNDGALNTISMTHPRIPTEHPNRLVVDDSDCHPLQPGIWYYKIIEADHILFIVNRERAGVQFDLLYDGIFQRCRKHAFRRSPPTVPNESSQSQ

SEQ ID NO: 76701 - protein, 170 aa, Haemophilus influenzae
  misc_feature (1)..(1): Xaa can be any naturally occurring amino acid
  misc_feature (69)..(69): Xaa can be any naturally occurring amino acid
  misc_feature (108)..(108): Xaa can be any naturally occurring amino acid
  misc_feature (115)..(115): Xaa can be any naturally occurring amino acid
XSLIRIGHGFDVHAFGEDRPLIIGGVEVPYHTGFIAHSDGDVALHALTDAILGAAALGDIGKLFPDTDXQYKNADSRGLLREAFRQVQEKGYKIGNVDITIIAQAPKXRPHIDAXRAKIAEDLQCDIEQVNVKATTTEKLGFTGRQEGIACEAVALLIRQEGGSHHHHHH

SEQ ID NO: 76702 - protein, 720 aa, Oryza sativa Japonica Group
MALTTFSISRGGFVGALPQEGHFAPAAAELSLHKLQSRPHKARRRSSSSISASLSTEREAAEYHSQRPPTPLLDTVNYPIHMKNLSLKELQQLADELRSDVIFHVSKTGGHLGSSLGVVELTVALHYVFNTPQDKILWDVGHQSYPHKILTGRRDKMPTMRQTNGLSGFTKRSESEYDSFGTGHSSTTISAALGMAVGRDLKGGKNNVVAVIGDGAMTAGQAYEAMNNAGYLDSDMIVILNDNKQVSLPTATLDGPAPPVGALSSALSKLQSSRPLRELREVAKGVTKQIGGSVHELAAKVDEYARGMISGSGSTLFEELGLYYIGPVDGHNIDDLITILREVKSTKTTGPVLIHVVTEKGRGYPYAERAADKYHGVAKFDPATGKQFKSPAKTLSYTNYFAEALIAEAEQDNRVVAIHAAMGGGTGLNYFLRRFPNRCFDVGIAEQHAVTFAAGLACEGLKPFCAIYSSFLQRGYDQVVHDVDLQKLPVRFAMDRAGLVGADGPTHCGAFDVTYMACLPNMVVMAPSDEAELCHMVATAAAIDDRPSCFRYPRGNGIGVPLPPNYKGVPLEVGKGRVLLEGERVALLGYGSAVQYCLAAASLVERHGLKVTVADARFCKPLDQTLIRRLASSHEVLLTVEEGSIGGFGSHVAQFMALDGLLDGKLKWRPLVLPDRYIDHGSPADQLAEAGLTPSHIAATVFNVLGQAREALAIMTVPNA

SEQ ID NO: 76703 - protein, 481 aa, Sorghum bicolor
MSMHYLAALSVTLLGAILLRWAFKWMNYGRTGGEEGMLLPPGSRGLPFLGETLEFFAASPTLELVPFFKRRLERFGPIFRTNIVGEDMIVSLDPELNARVLQQEERGFQIWYPSSFMRILGADNMVSMLGPLHRHIRNLVLRLFGPEALRLVLLRDVQRSARDELRSWLDRPEVEVRTATSRMIFGVTAKKLISHDDVASGGSLWKCFDAWTKGLMSFPICVPGTAFYRCMQGRKNVMKVLKQQLDERRNGAERKTVDFFDLVIDELDKPNSIMSESIALNLLFLLLFASHETTSMGLTVILKFLTDNPKSLQELTEEHEKIMERRVDPDSDITWEEYKSMKFTSHVIHESLRLANIAPVVFRQANQDVHIKGYTIPEGSKIMICPSAAHLNSKVYEDPLAFNPWRWKDTPEPVGGSKDFMAFGGGLRLCVGAEFAKLQMAMFLHYLVTNYRWKALSKGTMMLYPGLRFPDGFHIQLHKKT

SEQ ID NO: 76704 - protein, 324 aa, Frankia sp. EAN1pec
MGYQTENRRNLMLFAGRSHPELAAEVARALDVQPVPTNAYEFASGEIFVRFEESVRGCDAFVLQCHTAPVNTWLMEQLIMVDALKRASAKRITVVAPFYPYARQDKKHRGREPISARLVADLFKTAGAHRLMSVDLHTAQIQGFFDGPVDHLFALPLLADYIESKLDTSEVTVVAPDSGRVRVAERWTDRLGCPLAIIHKRRDPNVPNQVKMFDVVGEVRGRTCVIVDDMIDTAGTITKAAESLKEHGATDVIAAATHGVLSGPAADRLKNSEISEVVLTNTLPLPSEARIDKITELSIAPLIAAAIKAVFEDGSVTGLFGGDA

SEQ ID NO: 76705 - protein, 321 aa, Gloeobacter violaceus PCC 7421
MTQKYGPKTTTDEVLSGIELKGKRFLITGASSGIGLETARSLVSHGASVVGAVRNLAKAEPATASVRDAASQGGSLELINLDLASLQSVRACADKLLADGQPFDAIIANAGVMATPFGRTIDGFEVQFGTNHLGHFALINQIEPLLANDGRLVVLSSLAHRGADIDLDDPNFEQQAYDPWVAYSRSKTANSLFAVEFDRRYRDRGIRAASVMPGNSLTDLPRHLSPEDLQGLLQTVDAARTEAGLPPKELKEISQAAATSVWAAVVANKDEIGGHYLEDCAVVPIDDTPNPFADGVRSYALDANRAKQLWAKSEELISAAS

SEQ ID NO: 76706 - protein, 363 aa, Anthurium andraeanum
MATEVMTAVPAGSRVESLASSGIQAIPLEYVRPAEERVSLTDALEAARRAEDGPQIPTVDVAGFSSGDEAARRACAEAVRRAATDWGVMHVVNHGIPLELIRRMQAAGEAFFALPIEEKEKYANDQSSGNIQGYGSKLANNASGQLEWQDYFFHLIFPEDKADFSIWPKQPANYVEETREFGRQLRVVASKMLAMLSLGLGVEEGKLEAEVGGIEDLLLQMKINYYPRCPQPELAVGVEAHTDVSALSFILHNMVPGLQVHNEGQWVTARCVPDSIIMHVGDVVEILSNGQYKSILHRGLVNKEKVRVSWAVFCEPPRDKILLQPLPDILGQGRPAQFPPRTFSQHIQHKLFRKTQGDFATPN

SEQ ID NO: 76707 - protein, 165 aa, Fulvimarina pelagi HTCC2506
MRQAYPDAHDHSETTSMSAKLHVLIVEARFYDDIADKLLAGAKAELEKNEVTYDVVTVPGALEAPAAISYALAGADEDGTDYDGFVVLGCVIRGETYHFEIVANESAHGLMKLSIEETIAIGNGILTVENEEQALERADPDRKDKGGGAARTVLEMIALRDRLGA

SEQ ID NO: 76708 - protein, 465 aa, Neisseria meningitidis Z2491
MSQGKIVQIIGAVVDVEFPRDMIPRVYDALKLDENGLTLEVQQLLGDGVVRTIAMGSSDGLKRGMTVSNTGAPITVPVGKGTLGRIVDVLGTPVDEAGPIDTDKSRAIHQAAPKFDELSSTTELLETGIKVIDLLCPFAKGGKVGLFGGAGVGKTVNMMELINNIAKAHSGLSVFAGVGERTREGNDFYHEMKDSNVLDKVAMVYGQMNEPPGNRLRVALTGLTMAEYFRDEKDENGKGRDVLFFVDNIYRYTLAGTEVSALLGRMPSAVGYQPTLAEEMGCLQERITSTQTGSITSIQAVYVPADDLTDPSPATTFAHLDATVVLSRDIASLGIYPAVDPLDSTSRQLDPMVLGQEHYDVARGVQSTLQKYKELRDIIAILGMDELSDEDKLTVMRARKIQRFLSQPFHVAEVFTGSPGKYVALRDTIAGFKAILNGEYDYLPEQAFYMVGSIEEAVEKAKTLN

SEQ ID NO: 76709 - protein, 454 aa, Oryza sativa
  misc_feature (147)..(147): Xaa can be any naturally occurring amino acid
MPVSRMMMESNTMAKEMAVRHHLLPGSPRRRTAHNLSSSSLRKSSDASLLHKVPCAALRSLLANLNDVLLTTRLFLLFPAVLLAIAATYLHFGQVWVFVLSLIGLVPLAERLSFLTEQIAFYTGPTVGGLLNATFGNVTEVIIALLXALREGKIEVVKCSLLGSILSNLLLVLGTSLFLAGIANLRAHQPYDTKQAHVNTALLMLAVLCHSLPLMLRYAVTSGDHAIVSGDAALHLSRACSILMLIAYLAYLFFQLNTHRQLFEPQQVEDDDDDDLVIAQDDEPVLGFSSAMIWLALMTLLTALLSGYVVSTIEAASESWELSVSFISIILLPIVGNAAEHAGAVIFALKNKMDITLGVSLGSATQISMFVVPVSVIVAWTMGIPMDLDFNLLETGSLFLAILVTAFTLQEGESHYLKGLILVLCYAVISVCFFVIRRRSAGGTDGVHHLDVIV

SEQ ID NO: 76710 - protein, 248 aa, Herminiimonas arsenicoxydans
MYKIVLMRHGESTWNLDNRFTGWADVDLTEKGCAEAKHAGKLLRDAGFTFDLAYSSVLKRAIRTMWITLDEMDLMWIPVVCDWHLNERHYGALQGMNKAETASKYGADQVLQWRRSYDTPPKLLAEDDPRTMYKDPRYATLKREEIPLGECLKDTLLRVEPYWNDTIVPSIRAGRQIIISAHGNSLRALIKILDDISDQDIVSLSIPNGRPIVYELDDNLKPIRHYYLGDQESLAAAVQAAASHGPVP

SEQ ID NO: 76711 - protein, 359 aa, Bradyrhizobium sp. BTAi1
MSSTNSLHIAVLPGDGIGPEVMAPALEVLRKVEAKAGLAFRFTEAQAGAGNYLATGVSIAESTIRLCEQADAILLGACGLPSVRYPDNTEIAPQIELRFHFDLYAGVRPARLIPGVPSPIVGAAERGIDFVVIRESTEGLFASMGKGVVTHEEARETLVITRKTSERLFNFSFKLAERRRARGRSGILGCVDKANVFKAFAYFRKIFDEVAELHPNVKAERLYIDACALMLVKRPWDFDVLVTENMFGDILSDLAAGLIGGMGMAPSADIGDRHAVFQPCHGTAPDIMGQGKANPTAMILSAAMMLDWLADTRGIEGAAEAAQRIEQAVDKVYASGLKPFEFGGSAGTLEVTKAVLEAL

SEQ ID NO: 76712 - protein, 222 aa, Triticum aestivum
  misc_feature (13)..(13): Xaa can be any naturally occurring amino acid
  misc_feature (122)..(122): Xaa can be any naturally occurring amino acid
  misc_feature (177)..(177): Xaa can be any naturally occurring amino acid
RPNIRGPISYETXNWGFARSILEMFSGIQPWRAKSSDEIYQSAVVKKEKQIFPYNLHTEVENVLSGCFEYDFRDRSLMSYILQSFESAQDVDCNNTGWDSYENPRPTQPSRTNWSHFKDMLXIGDMVRSRKLKSSCTPETMEIPYVTMVGLEEEERASYILVQLHGLQDPVKVPSSXGDWVRLREEDKKRSQVGILHSIDRNGTMCAGLIAMDTLRKGGYSS

SEQ ID NO: 76713 - protein, 263 aa, Herminiimonas arsenicoxydans
MTDQESRITPGLFMNDQQLLRYSRHILLDEIDIEGQEKLLAAHALIIGAGGLGSPAAFYLASAGIGTITLVDDDTVDLTNLQRQILHTTERVGQAKVVSGQKTLAEINPTIEIIALQERVSGERLDELVRNASVVLDCCDNFATRHAINRACVANRVPLVSGAAIKFDGQVSVFDTRSDKAPCYACLFPEDQQFEEVNCGTMGVFAPLVGIIGSTQAAEALKLVAGIGASLTGRLLLLDARTMEWSSIKIARNASCSVCGQAH

SEQ ID NO: 76714 - protein, 333 aa, Vibrio fischeri ES114
MKIKVGINGFGRIGRLALRAAFDWPELEFVQINDAAGDAHTLAHLLEFDSVQGRWHHEVISNGSDMIIAGQTLKTTQEKDIDAVDWSGCDVVIEATGVHRKRVFLDKYLAQGVKRVVVSAPVKEEGVVNIVVGVNDDIFDPAVHQIVTAASCTTNCLAPIVKVINKGLGIENAAFTTIHDLTNTQTILDAPHKDLRRARACGMSLIPTTTGSAKAIVEIFPELKDKIDGHAVRVPLANASLTDIIFEVKRDTTVEEVNQLLKDAAQGDLKGILGYEERPLVSIDYKGDQRSTIVDAPSTMLVGKRMVKIYAWYDNEMGYATRTAELVRNVGLA

SEQ ID NO: 76715 - protein, 129 aa, Glycine max
  misc_feature (44)..(44): Xaa can be any naturally occurring amino acid
  misc_feature (115)..(115): Xaa can be any naturally occurring amino acid
  misc_feature (120)..(120): Xaa can be any naturally occurring amino acid
FIRQRPLVPREASDAAPPAPWASDSATTPLFQRKKTNGDHGASXSSSSPAFMQQQQLAVQQDSYMQSRAEALQNVESTIHELSNIFTQLATMVSQQGELAIRIDENMEETVANVXGAQGXLLKYLNSIS

SEQ ID NO: 76716 - protein, 186 aa, Oryza sativa Japonica Group
MEHGEISSKAPLVAPVAAGVNRAVAVVDTFLRFIAIIGTIGSAIAMGTTNETLPFFTQFIQFEAKYSDLPSFTFFVAANAVVCTYLVLSIPLSIVHILRPRARYSRLFLVFFDTAMLALLTAGASAAAAIVYLAHKGNVRANWFSICQQFDSFCERISGSLIGSFAAMVLLVVLITLSAFALARRH

SEQ ID NO: 76717 - protein, 235 aa, Oryza brachyantha
MCGIKQEVSGESPCSSPERQQTVWTAPPKRPAGRTKFRETRHPVYRGVRRRGNAGRWVCEVRVPGRRGCRLWLGTFDTAEGAARAHDAAMLAIAGDGGCCLNFADSAWRLAVPRSYRSLADVRHAVAEAVEDFLHRGRPAALLSDDADAMSATSSSSPSSPHTDDDESVATDGDESSPATDLAFELDVLSDMGWDLYYASLAQGMLMEPPSAAAAAAFGDIDTDANLADVALWSY

SEQ ID NO: 76718 - protein, 82 aa, Oryza sativa Japonica Group
MIIPVRCFTCGKVSLVSPSHASRLGDGRVLVIGNKGDLYLDLLQADYTEGDALDALGLVRYCCRRMLMTHVDLIEKLLNYNT

SEQ ID NO: 76719 - protein, 225 aa, Oryza brachyantha
MDMEEAHLEYRTVWSEPPKKPAGRTKFRETRHPVYRGVRRRGRAGRWVCEVRVPGRRGTRLWLGTFATAEMAARAHDAAVLALCGKGACLNFADSAWRMPPVPPEAAALAGARGVKDAVAEAVEAFQRQQCPSLSVASTAPSSPAETVADDNDDDDDKHILPVPATSLVPDAAFELLDDGFRFGGMDAGSYYASLAHGLLVEPPAAGAWWEDGELAGSDMPLWSY

SEQ ID NO: 76720 - protein, 585 aa, Oryza sativa Japonica Group
MALRLRLRVVSGSTPATHGRTSAPAHHPSWPLGPWAIVRAGTGDTGDGEAVWAVPPSPLTPLSPIISSPTLTRAAAAAMADSGDSSPHSAAATDDAHHEGSEAAAAQAAPPPPAPPAKVRLMVSYGGRIQPRPHDHQLSYVNGETKILSLERPLRFADFAARLAGLAGSPGDFCVKYQLPGEDLDALVSVTNDEDLEHLVLEYDRLHLLRPAPGSGGGSSRGGSTPRLRVFLFPVQSPTPPPPPQPSGLLEPKQEQRQWFVDALNSVHQPPPPSPPQPKQESVSVQSPPPAVVPMPQPPPVLPAPTGPDYLFGLDNGFVPPPAVKVKDPAGDPPTVKDNVPVEIPAKNDDRHTTNPVSDHVVVSPVVSPGEFQRQIQGLEKLQFADTAAQQPPPPPAPATAAPPPAALPRNGSDDSLTRAYPPATVTPTPPTATPEYYLPKYQEKPAAPPPSSAPPPTAFLPVPGRYTSVAPGSGADHAPVFFIPAPPHGYFTTAAGPGATSFPAVYAVAQHNGNANASGNGPSPAAASNAQAYAPQVAYDSNGHAIYYTSVLPQYASAVSGVPAAATVLGTDPAKPVAVKPTVS

SEQ ID NO: 76721 - protein, 385 aa, Mycobacterium tuberculosis CDC1551
MEVSRALLFELGVLLAVLAVLGAVARRFALSPIPVYLLAGLSLGNGGILGVAAAGEFIATGAPIGVVLLLLALGLEFSATEFASSLRHHLPSAGVDIVLNATPGAVAGWLLGLDGVAILGLAGVTYISSSGVIARLLEDLRRLGNRETPAVLSVLVLEDFAMAAYLPLFAVLATDGSWLEAVVGMTVAIAALLGAFAASYRWGHHVGRLVTHPDSEQLLLRVLGITLIVAAVAESLHASAAVGAFLVGLTLTGETADRARMVLTPLRDLFATIFFLGIGLSVDPGKLVSMLPVALALAAVTAATKVATGMFAARREGVARRGQLRAGTALVARGEFSLIIIGLAGASIPGVAALATAYVFVMAIVGPILARYTGGGLPAAAVASN

SEQ ID NO: 76722 - protein, 203 aa, Sorghum bicolor
MAEPGLEGSQPVDLSKHPSGIVPTLHFPVLGASKRANIVLNSWGFGGNYLVVILSPRVDFRNIVSTVNLDCKLDLKAIALQARNAEYNPKRFAAVIMRIREPKTTALIFASGKMYARIIQKLGFPAKFKDFKIQNIVGSCDVKFPIRLEGLAYSHGAFSSYEPELFPGLIYRMKQPKIVLLIFVSGKIVLTGAKMTQVKVTFF

SEQ ID NO: 76723 - protein, 336 aa, Streptomyces coelicolor A3(2)
MSKPVKAAVFGTGSWGTAFGTVLADAGCEVTLWGRRAALADAVNSTRTNPDYLPGVELPENLRATTDAAEAARDADFTVLAVPSQTLRAGLADWTPLLAPGTVLVSLMKGVELGSAMRMSEVIGDVAKVGAERIAVVTGPNLAREIAARMPAAAVVACPDETVAQRLQAACHTPYFRPYTNTDVVGCELGGAVKNVIGLAVGIADGMGLGDNAKGSLITRGLAETTRLGVALGADPLTFSGLAGLGDLVATCSSPLSRNHTFGTNLGKGMTLEETNAVTKQTAEGVKSCESVLDLARRHGVDMPITETVVAIVHEGKSPVVAVKELMSRSAKPERR

SEQ ID NO: 76724 - protein, 699 aa, Debaryomyces hansenii CBS767
MTNYPGSHKSNLSIAIQKADSTTGNQNYNDNNNNNNNNNHDFGNENLQPASLLPNLIQHNGSTSATTSPVVKSFKPELSPLKTDFLEAGKNENSGQREHAENHDDKHDDDEEDDDEDDEPVHPENEEDLKDYVPGGYHTCYIGENYKSNKYTLVRKLGWGHFSTVWLAKDNDKHCHVAMKIVRSAKHYTETAIDEIKLLDKITTSDIHHPGHEHAIQLLDTFTHKGPNGVHVVMVFEVLGENLLGLIRRYKHRGIPVVFVKQIAKQLLSALDFLHRKCGVIHTDLKPENVLIEIGDVEQIVKMVEVETNEAKKQKKLQKSKYKSDNSLNATPDTSFQENAQAQPSTSTAASTKPTTNSPSLGRNGRRSRRQTLITGSQPLPSPLSTFNKSFSNVYARSSSTANTPLKTFFEGAQPTLINQTASSQIAMASSNTNIPNYDNQDTLNSSLSSMSISNAGRSNTTTDPLQIPSGFDSSMQQTESNENSLIINEDELISVKIADLGNACWTSHHFTDEIQTRQYRSPEVLLGYHWGSLADLWSFACLIFELLTGDYLFDPRDGKTYTKDDDHIAQIIELVGPFPRAMLKEGYYTRDFFNSRGELHRIQKLKPWSLKDVLMEKYKFSLADAVEIADFLQPMLTLQPELRADAGGMVNHSWLSDALGLENVVLERPVGGSGEDIPGWSKEVLNLNIGGKHYHHRN

SEQ ID NO: 76725 - protein, 607 aa, Oryza sativa
  misc_feature (180)..(180): Xaa can be any naturally occurring amino acid
  misc_feature (195)..(195): Xaa can be any naturally occurring amino acid
  misc_feature (219)..(219): Xaa can be any naturally occurring amino acid
  misc_feature (254)..(254): Xaa can be any naturally occurring amino acid
  misc_feature (276)..(276): Xaa can be any naturally occurring amino acid
MDKGALMPSPDETCCVGGGGGSSFSSLRAYGRALAQTPRRLAARACAAASPGEEMSRVRARSGADMARALRWPDLVGLGLGGMVGAGVFVTTGRATRLYAGPAVVVSYAIAGLCALLSAFCYTEFAVDMPVAGGAFSYLRVTFGELAAFLTGANLIMEYVFSNAAVARSFTAYLGTAVGXVDAPSKWRIAVPGLXPKGFNEVDLVAVGVILLITVCICXRTKESSSVNMVLKGVHVVVILFVIGKGNFAHGKTXGNLTRPRHNPESPPPGGGSFPXGAAGVFNGAAMVYLSYIGYDAVSTMAEEVERPSRDIPIGVSGSVVLVTLLYCLMAASMSMLLPYDAIDTEAPFSGAFKGSSGWGWVSNVIGAGASLGILTSLMVAMLGQARYLCVIGRSGVMPAWLARVNPRTATPVNASAFLGVFTAALALFTELDILLNLVCIGTLFVFYMVANAVVYRRYVAAAEDDEEGRRRGAVPTLAFLLAFSLVALCFTLVWKLAPRGGARTGLLVACGAAAAAAVAAFRALVPQARRPELWGVPAMPWVPAASVFLNVFLLGSLDRPSYVRFGFFTAAAALVYVLYSVHASYDADEAAAALDGAKVLDEGCKV

SEQ ID NO: 76726 - protein, 139 aa, Brassica napus
  misc_feature (138)..(138): Xaa can be any naturally occurring amino acid
MGRFKNNKKGRVNVKPIAKSNQANVDHVTGDKIPKSFVFSRTKLPGSVKQLQMDLRKLMLPYTALSLKEKKRNTLRDFLNVSGPMGVTHFLMLKKTASALSLRVARTPQGPTLTFKIHQYSLASDIAQSQTRPRCPPXL

SEQ ID NO: 76727 - protein, 622 aa, Streptococcus suis 89/1591
MSDFIVEHLTKSVGDKTVFADLSFIIHQGDRIGIIGVNGTGKTTLLDVLSGRIGFDGDVSPFRTKNAYKIAYLTQEPDFDESKTVLDTVLSSDLRETQLIREYELLLSHYDEASQARLEKVMAEMDSLNAWEIESQVKTVLSKLGLTDLNKTVVELSGGLRRRVQLAQVLLGNADLLLLDEPTNHLDIDTIEWLTTFLKNTKKSVLFITHDRYFLDNVATRIFELDRASLTEYQGNYQDYVRLKAEQDERDAALRHKKEQLYKQELAWMRRQPQARATKQQARINRFHDLKGDLANKIDDSELEINFETSRIGKKVINFENVSFSYPDKPILADFNLLIQNKDRIGIVGDNGKGKSTLLNLIAGDLQADSGKVDIGETIRIGYFSQTIKGLDESKRVINFLQEVAEEAKTTSGMVSIAELLEQFLFPRNTHGTLIEKLSGGEKKRLYLLKILLQRPNVLLLDEPTNDLDIATLTVLEHFLQSFTGPVITVSHDRYFLDKVANKILAFEDSGIETFFGNYTDYLDEKAFLASSSAISLEKPKEKTEKIKENKKRMSYFEKQEWATIEEDIAGLEERIAAIEAEMLTCGSDFTKLSDLQKELDEKNDLLLEKYERYEYLSELEG

SEQ ID NO: 76728 - protein, 443 aa, Methylobacter alcaliphilus
MKIFEEIESEVRSYARAFPRVFDRAQGAKIYDHEGNEYLDFLAGAGSLNYGHNHPVFKEKLLEYIQNDGITQGLDLHTRAKGEFLESFNEHILKPRNLDYIVMFTGPTGTNAVEAALKIARKKTGRENIISFTNGWHGQTLGSLSVTGNSTHRGGAGIALHGSTRIPYDGYLGDDFDTTNLLDKMLSDSSSGVDKPAAVIVETVQGEGGINAASMTWLRSLSEICKRHDVLLIIDDIQAGCGRTGTFFSFEEAGIYPDIVTLSKSLSGYGLPLAIVLMKPEIDQWSPGEHNGTFRGNNHAFVTAKAAIDHFWKDDSFAKDVQRKGRYIADRVDVIVAKYGEGNFNSHGRGMFRGINCVSGDLAGQITRRCFQKGLIIETSGADDHVVKFLCPLIITDEELEKGIDILEQAIKEVCDKADTIPEGKDFFEGDYSVSKEVSKAGH

SEQ ID NO: 76729 - protein, 480 aa, Methylobacter alcaliphilus
MTFHTVEKIGGTSMSDYVAVRDNIILKPVHREDLYQRIFVVSAYGGITDMLLEHKKNGQAGIYGQFANSVNDDGWQASLVALKQAMFAINANIFDTADAIKKADTFIGERLDDAERCLADLQHLCRHGHFSLDAHLSTVREMLASLGEAHSAWNTVQLLQQDGINAVFVDLTGWQTDKHMTLDERIKNAFAEIDLRQQLPIATGYAHSIDGLMSTFDRGYSEMTFSRIAVLTKADEAIIHKEFHLSSADPRLVGEDKAVPIGRTNYDVADQLANLGMEAIHPKAAKGLRQNDIALRVRNTFEPDHAGTLITGDYVSSKPCVEIIAGCKGVYAFEVFDQNMAGEIHNYDREILGQIRRFRAHIVSKDINANTITHYLSASLKTIRRIRDALQEIYPDAEINQQKVSIVSAIGSDMKIPGILAKTVSALAEKQISVLAMHQSMRQVDMQFVIDEDAYTDAMKSLHCHLVEVHDHGIAICLAS

SEQ ID NO: 76730 - protein, 466 aa, Oryza sativa Japonica Group
MNLAGFLATPATATATRHEMPLNPSSSASFLLSSLRRSLVASLRKASPAAAAALSPMASASTVAAENGAAKAAAEKQQQQPVQVAKRLEKFKTTIFTQMSMLAIKHGAINLGQGFPNFDGPDFVKEAAIQAINAGKNQYARGYGVPELNSAIAERFLKDSGLQVDPEKEVTVTSGCTEAIAATILGLINPGDEVILFAPFYDSYEATLSMAGANVKAITLRPPDFSVPLEELKAAVSKNTRAIMINTPHNPTGKMFTREELEFIATLCKENDVLLFADEVYDKLAFEADHISMASIPGMYERTVTMNSLGKTFSLTGWKIGWAIAPPHLTWGVRQAHSFLTFATCTPMQAAAAAALRAPDSYYEELRRDYGAKKALLVNGLKDAGFIVYPSSGTYFVMVDHTPFGFDNDIEFCEYLIREVGVVAIPPSVFYLNPEDGKNLVRFTFCKDDETLRAAVERMKTKLRKK

SEQ ID NO: 76731 - protein, 120 aa, Pseudomonas aeruginosa
IMATGRSDYPNQVNNVLGFPFIFRGALDVRATRINEEMKIAAALALRDLAKQPVPEDVCAAYGVDKLEFGREYIIPKPMDKRLITVVSDAVAKAAIETGVATLPYPKNYPLKSVDDVFNG

SEQ ID NO: 76732 - protein, 345 aa, Chlamydomonas reinhardtii
MQMQQQRMRFSRDARRIGASRVPLAKAAPGRKVVAQVATATAEKVDVKQAGSFDFNTYMVDRAKLVNKAMDEAVPLKYPETLNESMRYSLLAGGKRVRPALCLAACELVGGDIHAALPAACAMEMVHTMSLIHDDLPSMDNDDFRRGRPTNHKVYGEDIAILAGDALLSFSFEHIARATKGVPAERVLRVIMELGKAVGQDGLVAGQVVDIQSEDKEVGLDVLKYIHEHKTAALLEASVVCGAILGGADESTIEKLRKYSLNIGLAFQVIDDILDVTATTEQLGKTAAKDLAVNKTTYPKLLGLEKSKQVADDLIKEAIQQLDGFDAAKAAPLVALAKFIGYRQN

SEQ ID NO: 76733 - protein, 447 aa, Corynebacterium glutamicum
MTVDEQVSNYYDMLLKRNAGEPEFHQAVAEVLESLKLVLEKDPHYADYGLIQRLCEPERQLIFRVPWVDDQGQVHVNRGFRVQFNSALGPYKGGLRFHPSVNLGIVKFLGFEQIFKNSLTGLPIGGGKGGSDFDPKGKSDLEIMRFCQSFMTELHRHIGEYRDVPAGDIGVGGREIGYLFGHYRRMANQHESGVLTGKGLTWGGSLVRTEATGYGCVYFVSEMIKAKGESISGQKIIVSGSGNVATYAIEKAQELGATVIGFSDSSGWVHTPNGVDVAKLREIKEVRRARVSVYADEVEGATYHTDGSIWDLKCDIALPCATQNELNGENAKTLADNGCRFVAEGANMPSTPEAVEVFRERDIRFGPGKATPEAVEVFRERDIRFGPGKAVNVGGVATSALEMQQNASRETCAETAAEYGHENDYVVGANIAGFKKVADAMLAQGVI

SEQ ID NO: 76734 - protein, 248 aa, Neisseria meningitidis Z2491
MSTQDLSGKIALVTGASRGIGAAIADTLAAAGAKVIGTATSESGAAAISERLAQWGGEGRALDSAEPETIESLIADIEKAFGKLDILVNNAGITRDNLLMRMKEEEWDDIMQVNLKSVFRASKAVLRGMMKQRSGRIINITSVVGVMGNAGQTNYAAAKAGLIGFAKSMAREVGSRGITVNCVAPGFIDTDMTRALPEETRQAFTAQTALGRFGDAQDIADAVLFLASDQAKYITGQTLHVNGGMLMP

SEQ ID NO: 76735 - protein, 521 aa, Neisseria meningitidis Z2491
MTQDKILILDFGSQVTQLIARRVREAHVYCELHSFDMPLDEIKAFNPKGIILSGGPNSVYESDYQADTGIFDLGIPILGICYGMQFMAHHLGGEVQPGNQREFGYAQVKTIDSELTRGIQDDTPNTLDVWMSHGDKVSKLPTGFTVIGDTPSCPIAMMENAEKQFYGIQFHPEVTHTKQGRALLNRFVLDICGAQPGWTMPNYIEEAVAKIREQVGSDEVILGLSGGVDSSVAAALIHRAIGDQLTCVFVDHGLLRLNEGKMVMDMFARNLGVKVIHVDAEGQFMAKLAGVTDPEKKRKIIGAEFIEVFDAEEKKLTNAKWLAQGTIYPDVIESAGAKTKKAHAIKSHHNVGGLPENMKLKLLEPLRDLFKDEVRELGVALGLPREMVYRHPFPGPGLGVRILGEVKKEYADLLRQADDIFIQELRNTTDENGTSWYDLTSQAFAVFLPVKSVGVMGDGRTYDYVVALRAVITSDFMTAHWAELPYSLLGRVSNRIINEVKGINRVVYDVSGKPPATIEWE

SEQ ID NO: 76736 - protein, 195 aa, Streptococcus suis 89/1591
MEINTHNAEILLSAVSKAQYPGDDIPEIALAGRSNVGKSSFINTLLGRKNLARTSGKPGKTQQLNFYNIDDKIRFVDVPGYGYAKVSKTERAKWGKMIEEYLTTRENLRVVVSLVDMRHEPSADDVQMYDFLKYYEIPVIIVATKADKIPQGKWNKHESMIKKKLDFDKNDQFVIFSSETRHGYDQAWDAILSNI

SEQ ID NO: 76737 - protein, 587 aa, Bradyrhizobium sp. ORS278
MSIASEHGAQRRVGQHQPTFAELYSPKLLTVLREGYGLADFRADALAGLTVAIVALPLSMAIAIASGVAPGRGLYTAVVGGFLISLLGGSRFQIGGPAGAFIVLVAATVDRQGLDGLLLATMMSGVMLVIAGYLRLGTYIKFIPYPVTVGFTAGIAVIIFASQLKDLFGITLAAKEPGELIPKLLALAHDAPTANSSAVLLAASAILIIVGLKRLRPTWPGILIAVAIAGVVTWAFNLPVETIGTKFGGIPRELPAPALPAFSLAKIQAVFPDAIAFALLGAIESLLSAVVADGMTGRRHRSNCELVAQGFANIGSALFGGICVTGTIARTATNVRAGARGPVSGMLHSLFLLVFMLIAAPLASYIPLSALAAVLVVVAWNMAEKHEFATLIRSSWGDATVLLATFGLTIFRDLTEGILVGFALGAVLFINRMAQMTGVEDGSPLVPEDRADFEDGARVPYNPKLSADKDVLVYRITGAFFFGAASTVGTVLDSIADRRKAFVVDFAAVPFLDSTAANAMSRVAAKAKRQGILLFITGASPTVRRSLLTHGVRPPLVRYRETIERAVADIKGKDPVREEIADGLAAS

SEQ ID NO: 76738 - protein, 137 aa, Streptococcus suis 89/1591
MERTFFIIKPDALKRGLAGQILSRIERRGFQIRDLKMVTATEELISQHYDHLTDKPFFPQLVQYMTSGPMIAGIIEGPEVIKSWRDMMGATNPVNALPGTIRGDFATAPVEGIVANVVHGSDSAEAAEREIGLWLGK

SEQ ID NO: 76739 - protein, 307 aa, Clostridium perfringens ATCC 13124
MDINLDALVEANRRYTKEGHVATYIPALAKVNPDQLGVCIYDLKENKEFSAGEYDVRFAIESISKVPTLILAILDNGIEKVFSEVGTEPSGFAFNSIMNMQINHKNKPSNPFINAGAIKVVSLLKGKNDEERFKRILDFYRKIMNDDEITLDTEIYLSERETGDINRSLAYYMKGNGIMEGDVTDILDSYFKQCSVLVTAKDLARLGAVLANEGVMPWNGERLFSVETATVVKSLMTTYGLYDESGAFSVHIGLPSKSGVGGGILSSVPNKCGIGLFSPALDVPGNSVASMKLLKEIADKLKLDIFR

SEQ ID NO: 76740 - protein, 903 aa, Desulfotalea psychrophila LSv54
MSQCIYEFGPKKTDGDSSQKDLLGGKGANLAEMAKLGLPVPPGFTISTECCNDYFELGGNLPDILDAQIFAAMANVESQMGMGFGDFENPLLVSCRSGARSSMPGMMETILNVGLCSTTIPGLIKKTGNEWFVYDAYRRLIMMYSDVVMEKAEELKPKDGMGIRLSLEMMMNNLKNDKGYANDTDISIEDMKNLCERFKKKISEDLGLDFPDDPREQLMGSIGAVFKSWNGRRAVAYRRIEHIPNSWGTAVNVQSMVFGNMGDTSATGVAFTRDPATGQNSFYGEWLVNAQGEDVVAGIRTPNPLNLDTKNSQNGHLSSLEEMMPELYTQLFDIRNLLEDHYQDMQDIEFTIQEGRLYMLQCRIGKRTATAALNMAMDMLDEGRIDEKTMLCRLEPKILDDLLHPIVDPEAEKHAAVVAEGLPAGPGGAYGQIVFTSEDAVRWAKADKKVILVREETNPEDIEGMRAAIAVLTARGGMTSHAALVARGWGKCCIVGAGVLKINLETKELRVGTRVFKEGDLFTLNGTKGTVYEGQLKMKDATENPKFKRFMEIADSHRTLRVRANADTPEDAKIAREFGAEGVGLFRTEHMFYGTDSDRPLFLLRKMILSKTVAERKEALAELFPFVKEEIGKTLAIMDGMPVTMRLLDPPLHEFVPQLVENQQEIADALRIDLEEVIKRSEQLKESNPMMGHRGVRLGITYPEIIEMQVLSIFEAAAELIQAGKTPQPEIMVPVTCNEKELDFARKIVDRCYEQTLEKYGLESIGYMYGTMIEIPRAALIAEKMAEHAQFFSFGTNDLTQMTFGFSRDDVGALMNDYLDNGILVADPFETLDQEAVGSLITTAVDGGRRARPDIKLGICGEHGGDPASVEFCHRAGLTYVSCSPYRVPIARLAAAQAAIKFN

SEQ ID NO: 76741 - protein, 297 aa, Herminiimonas arsenicoxydans
MNADLTVVSPQIQAQILAEALPYIRKFHGKTIVVKYGGNAMTEERLKHSFARDVILLKLVGMNPVVVHGGGPQIDNALKKIGKQGTFIQGMRITDEETMEVVEWVLGGEVQQDIVMLINHYGGQAVGLTGKDGGLIRARKMNMPDRENPGKFLDIGFVGDIEAINPAVVKALQDDAFIPIISPIGFGDDGQAYNINADVVAGKIAEILRAEKLIMMTNIAGVQDKQGNLLTDLSAREIDEMFEDGTISGGMLPKISSALDAAKSGVNTVHIIDGRIEHSLLLEVLTEQAFGTMIRSH

SEQ ID NO: 76742 - protein, 407 aa, Solanum palustre
  misc_feature (42)..(42): Xaa can be any naturally occurring amino acid
MEKFNLARVLLLLLQLGTLFIAHACPYCPYPPSTPKHPKLPXKVKPPSTQPPHVKPPSTPKYPKDPPHVKPPSTPKQPPYVRPPTTPKYPPHVKPPSTQPPHVKPPSTPKYPKDPPHVKPPSTPKQPPYVKPPTTPKYPPHVKPPSTPKHPPQKPCPPPSHHGPKPPILKPPHVPRPPIVHPPPIVSPPSTPKPPTTPPFTPKPPSPTPPIVSPPIVYPPITPIPPIVHPPVTPKPPSPTPPIVSPPIVYAPITPTPPIVSPPITPTPPIVSPPFVPNPPVVIPPPYVPSPPVVTPPIVPTPPTPCPPPPPAIIPSPPAQPTCPIDALNVGACVDVLGGLIHIGTGGSAKQTCCPLLGLVDLDAAICLCTTIRLKLLNINIILPIALQVLIDDCGKYPPKDFKCPST

SEQ ID NO: 76743 - protein, 490 aa, Nitrosomonas europaea ATCC 19718
MDNLFDVAVIGAGPGGYVAAIRCAQLGLNTVCIDDWKNEQGKPSLGGTCLNVGCIPSKALLESSENFERAGHKFAEHGIKVDGLSIDVPAMIARKNKIVKAFTGGIGMLFKKNKVTALHGRGTLQKHDQARDGGDDSWEIQVSADGKEQSVHARHVIIATGSTPRTLKVAPVDGNNVLDNAGALALQQTPGKLAIIGAGVIGLELGSVWRRLGAEVTLLEAQADFLPAADEQVAKEAYKALTRETGLTIHTGVEIKSTRASENGVEIDYVDRDKNAQNLKVDKLIVAVGRVPNTSGLGAEAAGLKLDERGYISVDEFCQTSLQNVYAIGDVVRGPMLAHKASEEGVAVAERIASGRQGATDSSGHVDLGMMPWVIYTAPEIAWVGKTEQTLKAEGVAYKAGQFPFMANGRARALGETTGFVKILADAESDRILGVHMVGPYVSEMIAEAVVAMEFSASSEDLARIVHAHPSLSESLHEAALGVDKRAIHI

SEQ ID NO: 76744 - protein, 387 aa, Oryza brachyantha
MANGGGGAGNGEARKAGAGASVLVTGGAGYIGTHTVLRLLEKGYAVAVVDNFHNSVPEALDRVRLIAGPALSARLVFIPGDLKSKDDMEKVFAAKRYDAVIHFAGLKAVGESVAHPQMYYENNVAGTMNLYAAMTKYGCNKIVFSSSATVYGQPEKTPCVEDSKLSALNPYGTTKLSFLTALILSLARARACHQLVLENYFRQVQAADPELRVILLRYFNPIGAHRSGDIGEDPRGIPNNLLPYIQQVAVGRRPELNVYGDDYPTRDGTAIRDYIHVVDLADGHIAALEKLFATPDIGCVAYNLGTGCGTTVLEVVKAFEEASGKKIPIKICPRRPGDCTEVYASTEKAKKELGWSARFGIEDMCRDQWNWARKNPYGYSGDADEKN

SEQ ID NO: 76745 - protein, 442 aa, Vitis vinifera
MGSMSGILQRPLIAATAVAVASVSSDLSDKLQPLKSSETSSTLKPICDSPAQESKSSWVSHISLSKLSNFSFVSRVRVPVPHINYYPVPNSPSGFAPNLLSSSVVSSPTLINLYQSAELAKAPKPTTFKHSIPALASDVLYRWHLPDPNACDVLEDSDCSSVKSRTVVVLLGWLGARQKHLKRYAELYTSMGFHAITFTFPMAEVLSYKVGGKAEQNVDLLVNHLAEWLEEEHGKNLVFHTFSNTGWLIYGAILEKFQKQDPSLMGRIKGCIVDSAPVAAPDPQVWASGFSAAFLKTRSVATKGTIRYDESGMEEFVDRKAVAEPKPAITEAALLVVLEKFFQVVLNLPSVNRRLSDVLGQLSLGQPNCPQLYIYSSADRVIPAGSVETFIEEQRKAGREVRACNFISTPHVDHFRNDPKLYTSQLTQFLDDYVLNCCKCSS

SEQ ID NO: 76746 - protein, 369 aa, Oryza sativa Japonica Group
MEALWKQASRLKEQVSRQGVFKPFGAAYGNSENAFTDESEVNLHQRLEKLYLSTRAAKHFQRDIVRGVEGYIVTGSKQVDIGNKLSDDSQKYGTGNTCTSDNTLSKAAMYYGKARSLMEKERGNMLRAFGTQVAEPLRAMVMGAPLEDARHLAQRYDRMRQEAEAQAVEVSRRQNRVRESAPNGDVITKLEAAEYKLEELKSSMVGLGKEAVAAMAAVEAQQQRLTLQRLIAMVEAERAYHQRVLEILDHLEQEMVSERQKIEAPPTPSAENYMAQPPPSYDEVNGMFASSSVDDSVTSVDFFLGEALDSFKAESESELNLSAGDIVIVRKISTNGWAEGECKGKAGWFPHGYIERRERVLASKVPHIF

SEQ ID NO: 76747 - protein, 503 aa, Oryza sativa Japonica Group
MATAIPQRQLFVAGEWRAPALGRRLPVVNPATESPIGEIPAGTAEDVDAAVAAAREALKRNRGRDWARAPGAVRAKYLRAIAAKIIERKSELARLETLDCGKPLDEAAWDMDDVAGCFEYFADLAESLDKRQNAPVSLPMENLKCYLRKEPIGVVGLITPWNYPLLMATWKVAPALAAGCTAVLKPSESASVTCLELADVCKEVGLPSGVLNIVTGLGSEAGAPLSSHPGVDKVAFTGSYETGKKIMASAAPMVKPVSLELGGKSPIVVFDDVDVEKAVEWTLFGCFWTNGQICSATSRLILHKKIAKEFQERMVAWAKNIKVSDPLEEGCMLGPVVSEGQYEKIKQFVSTAKSQGATILTGGVRPKHLEKGFYIEPTIITDVDTSMQIWREEVFGPVLCVKEFSTEEEAIELANDTHYGLAGAVLSGDRERCQRLTEEIDAGIIWVNCSQPCFCQAPWGGNKRSGFGRELGEGGIDNYLSVKQVTEYASDEPWGWYKSPSKL

SEQ ID NO: 76748 - protein, 528 aa, Synechococcus sp. CC9605
MSQPSSDTQRQPAIVILDFGSQYSELIARRVRETEVFSVVLGYSTSAEELRRMAPKGIILSGGPSSVYAEHAPLCDPGIWDLGIPVLGVCYGMQLMVQQLGGVVEAATGKAEYGKAPLEVDDPTDLLTNVDNGSTMWMSHGDSVKALPEGFVRLAHTANTPEAAVAHLQRKLYGVQFHPEVVHSTCGMALIRNFVYHVCGCDPDWTTAAFIDEAVALVREQVGDKRVLLALSGGVDSSTLAFLLKKAIGDQLTCMFIDQGFMRKGEPEFLMDFFDRKFNIHVEYINARQRFIGKLEGITDPEEKRKIIGTEFIRVFEEESKRLGPFDYLAQGTLYPDVIESAGTNVDPKTGERVAVKIKSHHNVGGLPKDLQFKLVEPLRKLFKDEVRKVGRSLGLPEEIVRRHPFPGPGLAIRILGEVTDEKLDCLRDADLIVRQEIKEAGLYHDIWQAFAVLLPVRSVGVMGDKRTYAWPIVLRCVSSEDGMTADWSRLPYDLMETISNRIVNEVKGVNRVVLDITSKPPGTIEWE

SEQ ID NO: 76749 - protein, 489 aa, Yersinia pseudotuberculosis IP 32953
MPAQNPLQHQRQHDGIYHIGYFVGGKWSQAQEQFDVCNPATGELVARVAKSGKQETEAAIKAASEAFPAWRKTPAKQRAEILQRWYLLIMEHQQSLAELMVSEQGKPLKEALVEVAYAASFIQWFSEQAKRANGEIIPSAKEGARILATREPIGVVAAITPWNFPLAMLTRKLGPALAAGCTGLIKPANNTPLSAFALLALAEQAGVPAGVLNGVVGDTHAISDAIMASSDVRKISFTGSTNVGKTLMRNAAATMKRISMELGGNAPYIVFDDADLEAAVAGAMACKFRNAGQVCVCVNRFYIQDAIYDEFVNRLAAEVKKLKVGNGMDKDVNMGPLINLAGLEKVEEHVKDALEKGGRLLAGGHRHALGGNFFQPTVIADANEQMKVASEETFGPLAACFRFSTEAEVIQRANNTPFGLAAYFYTQNLQRVFRVSEALESGMIGVNECSVSTELAPFGGVKESGLGREGSVLGLDEFMEVKTLHLGNL

SEQ ID NO: 76750 - protein, 167 aa, Saccharomyces cerevisiae
MSRKLKKTNLFNKDVSSLLYAYGDVPQPLQATVQCLDELVSGYLVDVCTNAFHTAQNSQRNKLRLEDFKFALRKDPIKLGRAEELIATNKLITEAKKQFNETDNQNSLKRYREEDEEGDEMEEDEDEQQVTDDDEEGVGRNSAKQSTDSKATKIRKQAPKNLKKTKK

SEQ ID NO: 76751 - protein, 251 aa, Saccharomyces cerevisiae
MNPLFFLASPFLYLTYLIYYPNKGSFVSKPRNLQKMSSEPFKNVYLLPQTNQLLGLYTIIRNKNTTRPDFIFYSDRIIRLLVEEGLNHLPVQKQIVETDTNENFEGVSFMGKICGVSIVRAGESMEQGLRDCCRSVRIGKILIQRDEETALPKLFYEKLPEDISERYVFLLDPMLATGGSAIMATEVLIKRGVKPERIYFLNLICSKEGIEKYHAAFPEVRIVTGALDRGLDENKYLVPGLGDFGDRYYCV

SEQ ID NO: 76752 - protein, 280 aa, Zea mays
  misc_feature (136)..(136): Xaa can be any naturally occurring amino acid
  misc_feature (150)..(150): Xaa can be any naturally occurring amino acid
  misc_feature (164)..(164): Xaa can be any naturally occurring amino acid
  misc_feature (191)..(191): Xaa can be any naturally occurring amino acid
  misc_feature (205)..(205): Xaa can be any naturally occurring amino acid
MSAASKKLFQAARSLVLSASNRSVLAAEGRTAALATLTNFGRKTLPTAYLSYHKQGSHHAASGWGAIAAAVPAAVYMLQDQEAHAAHMERTFIAIKPDGAQRGLISDIMSRFETKGYNLAAINLIAPSKEFAEKHXYHDLTERPFFSGLXDPLSSGPVLAMWSXEGEGVIKSGRKPMGAPHPQKSEPRTIXRGDLALGVGNNLLXGTDGPDSEGSPHPNDQDLYVAEQPKDLAVSLTPCPPMESMPLMHHHIHSVPLPPFHPAYAFMHAVPGPGVLLTRT

SEQ ID NO: 76753 - protein, 326 aa, Solanum lycopersicum
LGANAILAVSLAVCKAGAAVKKIPLYKHIANLAGNKKLVLPVPAFNVINGGSHAGNKLAMQEFMILPVGASSFKEAMKMGCEVYHHLKAVIKKKYGQDATNVGDEGGFAPNIQENKEGLELLKTAIEKAGYTGKVVIGMDVAASEFYGKDKTYDLNFKEENNNGSQKISGDQLKDLYKSFVSEYPIVSIEDPFDQDDWETYAKLTAEIGQKVQIVGDDLLVTNPKRVAKAISEKTCNALLLKVNQIGSVTESIEAVKMSKQAGWGVMTSHRSGETEDTFIADLAVGLSTGQIKTGAPCRSERLAKYNQLLRIEEELGSDAVYAGAS

SEQ ID NO: 76754 - protein, 654 aa, Microcystis aeruginosa PCC 7806
MTYEPLHHKYRPQTFADLVGQSAIATTLSNALISERIAPAYLFTGPRGTGKTSSARILAKSLNCLSSDHPTPIPCGKCSVCQAIANGSALDVIEIDAASNTGVDNIREIIERSQFAPVQCRYKVYVIDECHMLSTAAFNALLKTLEEPPDRVIFVLATTDPQRVLPTIISRCQRFDYRRIALDAMVAHLQKIAQIEAIDINLEALTLVAQIANGGLRDAESLLDQLSLLAGTITAERVWDLVGAVPERDLLTLLKVIHGNIPDQVIEQCRHLMNRGKEPLIVLQNLAGFYLNLLLAKTAPNRPEMVAVTAPTWQELCTEARTWSLEEILRGQQLLKDSETQLKNTTQPRLWLEVTLLGLLPQAQVIPLVATAAPSRPQTSAERPTEMITAPVPVNEPIKPAVITSTTSVAVPKTEVKTVTSDDNHEQIWQQVLEVMEPPTTRTLLRQHGSLFSRSESSAYVSISSEQLLKMARLRLTNIESAFEAVFQRRIKVHLQVGSATAAMAAEVSQSSAAKMPLPSETAATPPITPENKVMTVVDIPPVKEAIIEKKEAKITASGTPKTSSTELPQKILNFDSSLGTLDQDVDVSEILAAAQKLAKSFDGELVNMGYSLPENSAAETKVNKSLENMTIVRGRPDVNEILDSLEEDEDLPF

SEQ ID NO: 76755 - protein, 235 aa, Oryza sativa Japonica Group
MAAGAGGDGGGELKLLGTWASPFVQRVRLALNLKGLAYEFIEEEIGGGKSELLLASNPVHKKVPVLLHRSNPICESQVIVQYLDDAFPGGAAGGDLLPSDPHARAVARFWAAYIDAEFFAPWNRSFYTASEEEKTAEMGRAAAALATIERAFAELSRGKGFFSGEDRPGFVDVVLGGFVGSMRAYGTAVGVEVLDAGRTPLLVAWAERVAALDAARGVIPDVERVVELSRYARKK

SEQ ID NO: 76756 - protein, 188 aa, Methanothermus fervidus
MEKFKKAGKIASKVRKKAIKAVKGEMKILDLAEFIENEIEKMGAKPAFPCNISVNEITAHYSPPCNDDRKILPGDLVKIDIGVHVDGFIGDTATTVLVEGYEDLKNYNDELAEKNKKMIEAAESALENAINTIRDGVEIGKIGEVIENTINKFGFKPISNLTGHTIDRWVLHSGLSIPNVKGQNSHKL

SEQ ID NO: 76757 - protein, 440 aa, Zea mays
  misc_feature (302)..(302): Xaa can be any naturally occurring amino acid
TTLYRKLGTRKLGPLEGYSRAAAVGAARRELSAASLAVVDGEARYLVGTYKRSRVVFEHGRGCKLYDTDGREYLDMAAGIAVTALGHADPDVCATIAEQAGKVVHVSNVFYTKPQVELAKRLVEVSFADRAFFASTGTEANEAAIKFSRKFQRAAHPESGDPPTEFLAFSSSFHGRTMGAVALTSKSQYREPFAPVMPGVTFVDYGDLEAAKKFVRSGRVAAVFVEPVQGEGGIHSATREFLQGLRDACDEAGALLVFDEVQCGFGRTGHLWAHEAYGVEPDIMTLAKPLANGIPIGVVLVXGEEIAAAINYGDHGTTFGGGPLACQTAITVFDKITRPGFLAEVSRKGESFKQLLRAKLSGNPHVREVRGVGLLVGVELDVPAGPLVDACLDAGVVVLTAGKGNVVRLVPPLIVSEKELEHAADVIRDCLPALDVVAAA

SEQ ID NO: 76758 - protein, 223 aa, Oryza sativa Japonica Group
MARARRGRQNAAASPPSLALQLQVASLVIVFVFAFSSAITPTRADHVEGHMSHEMFGYENDATGPAKWGSLHKEWAVCGDGKKQSPIDITTVEPQKVKEPLMQAYKAGATTIQNRGHDYMLKWKDGNSKLTVQGKEYTLKQVHWHEPSEHTINGTRFDAEMHMVHEDPSMARAVVSVLLSTKAGQPNAVLTEVVTTTCLTVHLKWFVSISSPTERPRNGNEHI

SEQ ID NO: 76759 - protein, 90 aa, Nicotiana tabacum
AYSATPTNLKIIDLYVMFAIFTALIQVVYMAFVGSFPFNSFLSGVLSCIGTAVLAVCLRIQVNKENKEFKDLPPERAYADFILCNLVLLW

SEQ ID NO: 76760 - protein, 279 aa, Bradyrhizobium sp. BTAi1
MKHKTFGTGGASVSVIGQGTWHFDFGDRSRAIAALRRGLELGATHIDTAEMYGDAELIIAEAIAGRRDEVFLVSKVLPSNASRKGTITACERSLKRLKTDRLDCYLLHWPGSYPLEDTVAAFEELKAAGKIASWGVSNFDVDDLDELLEVAGEGKIACNQVLYHLQERAIEHAVIPWCGQHGVAVVAYSPFGHDDFPERRSAGGEVLQRIAEQHGATPRQIALAFLTRASSLLAIPKASRPDHAEENAAAGDIALTAADIAAIDRAFPRGPKPRGLPML

SEQ ID NO: 76761 - protein, 401 aa, Bradyrhizobium sp. ORS278
MMSFLAAALDRVKPSATIAVTDKARVLKAAGRNVIGLGAGEPDFDTPDNIKQAAIKAIQDGKTKYTAVDGIPELKDAIIGKFQRENGLTYKPNQVIVGVGGKQVLYNALMATINPGDEVIIPAPYWVSYPEMVALAGGEPVPVVCTSAHGFKLQPEALEKAITPKTKWLILCSPSNPTGAAYTKAELKALTDVLVKHPHVWIMTDDMYEHLVYDDFVFTTPAQIEPSLFDRTLTVNGVSKAYCMTGWRIGYAGGPAQLIKAMATIQSQSTSNPCSIAQWAAVEALNGPQHFIPENNKVFKERRDLVVSMLNQASGIECPRPEGAFYVYPSCAGTIGKTTPSGKVIDNDQTFVTELLETEGVAVVQGSAFGLGPAFRISYATKTSDLEDACKRIQRFCGNLR

SEQ ID NO: 76762 - protein, 641 aa, Synechococcus elongatus PCC 7942
MALMTLRNVSKDYGLKVLLQSASFSVGDRDRIGLIGRNGSGKSTLLRILAGLETADSGDIQRQSGLRSVYVPQDPQLDPERTVLEQVFADAGEQLQLVRDYEAISEQLATAEGEAAEALMARLTSLSQQLDAQDAWGLETQAKIVLSRLGIHNFQQRVGDLSGGYRKRLGLASALLADPELLLLDEPTNHLDADSVEWLQSFLSKFRGALVLITHDRYFLDRVTNRILDLDRGELSAYDGNYAYYLQKKAEQEASAASSAHKFQGVLRRELAWLQRGPKARSTKQKARIQRIEEMRSQEVRGAAGRVEIAAASQRLGKTVVRLENVSKSFGDRQLIQDFSYEVSPEERLGIIGPNGVGKSTLLNLMTGQLSPDQGKVVQGSTVCFGYVDQQAEGLELAAQKQQRPIDYLREEGEYLPLGNGEKLSASQLLERFLFPPAQQYAPIASLSGGERRRLYLLRILMTAPNVLILDEPTNDLDIQTLAVLEDYLEDFPGTVIIISHDRYFLDRTVDSILAFEPTGELRHYPGNYAVYLEYQQKQAAVIEAEPTKAPKSNGERSASQTSRSQQRRLSFKEKRELEQLELQIPVWEAEKAEIEAKLYQDNSGSFSQLQTLSEQLAELETRIEVGTERWLELSEVASSA

SEQ ID NO: 76763 - protein, 171 aa, Symbiobacterium thermophilum IAM 14863
MSDAVSEALVEAIIEIPAGSQNKYEVDKKRGLLRLDRVLYSPVHYPTDYGFVDETLEEDGDPIDILVLVSNPTVPGCIVDTRIIGVLVMSDDKGVDNKLLGVAQKDPRYAQVADLSGVPPHRLLEIEHFFRTYKELEGKRTVIEGWFGLDVALEKLRAARELYRRTRSAHE

SEQ ID NO: 76764 - protein, 718 aa, Arabidopsis thaliana
MMMSDLPHDLVEEILSRLPLISLKAMRSTCKTWNVLSKHRSFANKHIGNVTASGKRDLIMIKDCKVYSIGVNLHGIQNNNNIIDLSIKNKGILHLENLDLIFKEIFNVFHCNGLLLLYGSITDDSIRLVVCNPYWGKREWVKRINNFASFDKLAFGYDKSCGCHKILRVFDSYPNRLEIYNLRSNSRMVSSFPLKWDIAFMQDGVSLKGNTYWYAKDRRSEDCYLICFDFTRERFGPRLPLPQPFIDEFLGSLYVVREEKLAVLVKRWRGGKSEIDIWVTNKIEPDEVSWSKFLKVDNTPRFFLTEGYLIYDEEKVVVFFNKEETEGLKSTVHIAYIVGENGYFRRADLREPLYQPLCRLIYKLSNYKTERQQVTSKRSAMASSTLFKLNSQTFKALNPSPPSLSPPNSRIFHLHFSKSLSQQHSKLNHKSTTTRLFAPLCSSLPSPSSSSPPLSKEEAINQAKTCLLSCLIKPLNNPKLASPKLRKLKQPRFRLEIPILDDDSPSSLSQLAFSIFHDLPISRRGSNVKLLFLWPNPSFIDPAVKAFRSDSIHHIAMSPVSDSLKTALRSADVAIFMAPEKSQLEDVKTASEAFSTKPVVMINPRWLFEEEKSFGDGFIGSFEVIYAFTGLEVRGVFSKRKGVIFKCVRDGVVSGERWNVLVEEEEGNGTLKVVSQFNSRPSIEEVELVLYNLMAMNSPITKSAKFLSDLVSNITGKK

SEQ ID NO: 76765 - protein, 313 aa, Arabidopsis thaliana
MAALQTLREWIGIQQFPPATQSKLLEILGKYKEEDVSSLTVLVMGKGGVGKSSTVNSVIGEKAAAVSTFQSEGLRPTLVSRTRSGFTLNIIDTPGLIEGGYVNDQAINIIKRFLLNMTIDVLLYVDRLDVYRVDDLDRQVVGAITDAFGKEIWKKSALVLTHAQFSPPDGLNYNHFVSKRSNALLKVIQTGAQLKKQDLQGFSIPVILVENSGRCHKNESDEKILPCGTSWIPNLFNKITEISFNGNKAIHVDKKLVEGPNPNERGKKLIPLMFAFQYLLVMKPLVRAIKSDVSRESKLAWELRDSGLASRRS

SEQ ID NO: 76766 - protein, 497 aa, Oryza brachyantha
MVMDIAHRDHLLAAAHGVLAVATLAACVLAEVAVFSSRRHAGLYLVPVSAMVLLYRFRRRAAASDVGLVDFSCLKPPRRLRIPVAGLLEHYKLIGCFDDSSVEFMTKVIEASGMGNETYFPPSLHYIPPADTHAEAIREAHMLFFPTLDDLFAKTGVPPSAVGAVVVNCSGFCATPSLSAIIANHYRMPSDVKTYNLSGMGCAAGVIGVDVARNLLRTHAMSYAVVVSAEIVTVGWYSGKDQSKLLLNCYFRTGCSAALVTSKRGGGGGAASSPPVKYRLVSLTRTNQIANDRSYRSGYRDEDDEGITGFTLGQGVGRMVSELLRAHLLTLSISILPWREKLRYVAAVLVSAHLRRHDKLSSSSSSSSNPTAAMPMPDFRTAAEHFCLPSSGRPMIWRLGQGLGLGEKEMEAALMTFHRFGNQSAASLWYQLAYMEAKGRVRRGDTVWQLGIGSGLKANSLVWERVAADDHFASERRGRSTLGPWRECIHNYPVAQP

SEQ ID NO: 76767 - protein, 384 aa, Arabidopsis thaliana
MTLPELPKDLVEEILCFVPATSLKRLRSSCKEWNRLFKDDKRFARKHIEKAAKQFQPLTLTKNYRICPINVNLHGTTPSLEVKNEVSLVDPHSKNSAAQFNIDRVFHCDGLLLCTSQKDSRFVVWNPLTGVTKWIELGDRYNEGMAFILGYDNKSCNKSYKAMSFNYLDKDSEIYEFSSDSWRVIDDIIKPPHYMDYFRECFSLKGNTYWLGIDRRRRPPDLRITLIKFDFGTERFGYVSLPPPCQVHGFEASNLSVVGDEKLSVLVQGGSTSKTEVWVTSKIGEANVVSWSKVLSLYPKPDVGFWHGLSFLLDEEKKVVLCCKSKGWMEEEDEENVYSVGEDTKFILLNFGVQTIGGYSPIIVNYVPSLGQIELAGSKRKRDY

SEQ ID NO: 76768 - protein, 1077 aa, Zea mays
  misc_feature (869)..(869): Xaa can be any naturally occurring amino acid
MDGGDATNSGKHVAGQVCQICGDGVGTAADGDLFTACDVCGFPVCRPCYEYERKDGTQACPQCKTKYKRHKGSPPVHGEENEDVDADDVSDYNYQASGNQDQKQKIAERMLTWRTNSRGSDIGLAKYDSGEIGHGKYDSGEIPRGYIPSLTHSQISGEIPGASPDHMMSPVGNIGRRGHQFPYVNHSPNPSREFSGSLGNVAWKERVDGWKMKDKGAIPMTNGTSIAPSEGRGVADIDASTDYNMEDALLNDETRQPLSRKVPIPSSRINPYRMVIVLRLAVLCIFLRYRITHPVNNAYPLWLLSVICEIWFALSWILDQFPKWSPINRETYLDRLALRYDREGEPSQLAPVDIFVSTVDPMKEPPLVTANTVLSILAVDYPVDKVSCYVSDDGAAMLTFDALSETSEFARKWVPFCKKYNIEPRAPEWYFAQKIDYLKDKVQTSFVKERRAMKREYEEFKVRINGLVAKAQKVPEEGWIMQDGTPWPGNNTRDHPGMIQVFLGHSGGLDVEGNELPRLVYVSREKRPGFQHHKKAGAMNALVRVSAVLTNGQYMLNLDCDHYINNSKALREAMCFLMDPNLGRNVCYVQFPQRFDGIDRNDRYANRNTVFFDINLRGLDGIQGPVYVGTGCVFNRTALYGYEPPVKKKKPGFFSSLCGGRKKTSKSKKSSEKKKSHRHADSSVPVFNLEDIEEGIEGSQFDDEKSLIMSQMSLEKRFGQSSVFVASTLMEYGGVPQSATPESLLKEAIHVISCGYEDKTDWGTEIGWIYGSVTEDILTGFKMHARGWRSIYCMPKRPAFKGSAPINLSDRLNQVLRWALGSIEILFSRHCPIWYGYGGRLKFLERFAYINTTIYPLTSIPLLLYCILXPAVCLLTGKFIIPKISNLESVWFISLFISIFATGILEMRWSGVGIDEWWRNEQFWVIGGISAHLFAVFQGLLKVLAGIDTSFTVTSKATDEEGDFAELYMFKWTTLLIPPTTILIINLVGVVAGISYAINSGYQSWGPLFGKLFFAFWVIVHLYPFLKGLMGKQNRTPTIVVVWAILLASIFSLMWVRIDPFTTRVTGPDIAKCGINC

SEQ ID NO: 76769 - protein, 353 aa, Saccharomyces cerevisiae
MPKRIVYNISSDFQLKSLLGEGAYGVVCSATHKPTGEIVAIKKIEPFDKPLFALRTLREIKILKHFKHENIITIFNIQRPDSFENFNEVYIIQELMQTDLHRVISTQMLSDDHIQYFIYQTLRAVKVLHGSNVIHRDLKPSNLLINSNCDLKVCDFGLARIIDESAADNSEPTGQQSGMTEYVATRWYRAPEVMLTSAKYSRAMDVWSCGCILAELFLRRPIFPGRDYRHQLLLIFGIIGTPHSDNDLRCIESPRAREYIKSLPMYPAAPLEKMFPRVNPKGIDLLQRMLVFDPAKRITAKEALEHPYLQTYHDPNDEPEGEPIPPSFFEFDHHKEALTTKDLKKLIWNEIFS

SEQ ID NO: 76770 - protein, 413 aa, Pseudomonas fluorescens Pf-5
MALIVQKFGGTSVGSVERIEQVADKVKKFREAGDDLVIVLSAMSGETNRLIDLAKQISGEAKPVPRELDVIVSTGEQVTIALLAMALIKRGVPAVSYTGNQVRILTDSAHNKARILQIDDQKIRGDLKAGRVVVVAGFQGVDEHGNITTLGRGGSDTTGVALAAALKADECQIYTDVDGVYTTDPRVVPKAQRLDKITFEEMLEMASLGSKVLQIRAVEFAGKYNVPLRVLHSFQEGPGTLITIDEEESMEQPIISGIAFNRDEAKLTIRGVPDNPGVAFKILGPISAANIEVDMIVQNVSHDNTTDFTFTVHRNDYLAAQTVLENTAREIGAREVVGDTDIAKVSIVGVGMRSHAGVASRMFEALAKESINIQMISTSEIKVSVVIEEKYLELAVRALHTAFELDAPARQGE

SEQ ID NO: 76771 - protein, 472 aa, Streptomyces coelicolor A3(2)
MASTSQAPSPGAGTAHPDHLGHVIFIAAAAAMGGFLFGYDSSVINGAVEAIRDRYDVGSAVLAQVIAVALIGCAIGAATAGRIADRIGRIRCMQIAAVLFTVSAVGSALPFALWDLAMWRIIGGFAIGMASVIGPAYIAEVSPPAYRGRLGSFQQAAIVIGIAVSQLVNWGLLNAAGGDQRGELMGLEAWQVMLGVMVIPAVLYGLLSFAIPESPRFLISVGKRERAKKILEEVEGKDVDFDARVTEIEHAMHREEKSSFKDLLGGSFFFKPIVWIGIGLSVFQQFVGINVAFYYSSTLWQSVGVDPADSFFYSFTTSIINIVGTVIAMIFVDRVGRKPLALIGSVGMVIGLALEAWAFSFDLVDGKLPATQGWVALIAAHVFVLFFALSWGVVVWVFLGEMFPNRIRAAALGVAASAQWIANWAITASFPSLADWNLSGTYVIYTIFAALSIPFVLKFVKETKGKALEEMG

SEQ ID NO: 76772 - protein, 542 aa, Citrus reticulata
MDQAISSVVRKLQMVNTSDHNSVVSINIFVALLCASIVIGHLLEESRWMNESITALLIGVCAGVIILLTTGGKSSHLFVFSEDLFFIYVLPPIIFNAGFQVKKKQFFRNFITIMLFGAIGTLVSCTIISLGVIQFFKKLDIGTLDIGDYLAIGAIFAATDSVCTLQVLNQDDTPLLYSLVFGEGVVNDATSVVLFNAIQSFDLTHINTRSAFQFIGNFLYLFFTSTLLGVIGGLLSAYVIKKLYFGRHSTDREVAIMVLMAYLSYMLAELFYLSGILTVFFCGIVMSHYTWHNVTESSRVTTKHTFATLSFVAEIFIFLYVGMDALDIEKWRFVKGSPGTSVAASAMLMGLIMAGRAAFVFPLSFLTNLAKKSPTEKISIKQQVIIWWAGLMRGAVSMALAYNQFTRSGHTQLRENAIMITSTITVVLFSTVVFGLMTKPLIRLLLPHPKHTTNHILSDPSTPKSLSQPLLEEGQQDSYADLVGPTVPRPGSLRALLTTPTHTVHYYWRKFDDAFMRPVFGGRGFAPFVPGSPTERSVRGGQ

SEQ ID NO: 76773 - protein, 614 aa, Synechococcus sp. CC9605
MSSAYQPLHHKYRPQRFDQLVGQEAIAATLGHALTSNRIAPAYLFSGPRGTGKTSSARILARSLNCLNSEGPTPEPCGTCELCTTIAAGTALDVIEIDAASNTGVDNIRELIERSRFAPVQARWKVYVVDECHMLSTAAFNALLKTLEEPPPQVVFVLATTDPQRVLPTILSRCQRFDFRRIPLDALNTHLSWIAEQEAIEIKPEAIHVVAQRSQGGLRDAESLLDQLSLLPPPIEAAAVWDLLGAVPEQELLELVGAMSSAEPVQLLEATRNLLDRGRDPGAVLQGLAGMLRDLVLMAAAPDRLELTSVSPQFREQLPALAKAIGRARLLQWQAQLRGTEQQLRQSMQPRLWLEVLLLGLLAEPLAAQSAAAAPAPRQPATTQPAAAASPPTTPVALPAPTPSTAAPAIEASTPSPKPAPAPSPELPSVATPTPAASTNLPELWQQILGSLELPSTRMLLSQQAQLVRLDANRAVVQVAGNWMGMVQSRASLLEQAVAKALGGSRQLVLEANNSAMPPPLATAPAAVEPPAPTPAPTPAPTAAPLQAPPATQSPPPAVAPELPRTQSEPIEPKPTPPTAESNPQPSPPSGLDRQARNLADFFNGQVLDVDEIS

SEQ ID NO: 76774 - protein, 425 aa, Oryza sativa Japonica Group
MEDSPVAVAIPWFALAAATAVLAGAAWLIIRACKADESCCRLPPGSRGLPLLGESLEFFARSPSLELLPFLKQRLERYGPIFRTNIIAQDMIVSLDPELNNLVFQQEERLFQCWYPNSFMRVFGADSIITTFGSSHRHVRNLVLRLFGPENLRRAMLQEMQKTAQASLLSWLDRPSIEVKEEVSSMIIFSIIAKKLISYDSSASNGKLWKQFDAFLQGLLADRICIYTIDHDNQFDHCIYMQGRKNVMRMLRELLDERKKKTAHQLESIDFFDALIDELKQEKPAVSENVALDLLFLLLFASFETTSSGITAILRFLTDNPMALEELTEEHDRILKRKADPNSQITWEEYKSMKFTSHALRLANIAPVVFRKARQDVHIKGYTIPKGSKIMLSPSNIHLNPTVYKDPNEFNPWRWKVCGEIQSNL

SEQ ID NO: 76775 - protein, 442 aa, Zea mays
  misc_feature (324)..(324): Xaa can be any naturally occurring amino acid
AQGCKYCSAPHRSSCLVKVDSERRYVREYVVDLVVEPGSISCPDSSINGQLLSTVPSPFKTSSAVGSGNYTTPVAAWNQSTAGERRNMVSSNPQCSVARCRVVENSSAQVASSKEDLVPKCGQITQNGNCNGVSVLQVSMQLKAMDIGAENGNKENVPGADLPKPMSIEPPFAVDWLEISWEELELKERVGAGSFGTVYRADWHGSDVAVKVLTDQDVGEAQLKEFLREIAIMKRVRHPNVVLFMGAVTKCPQLSIVTEYLPRGSLFRLINKAANGEMLDLKRRLRMALDVAKGINYLHCLNPPIVHWDLKTPNMLVDRNWSVXRFKANTFISSKSVAGTPEWMAPEFLRGEPSNEKCDVYSFGVILWELLTMQQPWSGLGPAQVVGAVAFQNRRLPIPKDTSPELAALVEACWDDDPRQRPSFSSIVDTLKKLLKALLGGS

SEQ ID NO: 76776 - protein, 276 aa, Glycine max
MGTLGRAIYSVGNWIRETGQAIDRLGSRLQGGYYFQEQLSRHRTLMNIFDKAPVVDKDVFVAPSASVIGDVQLGRGSSIWYGVVLRGDVNIIRVGNGTNIQDNSLVHVAKSNLSGKVLPTIIGDNVTVGHSAVIHGCTVEDEAFVGMGAILLDGVVVEKNAMVAAGALVRQNTRIPSGEVWAGNPAKFLRKLTDEEIAFISQSATNYTNLAQVHAAENSKSFDEIEFEKVLRKKFARKDEEYDSMLGVVREIPPELILPDNVLPDKAEKALKKSGI

SEQ ID NO: 76777 - protein, 223 aa, Magnetospirillum magnetotacticum MS-1
NHWSRVIRVFEDAARQIVEDAGEHGAEVKFLVQGTLYPDVVESGGGEGAANIKSHHNVGGLPDDLQFSLVEPLRTLFKDEVRAVGRELGVPEEIVARQPFPGPGLGIRIVGEVTADRLETLRAADAIAREELTKAGLDQEIWQCPVVLLADVRSVGVQGDGRTYGHPIVLRPVSSEDAMTADWTRLPYDVLSVISTRITNEVSEVNRVVLDVTSKPPGTIEWE

SEQ ID NO: 76778 - protein, 559 aa, Debaryomyces hansenii CBS767
MVSENGAPNRKDAELSKNEIKKEQNTNSESKSSSTPQDPPPFVRAISNLRCPSPPPILNNSNNNNATKKAASSSPILGNSMSMSTPNITQQRETIPAGGAVLKEKEKVANQSATSIIPPQGHEPSFNVPLVREPGSSVNFNHYISPISSPAGSHVTGSNNSLTSLDYVSNPPSQSAHHKVPSVHAHFYVDETVKPGKAINRSRSSSASDYPPASLPANGTRKSSKKEKGNDLNLFAPPSIDSVLGPNEQNSNIDPRLPQDDGKLHVLLGVCGALSTIKIKLIINKLVEIYTPDKISIQIILTKSSENFIPQEMLHHLENNKRIRVWRDSDEWNTWKTRLDPVLHIELRRWADILIVSPLTANTLSKISLGLCDNLLTNVIRAWNTSFPILLAPSMVSASYNAVTTKRQLRLISEEMPWIEFLKPVEKVVGSYGEIGMGGMMDWNEIVNRIVLKLGGYPDEEDEEDNEAEDEEKKDDNEEAIMDDDDDDDDDDDDDDDDDDDDDDDDDDDDDDDDDDDDDDDDDDDDNDGDDNTENKNSVSQTAENLQSLIIEEEESNNT

SEQ ID NO: 76779 - protein, 507 aa, Gluconobacter oxydans 621H
MPDTDQAASWLASARSSLTDISVGPRTDRTGRVEDIGDGIALISGLPDAKLDELLSFGNGRYGFVHGLEEDSIGCILLNNEGTIEAGDAVQGTSGVVSVPVGPGLLGRVVDPLGRPLDGKGPVEAETWFPVERPAPAIIDRELVTEPVQTGTLAIDTLFPIGRGQRELIVGDRATGKTTIAVDAILAQKSNDMICVYVAIGQKTSSVQRVIETIRTRGNPDRCIIVVARPAEAPGLCWIAPFAAMSMAEYFRDRGQHALLVIDDLSKHAATHREVSLLTGRPPGREAYPGDIFYVHARLLERAAKLSAAKGGGSLTALPVAETEAGNLSAYIPTNLISITDGQIVLNRTLFDQGQKPAVDVGVSVSRVGGAAQSPILRSSVGTLRLDYAQFIELEAFTRFGGLPDTHVRQQLARGACIRATLRQGPHAPLDLLQEVALVTASQNGLLDGVTAKNIRTIQSGLGDYLRSNASEISTAIESGGVLSAEQKERFVACLRQYVEPRASAAS

SEQ ID NO: 76780 - protein, 342 aa, Physcomitrella patens subsp. patens
MASPKTAPPFADDEMFDFDGETCNENGMTGVKREFADLDDDEEELYPSKKIYASHGPSSDHATTTILNLRSTLEDRDSTIATLKASLDAANGELDKWKNSFINDSLFPAGTTADPAVVTQAMQKLQTTESQLKEQLLTAKRRESVLVVKLANTEQEVVDLKSTVHDLKLMLKPSMQQTRRLFLDPAIHAEFSRMKKELEAADKRVKELQDDLAAVQFTPHSKHGKLLMAKCRTLQEENSEIGREASEGKVHELGTRLAVQKSLNSKLRRCYQELYDTVEDVNYELERSQQMVYNLQREVQKRDHQLAEVLKQNEEHQSRREEPTTTHEEEDHQQLVVKDGDK

SEQ ID NO: 76781 - protein, 632 aa, Streptococcus suis 89/1591
MIILSGNKIERSFAGEVLFNNINIQVDERDRIALVGKNGAGKSTLLKILVGEETATSGEISTKRDLSLSYLAQDSRFESANTIYDEMLHVFDDLRTTEKRLRSMEEQMGSLSGSDLDQLMKTYDSLSEEFRLAGGFSYEADIRAILNGFKFDQTMWDMKISELSGGQNTRLALAKMLLESPELLVLDEPTNHLDIDTIAWLENYLVHYKGALIIVSHDRYFLDKVATLTLDLTKHSLDRYVGNYSQFVELKEQKLQTELQNYEKQQKEIAKLEDFVQKNIVRASTTKRAQARRKQLEKMERLDKPTTGQKSANMTFQSDKTSGNIVLTVENAAVGYDGDILSQPISIDQRKLDAIAIVGPNGIGKTTLLKSIIGALPFIKGEAKLGANVEVGYYDQTQSALTPSNTVLEELWSAFPTTPEVEIRNRLGAFLFSGDDVKKSVAMLSGGEKARLLLAKLSMENNNFLILDEPTNHLDIDSKEVLENALIDFDGTLLFVSHDRYFINRVATKVLEISETGSTLYLGDYDYYLEKKAELEVEAQPDQLESTSQSAGAMDYQAQKENQKEQRKLARRIEQIEAEIETIENRLSELNQAMLETNDIGQLTDYQKEIDQLTSQQESLMEEWEELSEQMG

SEQ ID NO: 76782 - protein, 157 aa, Daucus carota
QGRLSQEQSYRGVRKRKWGKWVSEIREPGKKARIWLGSYEAPEMAAAAYDVAALHLRGSAAHLNFPEMVGSLPKPVGSSHADVQRAAQEAAMSMRFGRSENRGPVTVQLSSSEIRAINESPLDSQEMWMEMGGSVFVEERRDDEELEEMQCSSLWKF

SEQ ID NO: 76783 - protein, 257 aa, Gluconobacter oxydans 621H
MYMEKLRLDNRVAIVTGGAQNIGLACVTALAEAGARVIIADLDEAMATKAVEDLRMEGHDVSSVVMDVTNTESVQNAVRSVHEQEGRVDILVACAGICISEVKAEDMTDGQWLKQVDINLNGMFRSCQAVGRIMLEQKQGVIVAIGSMSGLIVNRPQQQAAYNASKAGVHQYIRSLAAEWAPHGIRANAVAPTYIETTLTRFGMEKPELYDAWIAGTPMGRVGQPDEVASVVQFLASDAASLMTGAIVNVDAGFTVW

SEQ ID NO: 76784 - protein, 589 aa, Flavobacteria bacterium BBFL7
MSQTLLSQMNSPADLKGCDVDQLPQIAQELRDFIIEVVATKEGHLGASLGVIELTIALHYVFDTPEDLLVWDVGHQAYGHKILTGRRDVFHTNRDLNGISGFPKRDESVYDTFGVGHSSTAISAALGMAMASQLKGTDRKHIAVVGDASIASGMAFEALNHAGVSGADLLVILNDNAIGIDPAVGALKDYLTKTKSGKETGRDNIFESLNFDYSGPIDGHDLPLLLEELKRQKSLKGPRLLHVRTTKGKGLKQAEIDQVRYHAPGKFDKTTGDLTPSDTSLLPPKFQDVFGHTIVELAQQNENIIGITPAMPTGSSMKIMMDVMPDRAFDVGIAEQHAVTLAAGMATQGLVPFCNIYSTFLQRAYDQVIHDVALQKLPVIFCLDRAGLVGQDGATHHGNFDLAYLNCIPDLIIAAPMDAIELRNMMYTAQLGLELPIVIRYPRGRGRILNWQQPFQKLSIGQSRVIHASTKIAVLSIGSIGAMIDDLISDEELDVTHVDMRFLKPLDHDMLDDIFEQHEHIITIEDGTVIGGLGSVVVDYASAKAYKNNIYKLGIPDAFIQHGPTKDLHKIAGIDSETVFNLISDLSTR

SEQ ID NO: 76785 - protein, 302 aa, Bradyrhizobium sp. BTAi1
MGRVVVAGSINMDVVATAERHPRIGETVAGHSVMYFPGGKGANQAVSAAKLGAPTSLIGRLGRDAFGEQLRAFLASQGIDLTAVKDSAGAATGTALITLAKADNTIVVIPGANAEVSPEDVAQVALTASDVAVSQFEIPQATIVAFFRQARAAGATTILNPAPASAFDSALFALIDVLVLNETELGFLTGIALGDTPTLPQVSDAVRALDPRDDQTVCVTLGARGAVAVTGSKARLVEGRAVTAVDTTGAGDCFVGALAARLSQGAPIADAIGYANIAASISVQRMGAGPSMPTAEEVGALL

SEQ ID NO: 76786 - protein, 108 aa, Ipomoea batatas
MESEEGQVIGCHTVDQWKEHFEKARASGKLTVVDFTASWCGPCRFIAPILADMAKKTPHVIFLKVDVDELKSVAEDYKVEAMPTFVFLKEGNEVDRVVGPRKKNCFVA

SEQ ID NO: 76787 - protein, 419 aa, Bradyrhizobium sp. BTAi1
MTVYAGPVFEMAANQFNVIADHLGIPADERDRLLLPKRAITVSCPIHKDDGTIAVYEGYRVQHLLTMGPTKGGTRFAPTVDIGEVAALAIWMSWKCALVGLPYGGAKGGVTVDLSKLSRRELESLSRRYMQEMIPFVGPHTDVMAPDMGTNEQVMAWFMDTYSMYQGQTVTEIVTGKPVFSGGTLGRREATGRGVAHVSRRVMDVLGIDPAKSTVVVQGFGNVGSYAALGFHQMGMKVIAVSDHTGALHDARGLDIPALMAHASKHGSIAGFSTELAFDPKEILTLACDILVPAAVERVIDAKVAANLKCRVIAEAANGPTTPDADLVLDQRRKEIFLIPDILCNSGGVIVSYFEWVQDLQQLFWEEEEVMRREYQILDRAFERMVTRAKADDISHRTAAMAIGVEKVRNAKNTRGLFP

SEQ ID NO: 76788 - protein, 123 aa, Ipomoea batatas
MAAATSSEEGQVIACHTVDHWKEQFAKGVETKRLVVVDFTASWCGPCRMIAPILAEIAKKMAHVIFVKVDVDELQAVAAEYKVEAMPTFVFLKDGKEVDRMVGAKKDDLQNCITKHAAAVMTA

SEQ ID NO: 76789 - protein, 4032 aa, Streptomyces nanchangensis
MSGGAVTTETNEERLVDYLKRVAADLHDTRARLREVEDGQREPVAIVAMACRYPGDVASPEDLWDLVAARRHAMTAFPDNRGWDLERLFHPDPDHPGTSYAREGGFLHDADLFDPEFFGISPREAAAVDPQQRLLLEVAWEALERAGIAPGSLKGAPVGVYAGTALPGFGTPHIDRAAEGYLVTGNAPSVLSGRVAYTLGLEGPAVTVDTACSSSLVAMHLAAQALRQGECELALAGGVTVMTTPYVFTEFARQRGLAADSRCKAFSKGADGTAFAEGAGLLVLERLSDAQRNGHQVLAVMRGSAINQDGASNGLTAPNGLAQQRVIRQALAGARLSPADVDVVEAHGTGTTLGDPIEAQALLATYGQERPEGRPLWLGAIKPNLGHTQGAAGVAGVIKMVMALRNASLPALLHADRPTSVVDWDGGAVRLLAEPVAWPAGDRRRRAGVSSFGISGTNAHLILEEAPPRPDTELPASVPQRPEGTVVPWVVSARGAVSLRTQAAALAEHMAAHPDTPVDAIGWSLATTRSPLDHRAVVLGADRGELSARLADLAEGRTHPDVTRASAPARLGGSAFLFTGQGSQRPGMGAQLYRAYPAFAAAFDEACAALDPHLGRSLLELVFAPADTDGDGDADRASALDATEVTQAALFAVEVALYRLVESFGVVPGYLAGHSVGELVAAHIAGVLSLPDAARLVAARGRLMQALPEGGAMVALEAAEEEVALLLAGRADQVALAAVNAPTSVVVSGDEEAVEEIARTIRERGHRTRRLRVGHAFHSPRIDPMLEEFRQVAASLTYSQPRIAVVSNVTGALAGAEQLCDPDYWVRHARQPVRFRDGIAALRAEGVTRFLELGPDAVLTAMARDCLTSEAAPEVAAGESAQDAGTASGPSAPVLATVLRKGRDEPRTLLTALAQLHVDGESVDFSASFPATTQATDLPTYRFDRRRYWRDAPQAEADVRAAGLEASDHPLLRAALEPADGGLLLTGRLSLRGQPWLADHAIVDAVPLPGTLFVELALQAGERVGCDLIDDLTLEAPLLLPPVGAVDLQVAVGATDAAGRRAVTVYSRPSGGGSEGWESSADPGVADEPGDGPYGPWRRHATATLGTAPTGVPEPAASPAQWPPAGAEAIDVAGLYERLAAEGYRYGPAFTGLRTAWRVGEEMFAEVGLAPGQRGDGGAYAVHPALLDAALHPIGALFTGEDQAGGAPGTVRLPFSFGGVRLLARGASRLRVRITPTGPDTVTMRLSDDTGAEVVAVDSLTLRTVSAQRWRSGAVPADRPLYRLDWDAFALPAAATTAPDRWAVLAADDTNATDTATASLPAEHVARHPDLAALSASVAAGAPAPDLVVMACLGAPYDTSDDGDEPPSQVRTATHRVLARLREWLTDDALAASRLVVLTAKAVAADPADAPPDLAGAAVLGLLRAAQAEHPGRIVLVDTDGISASRDALAAAVAAAVAAGEWQLALRDGRALVPRLILAHPDPDAAPVVLDPDGTVLVTGGTGSLGRLLARHLVEHHGARHLLLVSRSGPAAEGIEAFAAGLAADVRIESCDTTDPEALAALLATVPGEHPLTAVVHTAGVLDDGVVTSLTPEQLDTVLAPKVDAAWQLHRLTRGADLASFVLFSSAASVLGSGGQGNYGAANAFLNALAEHIRAAGGPATSLAWGLWGVDEGMTEHLATADRARMARSGTAAMSGEAGLARFDAALATALPVLVPARFDLAVLREQAAGGALPPLLRRLVRLPVRTAAAVEASPSWAGRLAGLPETEQDRVIGELIRDRIAAVLAHPEPETLELGRTFAQLGLDSLTALELRNAIHEATGVRLPATAIFDYPTPETLVSHLRTELLGATATTAATAPLPPGAGAPARSGSADDPVVIVGMACHYPGDVHSPDELWRLVADGVDAIGPFPEDRGWDVAGLYDPDPERTGKSYTREGGFLPEAALFDAEFFGISPREALATDPQQRLLLETAWQAFEHARIDPAALRGSRTAVVTGIMYDDYGARFLGRIPEGYEGQIMTGSTPSVASGRVAYTFGLEGPTLTVDTACSSSLVAMHLAAQALRQGECDLALAGGVTVMATPNTFIEFSRQRGLAPDGRCKPFAAAADGTGWSEGAGLLVLERLSDARRNGHRVLAVLRGSAVNQDGASNGLTAPNGPSQQRVIGQALAAAGVDPAGVDVVEAHGTGTMLGDPIEAQALLATYGRNRPAEQPLWLGSIKSNIGHTQAAAGAAGIIKMVMALRHGRLPATLHVDEPSPHVDWASGSVRLLTEATDWPEADRPRRAAVSSFGISGTNAHLILEQAPDQPEPLPEQSESATAGGIVPFVLSARTAEALRAQAANLAARLPSAGVAEVGWSLATTRSAFEHRAVIVAEDRDALLAGLEKLAADEPDPAVVAGTATTAAAGPVFVFPGQGSQWRGMGVELLDTSPVFAARIAECERALAPYVDWSLTAVLRGSDTTTDPHRVDVVQPTLWAVMVSLAALWQHLGIAPAAVIGHSQGEIAAACVAGALTLDDAAKVVALRSQALRALAGHGTMASLTLGADDTAGLLEELGERADDVTVAAANGPVTTVISGAVEQIATVLAAAEAHGARTRTIDVDYASHGPHVDRIREDIVSALSGLAPTASEVAFYSTVTAERLDTAGLDADYWFTNLRRPVRFADTLATLLAHGHRHFIEVSPHPVLIPGMQDGFEAADAAATAVPTLRRDQGGPHQLAQAVARAYTAGLAIDWAPWYPARPYTTDLPTYPFQRRRYWLGMDGGPGDLRSAGLVSVSHAQIGAAVELADGGLVMTGRLPAAGSGGWLDDHVVADTPLVPGTALVEWVLRAADEAGCGGIEELALHVPMTLPASGGLRIQVVAYAPDGDGRREVRVHSRPDAEDGSSPWTCHATGHLSPTAPGAADPAPAGVWPPRDAEQVDVADFYGRAEAIGYGYGPAFRGLTAAWRQGDDLLAEVVLPEAAHEGADGFALHPALLDAALHPLALDGQGEDGRMRLPFAWSGVSLWATGARAARVRMSPLEHGFRLVVADAAGRPVLSAESVVVRPTSARQLRDAGARRVDGLYEVAWVALPPSSDTVAETETRGVEGWALLDGGPLPFDPSKAGSLPRHADIDALLTAPALPSTVLVGVSGPVGAAGDENSAEGALAVTTGVLTSARRWLETPELADARLVLVTRGAVAAAETDDGPDPAAAAVWGLLRSAQAENPGRFLLCDIDDGAGPDDVLGAVTRAVALDEPQVAVRGERVLTPRLERAGAAELVPPPGEPAWRLSADDTGTIDSVSVVACPEVLEPLAPGQVRIAVRAAGINFRDVLIVLGMYPDEGVFRGSEGAGVVLDVADDVTSVAVGDRVFGLFEGAFGPVAVADARAVVPVPPDWTDQQAAAVPTTFLTAWYGLVDLAGLKAGESVLIHAATGGVGTAAVQIARHLGAEVYATAGPGKHAVLEAMGIDEAHRASSRDLDFEDAFRTATGGRGVDVILNSLAGEYTDASLRLLTGGGRFIEMGKTDKRDAEQIADTYSGVRYRFYDLVPDAGLDRVAEMLTTLAGHFAQGVLAPPPVRAWPLTEARQALRQMSQARHTGKYVLDMPRTLDPDGTVLITGGTGTLGALVAEHLVTNHHISHLHLLSRRGPDAPGSADLAARLTELGATVRITATDTTDPQALRQALDTVDRDHPLTGVIHAAGALDDAVLTAQTPERLASVWAAKATAAANLHRATKDLPLAMFVIFSSAAGTLGTPGQANYAAANAYCDALAVRRRRAGLPATSIAWGLWAATSEMTGHLADADLARMSRTGFTPLATPMALALFDAAGRHGAATPLALDLDPRTLGAQPSDAVPAVLRTVAAAGAPVRRTAAVAQSTDWAGRLAALSAAERHRELVNLVRTHAATVLGHSDPAALRADTSFKELGFDSLTAVELRNRLSAATGLRLPAALVFDYPDAETMARFLDQKLAPGDRTEAAAVDHLAPVLNDLARLESTLGSHDVDGKARETVAGRLHALLSRLEGSTASAADIDGEALESASDDEMFALIDQQLGSS

SEQ ID NO: 76790 - protein, 472 aa, Escherichia coli
  misc_feature (450)..(450): Xaa can be any naturally occurring amino acid
MVTINTESALTPRSLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFVGITFWLIPETXNVTLEHIERKLMAGEKLRNIGV

SEQ ID NO: 76791 - protein, 3979 aa, Streptomyces nanchangensis
MPDEERLVDYLKRVATDLHDTRRRLREVEERHQEPIAITAMTCRFPGGVDSPEALWDLVASGGDVIGPFPADRGWDLEGLYHPDPDHPGTTYTREGGFLRDADTFDSGFFEISPREALVMDPQQRKLLEVTWELFERAGLDATSLRGSRTGVFIGAATMGSGTPSGPARKESEGYVGVAPSMLSGRLSYTFGLEGPSLTVETACSASLVAMHQGIHALRQGECGLAVVGGVTIMSSPAVFIGFARQRGLAPNGRCKPFAAGADGTGWGEGAGLVLLERLSDARRNGHQVLAVIRGSAVNQDGASNGFSAPNGPSQQRVIRQALLNARLSSAEVDAVEAHGTGTRLGDPIEADALHATYGQRRPADRPLLLGSVKSNIGHPQAAAGVAGVIKTVMAIRHGLFPATLHIDEPTPHVDWGSGAIRLVTEPVEWPETDHPRRAGVSSFGVSGTNAHVIIEQAPDPDTSETDAGETDAGETARDAEGAAPARQAVVAGGVVPWMLSARDEAALARQALRLAEVAEGDPAADVTDMGWSLATTRARFEHRAVVVGTDRATLLDGLAKLAADEPDPAVVTATAGPIGAGPVFVFPGQGAQWPGMARELLDSSPVFAARIAECERALGPYVDWSLTEVLRGTDPATDPGRDDVIQPVLWAIHVSLAAVWQSFGITPAAVVGHSQGEVAAACVAGALTLDDAAKVIALRVQALRPLIGHGAMASLSLGAEDTARLLAELGAAAGDVAVAAVNGPHATVVSGSPDHLDAVLETARERGARTRTIDVEYASHGPHVDRIRDDIVSALRDVTPVESEIAFYSTVTAERLNTAELGTEYWFDNLRRPVRFADAVGRLLADGYRAFIQCNPHPILSTSLQDIFEESGTRAASLATLRRDHGGAHQLALALAQAHAAGVEVDWRPWFPADRTPRTVELPTYPFQGKRYWIPVGGSGAGDVSAAGLRAVDHPLLAAAVSLPDGGMVLTGRLSATTGAGWLADHVVGDTTLLPGAAMVEWALQAAHEAGCAAVEELALQTPFVLPASGALRVRVAVGPADDEGRRTVDVYSRPDELDTETPDGWVCHAMGVLAPEAPEDRTAPPDAPAAPWPPRGAEPLDVTDFYERAAAGGYGYGPAFRGLTAAWRDGADLLAEIALPEAAGEGADRFGIHPALLDAATHPTILGGGREDGSDAGQVWLPFAWSGVSLWATGARRVRVRIFPEDNGQRISLTDETGAPVLEAASVAARPTGLAELRALGARAAEGLFVVDWVPARGGTGDAPPPDDGGWATVGGGGVRLAGVADHADLGALLAAVDDGAPVPTVVLHPVPATATPDDGLAAVGGVLALIREWLAEPRWLDSRLVLVTSDAVSAGDDEGAVDPGGAAVWGLVRSVQAEHPGRFTLLDVGGDTDADAGGGESLAEAVRRSIDADEPQVVVRAAGTLVPRLVRTAPAAEADTPELSGGTVLVSGGTGVLGGAAAEHLVRAHGVERVLLLSRRGPNAPEAAELVRRLTALGAQVDVAAVDVADRAALAETLRTIPDSHPLLGVVHSAGVTDDALVESWDADRLTRVWEPKATGAWHLHTLTRDLPLRMFVVFSSAAGVVGNSGQAGYAAANACTDALIAHRRAAGLPGTSVAWTLWEQASAMTEHLTEADLSRLGTLGMRPLATSRALGLLDAALHVTHPVVVAADLDATRLGPDSPAMLRALARPARRRAMEHHATGPALAGRLAGLDATARRDLLLQTVRQMVTVVLGHSSDAAIRAEAAFKELGFDSLTAVELRNRLAGATGLRLPATLVFDYPTPLALADHLLERLTATASPASPRAVPSRAGAADEPIAVVSMACRFPGGVTTPEELWDLVAADRHVLGPFPTNRGWDLANLFHPDPDHPGTTYASEGAFMYDADGFDAAFFGINPREALAMDPQQRVLLETSWELLERAGIDPHTLKDSLTGVYAGVMYHDYGNGLPPGDPRLDGYAGLSGTSSIIAGRVAYTLGLQGPAVTVDTACSSSLVTMHLAAQALRQGECDLALAGGVTVLATPDVFTGFSRQRGLAPDGRCKPFAAAADGTGFGEGVGLVLLERLSDAHRNGHRVLAVLRGSAVNQDGASNGLTAPNGPAQQRVIRQALAGAELDPADVDAVEAHGTGTTLGDPIEAQALLATYGQDRPTDRPLWLGSIKSNIGHTQAAAGVAGVIKMIMAMDHGRLPTSLHIDEPSPHIDWTTGNVRLLTEPADWPATDRPRRAAVSSFGASGTNAHLILEQAPDRPGDGPAGDRPAPVAVAWPLSARTDEALRTVATALADRLGADDTTPVTDVGWSLATARATFERRAVIIGSDRQEMTAALDALARDLPHPNLVAPLPVAPPAGDTVWLFSGQGSQRPGMGAELHERFPAFADTFDEICALIDPHLDHPLRDIVFATHPDHTDLLNHTTYTQAGLFAVQVALARLLEHCGLRPDTVIGHSIGEITAAHIAGVLSLQDACHLVANRATLLGKLPPGGAMTAIEATAEEITQTLTPYHGQVTIAALNAPTSTVISGPEELVAQLTRRWKERGRRTKTLTVSHAFHSPLMEPALNDFRHAIDHLTYHQPTIPLISNLTGEPATQDIATPDYWVRHIRQPVHFHPAITHIAPHTAAFLEIGPDATLIPATQNTLDTLENQPTSAPQLIPTLTRKQPDTQALAHALARLHTLTPLNWHPWYTDQPTPTTIDLPTYPFQHERYWLTPTHAGPTTPGATPLTHPFLAATAPLADGGLLLTGQVPSADHAGWHTEHTIAGATLLPATALLEIALHAADHTTTPHIDELILQHPLTLDPSHPLALQAIVSPADDSGHRALHIYTRAPSSPTAEWTHHATATLGGEPTAERPTTEAEAAWPPPGAKAVDITGFYDRAAADGYHYGPSYQGLQTVWRQGEDLLADITLPTAGTPDHTTDSLAIHPALLDAALHPLLATADNPDGEIWLPFTWSGVTLHATGATHVRARITPQGDNDYRLTLTDATGQTVLTAGTIASRPLDTARLRTRGPGDGLYQVRWTAMPIPAGSATAVADDWAMLGDAGLRDGGLADAVAPLASYPDVAALVAAMDDGTPVPSVVLTGLAPADGGDADVVVEVLTTAREWLAEPRLAESRLVVVTHDAAVAEDTDSGPDGGDVDPVAAGVWGLIRSAQSENPGRFTLLDLTRRDAGTAPDVVEVLRAAMDADEWQVAVRGGRALVPRLTAADAAAGIVLPVGAPAWQLVMADERAGTVDGLAPEECPEVLEPLAPGQVRIAVRAAGVNFRDVMVTLGVVPDRRGLGGEGAGMVLDVAPDVTSVAVGDRVMGLFQGSFGPIAVADARALVPVPPGWTDRQAAAVPIAFLTAWYGLIDLAGLKAGESVLIHAATGGVGTAAVQIARHLGAVIYATASPGKHPMLEAMGVDETHRASSRDLDFEHIFRAATGSEGMDVVLDCLAGEFVDASLRLLGQGGRFIEMGKTDIRDPEQIADTHPGVHYRSYDLVSDAGLDRLSEMLGTLADLFAQGVLTPPPVQAWPLARARQALRHMSQAKHTGKLVLDIPPALDPDGTVLITGGTGTLGALIAEHLVTNHHITHLHLLSRRGPDAPGAAELTAHLTELGATVHITATDTTDPHALRQALDTVDPRHPLTAVIHTAGIVDDAVITAQTADSLHRVWAAKATSAANLHQATEHLPLAMFVIFSSAAGTFGSPGQANYAAANAYCDALATRRRHAGLPATSIAWGLWAATSGMTGGLTEIDHARMSRSGMAPLPSEHALALFDAAHGLGAARVLAARLDLARLSAQPTEALPPLVRSLTGTGPRTARRSAAAPVADLSGRLASMAPAGQLALLLDLVRTHAATVLGHMDSGTVSADTPFKDLGFDSLTAVELRNRLTTVTGLRLSAASVFRYPTATAMAEHLRGELCPTGDDTAQPVLRELARLEAAVGESKPEGETSAQLVKRLQTLLWRLGDEAAAVDHTVDGEELESASDDEMFALIDQQLGSS

SEQ ID NO: 76792 - protein, 259 aa, Triticum aestivum
MSLSNKLSIADVDVKGKKVLIRVDFNVPLDADKNITNNQRIVGALPTIKYALENGAKSVILMSHLGRPNGSPNEKYSLKPVVAELEKLLSKKVTFAPDCVGPEVEEIVNKAEDGSVILLENLRFHIEEEGSSKDKEGNKTKADKAQVEAFRKGLTALGDVYINDAFGTAHRAHSSMVGVDLPQKASGFLVKKELEYFAKALENPQRPFLAILGGAKVSDKIQLIDNLLDKVNTLIICGGMAFTFKKTLENVSIGTPSST

SEQ ID NO: 76793 - protein, 744 aa, Oryza sativa Indica Group
MVLYADPPPPIKPPEIKIKELANKSTYESSMMEQKTRLHAIERHRSCEVSQAILSEVENRHQHQTLEPIKSPISGCSPSVESTTDTNTVHRHTVADAAWEALKKSIVHFRGQPIGTVAAIDKSQGALNYDQVFMRDFVPSALAFLMKGEPTIVKNFLLETARLQLREKMVDLFKLGQGVMPASFKVHHCNSKHKTESLLADFGETAIGRVAPVDSGLWWIILLHAYTIWTRDNSLAESPECQRAMRLILKLCLSEGFDTSPALLCADGCSMIDRRMGIYGYPIDIQALFFMALRCAVTLLKEDHNDDFVYQISRRIKALSYHLHSYYWLDFQRLNEIYRYKTEEYSETALNKFNVIPESIPDWIFDFMPSRGGYFIGNVSPARMDFRWFCLGNFIAILSSLTTGEQAEAILDLVEERWEELIGEMPMKVCYPAMENQEWQIVTGCDPKNTRWSYHNGGSWPVLLWLLVAVSVKLGRPHIARRAVEVMEKRLVKDEFPEYYDGKAGRNQLSLTRRRLHPGPDLLTLSSPRLRAGLRLARAAAGEAPVETVEAPPSKPEAEPSPAASNGAAVKAEKPPAAAAAPPLPKFRDSRWVNGTWDLRQFEKGGAVDWDAVIDAEARRRKWLEDCPEATSPDEAVVFDTSIIPWWAWMKRFHLPEAEKLNGRAAMIGFFMAYFVDSLTGVGLVDQMGNFFCKTLLFVAVAGVLLVRKNEDIETVKKLIDETTFYDKQWQATWQDESPSQPKK

SEQ ID NO: 76794 - protein, 359 aa, Mycobacterium tuberculosis CDC1551
MATHQVDAVVLVGGKGTRLRPLTLSAPKPMLPTAGLPFLTHLLSRIAAAGIEHVILGTSYKPAVFEAEFGDGSALGLQIEYVTEEHPLGTGGGIANVAGKLRNDTAMVFNGDVLSGADLAQLLDFHRSNRADVTLQLVRVGDPRAFGCVPTDEEDRVVAFLEKTEDPPTDQINAGCYVFERNVIDRIPQGREVSVEREVFPALLADGDCKIYGYVDASYWRDMGTPEDFVRGSADLVRGIAPSPALRGHRGEQLVHDGAAVSPGALLIGGTVVGRGAEIGPGTRLDGAVIFDGVRVEAGCVIERSIIGFGARIGPRALIRDGVIGDGADIGARCELLSGARVWPGVFLPDGGIRYSSDV

SEQ ID NO: 76795 - protein, 505 aa, Saccharomyces cerevisiae
MSEGPVKFEKNTVISVFGASGDLAKKKTFPALFGLFREGYLDPSTKIFGYARSKLSMEEDLKSRVLPHLKKPHGEADDSKVEQFFKMVSYISGNYDTDEGFDELRTQIEKFEKSANVDVPHRLFYLALPPSVFLTVAKQIKSRVYAENGITRVIVEKPFGHDLASARELQKNLGALFKEEELYRIDHYLGKELVKNLLVLRFGNQFLNASWNRDNIQSVQISFKERFGTEGRGGYFDSIGIIRDVMQNHLLQIMTLLTMERPVSFDPESIRDEKVKVLKAVAPIDTDDVLLGQYGKSEDGSKPAYVDDDTVDKDSKCVTFAAMTFNIENERWEGVPIMMRAGKALNESKVEIRLQYKAVASGVFKDIPNNELVIRVQPDAAVYLKFNAKTPGLSNATQVTDLNLTYASRYQDFWIPEAYEVLIRDALLGDHSNFVRDDELDISWGIFTPLLKHIERPDGPTPEIYPYGSRGPKGLKEYMQKHKYVMPEKHPYAWPVTKPEDTKDN

SEQ ID NO: 76796 - protein, 406 aa, Pseudomonas fluorescens Pf-5
MSVEQAPVQRADFDQVMVPNYAPAAFIPVRGAGSRVWDQSGRELIDFAGGIAVNVLGHAHPALVGALTEQAGKLWHVSNVFTNEPALRLAHKLIDATFAERVFFCNSGAEANEAAFKLARRVAHDRFGAEKYEIIAALNSFHGRTLFTVNVGGQSKYSDGFGPKITGITHVPYNDLAALKAAVSDKTCAVVLEPIQGEGGVLPAELAYLQGARELCDQHNALLVFDEVQTGMGRSGELFAYQHYGVTPDILTSAKSLGGGFPIAAMLTTEALAKHLVVGTHGTTYGGNPLACAVAEAVIDVINTPQVLNGVKAKHDRFKTRLLQIGEKYGLFTEVRGLGLLLGCVLSEAWKGKAKDVFNAAEKEGLMILQAGPDVVRFAPSLVVEDADIDQGLDRFERAVAKLTQA

SEQ ID NO: 76797 - protein, 354 aa, Cryptococcus neoformans var. neoformans JEC21
MSSKLPAAGKATRQFRILALPLARLPRPPPPSRTLPTTPPPSLESASSSHTTPPTPLILFHALQPEPSADSPPSLITKALDKSSETWLKLGEKPKGSWMYWFYEKGEKLMDRIEYEEWALKAVREGEGVKVAKDGQVLERIEIPLVLPRLPNQEMPSLLPKLHRFLLKRIPHHRKMMYRSILFSPVTWPFAIIPIIPNFPLFYVLWRAWSHYKAWRGATYLEQLIKAGLVVEKECPELTEIYAGKGREPLAATAALTDPSGKVKAGTTAQPFPPPAPGPITSQAQHPSLLLSPSQIPLLAKTFALKANEVVDVTRAVEQADFRARKTDQVEAKEAQEKEKAREEKEKEKEEEKV

SEQ ID NO: 76798 - protein, 1495 aa, Candida albicans SC5314
MSSEDIGSSSSSLQEYVGQQQHNKIQPSTDDDYNEDDYESRRLHLVRTVSSINHHNFDEKFDTISREISRQVTNKEGEFQLRLDEFNLAKILANFVYFAKKQGIVLRKSGITFQDLCVYGVDESFAIAPTVTDLLKGPVGAVQAILSQMKTPPRKILKNLNGFAKPGESVLVLGRPGAGCTTFLKALSGTDFDLYKGVTGDIRYDGLPQKEMLKLFKNDLVYNPELDVHFPHLTVDQTLTFAIACKTPEMRINGVTRDEFINAKKEILATVFGLRHTYHTKVGNDFVRGVSGGERKRVSIAEALACNGSIYCWDNATRGLDASTALEFAQAIRTSTKLLKTTAFVTIYQAGEGIYETFDRVTVLYDGHQVYYGPANKAKKYFEDMGWECPPRQSTAEFLTAITDPIGRFPRAGWENKVPRTAQDFEHYWLNSPQYQELMQEIKDYNDEIDEDETRSKYYQSIQQEKMKGSRTKSPFTISYLEQLKLCFIRSYQRILGDSAYTITLMFASVAQAFVAGSLYYNTPDDVSGAFSRGGVIFFAVLFMSLMGLAEISASFSSRPILMKQKNYTMYHPSADSLSNFVMSIPISIFINTFFVIILYFLSNLARDAGKFFICYLFVIMLHLTMKSMFQAIAAINKSIAGANAMGGILMLASLMYSSYMIQRPSMHPWFKWISYINPVLYAFEAVIASEFHGRKMQCTSQYLTPSGPGYENLGAGEQVCTFIGSVPGQSWVLGDDYLRIAYTYRFSHVWRNLGILFGFLAFFLAIATLGTEYVKPITGGGDKLLFLKGKVPEHITLPSEKKEEDIESGGNSDTTATSNGTLSQGKSEEKAAIADDGLKAKGVFVWKDVDYVIPYEGKKRQLLQNVSGYCVPGTLTALMGESGAGKTTLLNVLAQRVDFGVITGDMLVNGRPLDTSFSRRTGYVQQQDIHFSEVTVRESLQFAARLRRSNDVSDAEKLEYVEKIIDVLDMRGYADAVVGRLGNGLNVEQRKKLSIGVELVAKPSLLLFLDEPTSGLDSQSAWAIVKLLRDLANAGQSILCTIHQPSATLFEEFDRLLLLKKGGIVTYFGDIGPRSRTILDYFERNGARHCDDKENPAEYILEAIGAGATASTDFDWGEIWAQSPEKVQTDAKRDELINESAKNATDTSATDSPSEKNLTSKYATPYWYQFRHVTHRTSLIFYRDPDYIAAKVFLMTIAGLFIGFTFFGLKHTKTGAQNGMFCAFLSCVIAAPLINQMLEKAGSRDIYEVREKLSNTYHWSLLILPQIIFEVIYMIIGGTIMFVCLYFPTQVSTVASHSGMFYFSQAIFLQTFAVSFGLMVSYVSPDIESASVIVSFLYTFIVSFSGVVQPVNLMPGFWTFMNKVSPYTYFIQNLVSSFLHDRTIRCNAKELSYFNPPSGQTCKEFASAFISRNGGYLVDEGATSNCGYCNFSNADQYLLTIGAKFSYRWRNIGFFCVYIIFNISVCLVLYYFLRYRKVSFNVTGLVNKFKKSKK

SEQ ID NO: 76799 - protein, 601 aa, Synechococcus sp. CC9605
MALLVQKFGGTSVGSVERIRAVADRIGRCREEGHDVVVVVSAMGHTTDELTGLANAITSAPTQREMDMLLASGEQVSIALLAMALNAQGVSATSMTGPQVGIATESTHGRARILGIRTDRIRNRLAAGQVVVVAGFQGTSTSSDGLNEITTLGRGGSDTSAVALAAALGADACEIYTDVPGVLSTDPRKVSDAQLMETISCDEMLELASLGASVLHPRAVEIARNYGVNLVVRSSWSDAPGTRITSRSARPISSSGLELGSPVDGMEEVDGQAVLALSQIPDQPGIAARLFETLSEAGINVDLIIQATHEGSSNDITFTVSEADLELARPVCQKVLDQLGGDLASEGGLTKLSISGAGIMGRPGIAAGLFKCLCQQGINLRLIATSEVKVSCVIDSGAGSKAVQAVQEAFALEDSQIRINPTDNGSGEPEVRGVALDRDQVQLSVRHVPDRPGTAAALCSALADNSISLDAIVQSERQHSDGSRDITFILRKDDRARADVALAPLLAQWPGAALEDGEAIARVSAVGAGMPATPGTAGRMFRALADAGINIGLIATSEIRTSCVVAEDAGVQALQVVHAGFGLGGEERHTAQGTASPHDPD

SEQ ID NO: 76800 - protein, 826 aa, Zea mays
MAPVFFLLPLLLGQILLCAAGDTINSSTPLSGAQKIVSKGNKFTLGFYTPPQGTNTSSNQGNYYIAIWYSNIPLQTTVWMANPDLPVADPTTAALTIGSDGNLVLLDQSKNRQVLWSTNISTSSNSTIAVLQDGGSLDLRDATNSSMVYWRSIDHPTNTWLPGGKLGLNKTTGVSQRLVPWTNTANPSPGLFSLELDPRGTTQYLIQWNDSITYWSSGPWNNNIFSLVPEMTSGYNYDFQFINNATESYFIYSMKDNSIISRFIIDVDGQIKQLTWVPASQSWILFWSQPRTQCEVYALCGAYGSCNLNALPFCNCIRGFSQKVQSDWDLQDYSSGCKRRVPLQCQTNSSSSQAQPDKFYTMANVRLPDNAQTAVAASSQDCQVACLNNCSCNAYTYNSSGCFAWHGDLINLQDQYSGNGGGTLFLRLAASELPGSKRSKAVIIGAVVGGVAAVLIVLSIVAYFLFQKYRRERTLRIPKTAGGTLIAFRYSDLQHVTNNFSERLGGGAFGSVFKGKLPDSTAIAVKRLDGVHQGEKQFRAEVSTIGTVQHVNLVRLLGFCSEGSRRLLVYEFMPKGSLDLQLFLGETTALSWATRYQIALGTARGLNYLHEKCRDCIIHCDVKPENILLDESFVPKVADFGLAKLLGRDFSRVLTTMRGTRGYLAPEWISGVAITAKADVFSYGMMLFELISGRRNSDHGEQHGSTFFPTFAASKLHEGDVRTLLDPKLNGDANADELTRACKVACWCIQDDESARPTTGQIVQILEGFLDVNMPPVPRSLRVLGESPDVINFFSDISSNQTSQTQNSTTSQTRSTTSGSSHLQSP

SEQ ID NO: 76801 - protein, 371 aa, Streptococcus pyogenes MGAS8232
MALTAGIVGLPNVGKSTLFNAITKAGAEAANYPFATIDPNVGMVEVPDERLQKLTELITPKKTVPTTFEFTDIAGIVKGASRGEGLGNKFLANIREVDAIVHVVRAFDDENVMREQGREDAFVDPIADIDTINLELILADLESINKRYARVEKMARTQKDKESVAEFNVLQKIKPVLEDGKSARTIEFTEEEAKVVKGLFLLTTKPVLYVANVDEDKVANPDGIDYVKQIRDFAATENAEVVVISARAEEEISELDDEDKEEFLEAIGLTESGVDKLTRAAYHLLGLGTYFTAGEKEVRAWTFKRGIKAPQAAGIIHSDFERGFIRAVTMSYDDLMIYGSEKAVKEAGRLREEGKEYVVQDGDIMEFRFNV

SEQ ID NO: 76802 - protein, 607 aa, Oryza sativa Indica Group
MGACFSSHTATAAADGGSGKRQQRKGDHKGKLPDGGGGEKEKEAARVEFGYERDFEGRYQVGRLLGHGQFGYTFAATDRASGDRVAVKRIDKAKIPPLGVHSVTRFSLDKTSQESQLVLRYLQSSQDHPPDLTGLGALHQNVVNGLHFLIAEEAIPPMVRPVAVEDVKREVKILKELKGHENIVHFYNAFEDDSYVYIVMELCEGGELLDRILANFHSRTASRAIRPLLTGTFHFVRKNSRYSEKDAAVVVRQMLKVAAECHLHGLVHRDMKPENFLFKSTKEDSPLKATDFGLSDFIKPGKKFHDIVGSAYYVAPEVLKRRSGPESDVWSIGVITYILLCGRRPFWNKTEDGIFREVLRNKPDFRKKPWPGISSGAKDFVKKLLVKNPRARLTAAQALSHPWVREGGEASEIPVDISVLSNMRQFVKYSRFKQFALRALASTLKEEELADLKDQFDAIDVDKSGSISIEEMRHALAKDLPWRLKGPRVLEIIQAIDSNTDGLVDFEEFVAATLHIHQMAELDSERWGLRCQAAFSKFDLDGDGYITPDELRMVQHTGLKGSIEPLLEEADIDKDGRISLSEFRKLLRTASMSNLPSPRGPPNPQPL

SEQ ID NO: 76803 - protein, 489 aa, Synechococcus sp. RS9916
MAQIDLSRRTKIVATIGPATESPERLRQLIEAGATTFRLNFSHGDHSEHAARIATIRRVSAEMGVHIGILQDLQGPKIRLGRFADGPITLANGDPFTLTSRPVSCNQEIATVTYDKLADEVTAGSRILLDDGRVEMKVERVDKAEQNLHCTVTVGGVLSNNKGVNFPDVQLSVRALTEKDKTDLAFGLGQGVDWVALSFVRNPSDMEEIRGLIRQHGHTTPVVAKIEKFEAIDQIDAILPLCDGVMVARGDLGVEMPAEEVPLLQKELIQKANSLGIPIITATQMLDSMASSPRPTRAEVSDVANAILDGTDAVMLSNETAVGDFPVEAVETMATIARRIEKDYPQRRIDSHLPCTIPNAISSAVSTIASQLNAAAILPLTKTGATAHNVSKFRPAAPILAITSEPWVACKLQLVWGVTPLVTEPQERTSSTFATATNICRERGWLKQGDLVVQTAGTQPEVSGSTDLVKVGIVGSDGLLDSTHHNATI

SEQ ID NO: 76804 - protein, 427 aa, Frankia sp. EAN1pec
MPSIEAVGAREILDSRGNPTVEVEVVLEDGTLGRAAVPSGASTGAFEAVELRDGGDRYGGKGVTKAVEAVIGRIGPAIMELEATEQRLLDATLIDLDGTPGKSALGANALLGVSLAVAKAAAASSGLPLFRYLGGPSAHLLPVPMMNILNGGAHADTNVDIQEFMIAPIGAGTFAESLRWGAEIYQALKSVLKGRGLATGVGDEGGFAPSLPTNREALDLIAEAIDKAGFGLGDDIALALDVASTEFFADGSYTFEGSGRSAEQMIDYYADLVDSYPIVSIEDPLAEDDWAGWTSITTRLGARVQLVGDDLFVTNPERLARGIAEGAANALLVKVNQIGTLTETLDAVNLAHRSGYRCMMSHRSGETEDTTIADLAVAVDCGQIKTGAPARSERVAKYNQLLRIEEELDDAARYAGAGAFPRRTTTG

SEQ ID NO: 76805 - protein, 449 aa, Yarrowia lipolytica CLIB122
RAGYKLNSKRVLFVILSAIGFQTSTTTERTVFWPLFFAFEPNSAPVFIAMPSESTPLIGRRLQPSDHTYVQKVRIVLGSSYVNILLIFVPLGLLSGILGWGATWTFSLNFLAIVPLAALLSFATEELSAKVGQTLGGLLNATFGNAVELIVSVIALYQGQIRIVQASMLGSILSNMLLVLGCCFVAGGWGRVQQKFNMTVAQTMSSLLALGVTSLLIPAAFHASLPNSGKPGEDTDPSVVDPTLAVSRGTSIVILSIYTLFLYFQLGSHSGLFEDAESEAVDATEGEDEHEGSTLTPWESIFALVVITVMVSFCADYLVESIDDIVASSGLSKTFIGLILLPIVGNAAEHVTAVVVAIKDKMDLAIGVAIGSSLQIALFLTPFLVILGWIIDQPMSLYFSTFETAVLFVGVFVCNYLLQDGESNWLEGVMLLGTYFIAAIAFFYYPSDM

SEQ ID NO: 76806 - protein, 157 aa, Daucus carota
NQQGRLSQEQSYRGVRKRKWGKWVSEIREPGKKARIWLGSYEAPEMAAAAYDVAALHLRGSAAHLNFPELVGSLPKPVGSSHADVQRAAQEAAMGFGKSENRGPVTVQLSSSEIRAINESPLDSPKMWMEMGGSVFLEERRDEEQLEEMQCSSLWKF

SEQ ID NO: 76807 - protein, 515 aa, Daucus carota
MENGTKELNKPQPPSSAAMQLQTPVQKIPTATWKLVLVAAIAAGVQFGWALQLSLLTPYVQLLGIPHKWAAYIWLCGPISGMLVQPIVGYYSDHCQSSFGRRRPFIASGAGCVAISVILIGFAADISYKAGDDMSKTLKPRAVTVFVIGFWILDVANNMLQGPCRALLADLCSGDTRRMRSANAFYSFFMAVGNILGYAAGSYNNLYKLFPFSKTHACDLYCANLKSCFIISIALLIIITVVALSVVRENSGPPDDADAAEEPPSSGKIPVFGELLGALKDLPRPMLLLLIVTCLNWIAWFPFILFDTDWMGREIYGGTAGKGKLYDQGVRAGALGLLLNSVVLGLTSIAVEYLVRGVGGVKILWGFVNFILAIGLVMTVVVSKVAQHQREHSANGQLLPPSAGVKAGALSLFSILGIPLSITYSIPFALASIYSSGSGAGQGLSLGVLNLAIVVPQMIVSVLAGPFDSLFGGGNLPAFVVGAISAAISGVLAIVLLPKPSKDAASKLSLSGTYH

SEQ ID NO: 76808 - protein, 596 aa, Debaryomyces hansenii CBS767
MHALFETDWFLDSKKYGTPCIPKSFNEFMYLVEINAFYTYNKLRDYINTYYINAYCGVWGYLAIIRDAVFIYLMYLYMSQMVVLIRGRGMIASIRIFIHAISKRGFQFLLSIPPIKKKIDQELSETTKKIEEELMQNDESLMQFKSLPEKGLDATIVKKELDRLQDLKHSDWYNGRVSGAVYHGGNELLDLQSDAYHKYSIANQLHPDVFPGIRKMESEIVSMVLRLFNAPEEGCGSTTSGGTESLLLAGLSAREYGKFYKNISNPEIIAPITIHAGIEKACYYFGMKLHKVDLDPVTFKVDVNKVKKLINGNTVLLVGSAPNFPHGIIDDIEALSNLAVKYKIPLHVDACLGSFIVSFLEKSKVHGDKPIPKFDFRLPGVTSISCDTHKYGFAPKGSSIVMYRNSKLRQCQYYILTDWTGGMYGSPTLAGSRPGALMAGCWATLVNFGEDNYAESCRTIVGASMKLKCAIKEHEMLSKYLEVIGDPIGSVVAFGVTKNYRSTLSIYKIGECLSSKGWHFSTLQNPAALHFALTRLTVPVIGELISDLVEVTSAALKDESNSESEIAALYGVAGSVKTTGVAERVVVAFLDTLYKI

SEQ ID NO: 76809 - protein, 515 aa, Synechococcus sp. RS9916
MDHYLPRILRARVYDVARETPLEPAVSLSRRLDNSVWFKREDLQPVFSFKLRGAYNRMAQLSTEELERGVIASSAGNHAQGVALSAQQLQCRAVIVMPITTPDVKVQAVRGRGAEVVLHGETYDEAYAEAMRRSESDGLCFIHPFDDPEVIAGQGTIGMEILRQIPQPPDAIYVAVGGGGLIGGIAAYVKSLWPDVQVIGVEPHDAAAMTLSLEAGERIRLPQVGLFADGVAVRQVGENTFALAQRYVDAMVTVGTDEICAAIKDVFEDTRSILEPAGALAIAGLKADVARRNLRNKTLVAVACGANMNFDRLRFVAERAELGEEREAMLAVQIPEQAGSLRKLCECLDRRSLTEFSYRMSDGPQAQIFMGVQVQDHDDRRQLIGHLHDNGFSCQDLSDDELAKVHLRHMVGGRLPASAQCQQDNDCLELLYRFEFPERPGALMTFVTALRPEWTISIFHYRNHGADVGRIVVGVLVKNADLENWNTFLRDVGYPSWEETGNPAYRLFLGQSNPG

SEQ ID NO: 76810 - protein, 177 aa, Anaplasma marginale str. St. Maries
MCAVLFSIEEISSTIPREEEYLVHMGVGMQNSLNVLIVIGDFYPEISKLMIAGAVAKLQSYGAASVEHEVITVPGSFEVPAAISFAIMSDRERHDGYIALGCIVKGATNHHNVISSSVSASLGDIAVQHVVPLGFGIITSDSMELALERADPNGKDVGGNAATAVLRMIELYKRFLG

SEQ ID NO: 76811 - protein, 644 aa, Synechococcus sp. RS9916
MHLSELTHPNQLHGLSVPELEQIAAQIRERHLEVVSNSGGHLGPGLGVVELTLALYQTLDLDQDRVIWDVGHQAYPHKLITGRYGDFHTLRQQGGVAGYLKRCESDFDHFGAGHASTSISAALGMAIARDRRGESFKCVAVIGDGALTGGMALEAINHAGHLPNTPLLVVLNDNDMSISPPVGALSTYLNRMRLSPPMQFLSGSVEESVKHLPFMGGELPPELNRLKDSMRRLAVPKVGAVFEELGFTYMGPIDGHDIAEMTRTFQAAHRVGGPVMVHVVTTKGKGYPYAEADQVGYHAQSAFDLATGKARPSKTPKPPSYSKVFGQTLVKLCEQDSTVIGITAAMATGTGLDLLQKAIPSQYVDVGIAEQHAVTLAGGMACEGLKPVVAIYSTFLQRAYDQLIHDIGIQNLPVTFVLDRAGIVGADGPTHQGQYDISYFRAIPNFTVMAPKDESELQRMMVTCLQHNGPTALRIPRGPGEGVPLMEEGWEPLTIGCGETLRQGDDLLIVAYGSMVSRAMATADLLSQKGVQATVVNARFLRPLDQALIHPLARRIEKVVTMEEGALAGGFGAAVLESFNDHDVLVPLLRLGIPDQLVDHATPQQSFEVLGLTPEQMLVRISERFGFDRVHDTLNQPSQTLIQS

SEQ ID NO: 76812 - protein, 166 aa, Triticum aestivum
  misc_feature (77)..(77): Xaa can be any naturally occurring amino acid
DAWEGIGHAIVEELARFGARVHTCSRNTEELEECRRRWEEKNLQVTVSVCDVSIGADRERLMETVRQTFDSKLDILXESTFHLSQLAHPLLLHASIAGGGTIINMSSIGGSIGFAGYTIYATTKGAIHQLTRSLATEWGPDKIRVNAIAPSFITTDMIKDIDTEFM

SEQ ID NO: 76813 - protein, 256 aa, Gluconobacter oxydans 621H
MSHPDLFSLSGARALVTGASRGIGLTLAKGLARYGAEVVLNGRNAESLDSAQSGFEAEGLKASTAVFDVTDQDAVIDGVAAIERDMGPIDILINNAGIQRRAPLEEFSRKDWDDLMSTNVNAVFFVGQAVARHMIPRGRGKIVNICSVQSELARPGIAPYTATKGAVKNLTKGMATDWGRHGLQINGLAPGYFATEMTERLVADEEFTDWLCKRTPAGRWGQVEELVGAAVFLSSRASSFVNGQVLMVDGGITVSL

SEQ ID NO: 76814 - protein, 795 aa, Vibrio parahaemolyticus RIMD 2210633
MFLEKDMQKNTLWFNGLSMDDVDKVGGKNASLGEMVSNLANVGVSVPNGFATTSYAFNQFLDHEGLDERIHQLLDELDVDDVEALRKTGATIRQWVLQAPFPADLEQEIRNNYEELIEGNTELSVAVRSSATAEDLPDASFAGQQETFLNVKGIDAVLEATKHVYASLFNDRAISYRVHQGFDHRGISLSAGIQRMVRSDKASSGVMFTLDTESGFDQVVFITSSWGLGEMVVQGAVNPDEFYVHKPMLEAGEHPIVKKTFGSKLIKMIYSNNQEIGKQVDIIDTSEEERNTFSLNEEEIKELAKQAMIIEKHYQRPMDIEWAKDGIDGKLYIVQARPETVCSQTEQNVIERYELNNKADVLVEGRAIGQRIGKGPVRLVDSLDQMSLVQEGDVLVTDMTDPDWEPVMKKASAIVTNRGGRTCHAAIIARELGIPAIVGCGDATSKLTDGATVTVSCSEGETGYVYQGDLDFEVKRSSVDELPLLPTKVMMNVGNPDRAFDFAQIPNEGVGLARLEFIINKMIGIHPKALLNFDAQSDELKAEIKQRIRGYKDPIDFYVSKLTEGIATIASAFWPKRVIVRMSDFKSNEYSNLVGGKAYEPHEENPMLGFRGASRYISPVFEDCFELETQAIKRVRNEMGLKNVEIMIPFVRTPSEAASVIDLLAKFDLRRGDQGLKVIMMCELPSNAVLADEFLKYFDGFSIGSNDMTQLTLGLDRDSGDVAHLFDERNAAVKIMLKMAIDAATKAGKYVGICGQGPSDHEDLAEWLMEQGISSVSLNPDTVIDTWLQLGKVSK

SEQ ID NO: 76815 - protein, 159 aa, Rhodospirillum rubrum ATCC 11170
MIAVGDALPSGTLHHKTAAGIEAVDPAEFLGAGKAVLFAVPGAFTPTCSDSHVPGYIAQAQALRDKGVTKVACVAVNDAFVLAAWSKALGAEGTVEMLADGNGDYARALGLELDLTAKGLGKRFQRCALVLDNGKVTHLAVDEGGALDVSSAEAVLALL

SEQ ID NO: 76816 - protein, 354 aa, Vibrio parahaemolyticus RIMD 2210633
MTKNLFRLSTITLGLCLSSLSFAQSDLPNIKILATGGTIAGAGQSATESNYTAGKVGVESLISAVPSMTNIADISGEQVVSIGSQDMNDEVWLKLAKRVNELLAQDDVDGIVITHGTDTLEETAYFLDLTVKSDKPVVIVGAMRPSTAMSADGPVNLYNAVVTATDEDSKGRGVLVAMNDTIFDARDVTKTNTTSVSTFQSPNFGPLGYIHNSDAKYQRSPERKHTTETPFDVSKLNTLPKVGIVYNYANASSLPVKALVDAKFDGIVSAGVGNGNLYHTVFDELEKASKDGIVVVRSSRTPTGSTTLDAEIDDDKYGFVASGTLNPQKARILLMLSLTQTKNYQDVQKMFQYY

SEQ ID NO: 76817 - protein, 215 aa, Xylella fastidiosa Temecula1
MSEAKRRAAEKAIEYVENDMIIGVGTGSTVAYFIDALGHTPKRIKGAVSSSEQSTAHLKQHGIEVLELNHTGTLPLYVDGADECDPYKRLIKGGGASLTREKIIAEASKQFICIIDPNKQVATLGKFPLPIEVIPMARSLVARQIMARTDGQPVWREGVITDNGNVILDVHHLCITDPVKLEQELNQIPGVVCVGLFARRCADLVIIGSEPPHIL

SEQ ID NO: 76818 - protein, 200 aa, Streptococcus suis 89/1591
MTKTIYLMRHGETLFNTQKRVQGWSDSPLTERGIAQAQAVGQYFKEQGIVFTSAYSSTQERATDTLKLVTDAPYQQLKGLKEMNFGIFEAREEELLPKHRPGARSFEDLLVPFGGEDIRAVGSRVKEAILSVAESDPADPILMVSHGAAIWGLVQVLEVTFPPGVFLPNCAICQLTVENEQIRFEKLIDSAHDFKVYDFK

SEQ ID NO: 76819 - protein, 257 aa, Desulfotalea psychrophila LSv54
MPRPKLPRFIEMHPEVEGFSPDGISHTGDTTLSMEEFEAIRLSDYLGLDQSQAAEQMNISRQTFGRVLRQARFILSQALVTGKRLKVGGGCYKMQGRGGRRRRGRTTIDLKEDLMTQAEQENSQLNQAGSGENEQSPVQGPGQGRGQGQALGQGQRQGQEPGQGRGLGRGPGQGLGQGPGQGLGQRRPGQGQGGQGLGQGSGQGQGLGQKPGQGQGLGQGQGLGQGRGQGQGGGRGVGGGRGLGCGKRDGSCRQNNK

SEQ ID NO: 76820 - protein, 113 aa, Triticum aestivum
  misc_feature (33)..(33): Xaa can be any naturally occurring amino acid
MAANFWASSHSKQLLDPEDVDVVPAADRERGIXTTEEFRLDKIHMSSHIWRLAHQVKVRQRVIATAITDLRWVYTRTTMSEYDPPTGSPRVCLYVPSKVEESPGKGRTSSAST

SEQ ID NO: 76821 - protein, 184 aa, Schizosaccharomyces pombe 972h-
MSSPRRRIETDVMKLLMSDYEVTLVNDNMQEFYVRFHGPSETPYSGGIWKVHVELPSEYPWKSPSIGFVNRIFHPNIDELSGSVCLDVINQTWSPMFDMINIFEVFLPQLLRYPNASDPLNGEAAALLLREPNTYYAKVRDYIARYANKEDADITLNDSSDDDTMSSIDTESGDEIAGPMDSDF

SEQ ID NO: 76822 - protein, 63 aa, Arabidopsis thaliana
MVKVLTYFGMTLAAFAFWQSMDKVHVWIALHQDEKQERMEKEAEVRRVRAELLRKAREEDPLA

SEQ ID NO: 76823 - protein, 501 aa, Mycobacterium leprae TN
MLSRRAVGSCGKEEALMITESVAQKTAVSKSGVPPHTPPGVNSEATVVRLRQTFASGRTRSVDWRTQQLRALQALMVENEGAIAQALADDLDRNPVEAFIVDIAATVSEAKYAAKKVRKWMRRKYRFLEVSQLPGRGWVEYEPYGTVLIIGAWNYPFYLTLVPAVGAIAAGNTMVLKPSEVAAASAHLMAELVPRYLDNDAIAVIEGGGAVSQELIAQGLDRVMFTGGTEIGRKVYEGAASHLTPVTLELGGKSPVIVAVDADIDVAAKRIAWIKILNAGQTCVAPDYVLAAAPIRDELVNKIGFAIAKFRSQDDPSGMRIVNQRQFDRLCGYLAGVQSAAGGKGVVVVGGKCDASTLRIQPTVIVDPDPEGPLMTKEIFGPILPVLTVQSLDEAIGFINARPKPLAAYLFTKSRKTRDRVIKEVSAGGMLVNHLAIQVLTAKLPFGGVGESGIGAYHGKWGFDEFSHRKSVLTKPTRPDLSSFIYPPYTERSFRLAHRLF

SEQ ID NO: 76824 - protein, 62 aa, Triticum aestivum
  misc_feature (9)..(9): Xaa can be any naturally occurring amino acid
  misc_feature (45)..(45): Xaa can be any naturally occurring amino acid
YQRLNYFNXPWLTRITLVLVAFWWGIGEVLRLTFVNGEGRFTSDXMWQANVCKFYIIFFLGF

SEQ ID NO: 76825 - protein, 424 aa, Solanum lycopersicum
MGKDEDEMRGEIEERLINEEYKIWKKNTPFLYDLVITHALEWPSLTVEWLPDREEPSGKDYSVQKMILGTHTSENEPNYLMLAQVQLPLEDAENDARHYDDDRSEFGGFGCANGKVQIIQQINHDGEVNRARYMPQNPFIIATKTVSAEVYVFDYSKHPSKPPLDGACNPDLRLRGHSTEGYGLSWSQFKQGHLLSGSDDSHICLWDINATPKNKALEAMQIFKVHEGVVEDVAWHLRHEYLFGSVGDDQYLHVWDLRTPSVTKPIQSVVAHQSEVNCLAFNPFNEWVVATGSTDKTVKLFDLRKISTALHTLDCHKEEVFQVGWNPKNETILASCCLGRRLMVWDLSRIDEEQTPEDAEDGPPELLFIHGGHTSKISDFSWNPCEDWVVASVAEDNILQIWQMAENIYHDEDDLPGDDAPKGP

SEQ ID NO: 76826 - protein, 160 aa, Synechococcus sp. CC9605
MATFEGRFSDAAGLRVGIVVARFNDLVTAKLLSGCLDCLKRHGVDVSETSSQLDVAWVPGSFELPIVAQQMARCGQYQVLITLGAVIRGDTPHFDVVVAEASKGVAAVARDTSVPVIFGVLTTDTMQQALERAGIKSNLGWSYGLEALEMGSLMRALPSA

SEQ ID NO: 76827 - protein, 425 aa, Saccharomyces cerevisiae
MNTNVPIFSSPVRDLPRSFEQKHLAVVDAFFQTYHVNLILSLGLLGRVNLIGEHIDYCDFSVLPLAIDVDMLCAVKILDEKNPSITLTNADPKFAQRKFDLPLDGSYMAIDPSVSEWSNYFKCGLHVAHSYLKKIAPERFNNTPLVGAQIFCQSDIPTGGGLSSAFTCAGRLATIRANMGKNFDISKKDLTASQRLRSTMLESIMVVWIKQTSVYGEEDHALYVEFMAKTKWPHFQVSSIENHEISFVIAILCTRSNNRTLLHISLSCSLLTLLYISTFAREPCGPDTLGLTISQGQSNSERGNLEIYGCLLRPDTKTKPNHGMEISELVLNVYSRCYNWYEESFSRKKSGFTVHEASTALNCSREEFTRDYLTTFPVRFQVLKLYQRAKHVYSESLRVLKALKMMTSAIFTRTRFLYRFWPTNE

SEQ ID NO: 76828 - protein, 368 aa, Saccharomyces cerevisiae
MEEIPALYPTEQEFKNPIDYLSNPHIKRLGVRYGMVKVVPPNGFCPPLSIDMENFTFQPRIQNLENLDLKNRCRLFFMKQLNNFKRSVKDPSKLILREPYTIVEYSDSTHASEILKKKVYFYDVFSELIKDNRTLTDTTQSFRRKLKFRDISQLRGDISLWRTISKKFNVPIGLLKEIFEKYIASYYIFLHSLNENVHTALHADQYPKSLLSDDEDDFDLGPDSNSGSDFEEDDDDACIVCRKTNDPKRTILCDSCDKPFHIYCLSPPLERVPSGDWICNTCIVGNGYYGFTQDTHDYSLPEFQEYCKRQNSRLLPARKLSIDELEEMFWSLVTKNRRSSLTTVKYGADIHNELPGQITGFPTREFIP

SEQ ID NO: 76829 - protein, 463 aa, Streptococcus pyogenes MGAS8232
MTIFRKKKKYSNKTEMQRHFKVIDLIFLGLGSMVGTGIFTVTGIGAAKYAGPALTISIIISAIAIGILALFYAEFASRMPSNGGAYSYVYATLGEFPAWLVGWYIIMEFLTAISSVAVGWGSYLKGLLANYNIVLPNALNGTFNLKNGTYIDILPVLVMFFVTGIVLMNSKLALRFNSFLVILKFSALALFIFVGIFFIDHNNWSHFAPYGVGQITGGKTGIFAGASVMFFAFLGFESISMAVDEVKEPQKTIPKGIILSLIIVTALYIVVTTILTGIVHYTKLNVPDAVAFALRNIRLYWAADYVSIVAILTLITVCISMTYALARTIYSISRDGLLPKSLYTLTKKNKVPQNATLVTGLLAMICAGIFPLSSLAEFVNICTLAYLIILSGAIIKLRRIEGEPKANEFKTPLVPFLPILAIIICLSFMSQYKAFTWIAFAIATIIGTLIYLAYGYTHSIENK

SEQ ID NO: 76830 - protein, 248 aa, Synechococcus sp. CC9605
MFDHIRADLAIIRERDPAARGWLEILFCYPGFQAISLHRISHRLWSCQLPLKLAARCLSQIGRALTGIEIHPGARIGHSVFIDHGMGVVIGETAEIGHRCLLYQGVTLGGTGKEHGKRHPTLAENVVVGAGAKVLGAITIGTNTRIGAGSVVVRDVESDCTVVGIPGRVIHQSGVRINPLAHSALPDAEANVIRNLMERIDQLENTVMNLKRCLQEVAAGRQLLEECSGEAQNLKDREILEFLGDSTR

SEQ ID NO: 76831 - protein, 505 aa, Aspergillus oryzae
MPELDLFLDITAPNGRQYKQPTGLFIDNEFVKSTSGQTIASIDPATTREIASVYAAGAEDVDKAVNAAKAALKDDSWKLLPATDRGMLMGRLADLIEQNKELFATIDAWDNGKPYHVALSEDLVEAITTFRYYSGWADKTFGQTINTTPQKFAYTIRQPIGVVGQIIPWNYPLSMAAWKLGPALACGNTVVIKAAEQTPLSILVLGTLIKEAGFPKGVVNIINGYGREAGAALVQHPLVDKVAFTGSTATAREIMKMAAGSLKNITLETGGKSPLIVFNDTDMEQAVKWSHFGIISNQGQICTATSRILVQKDIYDTFVEQFKGAIQTTSKIGDQWDESTFQGPQVTRAQYDRVLEYIQVGISEGATVASGGGPHPANSNGESGYYVQPTVFTNVKDSMRIYREEIFGPVVVIVPFETEEEAIRRANDTTYGLGAAVFTKDLERAHRVAAEIESGMVWINSSQDCDPRVPFGGVKQSGIGRELGEAGLEAYSQVKAVHVNMGNKL

SEQ ID NO: 76832 - protein, 422 aa, Thiomicrospira crunogena XCL-2
MKYYCETKSATDLTRKTLALVLAGGEGSRLKDLTKWRAKPAVPFGGKYRIIDFVLSNCVNSGIRKIGVLTQYKSHSLIRHVQRAWSFMRYEVGEFVELLPAQQRVDKGWYKGTADALYQNLDIMRRHTPDYVLVLGGDHIYSMDYSKMLYEHAESGADVTIGCIEVPRMEATGFGVMSVDECFKITKFTEKPANPDAMPHKPDKALASMGIYVFSTEFLFQKLIEDADNPNSSRDFGKDIIPSIIEDWQVRAFPFEDETGLPVYWRDVGTIESYWKASLDLCSITPDLNLYDEDWPIWTYQAQMPPAKFIFDDEGRRGEAIDSLVAGGCIISGARIKRSVISSGGHVHSFCLVKDSVLLPRVKVERNCRIQNAVIDKGCVIPEGTVIGEDLEADRKRFYVEEASGIVLVTPDMLGQRLHITR

SEQ ID NO: 76833 - protein, 251 aa, Neisseria meningitidis Z2491
MWDQKWVIGNWKMNGRLQNNNSLMHRFRILPTAERVLIGLAAPTVYLLQLHNAMQIVLNNRILTCAQDVSRFPDNGAYTGEVSAEMLADTGTDIVLIGHSERSLYFGEKNEIQRRKMENVLNVGLIPLLCVGESLEEREAGKEHEVIAHQLSILQGLDTKNIAVAYEPVWAIGTGKVATVEQIADMHAFIYKEILSLCGSDVKIRVLYGGSVKADNAADIFAVPYVDGALVGGASLSYDSFTAIISAAQNA

SEQ ID NO: 76834 - protein, 992 aa, Magnaporthe grisea 70-15
MSSRPSSSARPVQDVLPNNDYETTNVAQKATKDSRPPQSSRDTATRQHRRSGSQRSGHHGHDGNAEAGPSTPSQASHGSSDPRTRKMRTVIPAQSGKWNLGKTIGAGSMGKVKLARKEDGTEQVACKIIPRVTPDDGHTPRAERERADLSKEVRTAREAAIVTLLSHPHICGLRDVVRTNFHWYMLFEYVNGGQMLDYIISHGKLKEKQARKFSRQIASALDYCHRNSIVHRDLKIENILISKTGDIKIIDFGLSNLFAPKSHLKTFCGSLYFAAPELLQARPYTGPEVDVWSFGIVLYVLVCGKVPFDDQNMPALHAKIKKGVVDYPNWLSSECKHLLGRMLVTDPKQRITMAEILSHPWMVKGYSGPPENYLPNREPLTLPLDQEVINGMTGFSFGPPEVIKAQLTRIIESEDYQRSIRAYQREKETQQTPKDPEKKRGFGFYRRRNSFSSKDTLTTPSSEGLALGNDPLNAFNPLVSVYYLVREKQEKDSASRRPATSARPNAVPEIAPPQEAHTNASAYEMPGENATGGRTRPRARTHGEDDAPTEPIRPPQLSPPAAPPPERLEPPKKESAAAGLLRRFSTRRRKEQPERLDKDRSHPPVVQVHSPAENSSQPTSAIRKSFSIRRGRRDREEQASAESQARMRAGSSQPQHSDLLSPPLSAGANTQTFRKGLGRSASVNSGEFSRRRAMGTARTSKDPPPTSGSDHSTIHEKPPKEQQEKRSPTTAGPSQSMTSRAKSLGHARQESIQARRQRREAEKKREANVPEETDAEVNGADDSSKERVTDFDLDKPVYLKGLFSVSTTSGKPVREIRTDIKRVLKQLGVDYTEIKGGFYCRHSPSIDLQNVADNGAASPAQTPSGAKRRFSFGALRSDGKEESNGERVPVTPRTPGRSGGGSGTDRDRHDSSSEVSENSEAREETSRRRDHPAGETRTHVRSDMGESMVSEFEIFIVKVPMISLHGIQFKRLGGNTWQYKNLADQILKELKL

SEQ ID NO: 76835 - protein, 490 aa, Oryza sativa Japonica Group
MTILLLVVFFCRMLGNMAGKNKRKKQPKLPPGPATMPVLGNIHQILMNKPVFRWIHRLLDEMDTEILCLRLGSVHVIAIASPEMAREALRRNDAVLTSRPVSFAWRAFSFGYKNTVGSTGDQWKKMRRMLASEILSSAMERRMLGQRVEEADHLVNYIYRNCNNGTVDIRHVTRHFCGNIIRKLVFGRRHFAFGAGNIGPGRDEEAHIDALFTALDYLGAFSISDYFPSLVLNGLMSTFRRLHDPIIMERMEEWRAPRRNGDERREVADFLDVLISLDDAQGKPLLSLDEVKAETLEIILNSVDNPSNAVEWALAEMVNNPKVMKKAVDELDMVVGKERLVEESDIHSLTYLKACIREAFRIHPYHPFNPSHVAIANITIAGFMIPKGSHIILSRIGLGRNPRARDNPLEFRPERHLKNTDNVVLAEPELRFLSFSAGELSLALSVEGKSVAALKNGSQAAGPTLPYFIAVHCTFAPKLLATAHCQVVVA

SEQ ID NO: 76836 - protein, 315 aa, Arabidopsis thaliana
MVGGGNRRDEGSMPIQNTNLFAALDTSRKKKKSDKAGKSKASSKREDSQKEPEPQVFWAPTPLKAKAWADIDSDDEDDDYYATTAPPQSLWSTSEASHSDAKDVPAEEIESEEDTLDDGDDDDVEEDHEQGTETQVHPEAEPEVKKAPEVRAPPKEAERQLSKKERKKKELAELEALLADFGVATKDENGQQDSQDKGEKKEVNDEGEKKENTTGESKASKKKKKKDKQKELKESQSEVKSNSDAASESAEQEESSSSIDVKERLKKIASMKKKKSSKEVDGASTAAAKEAAARKAKLAAAKKKEKKNYNQQPVR

SEQ ID NO: 76837 - protein, 520 aa, Oryza sativa Japonica Group
MAILLLVALFYRIKKQAAAMAAKRKQQPKLPPGLATMPVVSNMHQMLMNKPVFRWIHRLLDEMDTEILCLRFGRVHVIAVASPEMAREVLRKKDAMLASRPSSFVSRTFSFGYKNTIMSPAGDQWRKMRQVLTSEILSPAMERRMLGRRVEEADHLVNYVYSHCNDGTVDVRHVTRHFCGNIIRKLVFGRRHFNSGDGNIGPGRDEEAHIDALFTALDYHGAFSVSDYFPTLVGLDLDGHEEVVNGLMNTFNRLHDPIIMERIEEWKSLRTKGDKRREVADFLDVLISLEDAQGKPFLSVDEIKAETLEIILATVDNPSNAVEWALAEMVNNPKVMKKAVDELDMVVGRERLVEESDIHNLTYLKACIREAFRLHPYHPFNPPHVAIADTTVAGYMIPKGSHVMLSRIGLGRNPRAWDKPLEFQPERHLKNTGTVVLAEPELRFVSFSAGRRGCPAVSLGTSITMMLFARLLQGFSWSIPPGGDRIELQESATSLQLSKPLLMQAKPRLLLHLYEADVLN

SEQ ID NO: 76838 - protein, 438 aa, Oryza sativa Japonica Group
MAKRIASMSSLLLIALLCLSSHLAQAQVLFQGFNWESWKKQGGWYNFLHGHVDDIAATGVTHVWLPPPSHSVAPQGYMPGRLYDLDASKYGTGAELRSLIAAFHSKGIKCVADIVINHRCADYKDSRGIYCIFEGGTPDSRLDWGPDMICSDDTQYSNGRGHRDTGADFGAAPDIDHLNTRVQTELSDWLNWLKSDVGFDGWRLDFAKGYSAAVAKTYVDNTDPSFVVAEIWSNMRYDGNGEPSWNQDGDRQELVNWAQAVGGPASAFDFTTKGELQAAVQGELWRMKDGNGKAPGMIGWLPEKAVTFIDNHDTGSTQNSWPFPSDKVMQGYAYILTHPGVPCIFYDHVFDWNLKQEISTLAAVRSRNEIHPGSKLKILAAEGDVYVAMIDDKVITKIGTRYDVGNLIPSDFHVVAHGNNYCIWEKSGLRVPAGRHHY

SEQ ID NO: 76839 - protein, 2187 aa, Streptomyces nanchangensis
MANQEQLVDYLKRVATDLHDTQQRLREVEARDRQPIAIVGMACRFPGGTDTPEALWDLVSEGRDVISPMPDDRGWDPGMFNDSGETGTSYVREGGFVHDIADFDADFFDINPREALAMDPQQRLLLETSWEAIERARIDLTSLRGSKTGVFVGGSTVYYAGNAAGVPQDVAGYLATGLAASSMSGRISYTFGFEGPSFTVDTACSSSGVALHLAVQALRKGECSLALAGGVCVMATPGTYLEFSKLNGLAADGRCKAFAAAADGFGPAEGVGVLLVERLADAERLGHPVLAVIRGSAINQDGASNGLTAPHGPAQERVIRAALADAQLSARDIDVVEAHGTGTSLGDPIEAQALIAAYGRRRADGGPLWLGSVKSNIGHTQAAAGMAGVIKMVHALRHGLLPRTLHVDEPTHQVDWSEGTVRLLTEARPWPEAGGPRRAGVSSFGMSGTNTHVILEQAPPAEEPAPAAESPVVPWLVSGRGEAALRAQAARLRDFLAERPEASPTRVGFALAGSRAAQSHRAAVVAADRDTLLAGLGSLAEGTPAGHVVTGSVSPGATAFVFPGQGSQWVGMALALADASPVFAEHFRRCAEAVERHTDYTVESVLRADPGAPSLDRVDVVQPVLWAVMVALAELWRSHGVEPAAVVGHSQGEIAAACVAGVLSVDDAARVVVLRSQVLPELSGRGGMASVAQPVGLVEKHLERWDGRLSVAAVNGPSSTVVSGDADALEELLEGYEADGVRARRVPVDYASHCAHVDALRGPLLDALSGIEPKAGTVPLYSTVTGRRIDGTTMDAGYWYTNLRQQVRFQEATEALLADGHGVFIECSPHPVLTIGVQETMDQSGANATALGTLRRDEGGWDRFLLALGQAHTHGVAVDWSRVFPDGTSPADLPTYAFQRRRYWLDATAGAAGDPASLGLTPADHPLLGAVTLLAEGDEVVMTGRLGLDTHPWLADHAVAGAVLVPGAVFVELAVRAGDEVGCDHLEEMVLASPLVLPEQGGFDLQLVVGGAAEDGRRTLGGYARPSGSDRPWVQHVTGTLAPGGAARPFDLAQWPPEGARPVPVEGCYDQLAEGGFRYGPAFRSLRAVYRRETEVFAEVVLPEEQRGKAAAFGIHPALLDGALHASGLSAVRGDSGGRMALPFAWNGVSLAATGAELLRVRLAPVGDDGMSVHATDASGHPVISIESLVTRPFTAGQLPSDGDETRDGLFRVAYTPLTDPEPGTATDDWTAVATGSEPTYYGVRRYGDLDALAAAVDGGLPAPPVTLLPCEPAPDDGDLPGALRRRLGEVLHTVQRWLADERFAASRLVVVTRGAVAAFEGDDVTDLVHAPVWGLIRSAQSEHPDRLALVDLDGPELPKAVAAAVAVAVAAGEKQIVVRDGTVRVSRLVPAVSGGALALPETPHWRLDIAAPATLDNLGLVAAEEPGPPAPGHVRVQVRAAGVNFRDVLIALGMYPGDGAFRGSEGAGVVLEVAEDVTSVAVGDRVMGMFQGAFGSTAVADARSVVPIPPGWTDEQAAAVPIAYVTAWYGLVDLAGLKAGESVLIHAATGGVGTAAVQIARHLGAEVYATAGPGKHHVLEAMGIDEAHRASSRDLDFEDAFRAATGGRGVDVVLNSLTGDHTDASLRLLAEKGRFVELGMTDVRDPEQLAEPYPGLRYRVLDLREPGEDGIGRMLTEILGRFAGGELTHPAVRAFDIRRARDAFRLMSRAAHIGKIVLTLPRPLDPDGTVLVTGGTGTLGGLIARHLVTRHGVRHLLLTSRRGPEAPGAPALREDLAALGATVTVTACDAGDRERLAEVLAGVPDAHPLTGVVHCAGVLDDGMVDALTPEQLARVLRPKAEAALHLHELTQDADLALFVLFSSIVGVYGNPSQANYAAASTFLDALAQHRQAGGLPAQSLAWGMWEETSALTGELDDGVRQRISQAGMDPLPTEQALALFDRSYAVGDALLVPIRQSTAASRGGPAAGRTRARRVADSGVAGTGGPSLTDRVTALPEAERDSCVLEAVRAHMAAVLGHDSADEIAPDRTFKELGFDSLTAVELRNRLSAATGLRLPATFVFDFANPVALAEHLREQIAPPTELGPPTDPSTPADPSPPPGLPEGPSTDPRESRVRQVLAAIPLRRLEESGLLETLLRLGEGPGEADTTGARPVEGTRDETHTPDSADIASMDLEELVNAALRNDES

SEQ ID NO: 76840 - protein, 79 aa, Azospirillum brasilense
MSDVAERVKKIVVDHLGVEESKVTENASFIDDLGADSLDTVELVMAFEEEFGCEIPDDAAEKILTVKDAIDFIKANAAA

SEQ ID NO: 76841 - protein, 791 aa, Nitrosomonas europaea ATCC 19718
MTDHPDYILWLNQVGMNDIASVGGKNASLGEMIGNLARAGVKVPGGFATTTRAYREFLEIDGLGDRISQKLSGLDVGDVTALADTGKSIRSWLLAAPLPDNLLKAVAGAYQKLVSDMGEEVSFAVRSSATAEDLADASFAGQQETLLNVHGLENLISAIREVFASLYNDRAIAYRVHHGFHHDQVFLSAGVQKMVRSDRGASGVMFTLDTESGFREVVFVTSTYGLGETVVQGIVNPDEFIVYKPNLEARLPAILSRRSGTKAIEMIYSDGQTGQATEIRPVPPDRSQRFSLSDEQIESLARQAVIIERHYNRPMDIEWALDGIDGQIYIVQARPETVKSRAEQSIEQFRLDERGQVLVQGRAIGQKIGQGRARVILNAGQMSEVQPGDVLVTDMTDPDWEPIMKRAAAIVTNRGGRTCHAAIIARELGIPAVVGCEQATAKISNGHAVTVSCAEGDTGFVYEGLLPFQRMSSEIGTLSELPVRMMLNIGNPAQAFAFSRLPNQGVGLARLEFIINNAIGIHPRALLEFDTLPDDLQASIRKRMAGYPDPVSFYVEKLVEGIATLAAAFHPHPVIVRLSDFKSNEYANLIAGDRFEPHEENPMIGFRGASRYLADSFRACFELECRALRKVRDDMGFANVEVMVPFCRTLEEAQQITELLAANGLKRGSNGLRLIMMCEIPSNAVLAEEFLEYFDGFSIGSNDMTQLTLGLDRDSGLVAHLFDERNPAVKRLLKMAIDACHRQGKYIGICGQAPSDYPDFARWLVEQRISSLSLNQDTVVDTWLYLAGEKQ

SEQ ID NO: 76842 - protein, 424 aa, Desulfotalea psychrophila LSv54
MSFAILGLCDELLQTVAEQGYTTPSQIQTEAIPVVLNQRDVMAVAHTGTGKTAGFTLPMVQLLSGGDSPQPCTVRALVITPTRELAAQVAESVQTYGSMMNIRTGAAFGGVRIEPQIAKLQAGLDVLVATPGRLLDLYNQQAVSFDALKILVLDEADRMLDLGFIDDIRHIQTLLPAKRQTLMFSATFSEEIKSLAGGMLHDPVLIEVDTDKNIVDSIKQKMHPVDQERKSALLIHLIKKYNWQQLLVFSRTKRGADTLVTQLKEAGINAESIHANRTQYARTRALDGFKNGSVVVLVATDIASRGIDVHQLPCVINFDLPYVAEDYVHRIGRTGRAGTSGLAVSFFSEDEAQQLASIEKLIGRKFERDIVQGFAPSKKPAVVLSDEDEEYGNFEPDPPRRKGKSKGQAGKPAKTKRKHWKEYL

SEQ ID NO: 76843 - protein, 548 aa, Mycobacterium tuberculosis CDC1551
MTSVTDRSAHSAERSTEHTIDIHTTAGKLAELHKRREESLHPVGEDAVEKVHAKGKLTARERIYALLDEDSFVELDALAKHRSTNFNLGEKRPLGDGVVTGYGTIDGRDVCIFSQDATVFGGSLGEVYGEKIVKVQELAIKTGRPLIGINDGAGARIQEGVVSLGLYSRIFRNNILASGVIPQISLIMGAAAGGHVYSPALTDFVIMVDQTSQMFITGPDVIKTVTGEEVTMEELGGAHTHMAKSGTAHYAASGEQDAFDYVRELLSYLPPNNSTDAPRYQAAAPTGPIEENLTDEDLELDTLIPDSPNQPYDMHEVITRLLDDEFLEIQAGYAQNIVVGFGRIGGRPVGIVANQPTHFAGCLDINASEKAARFVRTCDCFNIPIVMLVDVPGFLPGTDQEYNGIIRRGAKLLYAYGEATVPKITVITRKAYGGAYCVMGSKDMGCDVNLAWPTAQIAVMGASGAVGFVYRQQLAEAAANGEDIDKLRLRLQQEYEDTLVNPYVAAERGYVDAVIPPSHTRGYIGTALRLLERKIAQLPPKKHGNVPL

SEQ ID NO: 76844 - protein, 167 aa, Candida albicans SC5314
MTDIAPPSAATPNDYILSLSPEQIEHDQKIGIKAIRLFLQSKTSYDVLPVSYRLIVLDTSLLVKKSLNILLQNNIVSAPLWNNQTSRFAGLLTSSDFINVIQYYLQFPEKFELVDQLTLGGLREIEKAIGVDQIETASIHPFKSLYEACVKMLESKARRIPLIDEHE

SEQ ID NO: 76845 - protein, 500 aa, Arabidopsis thaliana; identical to SEQ ID NO: 1604

SEQ ID NO: 76846 - protein, 418 aa, Treponema denticola ATCC 35405
MNYLESNNLAIIACPGGEEFANLTIKNLKHIYARKLYQQSEKLAKRYNTSSEDMIQKFNFYSDLFAGRMSVNKDTNKIHVPKFKVDARFTYFMNGEFKTELLETVRGKDVYIFQDVENKQEITINEGKNKEVFSVNDHLMSLIVTIDAVRHAGAGRISLVLPVYPYSRQHKKKGREGLTASLLGHIYEDLDVEQIITLDIHSREIENSFHSARLQNLHASYQIIRELTRILDLSADSEEQFVVVSPDSGAVDRNKFYSSGLQKPLAMIYKERDYSVVTQNAKQSNIISIKLLGDVEGKNAFIADDMLGTGGTLLKAMEFLKSKGAKKVIAAVSLPFFTGDAIQQFDEAYSKGLFYRVIGTNAVYHTELKQKEWYIETDVSGLFAQVITRLHENLSLSSLLDNRDIIEKLLKNAAIPKK

SEQ ID NO: 76847 - protein, 141 aa, Candida albicans SC5314
MLLKPLKNLSGLGDVKKLSTCTMDTPVIEVIHLLTENSVSSIPIVDGQGKLINVYEAVDILALVKGGMYTDLDLSVGDALLRRSEEFEGVHTCTLNDRLSTIMDTIRKSRLHRLFVVDDEGKLVSVITLSDILNYILFGED

SEQ ID NO: 76848 - protein, 528 aa, Saccharomyces pastorianus
MTKSHSEEVIVPEFNSSAKELPRPLAEKCPSIIKKFISAYDAKPDFVARSPGRVNLIGEHIDYCDFSVLPLAIDFDMLCAVKVLNEKNPSITLINADPKFAQRKFDLPLDGSYVTIDPSVSDWSNYFKCGLHVAHSFLKKLAPERFASAPLAGLQVFCEGDIPTGSGLSSSAAFICAVALAVVKANMGPGYHMSKQNLMRITVVADIMLVLTMAVWIRLPLFAVRKIMLYTLSSNAVEATPFKFPQLKNHEISFVIANTLVVSNKFETAPTNYNLRVVEVTTAANVLAATYGVVLPSGKEGSSTNKGNLRDFMNVYYARYHNISTPWNGDIESGIERLTKMLVLVEESLANKKQGFSVDDVAQSLNCSREEFTRDYLTTSPVRFQVLKLYQRAKHVYSESLRVLKAVKLMTTASFTADEDFFKQFGVLMNESQASCDKLYECSCPEIDKICSIALSNGSYGSRLTGAGWGGCTVHLVPGGPNNGNIEKVKEALANEFYKVKYPKITDAELENAIIVSKPALGSCLYEL

SEQ ID NO: 76849 - protein, 145 aa, Arabidopsis thaliana
MSKRRTWVCLFIAVYAILVSSSWNLLRSVLNWYKLQYTSSNSDYSPSRLPAVYASVVLGAMFGAMSMVAAMTVAVPAVMVIWISVVVLLAFFGKSRRVLVVEGRKITREVVGFVFKVLLKEGNVVAAFCAVLAYFLLIRRDFDSY

SEQ ID NO: 76850 - protein, 157 aa, Saccharomyces cerevisiae
DRDEIERLRKRFMKLDRDSSGSIDKNEFMSIPGVSSNPLAGRIMEVFDADNSGDVDFQEFITGLSIFSGRGSKDEKLRFAFKIYDIDKDGFISNGELFIVLKIMVGSNLDDEQLQQIVDRTIVENDSDGDGRLSFEEFKNAIETTEVAKSLTLQYDV

SEQ ID NO: 76851 - protein, 718 aa, Candida albicans SC5314
MTIETISNNEGIRQRSASESTHTHTYLDQLDIPQITLRSTIVGLLIGSLVLISNFQFGLQTGWVSMMSLPAALLAFSIFKLLPISIAKNFTDVENVFVQSIAVAVGTGPLCYGFIGIIPAMEKFMTSEESGLGRPLTFGLGQLMIWSLGLGLFGVFFAIPLRKQVIVKEKLPFPSGSATATLISVLHGSDIYQDKEEISEKLDIEEEEGRETGSIATESESLTQQSSKSQLITTTNIQDDYDSNMRSLIITFIISATYTILSFFLPILKKIPIFGNHLSVNYLWNFQPSPAYIGQGIIMGLPTVSYMLFGAILGWGILAPLAKHMEWAPGRIDDWINGGQGWILWISLTVMISDSLVSFVVVSIKSINNALDNFRQRRDLDQFLELQQSQQSEYLLQDQEETRSSTSSNENPENSTYDGKRTQEDCKYTMEVPERHLVSTKTTVIGIAVSTLLCIISLKLVFGNIVPIYASLAAIILAMFFSILGVRALGETDLNPVSGIGKLSQLIFALIIPSNHPAKILINLVAGGVAEAGAQQAGDLMQDLKTGHLIGASPKAQFIAQILGTLYSVGLSSIMYKVYNSVYKIPSDMFRIPTAVVWIDCSRLVTGQGLPPHIREFALVLGVIFGIISLLKNTVPPTSSYHKYLVYLPSGVAVGVGIYNTPNFTLARFIGGLICYNWQNIGPNGKIGMIIFSSGLVLGEGLFSGFTMLLTSLGVKHW

SEQ ID NO: 76852 - protein, 291 aa, Chlamydomonas reinhardtii
MQGHKNAVTSVCFSPDGRSLVSGSEDKTLRVWDAASGECKATLSGHSSAVTSVCFSPDGRSLVSGSEDKTLRVWDACQRGVQGHAQRTQQRGYQPAVSSVCFSPDGRSVVSGSEDKTLRVWDAASGECKATLSGHSSAVTSVCFSPDGRSLVSGTLSAAVGQTLRVWDAASGDVATLSGHSSAVTSVCFSPDGRSLVSGSEDKTLRVWDPASGECKATLSGHSSAVTSVCFSPDGRSLVSGSEDKTLRVWDVASRECKATLSGHSSAVTSVCFSPDGCSLVSGSHDETLRM

SEQ ID NO: 76853 - protein, 418 aa, Thiomicrospira crunogena XCL-2
MTLETFNKYESEVRGYIRSFPVIFERAKMAEIWDETGKRYIDFFAGAGALNYGHNNPDINAALIDYLQHDGIGHALDMGTVAKKDFIESFVFNILKPRDLEYKLQFVGPTGTNAIETALKIARKVKGRKQVMSFTNGFHGMSMGSLSITGNSYYHDESYGVPGYTTQVPFHKYLGDKVDTIAYLRKILEDASSGTELPAAIVLETIQAEGGINVSGEQWLRDLRQICDDFDILMIADEIQVGNGRSSDFFSFERAGIKPDIVTLSKSIGAGQPMAMVLLKPELDQWSPGEHSGTFRGNNLAFVSSSVALKKYWADDSFSKEVKQKSKLVQERMEKMALRFPQYVREIRGHGMIWGAEFKDPEMTSKVCTQAFEDGLVIETAGAGDEVIKFLGPLIITEDLINEGFDILEGAVEKVGKK

SEQ ID NO: 76854 - protein, 437 aa, Oryza sativa Japonica Group
MAKHSTTMSCLLFFVLLCLGSHLAQAQVLFQGFNWESWKKQGGWYNFLHSHVDDIAATGVTHVWLPPPSHSVAPQGYMPGRLYDLDASKYGTGAELRSLIAAFHSKSIKCVADIVINHRCADYKDSRGIYCIFEGGTPDSRLDWGPDMICSDDTQYSNGRGHRDTGADFGAAPDIDHLNTRVQTELSDWLNWLKSDVGFDGWRLDFAKGYSATVAKTYVDNTDPSFVVAEIWSNMRYDGNGEPSWNQDGDRQELVNWAQAVGGPASAFDFTTKGELQAAVQGELWRMKDGNGKAPGMIGWLPEKAVTFIDNHDTGSTQNSWPFPSDKVMQGYAYILTHPGVPCIFYDHVFDWNLKQEISTLAAVRSRNGIHPGSKLNILAADGDVYVAMIDDKVITKIGTRYDVGNLIPSDFHVVAHGNNYCVWEKSGLRVPAGRRH

SEQ ID NO: 76855 - protein, 182 aa, Prochlorococcus marinus str. MIT 9515
MDLSLIPPSPTKGIVNLVVEIPAGSRNKYEYCSQAGIMALDRILHSSVRYPFDYGFIPNTLADDGAPLDAMVIMDEPTFAGCLIKARPIGVLDMHDCGHYDGKLLCVPVANPRQDNITSINQIAPNQLEDVAEFFRTSKGLDGRTVQIDGWRDFEVIEELLRKCTSSKKKTFKVLKKSSIVK

SEQ ID NO: 76856 - protein, 263 aa, Pisum sativum
MACSAPFASLLYSNPNTLFSPKFSSPRLSSLSIPNAPNSLPKLRTSLPLSLNRSSSSRRTFVVRASGELPLVGNSAPDFEAEAVFDQEFIKVKLSEYIGKKYVILFFYPLDFTFVCPTEITAFSDRHAEFDAINTEILGVSVDSVFSHLAWVQSDRKSGGLGDLKYPLVSDVTKSISESYGVLIPDQGIALRGLFIIDKEGVIQHSTINNLGIGRSVDETKRTLQALQYVQENPDEVCPAGWKPGEKSMKPDPKGSKEYFAAV

SEQ ID NO: 76857 - protein, 473 aa, Chlamydomonas reinhardtii
MSYFVPTRFVWRFGGRQVHLCGSFTRWVETVPMAPVDGSPGLFAVVVHLPPGYHQYKFIVDGRWRHDETAPFMPDPLGNVNNWLFVRRIDPSPTPLANSAQGKQMPFEGREKHYMSRWGMTGVYVQTGWLGLPVRHLPFVQEYTRKKIADFLHSHTAYELIPESGKVVVLDVDLPVRQAFHALHEQGTASAPLWDTTTRSIPGVISASDFITILRRLRHSVSAGANPLSEAEMDAHTIRGLREEAAAEGREPKGLVYVLADEDLAKVVARLAQHKCSMAPVLSGDPGGPEQPPHVLHLATLSGVLACLMRHFRASLASLPLLSQPLGSLPLGTWSPDAAPLHTVTVSTPLTTALAMLLETGVSALPVVDERRCLVDCYARSQITDLCKGGAYNRLQWEDVTVGEGRGQGRLGGWGWDWGSGGRVWVVTKDDTLRTVVERLAVPGVRRLIVVTPESRRVEGIISLSDVAQYLFL

SEQ ID NO: 76858 - protein, 462 aa, Gibberella zeae PH-1
MGYLYYLLHPYQLRSIIQWKVWHDPVHERDPSTESPELQECFRYLNLTSRSFAAVIQELNHELLVPITLFYLCLRGLDTIEDDMTLPLEKKIPILRNFHTTMNEDGWQFHESQEKDKELLEHFDVVITELKKIKAPYHEIITDMTRKMGNGMADYAENEEMIKNGVQTIEEYELYCHYVAGLVGEGLTRLFVESELANPKLAERPSLTESMGQFLQKTNIIRDLHEDWQDGRRWYPKEIWSQHVDKWEDMFNPAQQTKAIECVSHMVLDALKHSEECLFYMAGIKDQSVFNFVAIPEGMAIATLELVFRNPEVLKRNVKITKGDACKIMFECTQNLFTVCEVFKRYTRKIAKKNDPRDPNFLAISAQCAKIEQFIETLFPKQDPKKLTLTQAQAQNKEPTMDAGEAVVLFGVVIAALVCISGLMLGTAWFFGARFDHIFREASVFLPGREKATPMITGHEEL

SEQ ID NO: 76859 - protein, 388 aa, Anabaena variabilis ATCC 29413
MPLSDAIPALLVLADGTAYRGWSFGATGTTIGEVVFNTGMTGYQEVLTDPSYCGQIVVFTYPELGNTGVNPEDEESARPQVRGAIARNICHKPSNWRSAQSLPDYLKQHQIPGIFGIDTRALTRKIRMYGAMNGGISTEILDEAELLEQVQAAPNMAGLNLVREVTTSTVYEWSDPTTAVWEFNPEGTVNNGESLTVVALDFGVKRNILRRLASYGCRVIVVPADTSPEAILKYNPDGIFLSNGPGDPSAVTEGITTAKVLLESEKPIFGICMGHQILGHALGAETFKLKFGHRGLNQPAGLQQRVEITSQNHSFAIDPDSLPEAVVEISHLNLNDRTVAGLRHKSLPIFSVQYHPEASPGPHDADYLFAQFVHQMRTTKQATTAEVS

SEQ ID NO: 76860 - protein, 233 aa, Spinacia oleracea
MEAMSGLSSPCNCISSLPHSSSTTTRHQNLLFRRNNHHQQKLAAFHSQSHLFSTKCPLISHSLPRKKSFKPHIFLPHLVASMEQVEETYIMIKPDGVQRGLVGEIISRFEKKGFKLIGLKMYPCPKELAEEHYKDLKAKSFYQKLIDYITSGPVVCMAWEGVGVVASSRKLIGATDPLQAEPGTIRGDLAVQTGRNVVHGSDSPDNGKREIGLWFKEGEICQWTPAQAPWLRE

SEQ ID NO: 76861 - protein, 522 aa, Vibrio parahaemolyticus RIMD 2210633
MGFTSLGLSAPILKAIQEKGYDTPSPIQAKAIPAILEGKDVMAAAQTGTGKTAGFTLPILERLSNGPRVRANQVRALILTPTRELAAQVQENVFMYGRHLPLSSAVVFGGVKINPQMLRLRKGADVLVATPGRLMDLYNQNAVKFDQLEVLVLDEADRMLDMGFIRDIRKILALLPKQRQNLLFSATFSDEIRDLAKGLVNNPVEISVNPANSTARTVEQSIYPADVKKKAPMLVKLIKDGDWKQVLVFTKTKHGANRLAKFLIEQNLPAAAIHGNKSQGARTKALADFKSGEIRVLVATDIAARGIDIPQLPQVVNFELPKVAEDYVHRIGRTGRAGEVGKAISLVCALEASELFAIERLIQEVLPRKELEGFAPTNVVPESKLDTRPIKPKKPKKPKKPKAPNASSENAPATEKKAGNGANKPKRRFNGGNNGNKNSTNQGGAGKPKGNREGQGRAHSKPDDRKPNGNKPNGNKPNGNKPNGNKSGNAGKPSGNRKPNNAKPAGNKPSGQRRKPRPQAAN

SEQ ID NO: 76862 - protein, 442 aa, Mycobacterium sp. MCS
MSRRITVFGTGYLGATHAACMAELGHEVTGVDIDEGKLAKLAVGELPFFEPGLPEVLRSNIAAGRLHFTTSYEEAADFADVHFIAVGTPQKHGELAADLRYVHGVVELLAPLLTRPAVIFGKSTVPAGTAARLGARLRKLAPVGEQAELAWNPEFLREGFAVKDTLHPDRIVLGVDRDRPGNAAAVAREVYAPLLEERIPLLVTDLATAELVKTSANAFLATKISFINAIAEVCKATGADVSVLADAIGYDARIGRRFLNAGIGFGGGCLPKDIRAFIAMAGELGAGQAFALLREVDSINMRRRNKVVEMAREAAGGSFIGTRVAVLGAAFKPDSDDVRDSPALNIAGQIQLQGAAVSVYDPEAMQNARQMFPTLQYASSIREACASADVVMLLTEWEQFVSMDPDELREVVRRHTIIDGRNCLSPQIWRDAGWTYRGIGRP

SEQ ID NO: 76863 - protein, 197 aa, Triticum aestivum
RVDRFRSLQAVPRRELQLVGIAAMLIACKYEEIWAPEVNDFISIADNSYSRQQILSMEKNILNSMAWNLTVPTPYVFLVRFAKAAGSDKELEHMIFFFAELALMEYGLVTVRPSLVAASAVYAARCTLKRSPIWTETLKHHTGFAEPQLLEPAKMLVMAHAAAPDSKLKAIYKKYSCEQYGRVSLRAPAVAAPQRLA

SEQ ID NO: 76864 - protein, 550 aa, Schizosaccharomyces pombe 972h-
MSFSLASTLPAWQAVQTHYESVGKHLVLKELFAKDSSRFEKFSFTFNGLKEEDGPILFDFSKNLITEETVELLVKLAKEANVEGLRDALFAGEHINFTEDRAVFHPALRNVSEKPMKVNGQDVMPGVRKVLRHMKEFSDAVRSGAWKGYTGKPIKSIVNVGIGGSDLGPVMVTEALKPYGQENLELHFVSNIDGTHLAEALKKCDPETTLFLIASKTFTTAETCTNAKSAKDWFLASAKDPSHVAKHFVALSTNEKEVTAFGISAQNMFEFSDWVGGRYSVWSAIGLSVALYIGYENFEAFLSGAHAMDEYFCSTPLEKNIPALAALISIWYSDFFGAQTHLVAPYDQYLHRFPAYLQQLSMESNGKAITRSGDMVNYTTGKILWGEPGTNSQHSFFQLIHQGTKLIPADFLIPIESHNPIDNNKHHRMLFSNFAAQTEALMLGKTPAEVKAEGTPDEIVPHKTFVGNRPSNSIIAKKITPASLGALIAFYEWVTFTEGAVWNINSFDQFGVELGKKLAKNVLAQLETKGDVENHDSSTNGLINLFKNGF

SEQ ID NO: 76865 - protein, 276 aa, Fulvimarina pelagi HTCC2506
MKKIEAHGASIPALGLGTYTLKGQTCTDIVAKAIEVGYRHIDDAKMYDNEREVGEGIRQSGVARNDLFVTTKVWWTDISREKLLDSARRSIDDLGIGAVDLMLIHWPNPDIALEESIDALNETISEGLTKFIGVANFPSALFREAASMSNAPLVCNQVEYHPHLSQRSVHEACRANDAAIIAYSPIGKGGDLLKAEPILRAAEAHGKSPAQIVLAWHMSQDGVGAIPRTSNPNRLSENIDVFDIALTPEETEAISALQSPDGRLIDPSFAPVWDRD

SEQ ID NO: 76866 - protein, 398 aa, Xylella fastidiosa Temecula1
MNTPTHTHPHPFGSTATIRCERAAAELRTGRPVLLIDAHARRHAVMALDSMTAQSFATFANAVGNTHYLFLTPVRSNVLGLEAPQGARIPLATLSYDSLAKLAYLRQPTRPTAWAPGDIMDAAATEITRLALLLPAIVAAPLTQHTEHAFADCQTLDLADLDTAAACASTTEYELVTRTPVPLRDLGMSEFIVFRGGIAQRDQVAILIGRPDLSSAVPVRVHSSCLTGDLFGSLKCDCGDQLRHSLATLKALGGGVLLYLDQEGRGNGIAAKIRAYGYQHVGLDTIDADAQLGFGPDERRYTGAVMMLRALGITRIQLLSNNPAKAERLRAAGIIVKQRISVIGQITKQNEHYLRTKVSRAGHDLDIDALIMTSQRPQDPSETVDGETVKPIAKTGHA

SEQ ID NO: 76867 - protein, 175 aa, Triticum aestivum
MVPTVMASLATSVAPFQGLKSIAGLPVSRRSNGASLGSVSNGGRIRCMQVWPIEGIKKFETLSYLPPFSTEALLKHVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESVKA

SEQ ID NO: 76868 - protein, 408 aa, Nitrosomonas europaea ATCC 19718
MQPIKKSSKLDNVCYDIRGPVLDRARQMEDEGQRVIKLNIGNPASFGFEAPDEILQDVIRNLSAASGYCDSKGLFAARKAIMHYTQEKNIANVQMDDIYIGNGVSELIMLATQALLENGDEILVPSPDYPLWTAAISLAGGVARHYTCDEQSSWLPDPENIKAQVSSRTRAIVIINPNNPTGALYPDDLLREIIEIARRNNLIIFADEIYDKILYDSASHTSVASLADDVLFVTFNGLSKNYRAAGFRSGWVVVSGNKTHARDYITGLNMLASMRLCANVPAQFGIQTALGGYQSIHDLTMPTGRLKRQRDLAWKLLTDIPGVTCFKPQSALYLFPRLDPDYYPVKDDEQFALDLLLEEKVLVVQGTGFNWSQPDHFRIVFLPNSDDLTEAIGRIAKFLDRYRTRHGS

SEQ ID NO: 76869 - protein, 679 aa, Oryza sativa Japonica Group
MGYLSCRADSSVATCRSITAISPLPLSRRSGVGGRRRALPAAAREGDGGEASSAAATIERFAYDELEAATSHFADAALLGRGSHGAVYKAVLASGRAVAVKRPSPRRPEVDNEIRILSSVRGPRLVNLLGFSDSGAGAGADQQQQQHRPRLLVVEYMPNGTLYELLHSNPRPPGWPRRVRLALQTARALRALHDADPPVIHRDVKSANVLLDANLDARLGDFGLALRVPKRLPGDAAANAAATPAPAGTLGYLDPAYVTPESLSTKTDVFSFGILLLEIMSGRKAIDVQHSPPSVVEWAVPLLRKGKVASLFDPRVAPPRDPVTRRDLAALAASCVRSCRERRPSMADIVDRLVVLSKAVSGKMWNGLAVVGNPCAVVDVQKTIAKRAAAAAAGDRAASQRELTSALAFDDDEKKEEEDAPNAGALEEDEVPLVGAKKAPRPLKNGKMFSEPGARERRNLLELMARIDGVAGQRFGITRARTVRAASESIEKDAAVLLLRRNQTVKVLGSEALSKADIFSSLDAKIKHELGKEQQEEAGKIKHELVKEQQEKAGNIKQELVKEQQEKAGNIKQESGEEQEKAGKTKHDAGKGHVEKAVGINLEAGKEQEKVEKNQEKEMKIQEKLGEIFDKAMKSEEKTGQNPGIEKKIQDTAEKKQEHDARVVQDKVEKIQDEAKKIQ

SEQ ID NO: 76870 - protein, 187 aa, Xylella fastidiosa Temecula1
MNPIRPFLDKTPQLGCTVYIDPTSTVIGDVVLGDDVSVWPQTVIRGDVNQIRIGARTNIQDGTIIHVSHHSPYNAAGYPTLIGTDVTIGHGTIIHACTIEKLCLIGMGACILDGVTIKKYGFVGAGAVISPNKIVGEAELWLGNPARLVRKLSDKEIESLHYSAQHYVKLKNRYLDLSAETTTTPSA

SEQ ID NO: 76871 - protein, 1118 aa, marine gamma proteobacterium HTCC2143
MKIEKLLIANRGEIAVRIAGAASELGIDTVAVYSDDDATSLHTRKTDQSVSLGRNGVAAYLDAAKIIEVAREYGCDAIHPGYGFLAENAGFARDCDAAGIVFVGPNADVLDLFGDKVKARSLAQECKVAVIEGTTGATSLNGVKDFFVSLGDDAAVMIKALAGGGGRGMRAVENVADIEEAYTRCQSEAQQAFGNGDVFVERLIRRARHIEVQIVSDGQGNVIHIGERECSIQRRNQKIIELAPCPDLSAILRGKITTAAVKLAKFASYENIGTFEFLVDADQLQTDADNAYFAFIEANPRVQVEHTVTEEVMDIDLVQTQLRIASNQSLPDMGLTQEQFLSPRGYALQARINMEVMTEDGEARPTGGVINTYEMPSGRGVRVDGFGYSGYRTSPSFDSLLAKLIVHSASADFDALLSKAYRTVGEVRIDGLETNIPYLQALLQRQELASGNIYTRFIDDQSSALFKSASEQREKYYFELPSVTAANDPLAVLAHGGNANPVDGDDGTLDGMHVVSAPLQGTIVEFSVEVGAEISAGQQLAIMDSMKMEHVISSPISGIVREIKVSPGGAIYENHGLIVIEPADVEETENVVEEIVDLDHIRPDLAEVLERHYFGMDEARPEAVAKRRKTHQRTARENIADICDEDSFVEYGPLAIAAQRRRRSVEDLIRKTPADGMVTGVGSVNGDLFGERESQCVVMSYDYMVLAGTQGKFNHTKKDRMFELAEKQKLPVILLAEGGGGRPGDTDAKGVAGLDCLAFAYFAKLSGLVPTIGINSGRCFAGNAALLGCCDVIIATENSSIGMGGPAMIEGGGLGVYTPDEVGPMSIQVPNGVVDIAVEDEAEAVVVAKKYLSYFQGPLEEWECADQRLLRTAIPENRLRVYDIQAVIENLADTDSVLEIRKAYGVGMVTSFARIEGRPVGIVANNPKHLGGAIDGPGADKASRFMQLCDAFDIPILFLCDTPGFMVGPEIEKTAVVRRFGRMFVTAASMSVPFFTVILRKGYGLGAQAMAGGSFMSPLFTITWPTGEFGGMGLEGAVKLGFRKELEAIEDLDERNDKYLEMVAASYERGKATNMASFLEIDDAIDPKDTRRWIMSALKSAPKPHPREGKKRNHVDTW

SEQ ID NO: 76872 - protein, 555 aa, Buchnera aphidicola str. Sg (Schizaphis graminum)
MKNINLIETKSWKDLKNHFKEVKNIHLKDLFLSDFNRFKKFSIFFENEILIDFSKNRITEKTLILLLNLAKEMNVKSAIKLMFSGSKINQTENRSVLHIALRNRSNFPILLNNSDIMSEVNDVLKKMKNFSELVIDGTWKGYSGKSISDVVNIGIGGSDLGPYMVTEALRPYKNHLNIHYVSNIDGTHLSEILKKINPETTIFLIASKTFTTDETITNANSAKFWFLKHSKTKETLDKHFFALSANINNAVNFGINIKNIFQFWDWVGGRFSLWSSAGLSIVLSIGFNNFEKFLQGAHVMDNHFYHTEYDKNIPILLALISIWYTNFFNSETEAIFPYDQYMHRFSAYFQQSNMESNGKSIDKNGNKVCYQTGPIIWGEPGTNGQHAFFQLIHQGTKLIPSDFIVPTVSHNNLNDHHLKLISNFLAQTQVLAFGKSKNSFLKESTSFKKEEDEFNRILPFKICEGNKPTNSILLRKITPYTLGMLIALYEHKIFVQGHILNIFSFDQWGVEIGKEVAQSIYKNINEKTKNSKSYDSSTQGLIDFYNFFKNKQNYL

SEQ ID NO: 76873 - protein, 318 aa, Synechococcus sp. CC9605
MALGSVVVCLGEALIDRLGPPGGDPAVDHPLDDRLGGAPANVACGLARLGTPVAFAGRLGQDAIGEAFSSLFAKRGVDTTLLQRDAKCPSRIVLVRRSLDGERQFQGFAGDEGAGFADQALEPVALPEVQWLLIGTLPLASTASAAALFSAARQARSQGTALALDVNWRPTFWDATADAEAGPSSAAKDAIQPLLEQAALIKLAREEALWFFNTDDPGSIQQSLSQRPDVVVTDGASPVLWQLGDESGQQAAFQPPSVVDTTGAGDAFTAGLLHRWAAAPQERVRFAAACGALVCGGAGGIDPQPTQAQVEAFLGGVS

SEQ ID NO: 76874 - protein, 426 aa, Arabidopsis thaliana
  misc_feature (154)..(154): Xaa can be any naturally occurring amino acid
MSACINGLCRAVTVSLLLLLLSFSFSSACSNGNCQLLDSCSSATDCVSGLYCGDCPAVGRSKPVCTRGQATSPTSIINGLPFNKYTWLMTHNAFSNANAPLLPGVERITFYNQEDTITNQLQNGVRGLMLDMYDFNNDIWLCHSLRGQCFNFTXFQPAINILREVEAFLSQNPTEIVTIIIEDYVHRPKGLSTLFANAGLDKYWFPVSKMPRKGEDWPTVTDMVQENHRLLVFTSVAAKEDEEGVAYQWRYMVENESGDPGVKRGSCPNRKESQPLNSKSSSLFLMNYFPTYPVEKDACKEHSAPLAEMVGTCLKSGGNRMPNFLAVNFYMRSDGGGVFEILDRMNGPVLCGCETLSACQPGAAYGSCKNVTVQTRTPSMDSTAGSNSGGSYSGSVQFSRSLASVAQLNNIVVFCFSLLPLLIFLL

SEQ ID NO: 76875 - protein, 696 aa, Thiomicrospira crunogena XCL-2
MTDTVLARKWRPKNFSELVGQTHVMQALSNALDQQRLHHAYLFTGTRGVGKTTIARIFSKALNCEQGITSKPCGVCSTCRSIDEGRFVDLIEVDAASKTKVEDTRELLENVQYAPVQGRYKVYLIDEVHMLSKSSFNALLKTLEEPPEHVKFLLATTDPHKLPITVLSRCLQFNLMRLTLPQIQQHLAYILQQEQVTFEETALAMIAKSADGSARDSLSILDQAIAYGGGKVQYDAVQAMLGLVDQQFTLNILSALANESADELKEVIQQLALMGVDYTALNGQLIEALHQMSMLQVLGDLTESSLIEVEMLQKLSEQLSPERIQVLYQIALLAKQDMALAPDIRIGFEMSLLRMLAFKPVFSETMSSMEQTEPEEGMSRQENVKTARPGQNEPAAIPNQPAAADEARTNFEAPSHFEAPSAPQSSMPETQAAPQSSAPQPSGEMDHLTDLKARLDSTLGKSEAPIEHRENHDAEVPTFDVPSGQSLEQSASFLTETRQEDDRPVESAAAFQASSHVPVQKAVTEEAMAPAFESPGMESVTPSSQEHFEQEPVSEAVVADAPIEMNADTASVTDWIALITQLQLEGMAAELARQSILVKRDAQSLTLSIDPEQVHAKTELALQRLEEQVKAQLGVRLIFVDYPEDHWTPAKHFAAEAKARQGNAAESIRNDAVVQNLIQTLNLKVIESSIRPITKA

SEQ ID NO: 76876 - protein, 503 aa, Pisum sativum
MDIPIPTRQLFINGDWKAPVLNKRIPVINPATQNIIGDIPAATKEDVDVAVAAAKTALTRNKGADWATASGAVRARYLRAIAAKVTEKKPELAKLESIDCGKPLDEAAWDIDDVAGCFEYYADLAEKLDARQKAPVSLPMDTFKSHVLREPIGVVGLITPWNYPMLMATWKVAPALAAGCAAILKPSELASLTCLELGEICKEVGLPRSVLNIVTGLGHEAGAPLASHPDVDKISFTGSSATGSKIMTTAAQLVKPVSLELGGKSPLVVFEDVDLDKAAEWAIFGCFWTNGQICSATSRLILHESIATEFLNRIVKWIKNIKISDPLEEGCRLGPVVSEGQYEKILKFVSNAKSEGATILTGGSRPEHLKKGFFIEPTIITDVTTNMQIWREEVFGPVLCVKTFSTEEEAIDLANDTVYGLGAAVISNDLERCERVTKAFKAGIVWVNCSQPCFTQAPWGGVKRSGFGRELGEWGLDNYLSVKQVTQYISEEPWGWYQPPAKL

SEQ ID NO: 76877 - protein, 122 aa, Nicotiana sylvestris
PEILKPDIIAPGVNILAGWTGAVGPTGLEEDDRRVGFNIISGTSMSCPHVSGLAALLKGAHPEWSPAAIRSALMTTAYTAYKNGGAIQDVSTGKPSTPLDHGAGHVDPVPALNPGLVYDITT

SEQ ID NO: 76878 - protein, 534 aa, Synechococcus sp. RS9916
MDDESRENEGDLICAAQYATPDQINFMATHARGLICLAMEGKQLDALDLPLMVDRNTDANQTAFTVSIDAGPEHGVSTGISAEDRSRTIQVALQADARPSDLRRPGHIFPLRARQGGVLKRAGHTEAAIDLSALSGLIPAGVICEIQNQDGSMARLPQLRDYADQWNLRLISIADLIRYRLDNERFVVRQAHASLPSAFGDFKAIGYRNALDGSEHVAIVKGDPAQLSEPVLVRMHSECLTGDAFGSLRCDCRPQLEAALRQIEAEGEGVVVYLRQEGRGIGLINKLKAYSLQDGGLDTVEANEKLGFPADLRNYGVGAQILSDLGIHRLRLLTNNPRKIAGLGGYGLEVVDRVPLIIHPGDHNADYLAAKRDKLGHLFQAGEASAEAGNSPSNRGGHPSISTTVVSWDGDLDLLPQIRARCEQDAQSLNLVLTPTSSPRLLALWERPQVAWQIDNALDNQAGASFATRLQSLLEVMASWPETRRLGFYSAASVDQLNHPSQTLERVEEPLDQLRTGLIGVQGRLQEPTLVQWS

SEQ ID NO: 76879 - protein, 637 aa, Neisseria meningitidis Z2491
MNPSPLLDLIDSPQDLRRLDKKQLPRLAGELRTFLLESVGQTGGHFASNLGAVELTVALHYVYNTPEDKLVWDVGHQSYPHKILTGRKNQMHTMRQYGGLAGFPKRCESEYDAFGVGHSSTSIGAALGMAAADKQLGSDRRSVAIIGDGAMTAGQAFEALNCAGDMDVDLLVVLNDNEMSISPNVGALPKYLASNVVRDMHGLLSTVKAQTGKVLDKIPGAMEFAQKVEHKIKTLAEEAEHAKQSLSLFENFGFRYTGPVDGHNVENLVDVLEDLRGRKGPQLLHVITKKGNGYKLAENDPVKYHAVANLPKESAAQMPSEKEPKPAAKPTYTQVFGKWLCDRAAADSRLVAITPAMREGSGLVEFEQRFPDRYFDVGIAEQHAVTFAGGLACEGMKPVVAIYSTFLQRAYDQLVHDIALQNLPVLFAVDRAGIVGADGPTHAGLYDLSFLRCIPNMIVAAPSDENECRLLLSTCYQADAPAAVRYPRGTGTGVPVSDGMETVEIGKGIIRREGEKTAFIAFGSMVAPALAVAGKLNATVADMRFVKPIDEELIVRLARSHDRIVTLEENAEQGGAGSAVLEVLAKHGICKPVLLLGVADTVTGHGDPKKLLDDLGLSAEAVERRVRAWLSDRDAAN

SEQ ID NO: 76880 - protein, 338 aa, Streptococcus pyogenes MGAS8232
MKAVVVNQASTGVEVVEHDLPNVGHGEALVKVEYCGVCHTDLHVAHGDFGQVPGRILGHEGIGIVEEIGEGVTSLKVGDRVSIAWFFEGCGHCEYCTTGRETLCRSVKNAGYSVDGGMSEYAVVTADYAVKVPEGLDPAQASSITCAGVTTYKAIKEAGVAPGQWIVIFGAGGLGNLAVQYAKKVFNAHVVAVDINNDKLELAKEVGADILVNGKEIEDVPGYIQEKIGGAHGVVVTAVSKVAFNQAIDSVRAGGTVVAVGLPSEYMELSIVKTVLDGIKVVGSLVGTRKDLEEAFAFGAEGLVAPVVEKVPVDTAPEVFDEMERGLIQGRKVLDFIS

SEQ ID NO: 76881 - protein, 302 aa, Thiomicrospira crunogena XCL-2
MSIKHFLTLQDFSPAELKQLMLRAIELKKIQKSGEIFEPLKNKTLAMIFEKSSTRTRISFEIGMSQLGGHALFLSPRDTQLGRGEPIEDTAKVISSMADGIMIRTFGHEVVEKMAEHSQVPVINALTDDYHPCQLLADMQTYYEHRGSIEGKTVLWVGDGNNMCHSYINAAKQYGFKLRISAPEDYDPNPRIVEANQEYVEMIRNPMDAAENVDLIVTDVWASMGQEEEQKKREKAFKDYQVNTAMMQQANPDALFMHCLPAHRGEEVSAEVMDAEDSVVWDEAENRLHAQKALLEYLMAKA

SEQ ID NO: 76882 - protein, 394 aa, Thiomicrospira crunogena XCL-2
MNSQDHLMNTYARLPVTFESGQGALLYDTDGQGYLDAISGIAVCSLGHAHPEISRTICEQSQQLIHTSNLYGIEKQTQLADELIDISHLEKVFFCNSGAEANETAIKMARKFAHQQQIQSPKIIVMENSFHGRTLATLSATGNPKVQQGFEPLVEGFVRVPYNDVEAIQNVSSDSDIVAILVEPVQGEGGVNIPDRGYLKALREICDQNNWLLILDEIQTGIGRTGKWFAHQHEDILPDVMTLAKALGNGVPIGACLAGKKAADLLVPGNHGTTFGGNPLACATGLAVIKTLTFHNFIEHVDAKGALLVARLQEALEQNSAVVNVRGLGYMIGIELDRPCAELVQKALKKHLLINVTQGNTIRLLPTFVMSNDQTDQLINTLVELIEEFTQTST

SEQ ID NO: 76883 - protein, 569 aa, Gluconobacter oxydans 621H
MKGLAAIPDNATFDVAIIGAGINGAGLFRELSLQGLRVLLVDRSDFCSGASCAPSRLIHGGIKYLETGEFRLVAQSTLERNLLLRNAPHVVKPLPTVLPIRSWFGGIVPSFRKFLRLGGKMTDRGALVLEAGLQIYDFLGRRARVMPRHSLFLKSQTRQEWPHIAADVMATAQYYDAAITQPERLGYECVRDGMDVGTDCAVSTYTVPVSFADGVLELRDEKSGETRHVRPRLIVNAGGAWIDRINADLGHQTRYIGGTKGSHLLLRHEGLLQELRGRMMYFGTPDGRICLAYPFYGHVLVGSTDLRIDDPDTAVCTDEEQDYMLRMLGGLFPGFRFGAEDVIYRYSGVRPLPATNAADPGAISRDHIIHEDVLDGIPLLSLVGGKWTTFRGLAEETADRVLEMLGAERHLSTRDFPIGGGRDYPPPERYSAYLDEFFVTHGLPKARAALLLERYGSRARAFAVFCQEKPDAPLRSLPSYTRRELAFIATDELVRTLSDVLFRRTPIALSGLLTPDVVREAGAIVGEALEWSAQETEQQCLLTWREGKERHQLKGELPAASFSHTALRA

SEQ ID NO: 76884 - protein, 275 aa, Gluconobacter oxydans 621H
MSIQPVGQSFGRLVVDQKNVWIGTSWKMNKGPSEAIAAARALESFQPPEGIRSFVIPSFTSLRDVCSVLEDSALLVGAQNMHWEDSGAWTGEVSAPMIAECGASIVEIGHSERRQHFGETDWTVNLKVQAALRHGLRPLICIGDTSDEFEFGVSQETLARQVKIALHGVSRKDLGQVMVAYEPVWAIGSAGRPAEASFVSGIHTRLRAVVRELAGDSGVRIPLLYGGSVSQANIRDYVALPDVDGVFVGRAAWEPADFMRLVESVSGVVSRKIAA

SEQ ID NO: 76885 - protein, 174 aa, Triticum aestivum
  misc_feature (90)..(90): Xaa can be any naturally occurring amino acid
  misc_feature (124)..(124): Xaa can be any naturally occurring amino acid
  misc_feature (140)..(140): Xaa can be any naturally occurring amino acid
  misc_feature (150)..(150): Xaa can be any naturally occurring amino acid
  misc_feature (153)..(154): Xaa can be any naturally occurring amino acid
  misc_feature (158)..(158): Xaa can be any naturally occurring amino acid
VLPDGDHDLQRCQYVTEKVLAAVYKALNDHHVYLEGTLLKPNMVTAGHSCPKKYTPQDVAVATVTTLLRTVPAAVPGICFLSGGHREEEXASLHLNAMNQSPLPKPWKLAFSYGRALQASALGXWLGKSENKKAAQEASXKRAHLKIWLXGTXXTLGXMKKLPSHFNASSLETK

SEQ ID NO: 76886 - protein, 472 aa, Frankia sp. EAN1pec
MHEVDVLVIGSGPGGQKAAIAAAKLGRSVAVVDKRDMIGGVCINTGTIPSKTLREAVMYLTGLAQREVYGQSYRLKDEITVADLSARTQHVIGREIDVIRSQLTRNRVQVLSGLATFLDPNTVSVRGPGGVEERQVRANKIIIATGTRPARPDSVDFDGRTVVDSDQILDIDRIPGSMVVVGAGVIGIEYASMFAALGTKVTVVERRDRMLDFCDLEIIEALKYQLRDLAVTFRFRESVVSVERHNGGTLTTLESGKKIPADTVMYSAGRQGLTEVLQLQNAGLSADNRGRILVGPDFRTEVDHIYAVGDVIGFPALAATSMEQGRLAAYAACGEPATGMRAELMPIGIYTIPEISYVGSTEDELTERAVPFEVGIARYRELARGAILGDSYGMLKLLVSPEDGRLLGIHVFGTGATELVHIGQAVMGCGGTVNYLVDTVFNYPTLAESYKVAALDAMNKMRAVARISGRHL

SEQ ID NO: 76887 - protein, 600 aa, Schizosaccharomyces pombe 972h-
MTGTSFYTSVLRLGRLAQQGLKFQSVKHIRPSCFSSFGLQAKRWNSTQQNDSSIDCLEPKLQGIIEDNISPSTAQKEISDIKFNIPKEMLLPDGTPDYLRLTLTSNVYEVIKETPLTKGVVISESTGVPVYLKREDLTPVFSFKIRGAHNKMASLDKQSLKNGVIACSAGNHAQGVAYSARTLGVKATIVMPQNTPEIKWRNVKRLGANVLLHGANFDIAKAECARLAKEQNLEVIHPFDDPYVIAGQGTIGLEILHQIDLRKLDAIYCAVGGGGLIAGIATYVKRIAPHVKVIGVETFDADALKKSLKDKKRVTLKEVGLFADGTAVKLVGEETFRLVSKNIDDVVLVDKDEICAAIKDVFLDTRSVVEPSGAMAVAGMKRYVAKHKPKNPNAAQVCILSGANMDFDRLRFIAERADLGLNKEVFLSVTIPERPGSFEALHNIITPRSITEFSYRYDNDDYANIYTSFVVKDRATELPLILQQISEQNMVAEDISDNELAKTHARYLIGGKSSVSKERLYRLDFPERPGALCKFLRSIKEVCSISLFHYRNCGGDIASVLAGLRVFDGQVEKLHSVLEEIGYNWVDETNNPVYLRYLRK

SEQ ID NO: 76888 - protein, 371 aa, Chlamydomonas reinhardtii
MALLAQRSVNASARAGRPNRSRVVVPCIRAESGKIKIGINGFGRIGRLVMRATMLRPDIEVVAINDPFIDAEYMAYMFKYDSVHKTWPGHVNGSKDGFLVEGRKIHTFTESDPSKINWGAAGADIVIESTGVFTDIAKATAHLTGGAKKVIITAPSNDAPMYVMGVNHEKYNPATDHIISNASCTTNCLAPLAKVVNSKFGIKEGLMTTVHATTATQKTVDGPSKKDWRGGRAVNGNIIPSSTGAAKAVGKVLPELKGKLTGMAFRVPTNDVSVVDLTVTLEKATTYEDIMKALKEASEGEMKGVLAYTDEDVVSSDFVTDPASCTVDAKAGIMLSPTFVKLVAWYDNEWGYSNRVVDLALHVAKKAAVKV

SEQ ID NO: 76889 - protein, 219 aa, Zea mays
HASARVPSASAPPFRPRVRVAAPLGVRVTGGRRGQAVVAMASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELPELKGRDKLGDRPVFVLVEADA

SEQ ID NO: 76890 - protein, 288 aa, Zea mays
MGKEVDVSTLEAGGVRDRDYADPPPAPLIDIDELGKWSLYRAVIAEFVATLLFLYITVATVIGYKHQTDASASGPDAACSGVGILGIAWAFGGMIFILVYCTAGISGGHINPAVTFGLFLARKVSLVRALLYMAAQSLGAICGVALVKGFQSGFYARYGGGANEVSAGYSTGTGLAAEIIGTFVLVYTVFSATDPKRNARDSHVPVLAPLPIGFAVFMVHLATIPITGTGINPARSLGAAVVYNNSKAWSDQWIFWVGPFIGAAIAALYHQIVLRASARGYGSFRSNA

SEQ ID NO: 76891 - protein, 686 aa, Bacillus halodurans C-125
MIDHPITDPVLIFAIAMVVFFVAPLLMSRLRIPGIIGLILAGVVIGPNGFALLDRDPTIVLLGTVGLLYIIFIAGLEIDLEGFKKYRNRSVLFGTLSFTIPFLFGLVFTFILGFSTPAAILLASILGSHTLLAYPIASRLGISKDRGVTTAVGGTIMTDTLALLVLAIVAGSMQGELNSTFWFTIAVSLVLYVAITLILIPILAKSFFRTMSSEGALEFIFVMSILFVTAYGATLAGLEPIIGAFLAGLALNRFILEHSPLMNRIKFVGNALFIPFFLLSVGMLMDIRVLLGDPSAWLLAALVVIFVQLGKFLAAFISGKLYNYSMDQIKLMFGLSVPQAAATLAATLVGFDLGLFDSAVVNAVIVMILVTCMVGPYVVEKYARKLALEEELKPFDPSEAPERVMVPIANPKTVESLLDLAFIVRGQSSEPLYPLTVAQGTNGDAESEVAKAEKVLAHAVTYAAGASVPIQMLTRLDPNIASGIIRAIEETRITTLVIGWNGKRSTPQLIFGGILDQLLERTEEMVLVSKLGHPLNTTKRIVLVLPSGVDHKTGYYRSLRTVKRLANQVGATLVCVVVKDDARPYEKTIKEIKPDVSTTVVGISSWNEWHKQWMLTLRADDLVVVLSARRGTLAWHPQLEQLPNVLAKANPESFIMIYPPETEKTDSRGSRGTDVPRMMSSRSYED

SEQ ID NO: 76892 - protein, 224 aa, Flavobacteria bacterium BBFL7
MDISKEFEKFAVKDQGVNPMYYDKIMGSMYPTNLTPNIIEERQMNIAIFDVFSRLMMDRIIFMGTGVNDQVANIIQAQLLFLESTDANKDIQIYINSPGGSVYAGLGIYDTMQFIKPDVATICTGMAASMGAVLLCAGADGKRSALPHSRVMIHQVSSGAQGQASDIEITAREVVKLREELYTIIAKHSKQTYEKVYADSDRDYWMKAAEAKEYGMIDEVLTRD

SEQ ID NO: 76893 - protein, 269 aa, Desulfotalea psychrophila LSv54
MSYLVLARKSRPQTFDQVIGQRPVVKTLQNSLARDRVAHALIFSGVRGVGKTTLARLMAKAINCEHRDNNNNPCNKCLSCQEITAGSSLDLYEIDGASNRGIQEIRELKEKIRFLPTSAKYRIVIIDEVHMLTTEAFNALLKTLEEPPEHVYFMFATTEIHKIPITILSRCQQYELKRVCADDLSGHFERLIGEEGKEIEKEALALIVREAAGSVRDGLSLLDQVLSFSESSVTTSDAIEVLGLIDREVLMNLDPSTLGRRSLHRHSCP

SEQ ID NO: 76894 - protein, 635 aa, Zea mays
  misc_feature (596)..(596): Xaa can be any naturally occurring amino acid
  misc_feature (624)..(624): Xaa can be any naturally occurring amino acid
MGNTCVGPSITMNGFFQSVSTALWKTPQEGDALPAAANGPGGASPGRSQSALPKPASDVHHVAVQSEAPEPVKIAAYHSEPAPAVRSEAPEPVKIAASHSEPAPMAAKPGGAAANASPSPSPRPRPQVKRVSSAGLLLGSVLRRKTENLKDKYSLGRRLGQGQFGTTHLCVERATGKELACKSILKRKLGSDDDVEDVRREIQIMHHLAGHPSVVGIRGAYEDAVAVHLVMELCGGGELFDRIVRRGHYTERKAAELARVIVGVVEACHSMGVMHRDLKPENFLFADHSEEAALKTIDFGLSIFFRPGQIFTDVVGSPYYVAPEVLKKRYGPEADVWSAGVIIYILLCGVPPFWAENEQGIFEEVLHGRLDFESEPWPSISDGAKDLVRRMLVRDPRKRLTAHEVLRHPWVQVGGVAPDRPLDSAVLSRMKQFSAMNKLKKMALRVIAENLSEDEIAGLREMFKMIDADNSGQITFEELKVGLEKVGANLQESEIYALMQAADVDNNGTIDYGEFIAATLHLNKVEREDHLFAAFQYFDKDGSGYITADELQVACEEFGLGDVQLEDLIGEVDQDNDGRIDYNEFVAMMQKPTVGXSRRRPTCRTASVSGSGRRSGWPRPLCLXLPCCLRVGVDD

SEQ ID NO: 76895 - protein, 558 aa, Aspergillus oryzae
MTQTAAGKSTGGVLQIPIAATQKNTANAAAAPTPKKAPKPAAPRLKLLVRRLPPGLTQAEFEVAVGPEWKLGAGKIDWFQYKPGKVSKDDHIIPLSNKVRQVSFTDARNTFNDPILLGPPSVEYAPYAKVPGSRVRKDARQGTIDQDPDFIAFLESLTQPITKPPTVENATDAEEKKETVTTTPLVQYIKEKKANKAKDSSNKSSKHAKADKETKAEKVQAKKLLQRPDKETAQAPEKIEKKAKADKATKEAVRVANKQAANVAKQAAKASAAQSSPKDPGQSTPATERRRERGSIAAAAKILQRDLGLAPAGSRRKGGKSGSAETDASKAEATSSESGKKETPPRSSRGGASSQNAKVKGNVPQPNEPTSQSEANTPPASTTPTSGKSSKSKGKQAPPAASTATQAFLKHANPSQGVTEPLLEAAFKTFGKVVKVEIDKKKGFGYIDFAEPDGLQKAIAASPVSVAQSQVVVLERKINPGGEKGRGKNRNEPQPTNAGGNNNSNNTNANGGRGGKSNEGGSGSSRGRGGRLKKGGGGGAKGSGGGNANANAPAKDAK

SEQ ID NO: 76896 - protein, 333 aa, Rhodobacter sphaeroides 2.4.1
MTVKVAINGFGRIGRNVLRAIIESGRTDIEVVAINDLGPVETNAHLLRFDSVHGRFPATVTTTEKTIDVGRGPMDVTAIRNPAELPWGHVDIVLECTGIFTDKEKAKVHLESGAKRVLVSAPSTGADKTIVYGVNHETLTKDDLIVSNASCTTNCLSPVAKVLNDTIGITKGFMTTIHSYTGDQPTLDTMHKDLYRARAAALSMIPTSTGAAKAVGLVLPELKGKLDGVAIRVPTPNVSVVDLVFEASRATSVEEVNAAIREAADGKLKGILGYTDQPNVSMDFNHDPHSSIFHLDQTKVMEGNMVRILTWYDNEWGFSNRMADTAVAMGKLI

SEQ ID NO: 76897 - protein, 144 aa, Rhodobacter sphaeroides 2.4.1
MLVQQILKAKSDDGVVTVPPGSSIAAAAEVLSSRRIGAVVVSRDGKRPEGMLSERDIVRELGRRGAGCLSDKVEAIMTSKIVTCACTDEADRIMQVMTEGRFRHLPVMAEGEMVGLISIGDVVKARLSELSMEKDALEGMIKGF

SEQ ID NO: 76898 - protein, 520 aa, Trametes versicolor
  misc_feature (329)..(329): Xaa can be any naturally occurring amino acid
MGRFSSLCALTAVIHSFGRVSAAIGPVTDLTISNADVSPDGFTRAAVLANGVFPGPLITGNKGDNFQINVVDNLSNETMVKSTSIHWHGFFQKGTNWADGAAFVNQYPIARGNSFLYEFTARDQAGTFWYHSHLSTQYCDGLRGPMVVYDPSDPHADLYDVDDETTIITLSDWYHTATSLGAAFPTGSDSTLINGLGRFASGDSTDLAVITVEQGKRYRMRLLSLSCDPNYVFSIDGHNMTIIEADAVNHEPLTVDSIQIYAGQRYSFVLTADQDIDNYFIRALPSAGTTSFDGGINSAILRYSGASEVDPTTTETTSVLPLDEANLVXLDSPAAPGDLNIGGVDYALNLDFNFDGTNFFINDVSFVSPTVPVLLQILSGTTSAADLLPSGSLFALPSNSTIEISFPITATNAPGAPHPFHLHGHTFSIVRTAGSTDTNFVNPVRRDVVNTGTAGDNVTIRFTTDNPGPWFLHCHIDFHLEAGFAIVFSEDTADVSNTTTPSTAWEDLCPTYNALDSSDL

SEQ ID NO: 76899 - protein, 379 aa, Brassica napus
MSTTGQIIRCKAAVCWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIYHFLGTSTFSEYTVVHSGQVAKINPEAPLDKVCIVSCGLSTGLGATLNVAKPKKGQSVAIFGLGAVGLAAAEGARIAGAGRIIGVDLNPKRFEEAKKFGVTDFVNPKEHDKPVQQVIAEMTNGGVDRSVECTGSIQAMIQAFECVHDGWGVAVLVGVPSKDDAFKTHPMNLLNERTLKGTFFGNYKPKTDIPGVVEKYMNKELELEKFITHTVPFSEINKAFDYMLKGESIRCIITMGA

SEQ ID NO: 76900 - protein, 254 aa, Oryza sativa Japonica Group
MSSAVDAISCSKGIAAPPTEEATKERVAVVGKNGGVEHGGDAATMNGKQCGEAPHCRKESNEEEEDDEEKAPKAIDLGPRVSIKDQLEKDKDDESLRRWKEQLLGSVDLNSVGETLEPDVKIMSLAILSPGRPDIFLPLPVEPNAKGVWFTLKEGSLYKLKFTFSVSNNIVSGLRYTNAVWKTGIKVDSHKEMLGTFSPQPEPYTYVTPEETTPSGMFARGSYSARTKFLDDDRKCYLEINYTFDIRREWPALS

SEQ ID NO: 76901 - protein, 309 aa, Yersinia pseudotuberculosis IP 32953
MSVFILGSYAKALVMTTDRIPLAGETLIGYDFRQTWGGKGSDMAVQAVRLGAEVAYAGVVGDDTFGHEFVGLMQEEGVNIDALTISGELPTGAGLIVKDKEARNVIVVDMGANKLFTPALVDSALSQLKQSNVVLAQLEIPLETALYGLQRAKEFGKITILNPAPARDLRGLDLSAIDYLTPNETEARVALGLPPDDPRSNREIANLLLETGCQYVVMTLGESGSAVFGRNDTQEIPPCIIDVVDSNGAGDSFNAALAVALDEGLPISEAVLFANATAALCCMDWETVPSYRYREDVDAFMRSITVKEE

SEQ ID NO: 76902 - protein, 344 aa, Silicibacter pomeroyi DSS-3
MERKSQNIVPWRMSCAPMMDWTDRHCRYLHRLLSRQTLLYTEMVTAPALVRGGALHLLEYSVEEHPVALQLGGSDPEELAQAARLGAEAGYDEINLNCGCPSDRVQSGTFGAVLMKHPGLVADCVTAMREAVDVEVTVKCRIGVDDQDPETVLPEFLEQIAGAGCQRVIIHARKAWLQGLSPKENRDIPPLDYDLVHRMKARFPGMHISINGGIDTLAAARAHLDAGLDGVMIGRAAYHQPADILCKADPLIYGTGTASDPVTAVRAMLPYIEAHLATGGRLHQITRHMLGLFAGRPGARGWRRMLSEGAVRPGAGPELVEAALDQVAGLWHTSETPLDPAPRL

SEQ ID NO: 76903 - protein, 190 aa, Ipheion uniflorum
PIRENLPGHQRKDPVCPHLQFSVMGQKLYVSQEQVSIGRKPVTGLKLCLEGAKQNRLSIQVQHLTSLPKILRPYWDSHIAIGAPKWHGPEEQDSRWFEPVKWKNFSHVSTAPIDNNESFIGDDPTRMGVCIVTGAQLGVWDFGSKNVLYMKLLYSKVPGCTIRRSLWDYTPNKIDDLGLRDDVGKFGKIV

SEQ ID NO: 76904 - protein, 532 aa, Synechococcus sp. RS9916
MSFPDFCANDPQVQWQRFCELLWFHDGLGMWLDISRMHVNQADLDELKPRFDQAFKAMAALEGGAIANGDEQRQVGHYWLRHPQLAPDPEVQAHIATEVDQIEAFGRSIVRGEIKAPNGQAFTDVLWIGIGGSGLGPLLMIRALQEEGAGLPFHFFDNVDPNGMSRVLAGLGDALPTTLVITVSKSGGTPEPHLGMEQARHRVEASGGSWAGQAVAITMANSKLDQKASQEGWLQRFDMFDWVGGRTSITSAVGLVPGALIGADIREFLDGAAQMDAATRLDDLERNPAALMAASWFVAGEGCGKRDMVVLPYRDRLEVFSRYLQQLVMESLGKRLDRAGNVVHQGIAVYGNKGSTDQHAYVQQLRDGVDNFFVTFIEALKDSQDIPDINGERPGDFLDGFLQGTRSALTEGGRQSISISMRQFDARRLGALIALFERAVGLYGELVNINAYHQPGVEAGKKAAAAILNLQGQVEAVLADGQSRSVSEVHAAIGEGSVEAVFWILRHLTGNERGYSAQGSWDAPATLRFSKS

SEQ ID NO: 76905 - protein, 132 aa, Silicibacter pomeroyi DSS-3
MTTHTVTIANREGASFQVNARRPLLEQLRDQGVDLPYGCEYGGCITCAAKLTAGEVDQRRQVALNNRQIANGYVILCVARATSDITLEIGVESHDTLYRNPFLDPLQPHELKADIATPRPSIGDALEQTKES

SEQ ID NO: 76906 - protein, 318 aa, Chlamydomonas reinhardtii
MLRPDIEVVAINDPFIDAEYMAYMFKYDSVHKTWPGHVNGSKDGFLVEGRKIHTFTESDPSKINWGAAGADIVIESTGVFTDIAKATAHLTGGAKKVIITAPSNDAPMYVMGVNHEKYNPATDHIISNASCTTNCLAPLAKVVNSKFGIKEGLMTTVHATTATQKTVDGPSKKDWRGGRAVNGNIIPSSTGAAKAVGKVLPELKGKLTGMAFRVPTNDVSVVDLTVTLEKATTYEDIMKALKEASEGEMKGVLAYTDEDVVSSDFVTDPASCTVDAKAGIMLSPTFVKLVAWYDNEWGYSNRVVDLALHVAKKAAVKV

SEQ ID NO: 76907 - protein, 100 aa, Microcystis aeruginosa PCC 7806
MATYKVTLKNESEGLNTTIEVPDDEYILDVAEEAGLDLPYSCRAGACSTCAGKIESGTVDQSDQSFLDDDQIEAGYVLTCVAYPTSDCVILTHKEEDALK

SEQ ID NO: 76908 - protein, 482 aa, Streptomyces avermitilis MA-4680
MSILNDVPKQLFIGGTWADAADGATMPVDDPATGEILCHVADAGPKDARLAADAAVEAQDGWARTAPRERSEILRRAYEIIVSRTGELALLMTSEMGKPLAEARGEVAYAAEFFRWFSEEAVRIDGGYGVLPDGRNRMLLMRRPVGPCLLVTPWNFPLAMGTRKIGPAIAAGCTMVLKPAPQTPLSSLALAGILKEAGLPDGVLNVVTTSRAGEVVEPLLTGGRIRKLSFTGSTRVGRLLLAQCADAVVRTSMELGGNAPFIVLDDADLSAAVDGAMTAKMRNMGEACTAANRFFVHRSVADEFGRRLAERMGALVVGPGTRDGVDVGPLIDEAGRAKVEELVADAVERGARVLVGGVAPDGPGRFYPPTVLADVDPGSRLMETEIFGPVAAILVFDDEDEVVRRANDTPWGLVGYVFTQGLDRALRVSERLEVGMVGVNTGLVSNPAAPFGGVKQSGLGREGGRVGIEEFLEYKYLAVPLR

SEQ ID NO: 76909 - protein, 419 aa, Streptomyces avermitilis MA-4680
MSALSPHLRQATPVVAVRGEGVHLYGEDGRRYLDFTAGIGVTSTGHCHPRVVAAAQEQAGTLVHGQYTTVLHPPLRRLVDRLGEVLPAGLDSLFFTNSGSEAVEAALRLARQATGRPNVLVCHGGFHGRTVAAAAMTTSGTRFRSGFSPLMSGVVVTPFPTAFRYGWDEETATRFALQELDYTLRTISSPDDTAAIIVEPVLGEGGYVPATRAFLEGLRERADRHGFVLILDEVQTGVGRTGRFWGHDHFGVTPDILITAKGLASGFPLSGIAASAELMGKAWPGSQGGTYGANAVACAAACATLDVVRDEKLVDNAEAMGARLRAGLAAVAATTPAIGDVRGLGLMLASEFVTEDGGPDPETAARVQRAAVDEGLLLLLCGAWNQVVRMIPALVIDEAEVDEGLRAWSAAVEVGVPAR

SEQ ID NO: 76910 - protein, 360 aa, Streptomyces avermitilis MA-4680
MPVISVPYAFNEEELYVDLRSIFGHSLFLKCEGFNFAGSIKLKAATEMVEAAERDGVLTPESILVESSSGNLGVALSMIAASKGYRFLCVTDSRGNLSTRMMMEALGSEVHMIAGQEANGGFLGARIAYVRALCASDDRYVWLSQYTNPSNWKAHYRKTAPEIARQFPRLDVLFVGAGTTGTLMGCARYFREWHRPVRIVAVDSVGSVSFGGPPGRRMIPGLGMSMRPPLLDESYVDEVIRVEEADTIRTCHRLARRGFLFGGSTGTVVSGATDWLAGHDARELTAVAVGPDLGERYLDTIYQTNWLKDLYGDEVLDSDDVAAGSWASSPAQPTRWGRSLDLQTGDHHGNQHHQFHDRKT

SEQ ID NO: 76911 - protein, 346 aa, Prochlorococcus marinus str. MIT 9515
MFGLIGHSTSFEDAKRKASLLGFDHIADGDLDVWCTAPPQLVENVEVKSATGISIEGSYIDSCFVPEMLSRFKTARRKVLNAMELAQKKGINITALGGFTSIIFENFNLLQHKQIRNTSLEWERFTTGNTHTAWVICRQLEINAPKVGIELKKATVAVVGATGDIGSAVCRWLINKTGIGELLLVARQKEPLDNLQKELDGGTIKSLDEALPEADIVVWVASMPKTMEINTNNLKQPCLMIDGGYPKNLDEKFQGNNIHVVKGGIVKFFNDIGWNMMELAEMQNPQREMFACFAEAMILEFEKCHTNFSWGRNNISLEKMEFIGAASVKHGFSAIGLDKHPKVLAV

SEQ ID NO: 76912 - protein, 348 aa, Physcomitrella patens subsp. patens
MRVLRIRRVERVGALRCVCRGGGVKPETTDGGQKHGNRVFIFGMGYTSLALANSLKKQGWDVVGTCRSEEKREALELRGFQTHRFNPDNDGEWLQGEAIRDLHASTHIVNSIPPVGDFDCDPVLASVKVELQQAARERLQWIGYLSSTSVYGDWQGNWVGEETDPRPVERKAVARWEAEKSWMQFGEETGVCVHVFRLGGIYGPGRSALDTIRQSEQNKKLSTRQQLRGHKRFTSRVHVADICQVIVKTMASRDRARKIYNVVDDDPSPRAKVMAYARGLLLGTSVEHDMEFPEESAGFVSSGHVSEKRVSNQRVKDELQVKLLYPSFRSGLEAIANGLNNPFDQEIR

SEQ ID NO: 76913 - protein, 605 aa, Vibrio parahaemolyticus RIMD 2210633
MSQPVLSQINVFPVKSVGGVSLSSAWVEKQGLSFDRRFMIAKADGSMITARKYPQMVTVKSALLADGVVFSSLGMEPLKIRYQDFKMQETPATVWKDAFTAYTTTDDADDWFSQVLGQRVELLFSGEQSNRVRESLGQNVSFADGYPVLVISQASLEELNKRSSEQHSMDQFRTNLVVSDTKPFEEDSWKRIRIGEVEFESLKPCERCILTTINTQRGTFRESKEPLKTLQQFRANERGGVFFGQNLVARNEGIIRQGDKVEVLEYKEPEFYPDNSPVRMTLTCVEREEIAQDFVTLWLEPSNCSLPNYLPGQHLPIEVDINGKKIGRRYTLSSSPSRPGRYAISVKRIAGGRVSNALLDNLQVGDVLEAENPDGQFHLKTHDAQPLLLLSAGSGVTPMLSMVRYLADHNQLNDVVFYHQCRTEHDIPCRSELEQLKREHSGLEVKICLTQPAVDWFGLKGRLSLSHIKQIKDVEQRQVFVCGPDGFMQKAKNLLLKKGLPEAHYHQEAFGVSAVEARPEKEVEIEFNGLKIQGNNQKTLLDQIEDAGKVVSNSCRAGLCGACKVQLTSGQVHHPDVPALTDEERAMGTVLACCAIPETDVTVTE

SEQ ID NO: 76914 - protein, 377 aa, Neisseria meningitidis Z2491
MSTPALLVLADGSVFHGTSIGYEGSTSGEVVFNTSMTGYQEILTDPSYCKQIVTLTYPHIGNTGTNAEDEESRSVYAAGLIIRDLPLLHSNFRASESLHDYLVRNKTVAIADIDTRRLTTLLREKGAQGGAILTGADATIEKAQELIAAFGSMVGKDLAKEVSCTETYEWTEGEWALGKGFVTPDEQPYHVVAYDFGVKTNILRMLASRGCRLTVVPAQTSAQDVLALNPDGVFLSNGPGDPEPCTYAIEAVQKLMESGKPIFGICLGHQLISLAIGAKTLKMRFSHHGANHPVQDLDSGKVVITSQNHGFAVDADTLPANARITHKSLFDNTLQGIELTDKPVFCFQGHPEASPGPQDVGYLFDKFIGNMKAAKRA

SEQ ID NO: 76915 - protein, 616 aa, Oryza sativa Japonica Group
MAAVDTPEKPYEGKPAAEARSYWRWQKEDFFPEPSFASWGAYRAALAATPARFRDRFAGRSTDADELGALRRRSENEMRRCLTWWDLTWFGFGSVIGAGIFVLTGQEAHDHAGPAIVLSYVASGLSAMLSVFCYTEFAVEIPVAGGSFAYLRVELGDVAAFIAAANLILESIIGTAAVARSWTSYLASLINKPASALRIQTSLAEGYNELDPIAVVVIAVTATLAILSAKGTSRVNWVASAVHVLVIAFVIVAGFLHAKTSNLTPFMPHGVPGVFRAAAIVYFAYGGFDNIATMAEETKNPSRDIPLGLLGSMSVITAIYCVMALVLSMMQPYTAIDRSAAYSVAFSNVGMRWAQYVVALGALKGMTTVLLVGALGQARYTTHIARSHIIPPVFALVHPRTGTPVHATVLIAAAGACIGLFSSLDVLSSLLSVSTLFIFMMMATALLVRRYYVRGVTSRTHARRLVALLSVVIGSSAGIAAYWGAAPERWVGYTVLVPAWAAGTLGIQLLVPAARAPKVWGVPLVPWLPSLSIATNLFLMGSLGAQAFIRFGVCTAIMLLYYVLVGLHATYDVAHGACSGDDVDEEVYADAAHVDDAKAAAAVAANADVERAGAKI

SEQ ID NO: 76916 - protein, 692 aa, Clostridium perfringens ATCC 13124
MIGKILGNRYELLQCVGEGGMSFVYKARCRKLNRFVAVKILKDEFKNNEEIVRRFKKEATAIANLSNPNVVNVLDVGTQDDINYIVMEYVEGKTLKDIIKEKGALPYEVAISIGIKVAKALECAHKSGIIHRDVKPQNILVTEEGVVKVTDFGIAKSMDSSTIAHTNSVMGSAHYFSPEQAKGTYTDYRTDLYSLGIVLYEMVTGVVPFNGDSPVTVAVKHIQEKAIPPKNINQNIPNSLNDLIMKAMEKDPVNRYQTAKEIIGDLEKIKKDPNVTISSKSAEDEDQFTRVMSPVVVPNTETNNSEPDEDDEDDDEYYEDDEDEDEEENNIQTKPQKAINKKKKKSPILIIIATILVVALGITLGFLGMKKFMEGGKDVKIPNVVGEKVEDAKSKLEGLGLKVLEVTEESDQEKGIVLKVDPNVDSTVKTGSEVKLTVSGGEGQIKVPNLADMSSDEVRRTLKSLGLELVEDEKYSDKVPSGKVISQSPNANELVDKGSKVKVVFSKGKEIKKVSVPSLVNMNIDSVKNNLNDIGLKLGEVKYEYSDSVQQGQVISQSPNANEPVDEGSKVSITISKGKEIKTTTLNIPDVSGKSVDEAKSILANAGVEANAVKGEAAKSEEEAGKVYSQSQSGSITLKEGEKITITINYYGDYIKPVQPSQSDKTNQSEQQTQSPDQSTEKPKDPAHPGNN

SEQ ID NO: 76917 - protein, 395 aa, marine gamma proteobacterium HTCC2143
MFSQLKQQPADPILGLSVKFKADNNSNKIDLGAGIYKDEAGRTPVLASVKAAEQFRTDNETSKAYLGSAGSMLFNEKIQALNLGEHKVIGDNRIRTISTPGGTGALRIAAEFINRCTPGATIWVSNPTWANHQGVFTAAGLNVKTYPYYDYDNKCIDFAGMVEALKEVSKDDAVLLHACCHNPSGMDLSNSQWREIAELSKKIGFMPVVDMAYQGFGQGLDEDAYGLRLMADTVDEMIICSSCSKNFGLYRERIGACSIIGKSAAAADIINSALLPIVRVNYSMPPAHGAAIVETILSSEELTSQWHGELNEMRSRIGGMRRLLVDKLVAKGVTRDFSFITQQNGMFSFLGIDKDQVQRLQDEFSIYIVGSSRISVAAVSYDNVDYLTESIAKVL

SEQ ID NO: 76918 - protein, 499 aa, Rhodobacter sphaeroides 2.4.1
MEELSHWIDGKRVKGTSGRFADVFNPATGEVQARVPLASKAELDAAVASAAAAQPKWAATNPQRRARVMMEVVRLLNRDMDKLAEALSREHGKTIPDAKGDVQRGLEVIEFCIGAPHLLKGEFTDSAGPGIDMYSMRQPLGVAAGITPFNFPAMIPLWKMGPALAAGNAFILKPSERDPSVPLMLAEIFQEAGLPDGVLQVVNGDKESVDAILDNPTIAAVGFVGSTPIAEYIYSRGCANGKRVQCFGGAKNHMIIMPDADLDQAADALVGAGYGAAGERCMAISVAVPVGDETADALIERLIPRIEKLKVGPYTAGNDVDYGPVVTAAARENILRLVQSGVDQGAKLVVDGRNFSLQGYEKGFFVGPHLFDHVRPDMDIYRKEIFGPVLSTVRAASYEEALSLAMDHEYGNGTAIYTRDGDAARDFAARVNVGMIGINVPIPVPLAYHTFGGWKKSAFGDLNQHGPDSFRFYTRTKTITSRWPSGIKEGSAFNFKAMD

SEQ ID NO: 76919 - protein, 354 aa, Panax ginseng
MASTLTSLSSLFFFFSSLSLLLYHLHVSEAQTPPIVKGLSLAFFDSTCPKLESIVRKQLEKEFKADIGQAAGLLRLHFHDCFVQGCDASVLLDGSASGPSEKNAPPNLSLRAKAFTIIEDLRRQVHKQCGKIVSCADITALAARDAVVLSGGPNYQVPYGRRDGLQFATRQATLANLPPPFANTTTILNSLVTKNFDPTDVVALSGAHTIGLSHCSSFIRRLFPTQDSTMAQSFAKDLRITCPTNTTDNTTNLDFRTPNVFDNKYYVDLVNRQGLFTSDQDLFTDNRTRGIVTSFANNQTLFFEKFVNAMLKMGQLSVLTGTQGEIRGNCSVKNSNNLFLSTVVEEGMENLLGF

SEQ ID NO: 76920 - protein, 468 aa, Rhodobacter sphaeroides 2.4.1
MEARMPAKSFDMIVIGAGPGGYVCAIRGAQLGLNVAIVERENLGGICLNWGCIPTKAMLRSAEVYHLMHRAKEFGLKAEGIGYDLGAVVKRSRGVAKQLSSGVAHLMKKNRITVVMGDATLAGKGRVSVRTDKGTEELEAKSIVLATGARARELPGLEADGDLVWTYRHALEPKRMPKKLLVIGSGAIGIEFASFFNTLGADTTVVEVMERILPVEDAEVSAFAKKQFVKQGMKILEKATVKKLDRAGGKVTAHVETGGKTETMEFDTVISAVGIVGNVEGLGLEAAGVTVDRSHVVTDEYCRTGVEGLYAIGDIAGAPWLAHKASHEGVMVAELIAGGHPHPIKPGSIAGCTYCQPQVASVGLTEAKAKEKGYEIRVGRFPFIGNGKAIALGEAEGFVKTVFDAKTGELLGAHMVGAEVTELIQGYVVGRALETTEAELMETVFPHPTLSEMMHESVLDAYGRAIHF

SEQ ID NO: 76921 - protein, 454 aa, Saccharomyces cerevisiae
MSEPEFQQAYEEVVSSLEDSTLFEQHPEYRKVLPIVSVPERIIQFRVTWENDKGEQEVAQGYRVQYNSAKGPYKGGLRFHPSGNLSILKFLGFEQIFKNSLTGLDMGGGKGGLCVDLKGRSNNEIRRICYAFMRELSRHIGQDTDVPAGDIGVGGREIGYLFGAYRSYKNSWEGVLTGKGLNWGGSLIRPEATGYGLLYYTQAMIDYATNGKESFEGKRVTISGSGNVAQYAALKVIELGGTVVSLSDSKGCIILETGITSEQVAVISSAKVNFKSLEQIVNEYSTFSENKVQYIAGARPWTHVQKVDIALPCATQNEVSGEEAKALVAQGVKFIAEGSNMGSTPEAIAVFETARSTATGPSEAVWYGPPKAANLGGVAVSGLEMAQNSQRITWTSERVDQELKRIMINCFNECIDYAKKYTKDGKVLPSLVKGANIASFIKVSDAMFDQGDVF

SEQ ID NO: 76922 - protein, 453 aa, Saccharomyces cerevisiae
MSEPEFQQAYEEVVSSLEDSTLFEQHPEYRKVLPIVSVPERIIQFRVTWENDKGEQEVAQGYRVQYNSAKGPYKGGLRFHPSVNLSILKFLGFEQIFKNSLTGLDMGGGKGGLCVDLKGRSNNEIRRICYAFMRELSRHIGQDTDVPAGDIGVGGREIGYLFGAYRSYKNSWEGVLTGKGLNWGGSLIRPEATGYGLVYYTQAMIDYATNGKESFEGKRVTISGSGNVAQYAALKVIELGGTVVSLSDSKGCIISETGITSEQVADISSAKVNFKSLEQIVNEYSTFSENKVQYIAGARPWTHVQKVDIALPCATQNEVSGEEAKALVAQGVKFIAEGSNMGSTPEAIAVFETARSTPLDQATVWYGPPKAANLGGVAVSGLEMAQNSQRITWTSERVDQELKRIMINCFNECIDYAKKYTKDGKVLPSLVKGANIASFIKVSDAMFDQGDVF

SEQ ID NO: 76923 - protein, 404 aa, Buchnera aphidicola str. Sg (Schizaphis graminum)
MKNPIYLDYAATTPVEFKVAKKMMNYLTIDGIFGNPASRSHKFGWEAEEVIDIARNEISELIGSDSREIVFTSGATEANNLAIKGIAFFHRKKGNHIITSKTEHKSVLDACRYLESVGFSVTYLTPKNNGIIDLNDLKKNINKNTILVSIMHVNNETGIIQDITNISKICRSHDIFFHVDATQSVGKIAINLKNLFVDLMSFSAHKIYGPKGIGGLYVRRKPRVRLSALSHGGGHERGMRAGTLPVHQIVGMGESFKLARKKINDDFIHLTNLRNDLWNGIKNIEEVYLNSDLKQGAPHILNVSFNYIEGESLIMALKDLAISSGSACTSSSLEPSYVLRALGIKDELAHSSIRFSIGRFTTKEEIQHTVKSVHKSIHRLRALSPLWEMFKSGVDLNSIEWDHT

SEQ ID NO: 76924 - protein, 128 aa, Buchnera aphidicola str. Sg (Schizaphis graminum)
MAYSKKVMDHYENPRNVGSFSNSDSNVGSGLVGAPACGDVMKLQIKVNEQGIIEDACFKTYGCGSAIASSSLVTEWIKGKSITEAEAIKNTSIVEELELPPVKIHCSILAEDAIKAAISDYKSKKNKN

SEQ ID NO: 76925 - protein, 119 aa, Streptococcus pyogenes
MDKITLEGCRFYGYHGAFQEEQTLGQIFLVDLDLSVDLQAASLSDELADTVHYGMVFESVRQLVEGETFTLIERLAGAICEKLFNEFSRIEAIKVAIKKENPPIAGHYKAVGIELERQR

SEQ ID NO: 76926 - protein, 83 aa, Thiomicrospira crunogena XCL-2
MPKITVLGQGECEFDGQFSLLDALDEAGFDMPYSCRGGNCGACEVRLLSGEIEHIQDTVYETEGKDILTCSVIPLTDIEIELI

SEQ ID NO: 76927 - protein, 397 aa, Oryza sativa Japonica Group
MAKLQAGYLFPEIARRRAAHLLKFPDAKIISLGIGDTTEPIPDVITNAMAKRAHALSTVDGYSGYGAEQGEKKLRAAIAATYYADLGIEETDIFVSDGAKCDISRLQVLFGSNVKIAVQDPSYPAYVDSSVIMGQTGLYQEDVQKYGNIEYMKCSPENGFFPDLSSVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNISQAGGLGCLSPEGLKAMSDVVGFYKENTKIIVDTFTSLGFNVYGAKNAPYVWVHFPGRNSWDVFAEILEKAHVVTTPGSGFGPGGEGFVRVSAFGHRENIIEAARRLKQLYK

SEQ ID NO: 76928 - protein, 256 aa, Zea mays
MGSTAAASVLPVSAGSGENLVLILDYGSQYTHLITRRVRQLGVLSLCVSGTAPLASLEGLRPRAVILSGGPHSVHAPGAPAFPEGFLGFAAAAGAHVLGVCYGMQLLAQSLGGAVVSGERQEYGKMDVEVTAASSALYGQAETGKRQTVWMSHGDEVVRLPEGFEVVARSVQGAVAAIENRENRFYGLQYHPEVTHSAQGMETLRRFLFDVCGIKADWKMQDVLDEEIKTIQSTVGPDEHVICALSGGGDSTVAAT

SEQ ID NO: 76929 - protein, 501 aa, Escherichia coli K12
METKDLIVIGGGINGAGIAADAAGRGLSVLMLEAQDLACATSSASSKLIHGGLRYLEHYEFRLVSEALAEREVLLKMAPHIAFPMRFRLPHRPHLRPAWMIRIGLFMYDHLGKRTSLPGSTGLRFGANSVLKPEIKRGFEYSDCWVDDARLVLANAQMVVRKGGEVLTRTRATSARRENGLWIVEAEDIDTGKKYSWQARGLVNATGPWVKQFFDDGMHLPSPYGIRLIKGSHIVVPRVHTQKQAYILQNEDKRIVFVIPWMDEFSIIGTTDVEYKGDPKAVKIEESEINYLLNVYNTHFKKQLSRDDIVWTYSGVRPLCDDESDSPQAITRDYTLDIHDENGKAPLLSVFGGKLTTYRKLAEHALEKLTPYYQGIGPAWTKESVLPGGAIEGDRDDYAARLRRRYPFLTESLARHYARTYGSNSELLLGNAGTVSDLGEDFGHEFYEAELKYLVDHEWVRRADDALWRRTKQGMWLNADQQSRVSQWLVEYTQQRLSLAS

SEQ ID NO: 76930 - protein, 473 aa, Pseudomonas syringae pv. syringae B728a
MSSSSTSAAAGQQGRQRAASNRLIFISVLVATMGALAFGYDTGIIAGALPFMTLPADQGGLGLDAYSEGMVTASLIVGAAFGSLASGYISDRFGRRLTLRLLSVLFIAGALGTAIAPSIPFMIAARFVLGIAVGGGSATVPVFIAEIAGPSRRARLVSRNELMIVSGQLLAYVLSAVMAALLHTPGIWRYMLAVAMVPGVLLLVGTFFVPASPRWLASKGRFDEAQDVLEQLRPSKQDAQREVDEMKAQDEEARHRPKARELLRQRWVIKLLLIGVGLGFTAQFTGVNAFMYYTPIILKNTGMGTNAALTATIGNGVVSVIATLLGIWAIGRYGRRHLLMTGLVIVILMQAALGCVLQFMPQNMTQSYTALACILVFLLFMQMCISPVYWLLMSELFPMQVRGLLTGTAVSMQWLFNASVAFTFPIAVDTIGNPTFFIFAAINIGSLIFVFLCLPETKGKSLEQIEKHLKKEL

SEQ ID NO: 76931 - protein, 287 aa, Schizosaccharomyces pombe 972h-
MEKLLAFSTQLQAQGNSSNSPPDPKDLDPSVLDHIFGANPADEMRKAMDAIEDPSVPLDQKEIAFDNLEMLVEHIDNANNLVPLQLWPRLLKQLESPESTLRRLAAWTIATAVQNNPKSQQALIENDGLKILFGALKKEDSDETKNKVLYAITSELKLNEAGIALLDKIPNSWEMLIEILELKHSVMTKRVIFFFYALLIQEDKSKQIILQKAHEFQIPEKVYQFSLEHSVDEDCVTKSLHTLYLFQKNKVSVANTNELLKSLVQFKSEFPEIFTVDEWKAFHEALE

SEQ ID NO: 76932 - protein, 346 aa, Oryza sativa Japonica Group
MQTYSIMLGRNSKKSTVDVDLSSLGGGMNISRHHARIFYDFQRRRFALDVIGKNGCLVEGVLHLPGNHPVKLDSQDLLQIGDKKFYFLLPTRSIFASAAAARHPPIIPQQMPPPSYVRTGRPRLSEFHDRSFEGDYGREGDEIGNGISESGGMRGKLIKRNKKLSAESEMYGGHRINVEAIGTLGEGDSRSEIRSRGDRDMDNQHILQAEEKDVVSSVATVLSDLCGPGEWMPMAKLHTELLEQFGNVWHHSRVRKYLSPEDWSPTETKGQMGNRWEPASDELRESWPVGAKFFWNLSVLYSIDGWIIHLDFSRNQTFGSKVYRSSEFGSTLHQLWSALESGLIGL

SEQ ID NO: 76933 - protein, 197 aa, Kluyveromyces lactis NRRL Y-1140
MVAQVQKPAPEFKKTAVIDGVFDEVSLEKYKGKYVVLAFIPLAFTFVCPTEIIAFSEAAKKFEAIGAQVLFASTDSEYSLLAWTNVARKDGGLGPVDIPLIADTNHSLSRDYGVLIEEEGVALRGLFLIDPKGVVRHITINDLPVGRNVEEALRLVEGFQWTDKNGTVLPCNWTPGAATIKPEVDASKEYFSSVNKD

SEQ ID NO: 76934 - protein, 223 aa, Oryza sativa Japonica Group
MARFEVYENNGGTCVAVAGADYCVVAADTRLSVGYSILSRDSSKIAHLADKCVLASSGFQGDVKALQRNLTAKELLYEHNHNKKMSCPAMAQLLSNTLYYKRFFPYYAFNVLGGLDSEVAAHQYERMITTCENIFSSFAGYSAQGTGAALMMPVLDNQLKSPSPLLLPARDAVTPLSQSDAVDLVKDVFASATERDIYTGDKLEIVVINSAGSHREFIELRKD

SEQ ID NO: 76935 - protein, 214 aa, Flavobacteria bacterium BBFL7
MNSDAPLLNIESTQKKVPVTVYAEATPNPSVMKFVANKKLVVNSTEFKSIADTADNTLARQLYNFPFVKEIYADENYVSIQKHDIASWDEVTFEIRSFIKEAIENGAEIGSSKHEAGTVKKEGENIELPKFENLDDVSKKVVEILDEYIKPAVASDGGNIVFDSYDENTKEVKVILQGACSGCPSSTMTLKSGIETMLRDMLPGKVDRVMAING

SEQ ID NO: 76936 - protein, 355 aa, Blumeria graminis
MSTRAPNATTGSRKISFNVSEQYDIQDVVGEGAYGVVCSALHKPTGQKVAIKKITPFDHSMFCLRTLREMKLLRYFNHENIISILDIQKPRSFDSFTEVYLIQELMETDMHRVIRTQDLSDDHCQYFIYQTLRALKAMHSANVLHRDLKPSNLLINANCDLKVCDFGLARSAASQEDCSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPFKQMFPKTSDLALDLLEKLLAFNPVKRITVDEALQHPYLEPYHDPEDEPTADPIPEEFFDFDKNKDNLSKEQLKELIFQEIMR

SEQ ID NO: 76937 - protein, 127 aa, Schizosaccharomyces pombe 972h-
MEDENILRNAVNLQVLKFHYPEIESIIDIASHVAVYQFDVGSQKWLKTSIEGTFFLVKDQRARVGYVILNRNSPENLYLFINHPSNVHLVDRYLIHRTENQHVVGLWMFDPNDMSRIFNIVKESLLR

SEQ ID NO: 76938 - protein, 507 aa, Streptomyces avermitilis MA-4680
MTRFAAPGTDGAIVSYQARYDHFIGGEYVPPARGQYFENPSPVNGQPFTEIARGTAEDVERALDAAHAVAPAWGRTSVAERSDILRRIADRMEANLEKLAVAESWENGKPVRETLAADIPLAIDHFRYFAGAIRAQEGSLGEVDDDTVAYHFHEPLGVVAQIIPWNFPILMATWKLAPALAAGNAVVLKPAEQTPASIHYWLSLVADLLPPGVLNIVNGFGVEAGKPLASSPRVAKVAFTGETTTGRLIMQYASENITPVTLELGGKSPNIFFDDVWSANDDFRDKALEGFTMFALNQGEVCTCPSRALVQRGQYAEFMEAAVARTELIKTGHPLDTDTMIGAQASNDQLEKILSYLDIGRQEGAKILTGGERIEHDGELKGGYYVQPTIFEGDNRMRIFQEEIFGPVVSVTSFNDFDDAIKIANDTLYGLGAGVWTRDINTAYRAGRAIQAGRVWTNCYHAYPAHAAFGGYKGSGIGRETHKMMLDHYQQTKNLLVSYSPKKLGFF

SEQ ID NO: 76939 - protein, 412 aa, Ustilago maydis 521
MYQPQGDYPSRSPPPLQHPIPTHPPFKVPDPPISPNPVPQASVTDPHVSAANRRGGPAANLQASAGGGYQRFASPPIQSPPTQPYAAASSSSYGQPGAAPTQNYFTSAAGGNVAGQQQGWGGFGGFSGAGGVPIMNDATAQMGVQFGQHMAAVGGEYVQKNFNALLPMPVLKHYFNVSNSYVLHKLRIVLFPWRHKPWSRAHRHSAAVGGVGSAYAETPSGIKTASSGAEGFLPPRDDVNSPDLYIPTMAFVTYIIVTSVILGLESRFHPEVLGLRASRALAIILVELAAIKFGTYILNIQGDHTMMDLLAYSGYKFVGTLITLLVGLLKVRGLVYWSVFLYCFAANAFFLLRSLRYVVLPDPSSPSSQTITHAQRSRRIQFLFCIAVVQIVFGWALIIGIFKDAPVSKKVV

SEQ ID NO: 76940 - protein, 209 aa, Zea mays
SHSRSRSRSRSPQRRDRLRSERAPRHSRSRSRSRSPYRRRERRGYKDLVCKNCRRPGHFAKECPSAPTCNNCNLPGHFAAECTSKTVCWNCKEPGHIASHIAVDCTNERACNNCRQPGHIARECKNDPVCNLCNVSGHVARVCPKTTLASEIHIQGGPFRDILCRICGQPGHISRNCMATVICDTCGGRGHMSYECPSARIFDRGFRRF

SEQ ID NO: 76941 - protein, 134 aa, Glycine max
  misc_feature (40)..(40): Xaa can be any naturally occurring amino acid
  misc_feature (46)..(46): Xaa can be any naturally occurring amino acid
LWEVPPLAALSSICTPCVRSRAWSSQPPCGGYYSCPASRXPVVVTXPSCIVYPGTSIIGGSPPSPIIDPGAPGTPFMPAPFPSITGTCDYWRNRPTLIWGLLGWWGAVGGAFGTVSIRSSIPGFDPRMNLLQAI

SEQ ID NO: 76942 - protein, 179 aa, Triticum aestivum
  misc_feature (9)..(9): Xaa can be any naturally occurring amino acid
  misc_feature (42)..(42): Xaa can be any naturally occurring amino acid
  misc_feature (120)..(120): Xaa can be any naturally occurring amino acid
  misc_feature (141)..(141): Xaa can be any naturally occurring amino acid
MAPTVMASXSSPPCAPFQGLNSTVGLPVCRRSKGAGLGSVSXNGGRIRCMQVWPIEGIKKFETLSYLPPLSTEALLKQVDYLIRSKWVPCLEFSKVGFIFREHNASPGYYDGRYWTMWKXLPMFGCTDATQVINEVEEVKXKEYPDAYVRIIGFDNMRQVQCVSFIAFKPPGCEESGQA

SEQ ID NO: 76943 - protein, 328 aa, Glycine max
  misc_feature (94)..(94): Xaa can be any naturally occurring amino acid
MKEADEQLCEAAIKGDTKKVRSLIYSGADVTHFDGDGLNPLMHAAKHGHAPVLTLLLSVGAPWNALSPSNLSAGDYAMQEGHNETFELLLNAGXQSELILGTIARKANKNGDSGHDYLEDRVSFSEDKLMDSESKAVMMAWENPLMEAHAKAVCSGGGHVLNIGFGMGLVDSAIQRYAPASHTIVEAHPEVYERMLRSGWGQKENVKIVFGRWQDVLPQLETYDGIFFDTYGEYYEDLREFHQHLPALLKTGGIYSFFNGLCGSNAFFHVVYCHLVSLELENLGYSTQLIPLPVKDCLGEQVWEGVKQRYWQLDTYYLPVCQAIENPE

SEQ ID NO: 76944 - protein, 119 aa, Streptococcus pyogenes
MDKITLEGCRFYGYHGAFQEEQTLGQIFLVDLELAVDLQAASLSDELADTVHYGMVFESVRQLVEGETFTLIERLAGAICEKLFNEFSRIEAIKVAIKKENPPIAGHYKAVGIELERQR

SEQ ID NO: 76945 - protein, 486 aa, Synechococcus sp. CC9605
MAATPLIPVILCGGTGTRLWPLSRASYPKQYWPLSGDGEATLLQQTQQRLTGLEALAAPLLICNEDHRFIVAEQMRQIGVEPNAILLEPMGRNTAPAVTVAALQATANGEDPLLLVLAADHLIRDGAQFRQAINAGRKPAEVGRLVTFGIVPTAPETGYGYIEASEPFSLGEPAHVPIKRFVEKPDQATAEQFLATGRFTWNSGMFLFRASAMLAELERLAPEVVSCCRAALEQDTADLEFHRLEREAFAKCPNVAIDVAVMEKTELGSVLPLDAGWSDVGSWSALWDTSEQKDSQGNVLQGHVIAEDSHDCYLRSEHRLVVGLGVENLVVVETDDAVLIADRSKAQEIKTVVKQLEAEGSPEGKAHRKIYRPWGHYTGVVEDSRWQVKRISVKPGASLSLQMHHHRAEHWVVVKGTALVERDGEEQLVGENQSTYIPMGCKHRLSNPGRIPVELIEIQSGTYLGEDDIVRFQDRYGRSDMSISAS

SEQ ID NO: 76946 - protein, 742 aa, Aspergillus oryzae
MEQMAGPRPPDVSIGYRLLVGTTVTFVCAFIVVSLRGVARSLYARMSWDDYLTIFALVQALIATIFDCIAVDKGLGCHLIYIPKNDAVTAMYYDLLSQVFCINALSFAKISICLSYLRILKGSRHTVLRVICYLTAFLVFVVNTVVTISFAGLMGLGVITGVFATIRTIESGLGLKNGISDASYTTVMGLMWAGMERNIAMMIGSVPALRPLTTPFMKLTSETMSYLGIRSSSKTQSSSGVNGSGSFPNRSGNKSTKHLPTTSMVMVAMSEKQTRCVNLPDTYETSLPEARARASKDYRQHVSGYNWRLPCMTNVDGLLSTRGGLNVTQVLGRIPSHVLNPALHRDEIDLSMAENQLAKVAIETILYYEGFFGDATLLDLLASTVNTHFRSHSQVAADNIAVTAGAAAGLDAILYNICNPGDGVLVPCPYWNGYDALFALHSGVRPVGVVVPSLEDSFGPALLSALEESYEKASCPIRALVLANPHNPLGRPYSRLILEQCMAFCQRRNIHLVSDEAFAFSSFTSPDFTNPEPFISCLSIDPSRVGCDPQRIHVVWSMSKDLSASGVRLVRSQLPLFLLPWINSRVLTKGCVITRNRPLRDVVGLVASVHVSVLSTVFAKEVLASPQLPKLLTLSATRLAKAYSTLTTAFKATGIEYFPSYATVFVLARLAPNATAWDEEMLALRAYMQAGVAVAPGRAYHMAERQKGWMRVTFAVSNEDLSEGIRRTKTVYVSLLAGGVIL

SEQ ID NO: 76947 - protein, 383 aa, Rhodobacter sphaeroides 2.4.1
MRVSRRGAVDPFIVMDVMEQARRLEATGRAIVHMEVGQPGTPAPAGARAALARAMEEGPLGYTVALGLPELRQGIADLYRRWYGVELDPGRVVVTAGSSSAFLLAFTALFEAGERVALGEPGYPSYRQILRALSLEPVGIPTEARNRLQPVPADLEGVEDLAGLIVASPGNPSGTMLSKEALDALIAHAQARDMAFISDEIYHGLDYGTRSVSALEITDDVYVINSFSKYFSMTGWRLGWLVVPEDHVRRVERLAQNMFICPPHASQIAALAALDCTQELEANRAVYAENRRLMLEGLPKAGFTRFAPPDGAFYVYADVSDLTSDSLAFAAEILEEAGVAVTPGLDFDPLRGGRTLRFSYARATEDIVEGLARLEAFMAARRR

SEQ ID NO: 76948 - protein, 281 aa, Oryza sativa Japonica Group
MRKRERENPCGICGHYHKYELGEVCGVCGHRPPASAGAQAAAGAAQAAAPRQDSAFPSEILKDFLFLGSYDNASRSELLKTIGISHILNTVPLCQNLYRNSFTYHCLQDEKTLQFDDAIQFLEQCERDKARVLVHCMSGKSRSAAFVIAFLMKTKGWRLSQCFQWVKERRPQVQLADAAQRQLIEYEQKLFNSTVGIPAQAFVPTDAFPSLGFGFPKPSGDIQVPIFNQQAPASIFERVSPHNIPSNFTFGAERTTEVKLPDNNSFGVVNSSGGDSMMDSS

SEQ ID NO: 76949 - protein, 168 aa, Brassica napus
MTSSNQSPSHNVFVYGSFQEPSVVNLILECDPVTISAQLQGCHLYRLKGRLHPCISPSENGLINGKILTGLTDAQLENLDMIEGDEYVRKTVEVVLTETSEKMQVETFVWANKDDPHLYGEWDFEEWKKVHMEKFIEASKKFIEWKKNPEGRSREEFVKFVEEDLTAA

SEQ ID NO: 76950 - protein, 570 aa, Aspergillus oryzae
MESATLSNLINKTNMNSTTPPLLSPSDTALLEAFIPGYSFISRFLISYLQIDLSLYLPYILTYIAIAAVLKYSFSKLKGVLETHCIATAEIRLDDEISNYLLYWMAQQPFANRSTRFVAATRISTQSYYYDSEDEDEWGEEDEYDEDGNVINNFDEYWARTRNRDKFKRLRFTPAEGTHYFFFRGQLLAFVRAKGDKKSSSSSRWGARFETEKLYLSCFGRDPAILKELLAEAQRVYVARDGNSTIIYRAQRSPGDYVDWSRCMARSPRPLSTVILDQAQKDAFLDDIKEYLHPRTRRWYSNRGIPYRRGYLLHGPPGTGKTSLCFAVAGLMGLPLYLLNLSSKSFNEDDLMSLFQELPRRCIVLLEDVDCAGITQKRVSDGGEDSTAKPAEGKEGDSPEDADADSSKQGISLSGLLNVIDGVAASEGRILVMTTNHPEKLDPALLRPGRVDMSIQFGYAEPGDIKELFSAIYSTLEGDVRSSRTKRPRGKKDQVTSEVPWHQFSREQIQNLADQFLALVPGGQCTAAEIQGYLLNYKRDPEAAIEGVEEWVRSIRSKREGQTEATVKAD

SEQ ID NO: 76951 - protein, 132 aa, Schizosaccharomyces pombe 972h-
MHALIIINRAGSLIFQREFGSSPTALTPNEYLVLAGTIHGVHAISTQISPLPGSSGIQLLEAGTFNMHILQTHTGMKFVLFTEKKTTNARLQLQKFYELYSDYVLKNPFYTLEMPIKCQLFDEQLKRYIDSH

SEQ ID NO: 76952 - protein, 247 aa, Streptococcus gordonii
QVAQTLDHKVKVMHASKGLEPDSHERISTILEEEIPSELRSEIVVVSGPSHAEETIVRDITLITAASKDLEAAKYVQKLFSNHYFRLYTNTDVVGVETAGALKNIIAVGAGALHGLGYGDNAKAAIITRGLAEITRLGVKLGASPLTYSGLSGVGDLIVTGTSIHSRNWRAGDALGRGEKLADIEANMGMVIEGISTTKAAYELAQELDVYMPITQAIYKVIYQDHDIKEAIFEIMNNEFKAENEWS

SEQ ID NO: 76953 - protein, 313 aa, Streptococcus gordonii
MVITKSASRRDLLMSKVKKAVIPAAGLGTRFLPATKALAKEMLPIVDKPTIQFIVEEALKSGIEDILVVTGKSKRSIEDHFDSNFELEYNLKEKGKDDLLKLVDETTGIGLHFIRQSHPRGLGDAVLQAKAFVGNEPFVVMLGDDLMDITNDKAMPLTKQLMNDYEATHASTIAVMQVPHEEVSSYGVIAPQGEGLNGLYSVEKFVEKPSPEEAPSDLAIIGRYLLTPEIFKILENQAPGAGNEIQLTDAIDTLNKTQRVFAREFKGDRYDVGDKFGFMKTSIDYALKHPQVKDDLEQYIIELGKKLEEKTKK

SEQ ID NO: 76954 - protein, 476 aa, Gluconobacter oxydans 621H
MTSSSHYRRTRIVATLGPASSSPEMILSLAQAGVNVFRLNFSHGAHEDHGERHAAIRAAEEKIGHPLAILADLQGPKLRVGVFENGPIILEEGKPFRLDLDRTPGTVSRVCLPHPEIISAAKPGSHLLLDDGKLKLRVVKTGEGFLETVVVVGGKLSERKGVNVPDVTLPIPALTEKDRRDFDFALSLGVDFVALSFVQRPEDVQEAREIAAGRAAIVTKLEKPQAMDDLAAIVHLSDAIMVARGDLGVELPPEEVPVAQKRAIAEARKQCRPVIVATQMLESMIESPTPTRAEVSDVSNAVYDGADAVMLSAESAAGKYPVEAVSMMVRIAERVEQDTEWRLRMDRLRPAPDETVQSAIVQAAWQVSRTLHAGAIACRTRSGAGAMRLSRERPHCPIIALTPELWVARRLCVVWGVFPHLINSEQSTQGIEPLAGPVAELARNMGFCKTGDRVLILAGLPSGHSGSTNTLRVITA

SEQ ID NO: 76955 - protein, 292 aa, Vibrio brasiliensis
GRFVFRAAQERADIEVVGINDLIDVDYMAYMLKYDSTHGRFNGTVEVEGGNLIVNGKTVRVTAERNPEDLKWDEIGVDVVAEATGLFLTDETARKHITAGAKKVVLTGPSKDATPMFVMGVNHSTYEGQDIVSNASCTTNCLAPVAKVLNDKFGIVSGLMTTVHATTATQKTVDGPSAKDWRGGRGASQNIIPSSTGAAKAVGVVLPELNGKLTGMAFRVPTANVSVVDLTVNLEKGASYEAICAAMKEASEGELKGVLGYTEDQVVSQDFIGEVQTSVFDAKAGIALTDNF

SEQ ID NO: 76956 - protein, 400 aa, delta proteobacterium MLMS-1
MQLKNPADCAAIIAAGGSGSRMGGGVPKQFLELAGVPLLIHGLRAFAAVPEIGTLVVSSRADYLAYTRELAAHHGFTELLVVAGGDSRQQSVMNGLAAITDSGRQCRLVAVHDGARPLVSPELIRRCLQAAGRHGAAIAATEVQDTLKQSGKPPLIDATVDRAGLWQAQTPQVAESGLLRRALEQARAAGFTGTDEASLLERLGVPVALVEAGAGNLKITRPHDLPLAEALMSKQAPSPTAATRIGHGYDVHRLVPERKLILAGVEIPHQLGLLGHSDADVATHALCDAILGALGNGDIGRHFPDDDPRYQGISSLKLLEAVIAQAAAAGWRINNADLTIIAQQPKLAPHLPAMVRQLAAACQVSPERLNIKATTTEGLGFAGRQEGIAATAVVLLAPLP

SEQ ID NO: 76957 - protein, 430 aa, Staphylococcus aureus
MAFEFRLPDIGEGIHEGEIVKWFVKAGDTIEEDDVLAEVQNDKSVVEIPSPVSGTVEEVMVEEGTVAVVGDVIVKIDAPDAEDMQFKGHDDDSSSKEEPAKEEAPAEQAPVATQTEEVDENRTVKAMPSVRKYAREKGVNIKAVSGSGKNGRITKEDVDAYLNGGAPTASNESADSATNEEVAETPAAPAAVSLEGDFPETTEKIPAMRRAIAKAMVNSKHTAPHVTLMDEIDVQALWDHRKKFKEIAAEQGTKLTFLPYVVKALVSALKKYPALNTSFNEEAGEIVHKHYWNIGIAADTDRGLLVPVVKHADRKSIFQISDEINELAVKARDGKLTADEMKGATCTISNIGSAGGQWFTPVINHPEVAILGIGRIAQKPIVKDGEIVAAPVLALSLSFDHRQIDGATGQNAMNHIKRLLNNPELLLMEG

SEQ ID NO: 76958 - protein, 451 aa, Pseudomonas aeruginosa PAO1
MNATALSPNPAPAISRRTMLIAFVFCFLGLLADGVDLMFLAYSLNSLKAEFGLSNFEAGSLGSLTLAGMAVGGIYGGWCCDRFGRVRVVTWTIVLFSIGTALLGLTQNYWQFALIRFVASLGLGSLFVACNILMSECVGTRYRTTILAAMQAGWTVGYLVATLLAGQIIPEFGWRTLFFTAVAPALVCLALRPWVPESPSWLAAQAGRQRPGAAPQSHAEAGGAGPLGRMLGDPETRGMFLLWSLTSCFLLFGYYGTNNWMPSYLESELGMNFKSMTGYMVGTYSAMILGKVAAGVCADLFGRRLTFAAGAIGSAAFMPLIVFYHSPSNILWILITFGFIYGVPVGVLATYMTESFSTRVRGSAVGTAYNLGRIGAAVAPAGIGLLATHVSIGAGFLVMGITYVLTGLIPALFIADRLYDPNRESRDAESASRRQAPGSAVDTAERRAAKA

SEQ ID NO: 76959 - protein, 291 aa, Vibrio campbellii
GRFVFRAAQERNDIEVVGINDLIDVDYMAYMLKYDSTHGRFNGTVEVEGGNLIVNGKTVRVTAERNPEDLKWDAIDVDVVAEATGLFLTDETARKHITAGAKKVVLTGPSKDATPMFVMGVNHATYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELAGVLGYTEDQVVSQDFIGEVQTSVFDAKAGIALTDN

SEQ ID NO: 76960 - protein, 235 aa, Triticum aestivum
MAPSQEVAPPAAAITKDPSTNGNGNGNGTAATAPKTKTPALNERILSSITRRSVAAHPWHDLEIGPDAPTIFNCVVEIPKGSKVKYELDKKTGLIKVDRVVYSSVVYPHNYGFIPRTLFDDSDPIDVLVIMQEPVVPGCFLRAKAIGLMPMIDQGEADDKIIAVCADDPEYRHFNDIKELPPHRLAEIRRFFKDYKKNENKEVAVNDFLPSEDAYEAIQHSMDLYATYIVEGLRR

SEQ ID NO: 76961 - protein, 289 aa, Vibrio harveyi
FGRIGRFVFRAAQERNDIEVVGINDLIDVDYMAYMLKYDSTHGRFNGTVEVEGGNLIVNGKTVRVTAERNPEDLKWDAIGVDVVAEATGLFLTDETARKHITAGAKKVVLTGPSKDATPMFVMGVNHATYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELAGVLGYTEDQVVSQDFIGEVQTSVFDAKAG

SEQ ID NO: 76962 - protein, 580 aa, Escherichia coli K12 [sequence omitted]

SEQ ID NO: 76963 - protein, 614 aa, Triticum aestivum
  misc_feature (330)..(330): Xaa can be any naturally occurring amino acid
  misc_feature (391)..(391): Xaa can be any naturally occurring amino acid
PGLHPSPLPFLAVTNGTGAVRSFSTTFVFAIFGPYTDLSSHGMAFFISASREVLSTALPGRYLGLLNSSNDGSRTARVFAVELDTILNPEFNDISGNHVGIDVDSLVSLDSTDAGYYDDGTGRFLNLSLISRTAMQVWVDYDSGATKITVTMAPLGVARPKKPLLQITVDLSGVVQSTAYVGFSSATGIMNARHFVLGWSFAMDGLAPALDISMLPALPQVWPNQRFMSVSVKMGLALASVTLVSVGIGIYIFVRWRRLKYSEVHEDWEIPFGPNRFSYKDLFHATGGFSDKNLLGRGGFGSVYKGVLRKPDMKVAVKRLSHNSRQGKKXEFIAEVVSIGRLRHRNIARLLGYCRRKGELLLVYEYMENGSLDKYLHNRNSSVLDWSHRYXIIRGVASSLLYLHEKWEQVVIHRDIKASNVLLDGKRNGRLGDFGPARIYDHETVAGATHVAGTIGYLAPELGRTGKPTAFTDVYAFGMFLLEVTCGRRPIFTSEQKNQVLLVDWVLEHHQNGSILDTVDPRLQGEFNREEVTIVLKLGLLCTYPLPDVRPIMRKVMHYLDHGQSPPDLSPAYITYMNLVKNEGLNSYNMNRPGLGPKMSVATISSATILQDGR

SEQ ID NO: 76964 - protein, 172 aa, Gerbera hybrid cultivar
MANPKVFFDMTVGGAPAGRIVMELYADTTPRTAENFRALCTGEKGKGSSGKPLHFKGSSFHRVIPNFMCQGGDFTRGNGTGGESIYGNKFADENFIKKHTGPGILSMANAGPNTNGSQFFICTAKTEWLDGKHVVFGKVIDGMDVVKAIEKVGSGSGTTSKPVVIADCGQLS

SEQ ID NO: 76965 - protein, 497 aa, Aspergillus oryzae
MADLFTTIETPSAKYEQPLGLFINNEFVKAKSGRTFETINPTNEKPIVAVQEADENDVEDAVKAARAAFEGEWSKVTPSERGRLLVKLADLFERDSDILAAIEALDNGKAFTMAKGDVAAAAGCLRYYGGWADKIHGQTIDTNPESLTYTRHEPIGVCGQIIPWNFPLLMWSWKIGPAIAAGNVVVLKTAEQTPLSGLYAAKLIKEAGFPAGVVNILSGFGRVAGAAISSHMDIDKIAFTGSTLVGRMILQAAAKSNLKKVTLELGGKSPNIVFDDADIDNAISWSNFGIFFNHGQCCCAGSRILVQEGIHDKFVARFKERAAANKLGNPFTADTFQGPQVSQLQFDRIMEYINHGKQEGATVATGGERHGTEGYFIQPTVFTDVHSDMKIAKEEIFGPVVTIQKFKDEEEAIKIGNSSSYGLAAAVHTKNVNTAIRVSNSLRAGTVWINCYNMINYQAPFGGFKESGLGRELGSYALENYTQVKTVHYRLGDALFA

SEQ ID NO: 76966 - protein, 186 aa, Triticum aestivum
PRVRGRGGEEKEQKEKELRAQIIAEAEEFKIAFNEKRIQTCETNKVHSREREKIFVESQEKFHASADKQYWKSISELIPHEIATIEKRGKKDKDKKPSIAVIQGPKPGKPTDLSRMRQVLVKLKHAPPPHMMQPPPAPAAKEGAKEGAKDGAPAPANGAKQPVESKEAPANGPAAETEKEQTAASE

SEQ ID NO: 76967 - protein, 387 aa, Agrobacterium tumefaciens str. C58
MPLITMSKRSAVEPFHAMDILAEANRRRQAGRPVISMAVGQPSHPAPKASLAAAQEALKHGRIGYTDALGLRELREAIAGHYRLRHQVAIDPARIAVTTGSSAAFNLAFLGLFDAGDHVAIARPGYPAYRNILKALGLNVVEVPVTAETGYTLTPASLERAETKAGCKLKGVLLASPANPTGTVTGREALKRLASYCESRDMAFISDEIYHGLTFVGEETSALEITDSAVVINSFSKYYCMTGWRIGWMVLPENLVRPVECLAQSLYISPPELSQLAATAAFSAAEELDVYRESYRTNRDFLMARLPEIGLPLASPMDGAFYAYVDTSRFSNDSMDFAKRMLAEIDVAATPGMDFDPEEGHRALRISYAGSVSDIAEAVGRIAGWLK

SEQ ID NO: 76968 - protein, 348 aa, Salmonella enterica subsp. enterica serovar Typhi str. CT18
MTAYEELRTKLVLAPKRWLITGVAGFIGSGLLEELLFLNQTVIGLDNFSTGYQHNLDDVRTSVSEEQWSRFIFIQGDIRKFTDCQKACKNVDYVLHQAALGSVPRSLKDPIATNSANIDGFLNMLTAARDAHVSSFTYAASSSTYGDHPDLPKIEERIGRPLSPYAVTKYVNELYADVFARSYEFNAIGLRYFNVFGRRQNPNGAYSAVIPRWILSLLKDEPIYINGDGSTSRDFCYIENVIQANLLSATTNDLASKNKVYNVAVGDRTSLNELYYLIRDGLNLWRNEQSRAEPIYKDFRDGDVKHSQADITKIKTFLSYEPEFDIKEGLKQTLKWYIDKHSTLYSSV

SEQ ID NO: 76969 - protein, 425 aa, Salmonella enterica subsp. enterica serovar Typhi str. CT18
MFGIDEVKIAIIGLGYVGLPLAVEFGKSRQVVGFDVNKKRILELKNGVDVNLETTEEELREARYLKFTSEIEKIKECNFYIITVPTPINTYKQPDLTPLIKASETVGTVLNRGDIVVYESTVYPGCTEEECVPILARMSGMTFNQDFYVGYSPERINPGDKKHRLTNIKKITSGSTAQIAELIDEVYQQIISAGTYKAESIKVAEAAKVIENTQRDLNIALVNELAIIFNRLNIDTEAVLRAAGSKWNFLPFRPGLVGGHCIGVDPYYLTHKSQGIGYYPEIILAGRRLNDNMGNYVSEQLIKAMIKKGINVEGSSVLILGFTFKENCPDIRNTRIIDVVKELGKYSCKVDIFDPWVDAEEVRREYGIIPVSEVKSSHYDAIIVAVGHQQFKQMGSEDIRGFGKDKHVLYDLKYVLPAEQSDVRL

SEQ ID NO: 76970 - protein, 488 aa, Bordetella pertussis Tohama I
MIGGKLVQSKTTQWRDVINPATQEVVAQVPFATREELDLAVANAKEAFKTWRNTGQGARMRVMLKLQQLLRDNTGKLAEMITREHGKTLPDAEGEVGRGLEVVEHACSIANLQLGEYAENAAGGIDVYTLIQPLGVCAGITAFNFPVMLPCFMFPIAVACGNTFVLKPSEQDPSSSLFLAQLALEAGLPPGVLNVVHGGPDIANGLCEHPDIKAVSFIGSTRVGTEIYNRASAAGKRCQSMMGAKNHCVILPDADPEVALNQLVGAAFGAAGQRCMATSVAVMVGEARNWLPDFVERARKLKVNNGVDREADLGPLVSPAAKQRVEGLIQKGVDEGAKLLLDGRSLKVAGFEQGNFVGPTIFDGVTENMTIYTEEVFGPVLCVVGVDTLEDAVEFINRNPNGNGVALFTQDGGAARYFQNNIDVGQVGINIPIPVPVAWFSFTGSRGSKLGDLGPNGKQAVQFWTQTKTVTARWSAHGRGVNTTISMK

SEQ ID NO: 76971 - protein, 447 aa, Staphylococcus aureus subsp. aureus MSSA476
MYMSKAHQLIQEDEHYFAKSGRIKYYPLVIDHGYGATLVDIEGKTYIDLLSSASSQNVGHAPREVTEAIKAQVDKFIHYTPAYMYHEPLVRLAKKLCEITPGDFEKRVTFDLTGSDANDGIIKFARAYTGRPYIISFTNAYHGSTFGSLSMSAISLNMRKHYGPLLNGFYHIPFPDKYRGMYEQPQANSVEEYLAPLKEMFAKYVPADEVACIVIETIQGDGGLLEPVPGYFEALEKICREHGILIAVDDIQQGFGRTGTWSSVSHFNFTPDLITFGKSLAGGMPMSAIVGRKEIMNCLEAPAHLFTTGANPVSCEAALATIQMIEDQSLLQASAEKGEYVRKRMDQWVSKYNSVGDVRGKGLSIGIDIVSDKKLKTRDGSAALKICNYCFEHGVVIIAVAGNVLRFQPPLVITYEQLDTALNTIEDALTALEAGNLDQYDISGQGW

SEQ ID NO: 76972 - protein, 537 aa, delta proteobacterium MLMS-1
MADLQKYFNDFNKLPAFSRLTELALQPVELRAAVDPARIADYRCRGGGVELIYFGQRVNGQVLEALGELAAQAGVLEQYDLMRQGAVLNQIAGYASENRQVLHCSNRDIFAESPRQPEATARTANELAKLREFLEDLEAGRLANPAGEPFETMLQVGIGGSDLGPRALYLALRAYAKPGRQVRFISNVDPDDAAAVLQELDLSRTLVKVVSKSGTTLETLANEELVRRAYQDAGLDPKDFFIAVTGQGSPMDNPEHYLRSFYMFDYIGGRYSATSMVGLVMLGFALGYEQVLEILRGAYEMDEAATQPDPTRNPPLLLALLGIWNRNFLGSQDVAILPYSQALSRFAAHLQQLDMESNGKGVSRAGEPLGWDSGPVVWGEPGTNGQHAFYQLLHQGTAVVPIEFIGFKESQYRRDLTVKGTTAQEKLLANLLAQSLALAVGQEEENPNRRFPGNRPSSILLADRLTPATMGALLALYEAKVVFQGFLWNINSFDQEGVQLGKRLADGLLAQYEARRRGTTPPQDPLGRALLALASSE

SEQ ID NO: 76973 - protein, 253 aa, Silicibacter pomeroyi DSS-3
MDLFDLKGRRALVTGSSMGIGYALARGLAQAGASVVLNARDGARLAGAAEQLRGQGIEVETLVFDVTDADAVRKAVDGFEAEIGQIDILVNNAGMQHRTPLEEFPVEAFDRLMRTNVNSAFYVGQAVARHMIGRGAGKIVNIASVQSALARPGIAPYTASKGAVSNLTKGMATDWARHGLNCNAIAPGYFDTPLNAALVADPEFSAWLEKRTPAGRWGEVEELVGACIFLCSDAASFVNGHVLFVDGGITASL

SEQ ID NO: 76974 - protein, 286 aa, Vibrio harveyi
VFRAAQERNDIEVVGINDLIDVDYMAYMLKYDSTHGRFNGTVEVEGGNLIVNGKTVRVTAERNPEDLKWDAIGVDVVAEATGLFLTDETARKHITAGAKKVVLTGPSKDATPMFVMGVNHATYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELAGVLGYTEDQVVSQDFIGEVQTSVFDAKAGIALT

SEQ ID NO: 76975 - protein, 669 aa, Kluyveromyces lactis NRRL Y-1140
MADFRNIMQVLKECGTSRVVKHMEPERYLQSVGAAKELYQNKDEESLKRQKLVFHTPRPVTTENNGVPHFSFGVPEERPHYKFMAHSKKALEDLQLKSDSSLINICQGSDVYIDESREIFPYSLAYAGFQFGEFAGQLGDGRVLNLFDIKDKESKLQTVQLKGSGLTPYSRFADGKAVVRSSIREFLICESLHAIGIPSSRALQISSLPKTRARRSVFEPCAVITRFAPSWIRIGNFDLFRWKQDDEGLLKLADFSINHVFEGLKDYRDTVALNSFSANYFEGTSDTVNNKELRSSKVDDGLTNYDKLFRHIVTLNAECVAYWQAYGFCNGVLNTDNTSILGLSIDFGPFGFMDKFQPQYTPNHDDYNLRYSFANQPTVIWWNLIKLAEALVIPLGVGPSLIDKLPTTNRGEWKDPEIEKISKRATAIINLTGLEYEFRFTTKYADLMAKRLGYDLNIPATLTDDNLKSVAEKVTAFTTDIIEPILRILTVSGVDYNSFFLALQNYDGNFLDEGGINGVDDGLYRVFFNEEQTKKINDYYIGQEQDDSGETRKLIEEAEVLSNWSKDYKQLISDYPERVKIAKQFNPLFIPRNYILESVANHYTDEQRNELNDPDAKLDNGPLQKLILMATNPYDKSAWDSSFLPELEKKWTNVTEDEDLLMTQCSCSS

SEQ ID NO: 76976 - protein, 288 aa, Vibrio nereis
RFVFRAAQERNDIEVVGINDLIDVEYMAYMLKYDSTHGRFNGTVEVEGGNLIVNGKTVRVTAERNPADLKWNEIDVDVVAEATGLFLTDETARKHIEAGAKKVVLTGPSKDATPMIVMGVNQDTYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYDAICAAMKEASEGELKGVLGYTEDAVVSQDFIGEVQTSVFDAKAGIALT

SEQ ID NO: 76977 - protein, 385 aa, Schizosaccharomyces pombe 972h-
MSGYGQQGVSAANIDSIRPKKRLSIGVVGSGNWGTAIAKICGENARAHGHHFRSKVRMWVFEEEIEYKGEKRKLTEVFNEAHENVKYLPGIECPPNVIAVPDVREVARRADILVFVVPHQFIERVCDQMVGLIRPGAVGISCIKGVAVSKEGVRLYSEVISEKLGIYCGVLSGANVANEVAREQFCETTIGFNPPNEVDIPREQIAAVFDRPYFSVVSVDDVAGVALGGALKNVVAMAVGFADGLEWGGNTKAAIMRRGLLEMQKFATTFFDSDPRTMVEQSCGIADLVTSCLGGRNNRCAEAFVKTGKSLETLEKELLGGQLLQGAATSKDVHEFLLTKDMVKDFPLFTAVYNISYEDMDPKDLIIVLQPLKEDSENEGGTETE

SEQ ID NO: 76978 - protein, 291 aa, Vibrio parahaemolyticus
GRFVFRAAQERADIEVVGINDLIDVEYMAYMLKYDSTHGRFNGTVEVEGGNLIVNGKTVRVTAERNPADLKWDEIGVDVVAEATGLFLTDETARKHIEAGAKKVVLTGPSKDATPMFVMGVNHATYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELKGVLGYTEDQVVSQDFIGEVQTSVFDAKAGIALTDT

SEQ ID NO: 76979 - protein, 715 aa, Gibberella zeae PH-1
MSSEDKYETLEKIGHGSFGIIRKVRRRTDGFIMCRKEISYLRMSQKEREQLHAEFQILSHLRHPNIVAYYHREHLKVSQDLHLYMEYCGNGDLGRVIKDLALKGQRAQESFVWSIFSQLVMALYRCHYGVDPPEVGSNILGLTQGNAAAGPKVPAGTMTILHRDLKPENVFLGEDNSVKLGDFGLSKMIKSHDFASTYVGTPFYMSPEICAAEKYTLKSDIWSLGCIIYELCAREPPFNAKTHFQLVQKIKDGKFPALPDVYSPELYQVIKDCLRVNPDRRPDTSELLNLPVVKLMRKEKEVVDLNKSIRLREDSLRKKERDLNERLVNMEREKELIRDELDSSLRREWEVKARLEIDRLANAEIEQLQNRFEEEVQARVEAELQKKAAAYANSRPNSQEDEYTTSTGKTDYPHSSVGGSEVEFPSTTDLTEYSSIESPEAPRETKKTARTPFGRAQTMFVGNPAGTPMDIEMNSPSPIAIASLSLSPRRNGNTKAPTAASGNIFAVNANRSADNSRWDLRDTLSDSEDEDVMPSPTRNIKSSKNPFTSKTRPVLTSQKSAPINRLKSQPSTSGFVSKQVSQPEAPRSPRRLSKIPSAANLQAESNNSSGGGLTRQSSLNRKNNHSDDGLGKVAAKNNIRGRTLVELQQARAGGRPMSAIVMPSTGENVSPKRAFRDRIGAERKSSGDEPVAVWDPERDEMPSPFLVRQRRIARV

SEQ ID NO: 76980 - protein, 174 aa, Zea mays
MEHKEAGCQAPEGPILCINNCGFFGSAATMNMCSKCHKEMITKQDQAKLAASSIDSIVNGSDAVMEPVVAGSNTVVAVAQVELQTMNVQQPADVAGPSEGVAAISKGGKVGPNRCSACRKRVGLTGFNCRCGNLYCALHRYSDKHDCKFDYRTAARDAIAKANPVVKADKLDKI

SEQ ID NO: 76981 - protein, 454 aa, Prochlorococcus marinus str. MIT 9515
MEFEFDLIVVGAGSGGLAAAKRAASYGAKVAIIEVNKIGGTCVLRGCVPKKLMVYAANNRRNMVSAEGYGLINKEITFNSSVLLKNVREEVSRLSHIHSNSLKKLNVTVFEGLGRFKNQNTVEVVCPKTRNILRKVSANKVLISVGGKPKKLEIPGVDLAWSSDDIFELQDFPKTLLIVGGGYIACEFASIFKNLGTEVIQIIRGQNLLSGFDKDLSECLKKSMTSLGIDLKFNNQLKSIKKIKGKLQSTLVSGSKFLTNNILIATGREPALKELHLDTLNLKMDGIYLDVNEVNQTSNSNIFAIGDIIKRPNLTPVAIEQGRVFADNYFADRRRKVNYQNIPKAVFTIPEISTVGLSEEEATEIYSELNIKIFKCSFTPMSNTFKKNKSKCMLKLVVNKKNDKILGCHMFGEAASEIIQMVSVSLNAGITKKDFDNTMALHPTISEEFVTMYG

SEQ ID NO: 76982 - protein, 292 aa, Vibrio rotiferianus
GRFVFRAAQERNDIEVVGINDLIDVDYMAYMLKYDSTHGRFNGTVEVEGGNLIVNGKTVRVTAERNPEDLKWDAIDVDVVAEATGLFLTDETARKHITAGAKKVVLTGPSKDATPMIVMGVNQDTYAGQDIVSNASCTTNCLAPIAKVLNDKFGIVSGLMTTVHATTATQKTVDGPSAKDWRGGRGASQNIIPSSTGAAKAVGVVLPELNGKLTGMAFRVPTANVSVVDLTVNLEKGASYEAICAAMKEASEGELKGVLGYTEDQVVSQDFIGEVQTSVFDAKAGIALTENF

SEQ ID NO: 76983 - protein, 569 aa, Vitis vinifera
MSKQSFKVCFCFRRIFKLQATGPPEDVQYLFNRYSQNGTMTLDQLRYFLIDFQEEKQATREDAQAIFNSLKHLNIFQRKGLHLEAFFRYLLGDLNTSLPPSPTVHHDMTAPLSHYFLFTGHNSYLTGNQLSSNCSVEPIINALRRNVRVIELDLWANDKKDNVEVRHGGTATSPVELIKCLRAIKENAFYASEYPVIITFEDHLTRNLQEKVAKMVTETFGDMLFRPESEYLPEFPSPESLKKKIVISTKPPKEYLDIEKYKDKTITHTVYEAKLEEEEELHQDEDLQNAVPDYRRLIAIHAGKLKGGLESWLSIDPYRVRRLSLSEQELENAVKTHGTEIVRFTQRNLLRIYPKGTRIDSSNYNPFVGWMHGAQMVAFNMQGHGKPLQIMQGMFRANGGCGYVKKPDFLLEVGANNEVFDPSAPFPVIKVLKVTVYMGEGWHLDFRHTHFDLYSPPDFFVKVGIVGAPADTRTKETKPIEDDWTPSWNDTFEFPLTVPELAILRVEVREYDTSGKSEFAGQTCLPIAELRSGIRAVPLHNRKGEKYKSVKLLMCFKFEDTNLSNEFSL

SEQ ID NO: 76984 - protein, 298 aa, Vibrio harveyi
GFGRIGRFVFRAAQERNDIEVVGINDLIDVDYMAYMLKYDSTHGRFNGTVEVEGGNLIVNGKTVRVTAERNPEDLKWDAIGVDVVAEATGLFLTDETARKHITAGAKKVVLTGPSKDATPMFVMGVNHATYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELAGVLGYTEDQVVSQDFIGEVQTSVFDAKAGIALTDNFV

SEQ ID NO: 76985 - protein, 586 aa, Vitis vinifera
MGSYRVCMCFRRKFRVVEAEPPEDVKEAFKKYAEGGTHMTAEQLRRFLLESQSDGSVTLSDAERIVEQVLQKRHHIAKFTRHNLTLDDFHHFLFSTDLNAPIGSQVHQDMNAPLSHYFIYTGHNSYLTGNQLSSDCSDVPVIKALKRGVRVIELDIWPDSTKADVHVLHGRTLTTPVELIKCLRSIKEHAFSASPYPVIITLEDHLTPDLQAKVAQMVTQTFQDILFYPKSECLQEFPSPEELKYRIIISTKPPKEYLEAKGSEDKENNIQKGKDSDDDVWGEEPSNITADHENNDKVEGSEVDEDGEENNDCRPIGAPAYKHLISIHAGKPKGGFKDALKVEPNKVRRLSLSEQALEKATASHGTDVVRFTQKNFLRIYPKGTRFNSSNYKPLIGWTHGAQMVAFNMQGYGRYLWLMHGMFRANGGCGYVKKPDFLMNVGPNNQVFNPRVKLPVKKTLKVKVYMGDGWHLDFKQTHFDLYSPPDFYARVGIAGVPGDEVMKKTKTKEDKWTPVWNEEFQFPLTVPELALLRVEVHEYDLSEKDDFAGQTCLPISELKPGIRAVPLFNRKGEMFCSARLLMRFEFV

SEQ ID NO: 76986 - protein, 486 aa, Coccidioides immitis RS
MASAIFFLDLKGKTLLARNYRGDIPMSAVEKFPVLLSEAEEESSAVPPCFSSEGINYLYIRHSNLYLLALTKRNTNAAEILLFLHKIVEVFTEYFKELEEESIRDNFVIIYELLDEMMDFGYPQTTESKILQEYITQESHKLEIQARPPIAVTNAVSWRSEGIRYRKNEVFLDVIESLNLLVSANGNVLRSEILGAIKMKCYLSGMPELRLGLNDKVMFETTGRATRGKAVEMEDVKFHQCVRLSRFENDRTISFIPPDGEFELMSYRLNTQVKPLIWVECLVESHSGSRIEYMLKAKAQFKRRSTANNVEILVPVPEDADSPRFRTNIGTVHYAPEKSAIIWKIKQFGGGKEFLMRAELGLPSVKGDDEHGGGMTGGFGGSMGGAGQTAKGKRPINVKFEIPYFTTSGIQVRYLKIIEPKLQYPSLPWVRYITQSGDIAHAIGVAHQMIFSVGLFIIIWLPKKLKWCKGEQGVKPKFQSQFAGGK

SEQ ID NO: 76987 - protein, 588 aa, Vitis vinifera
MGSYSVCICFKRKFRLTEAEPPTDVKEAFRRYTEGGTHMTAEQLLRFLVEGQNDVAATISDAERILELVLHRRHHVTKFARTTLTLDDFHHFLFSTDLNGPIGSQVHQDMSAPLSHYFIYTGHNSYLTGNQLNSNCSDVPIVKALKRGVRMVELDLWPGSTKENVHVLHGRTLTTPVELIKCLKSIKEHAFSASPYPVIITLEDHLTPDLQAKVAQMISQTFGDMLFYPKSESLPEFPSPEELKYRVIISTKPPKEYLEAKSSEDKVNNSQKGKDSDEDVSMKVPPDLTVDHESNDKSDSGRSEGSSENDESNDECDRPLEAPAYKHLIAIHAAKPSGGLKASLKVEPNKVSRLSLNEQAACAPMLGVSISRFTQKNLLRVYPKATRFNSSNYKPLIGWMHGVQLLAFNMQGHGRSLWLMHGMFRANGGCGYVKKPDFLLNVSPHNQVFDPKAKLPVKKTLKVRVYLGDGWNFDFKKTHFDFYSPPDFYTRVGIAGAAADKTMKETKKKQNNWKPVWNEEFTFPLTVPELALLRIEVYEYNMPEKDMFAGQTCLPVWELRQGIRAVPLFNRKGEMYSSVRLLMSFQFV

SEQ ID NO: 76988 - protein, 404 aa, Streptococcus pyogenes M1 GAS
MKIIEKSSKLEHVAYDIRGPVLDEANRMIASGEKILRLNTGNPAAFGFEAPDEVIRDLIVNARLSEGYSDSKGIFSARKAIMQYCQLKGFPDVDIEDIYLGNGVSELISISLQALLDNGDEVLVPMPDYPLWTACVSLGGGKAVHYLCDEEAGWYPDIADIKSKITSRTKAIVVINPNNPTGALYPKEILEDIVALAREHQLIIFADEIYDRLVMDGKEHIAIASLAPDVFCVSMNGLSKSHRIAGFRVGWMVLSGPKDHVKGYIEGLNMLANMRLCSNVLAQQVVQTSLGGHQSVDALLLPGGRIFEQRNFIYEAINAIPGLSAVKPEAGLYLFPKIDRQMYRIDDDEEFVLQLLKQEKVMLVHGRGFNWKDPDHFRIVYLPSVEELEDVQEKITRVLYQYRR

SEQ ID NO: 76989 - protein, 158 aa, Populus trichocarpa
MASNCPNEGICHTCGKAGHRAKECTAPPMPPGDLRLCNNCYKQGHIAADCTNDKACNNCRKTGHLARECPNEPICNMCNVAGHVARQCPKSNMLGDRGGMRSGGYQDIVCRNCHQYGHMSRDCMGPLMICHNCGGRGHRAIECPSGRMMDRYPQRFYR

SEQ ID NO: 76990 - protein, 440 aa, Oryza sativa Japonica Group
MGKQMAALCGFLLVALLWLTPDVAHAQTQILFQGFNWDSWKKQGGWYNMLKDQVGDIASAGVTHVWLPPPTHSVSPQGYMPGRLYDLNASKYGTKAELKSLIAAFHAKGIKCVADIVVNHRCADDKDGRGVYCIFKGGGPRGCLDWGPSMICCDDTQYSDGTGHRDTGADFAAAPDIDHLNPLVQRELSDWLRWLRRDVGFDGWRLDFAKGYSAAVARTYVQNARPSFVVAEIWNSLSYDGDGKPAANQDGQRQELVNWVKQVGGPATAFDFTTKGILQSAVQGELWRMRDKDGKAPGMIGWYPEKAVTFVDNHDTGSTQRMWPFPSDKVILGYAYILTHPGVPCIFYDHVFDWNLKQEINALAATRKRNGINAGSKLRVLAAESDMYVAMVDERVITKIGPRIDVGNIIPSDFHIVAHGNDYCVWEKSGLRVPEPEGRR

SEQ ID NO: 76991 - protein, 455 aa, Mycoplasma pulmonis UAB CTIP
MEKFDFVIIGSGPGGYSLALILSKLGKKVAIAERKNFGGSCINEGCVPTKGLVKVARTYELIKNSSKFGIKVNDFSFDWKQIIKRKNEIKDTLNNSIEKNLELNNVKIFKAEAKVLKDKSIEVNNTKIYAEKIIIATGSRARKISFDGSDKALEKQVLVDSNYLLDMQEVPKSIAFIGAGPISLELGYVLSALGSDVTLLEGRDQILANFDHDVREEVLKYLEQKNIKYFTSTKVLKYDQDGLHFSVGEKNKVINPEKIALSVGREANLEAVEDLDLELNPNKTIKVDDKLETSIKGIYALGDVTGKMMLSTIAYKHGDVIVNNLINNKEVKLDYKKVPHTIYLSPEISSIGLSEEEAKKTYGENLLAIKIPSERLPRNHADGNLGYGFFKLIINKDTKQVLGASIILENSSLIINEISIAMNNDLTIYDLAKSPHVHPTLAEALYYAIRDLSFQ

SEQ ID NO: 76992 - protein, 330 aa, Vitis vinifera
MNGRAWLSLDSSRRRGRGSGSLCSCNGTLDILSEQNRGPRASKPKSQITAEHGSSIDNNKHSTSTAKTNDGLYNQLSFVTEYKDAKFFIIKSYSEDNVHKSIKYGVWASTPNGNRKLDAAYREAKEKQAACPVFLLFSVNASAQFCGVAEMVGPVDFDKSVDYWQQDKWSGQFPVKWHIIKDVPNSQFRHIVLENNDNKPVTNSRDTQEVKLEQGIEILNIFKNYETDTSILDDFDFYEDRQKAMQERKARQQASLMVVGGNEHRNAVTLSTDFIKQMSKSYAQVVRLDDCGKDGTMPDRAGPASDPSMGARVKLDDAMTTAAVSSAQSS

SEQ ID NO: 76993 - protein, 499 aa, Arabidopsis thaliana
MAELIIVDFQNISIFILLCLFSFLCYALFFKKPKGFDLPPSPPSLPIIGHLHHLLSSSLPHKSFQKLSFKYGPLLHLRIFNFPMVLVSSASMAYEVFRTNDVNVSYRFVPVNKDSLVFGSSGFVTAPYGDYWKFMKKLISTKLLRPHALELSKGNRAEELRRFCLDLQGKARKKESVEIGKVALKLTNNIICRMSMGRSCSEKNGVAERARELVNKSFALSVKLFFSNMFRKDIMGVSREFDEFLERILVEHEENLEGDQDRDMIDHLLEAYRNEEAEYKITRKQIKSLIVEIFLGGTDSSAQTIQWTMAEILNNPGVLEKLRAEIDSVVGGKRLIQESDLPNLPYLQAVVKEGLRLHPSAPVLLRVFGESCEVKEFYVPEKTTLVVNLYAVNRDPDSWEDPDMFKPERFLVSSISGDEEKIREQAVKYVTFGGGRRTCPAVKLAHIFMETAIGAMVQCFDWRIKGEKVYMEEAVSGLSLKMAHPLKCTPVVRFDPFSF

SEQ ID NO: 76994 - protein, 433 aa, Arabidopsis thaliana
MRRRRCDLQPKRTRMCDLQPKRTSMCDLPPKLVGEKILTRIPITSLRAVRSTCKLWNALTKDRVLGKAAAQFLGFMTMDSKVCSVRFHLRRSKEEEEDTMDLSIKQVDLLNQVEISRVYHCDGLLLCVAKDNSRVVVWNPYLGQTRWIRPRTESNIGDSYALGYDINRNHKILRMVQTRNVSVYRYEIYDLRSNSWRVLEVTPNGEMDPNHPLYGVSVKGNTYFFAHEDSSSGEIDEDGDIIDLEDFLLCFDFTTETFGLRLPLPFHSTIDATVTLSCVRDQQLAVLYHNEGLHSDDRFTTVEFWVTTSIEPNSVSWSKFLTVDMRPLALTGVRFDNDMGATFFIDEDEKVAVVFDLDGYLSTESARYHTAFISGKDGFFKPVTLGVAPNVGEPCPRTGHIPTTYRPPLVCSSTYLPSLVQVNQQRKRKERHV

SEQ ID NO: 76995 - protein, 506 aa, Pseudomonas aeruginosa
MIYAAPGTPGAVVTFKPRYGNYIGGEFVPPVKGQYFTNTSPVNGQPIAEFPRSTAEDIDKALDAAHAAADAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAESIIPSTVELGGKSPNIYFEDIMQAEPAFIEKAAEGLVLAFFNQGEVCTCPSRALVQESIYPAFMEEVLKKVRAIKRGDPLDTETMVGAQASQQQYEKILSYLDIAQQEGAELLAGGSVEKLEGNLASGYYIQPTLLKGHNGMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDIDPLGFF

SEQ ID NO: 76996 - protein, 73 aa, Zea mays
RLPLREIMICRSVSKFFLQLLSTPSFLQVLSSSHPPLQLLGLRNRHHTPSHTYLPLFDPVTKSWIHFPLDFSP

SEQ ID NO: 76997 - protein, 127 aa, Cryptococcus neoformans var. neoformans JEC21
MSAQPNPKAFPLANAQLTNQILDLIQQAQHYKQLKKGANEATKTLNRGICEFIVMTADVEPIEIVLHLPLLCEDKNVPYVFLPSKTALGRACGVSRPVIAASVTTNEARELNAQIQAVKNEIEKLLI

SEQ ID NO: 76998 - protein, 1866 aa, Aspergillus oryzae
MDLTSGAVIPPASSRVRGGSGKLFALELEDGTVYQGYSFGAEKSVAGELVFQTGMVGYPESVTDPSYRGQILVVTFPLVGNYGVPSRETMDELLKTLPKYFESTEIHIAALVVATYAGEDYSHFLAESSLGQWLKEQGVPAMHGVDTRALTKRIRQKGSMLGRMLLQKSDETLEEAPVDKDSWRSYFEQTEWVDPNKKNLVSEVSIREPRLFSPPEDVALKHPSGRPVRVLCLDVGLKFNQLRCLLARGVEVLVVPWDYDFPTLAGKDYDGLFVSNGPGDPATLTTTVNNLSKTLKEARTPVFGICLGHQLIARSVGAQTLKMKFGNRGHNIPCTSMVTGKCHITSQNHGYAVDSTSLPEDWEELFVNANDGSNEGIRHTSRPFFSVQFHPESTPGPRDTEYLFDVFINSIKDTLTSPEAINNPVTFPGGTMEENIKASPRVSVKKVLILGSGGLSIGQAGEFDYSGSQAIKALKEEGIYTVLINPNIATIQTSKGLADKVYFLPVNADFVRKVIKHERPDAIYVTFGGQTALQVGIQLKDEFESLGVKVLGTPIDTIITTEDRELFARSMDSINEKCAKSASASNLEEALRVVEDIKFPVIVRAAYALGGLGSGFANNMEELKDLCTKAFAASPQVLIEKSMKGWKEIEYEVVRDARDNCITVCNMENFDPLGIHTGDSIVVAPSQTLSDEDYNMLRTTAVNVIRHLGVVGECNIQYALNPFSKEYCIIEVNARLSRSSALASKATGYPLAFIAAKLGLGIPLNEIKNSVTKVTCACFEPSLDYCVVKIPRWDLKKFTRVSTQLGSSMKSVGEVMSIGRTFEEAIQKAIRSVDFHNLGFNETSALMSIKGELQTPSDQRLFAIANAMAAGYSVDDIWKLTQIDKWFLSRLKGLSDFSKLMSTHNATTVPRPLIRQAKQLGFSDRQLAKFLSSNELAIRRMRVEAGIIPIVKQIDTVAAEFPSVTNYLYLTYNASEHDVAFDDKGIMVLGSGVYRIGSSVEFDWCSVRTIRTLREQGYKTVMVNYNPETVSTDYDEADRLYFENINLETVLDIYQLESSSGVIMSMGGQTPNNIALPLHRLNVRILGTSPEMIDGAENRYKFSRMLDRIGVDQPAWKELTSIEEATGFCDKVGYPVLVRPSYVLSGAAMNTVYSEHDLASYLNQAAEVSREHPVVITKYIENAKEIEMDAVALNGTMVGHFISEHVENAGVHSGDATLILPPQDLDPETVRRIEEATRKIGNALNVTGPYNIQFIAKDNDIKVIECNVRASRSFPFVSKVMGVDLIEMATKAMLGVPFQEYPPVSVPKDYVGVKVPQFSFSRLSGADPVLGVEMASTGEVASFGRDKYEAYLKALLSTGFRLPKRNVLFSIGSYKEKLEMLPSIRKLHQIGFNLFATSGTADFLKENGVPVKYLEILPGQEDELKSEYSLTQHLSNNLIDLYINLPSSNRFRRPANYMSKGYRTRRMAVDYQTPLVTNVKNAKILIEAIARHYDLAVQTIDYQTSHRTVTLPGLINVAAFVPGLMTPGSKDFEPVGELGPPLYPTVSQTSSPLHEMLSRSTFRQKHVLSVGQFTRADLHLLFTVAQEMRLGVQRQGVLDVLKGRVLCTLFYEPSTRTSASFDAAMQRLGGRTIAISTEHSSTKKGETLQDTLRTLGCYGDAVVLRHPDPASTEVAAKFSPVPVINGGNGSVEHPTQAFLDLFTIREELGTVTGLTITFTGDLRYGRTVHSLIKLLQFYDVRVQLVAPKDLSLPEEVRQQVIASGQLVVESEELTPEIVARSDVLYSTRVQKERFADLEQYERLKNSFVIDNALLKHAKSHMVVMHPLPRNAEIAEEVDFDQRAAYFRQMRYGLYCRMALLALILAP

SEQ ID NO: 76999 - protein, 254 aa, Aspergillus oryzae
MASSSKPPSFLLYTCIAHRTTILAEHSSPGTSSTSASSLASIILPKITHEKSQKLTYTHERLFVHYIADSPTGASDDSSFRQEPNSYAPLSYIVVATAEQGRRIPFAFLLEMKRKFLSTYPPSSTDFAALPAYGCAAFNNELRSLLQTYNTAPPSDSLASARREIDSVRDIMTENIERVLERGERIDLLVDKTDRLGGSAHDFRIRSRGLRRRMWWKNIKLMVLLGVVIVFLLYLFIGVGCGLPAWGKCVGHSE

SEQ ID NO: 77000 - protein, 329 aa, Chlorobium tepidum TLS
MKILVIGGAGYIGSHVAREFLDRGYQVTVFDNLSTGREENLFDDAEFVRGDIFDAEMLAEVMNRGFDGCVHLAALKAAGESMQKPEEYSVHNICGTIGTINQAVASGIKCLLFSSSAAIFGSPAYLPIDENHPKKPENYYGFTKLEIERILEWYDRLKGLKFAAVRYFNAAGYDVRGRIRGLERNPANLLPVIMEVASGVRPMLSVFGTDYPTRDGTCIRDYVHVNDLATAHVLAFEQVIESGESLSVNLGSETGVTVLEMLEAARRLTGKEIMAEFAPRRAGDPANLVATSAMARELLGWVPQYSDLDTLVESTWNVYRDVNAGSGRQ

SEQ ID NO: 77001 - protein, 366 aa, Zea mays
MVIYLSTPKTDKVSEDGENDKLKFGLSSMQGWRATMEDAHSALLDLDNDTASFGVFDGHGGKVVAKFCAKYLHREVLHTEAYAAGDLGAAVHRAYLRMDEMMRGQRGWRELQALGDKINQFTGIIEGLIWSPKASDSNDRHDDWAFEEGPHSDFTGPNCGSTACVALVRNRQLVVANAGDSRCVISRNGQAYNLSRDHKPELEAERERIQSAGGYIKMGHVNGSLNLSRAIGDMELKQNKFLSPDKQILTANPDINIVELCDDDEFIVLACDGIWDCMSSQQLVDFIREHINTEESLSAVCEGVLDRCLAPSTMGGEGCDNMTMILVQFKKPFAQVKDASDAEQLTGDAGCSETHGAEENGSDKQI

SEQ ID NO: 77002 - protein, 371 aa, Vitis vinifera
MSKSNRSKDDEARMSGCCFPVNLDRSMKSGLSFKKSSSGSFKGESQEKRPLVVCFGEMLIDFVPTVGGVSLSESPAFKKAPGGAPANVAVGISRLGGSSAFIGKVGEDEFGFMLADILKQNNVDSSGMRFDRNARTALAFVTLRDDGEREFMFFRNPSADMLLRESELDANLIKKASIFHYGSISLIEEPCKSAHLAAMNIARKSGSILSYDPNLRLPLWPSPETARKTIMSIWNQADLIKISEEEITFLTGGDDPNDDYVVLKKLYHSNLKLLVVTEGSNGCRYYTKEFKGRVTGVKVKAVDTTGAGDAFVGGILNSLAADLNLYKNEEKLREALLFANACGAITVTERGAIPALPTKEAVLQILPKANA

SEQ ID NO: 77003 - protein, 332 aa, Helicobacter pylori 26695
MKIFINGFGRIGRCVLRAILERNDTNPKLEVIGINDPANWEILAYLLEHDSVHGLLPKEVRYSNYKLIIGSLEIPVFNSIKDLKGVDVIIECSGKFLEPKTLENYLLLGAKKVLLSAPFMGEYDEKQYPTLVYGVNHFCYQNQAIVSNASCTTNAIAPICAILDKAFKIKEGMLTTIHSYTSDQKLIDLAHPLDKRRSRAAASNIIPTTTKAALALHKVLPNLKNKMHGHSVRVPSLDVSMIDLSLFLEKKAPKDPINDLLIEASKGVLKGVLEIDLKERVSSDFISNPHSVIIAPDLTFTLENMVKIMGWYDNEWGYSNRLVDMAQFMYHY

SEQ ID NO: 77004 - protein, 666 aa, Oryza sativa Indica Group
MAGGGVVDGVRRWLRRRRGRTASAYQPLRSSSLARHPGGDGGLEVVPGPFALPAAIRVPARNSPPPPDAQLRNEVASGVGILQQDDLFSRSACAFQVLEYILTVPWQKNYSVELSIVGVRTWELRSFMKDEIFVHDRSNDSNMEARDDMNQWNCAMRTSDMEFFTEYGEASQYQIQEVVGKGSYGVVAAAVDTHTGERVAIKKINDVFEHVSDAIRILREIKVLRLLRHPDIVVIKHIMLPPTRREFRDIYVVFELMESDLHQVIEANHDLSPEHHRFFLYQLLCALKYIHSANVFHRDLKPKNILANSDCKLKICDFGLARVAFNDSPSTIFWTDYVATRWYRAPELCGSFFSKYTPAIDIWSIGCIFAEILTGRPLFPGRNVVHQLDLITDLLGTPSSETLSRIRNENARGYLTGMQRKHPIPFSHKFHNADPLALRLLERLLAFDPKDRPTAEEALADPYFRGISKLSREPSRLPVSKFEFEFERRKLTKDDVREMIYREILEYHPQMLQEYIRGGEQISFLYPSGVDRFKRQFAHLEENYSRGERSTPLRRQHASLPRERVCSSVDSNNQDSDNEERRAISSIARTMISPPRSQEKGKNRASAYPNGIINLNSNPKIYLKSASISASTCIIRGNKGPKENGISEDMEEVVYELSDNVTRMLS

SEQ ID NO: 77005 - protein, 304 aa, Silicibacter pomeroyi DSS-3
MTSFLAIGECMIELHETGDGLYRRGFAGDTFNTAWYAKRLLPASWRVGYASCIGQDTVSDEMAGFMAQEGIDTCALRRLPDRTVGLYMISLDNGERSFSYWRGQSAARQLASDPDWLDSVLSGADILYFSGITLAILCPDHRRALCDALARARSRGATVAFDTNLRPSLWEDTATMRAGLSLGASVADVVLPSFDEENGLFGDAEPQATIARYHAAGAGIVAVKNGGGDLTLWDGKRLHNLPATPVARVVDSTAAGDSFGAAFMAGLATGASATDAAARAMSLAAQVVQSRGALVPGIFEREPK

SEQ ID NO: 77006 - protein, 127 aa, Brassica napus
  misc_feature (30)..(30): Xaa can be any naturally occurring amino acid
SNPPVHGARIVANVVGDATMFGEWKAEMEXMAGRIKTVRQRLYDSLVSKDKSGKDWSFILKQIGMFSFTGLNKAQSDNMTDKWHVYMTKDGRISLAGLSMAKCEYLADAIIDSYHNALLYWETPIEL

SEQ ID NO: 77007 - protein, 600 aa, Gluconobacter oxydans 621H
MQYDILIGIASTFGAGMLAQWIAWRFRLPAIVLLFSLGLIFGPGLGILHPSETMGWMFRPLVSLLVALVVFEGGMALDFRQLREAGEGVARLTMLALPINWVLGSLAAHYVAHLEWGTSMLFGAIVVVTGPTVVLPLLRSAKLQPRVAAFLRWEAIVNDPLGAILAAVVLQLLMLHVDVHADVFFTHTLPDLLGAIAVSLSAGILPAYLIRYLFTRDLMPEILKTPMLISMALVIFSLCNLEMGGAGLMAVTIFGMALANLQIPGVTELRRMKESLVVLVVSVLFIMLTADLHRDVLARLSIPIFALTVVVLFVVRPLGIFLSTLGTSMPWKEKLFVGWIAPRGIVAAAVAGEAGISLKEAGYQSADLIMPAVFAVIAVTMILHGFSLGPIARLLKLTLSNDPAIAILGASPWSINFASCLRRAGVPVLLVDNRSSALMPATRQDIPVLRAELLSQHGQESFEERPADYLIATTGDGIYNGMVCGHLAPTMGRQRVYQISPGVARLDFYHGLSRDARGKVLGEPAWNYTLFDTLFEQGWRFVAVEATEESAPTFGTDENRLDILVVRRDGNILIRSAEDNDKAVPQPGDYMVSMVPPGAD

SEQ ID NO: 77008 - protein, 285 aa, Vibrio harveyi
RAAQERNDIEVVGINDLIDVDYMAYMLKYDSTHGRFNGTVEVEGGNLIVNGKTVRVTAERNPEDLKWDAIGVDVVAEATGLFLTDETARKHITAGAKKVVLTGPSKDATPMFVMGVNHATYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELAGVLGYTEDQVVSQDFIGEVQTSVFDAKAGIALTD

SEQ ID NO: 77009 - protein, 321 aa, Streptococcus pyogenes M1 GAS
MKKILVLHTGGTISMQADNSGRVVPNQDNPMTKIHAAAQDIQLTVSDFLNLPSPHITPHHMLSIYHHIQERTDVFDGIVITHGTDTLEETAYFLDTMALPTNIPVVLTGAMRSSNEVGSDGIYNYLTALRVASSDKAKEKGVLVVMNDEIHAAKYVTKTHTTNISTFQTPTHGPLGIIMKNDLLFFKTAEPRIRFDLRCISGTIPIIKAYAGMGDGSILSLLTPGSIQGLVIEALGAGNVPPLAVGEIEHLIALGIPVILVSRCFNGMAEPVYAYEGGGAMLQEAGVMFVKELNAPKARLKLLIALNAGLTGQELKDYIEG

SEQ ID NO: 77010 - protein, 523 aa, Gibberella zeae PH-1
MSSFLSSETLSNPRFQLFAAAAFSGATVASLILGYQALEREERVYELKNSIPADDPNLHPVLSSCFFSKNTTDQSQLNNFGGSSAPPVDKEDARNQAMARRAQAGDFDEELILEQLARNRVFLTDEGLDKLRNSFVIVVGCGGVGSHCTAALARSGVSKIRLIDFDQVTLSSLNRHAVATLADVGIPKVQCLERRMMAIAPWVKFDLRQEQFNENVAERLLRPWGDDGRAPDFVIDAIDNIETKVSLLEYCHKNNLPVISAMGAGCKSDPTRIIVGDIGSSKDDGLSRATRRKLKLKGITSGVPVVYSTETAGAGKAELLPLPEEEFQKGSVGDLAAMPNFRVRILPVLGTMPAIFGLTVANHVILSITGYPLDYVPAKGREKMYEGMLATIQSSEEKLARMTYEGDTVGLKVPITTGDVAFLSEELYRGRSAISGIPTKLVLIRWEKPEGPSMTTLGEGKDTQKCSTVKLRDLVLMTKEEATRHEKGIFKEGKSLDEVYDAETLARVEEKRATAEKYEAFRS

SEQ ID NO: 77011 - protein, 200 aa, Gluconobacter oxydans 621H
MLTDLPNILTLLRIASIPVLVVLLSVHSPTANVIACAVYTTACITDYLDGALARRWHQLSELGRMMDPIADKLLVGSLLLALAGLTHLPVFSLYAGIIIMVREILVSGLREYMASQRETLPSTRLAKWKTGIQMVAIGFLIGGDGAAGMLGLSFLPASLIGGILLWFSVIPTVISGWGYLTAGLARIMAGQSRKSSKISF

SEQ ID NO: 77012 - protein, 437 aa, Vitis vinifera
MDSQEVWNLENGEVKGLSNKDGPHLIRNAHTMSSSSLRKRSDPMLLPKVRCRVLRQFLNNLQEVILGTKLCLLFPAIPLAVLAKCYQFGRPWIFALSLMGLTPLAERVSFLTEQIAYFTGPTVGGLLNATCGNATELIIALFALHQKKILVLKYSLLGSILSNLLLVLGTSLLFGGLANLKKEQLYDRKQADVNSLLLLLGLLCHVLPLMFKYAAWTDTFTAISTLQFSRASSILMLTTYVAYLIFQLKTHRQLFESQEGYEMIRKMKMALIGFWSAFSWLVGMTVIIALLSEYVVGTIEAASDSWGVSVSFISIILLPIVGNAAEHAGSIIFAFKNKLDISLGVALGSATQISMFVVPLCVIVAWIMGVAMDLDFSLLETGSLAFAIIITAFALQDGTSHYMKGVVLSLCYIVIAACFFVHKNPSVRKSLTSKLLH

SEQ ID NO: 77013 - protein, 319 aa, Bacillus halodurans C-125
MNHLSEKVISLKGRDLLTLLDYTPEEVQQLLTQALELKQKAKNGEPTPYLTGKSLGMIFENASTRTRVSFEVGMTQLGGHALFLSPKDLQIGRGEPIKDTANVLSRYVDAIMIRTNSHESVEELAHYATVPVINALTDAYHPCQALADALTILEKKETLIGKKLAYIGDGNNVCHSLLAIGAKTGMDVTVATPKGYEVDQEIFQRATEAAKETGATLVQTTNPQVAAENADAIYTDVWASMGYEAEQSEREEVFQPYQVNDQLLTLAKKDVSFLHCLPAHRGEEVTASVIDGPHSAIYDQAENRLHAQKAVLTALLIGE

SEQ ID NO: 77014 - protein, 359 aa, Bacillus halodurans C-125
MKAYLVLATGETFAGEIANAKEDVYGEVVFFTGMTGYQEVLSDPSFKGQLVVFTYPLIGNYGINASDFESKEPQAAGLIVSEQSEEGHHYEATQSLQQFCDQHQLPLLTGIDTRAVVKRIREQGDMPAVITTDLSRVSFEEWVPLSERALVDEVSTKKVETFEGNGPHIVLIDYGFKQSILNSLLKRDCQVTIVPYDVSFEVVQELNPDGLLFSNGPGDPKQIEDRLPTIYRLASTYPSLGICLGHQLLALAFGADTEKLRFGHRGANQPVINLKSNRVYMTSQNHSYVVKEDSLQRTDWDATFKNINDGSIEGLTHKYLPIQTVQFHPEAHPGPSDSDEIFHSFIDDVAAKGREKTYA

SEQ ID NO: 77015 - protein, 141 aa, Rhizobium etli
MPDIDKKDRPVTSVTDQEALEFHAMGRPGKLEINPTKPMATQRDLSLAYSPGVAVPVKAIAADPQTAYDYTARGNMVAVISNGTAILGLGNLGALASKPVMEGKSVLFKRFADVDSIDLEIDTENVDEFINCVRFLGPSFG

SEQ ID NO: 77016 - protein, 516 aa, Thermoplasma acidophilum DSM 1728
MFRSRPNALSQRSVIASSSELASLAGRDILKRGGNIFDAALAVSAMLCVTQNNLCGLGGDLFALIRDENGQIMDLNGSGQASRAVSIDYYESMGLTKIPERGPYAAITVPGIAGSWDEIFRKFATMDIADILEPAIRTASAGFPITQNYSDSIARSAPVIGQYRGWSSIFMPNGSVPVAGEILKQPDLAESFRLMSEEGFRSFYDGSLADIIIAGLEGTGSPLSDRDLRVYRPLIGKPVFTDLDEFRIYETSPNSQGITVIEWIRGMESHGYDSRTMWEAKIEDIFETMEEAYDKRRKITDPSYMNIAQHDSANGKKDGLPKRDHNDIGDTTYFSISDSEGRSVSIIQSNYMGFGSGIVPKGTGFVLQNRGSYFTLQRDHPNALMPGKRTFHTLAACMVEKEHDLYASLGSMGGDIQPQVQMQILMEILKDNTDPQAILDKPRWTEPYTIYEAPGAVYVESEELYRNVSKQISGRKVVLRDVSQEFGTAQITTLIRGDVVVGAADPRGDGIAIPYS

SEQ ID NO: 77017 - protein, 459 aa, Cryptococcus neoformans var. neoformans JEC21
MTGGAFFAPAADNDEEYDMGPVGEAHAVQWIGTAGVKGPKWARLPLLTVGMLGIQCVWSIEMGYASPYLLELGLSKSFMSLVFMAGPLSGLIVQPLVGIFADRSRSPLGRRRPFMLAGCLICVSAMMLLGWSREVAAIFGGGQWLAITLAVWAIYCIDFSINAVMSTDRALVVDTLPPREQEEGSAWAGRMFGFGSVAGFFVGNLDLAPVLPFLGKTQLQILSFLTSAVLMVTHSFTSWAVSERVLLRDDRPQSKSSLKSNLKSIWENMFSLPPGIRTVCIVQFFASLGWFPILFFTTVWVSEIYKSSVPSDGIDPATFDSRAVRSGARALLLQALVNIITSIGMPFLVAESGVQPSESVDGYEAIEGSSSRRVGLETANGDGRSPQASVATPPNSALWKRAREDLENGTVFRRFLHSVQSMVNNVKKGELGIPIKGLTLVKVWWISQFVFAAAMAGSW

SEQ ID NO: 77018 - protein, 667 aa, Oryza sativa
MKGTAGLIGERGLCFNIILWQDLEDLTTSRRLSDRKVARFEKNVTKRGSVPETVKKGNDYPVGPIVLGFFVFVVVGSFSWFTPDMVVNCCSYHTHGHQLLICCQAINPYMLINFSKKYMLLLKTLENRRGRFDVTLVKDSNGTDSLMLAEACRFLNQIHSNRFLSSASVFFLSDLQRISSAFTTRNLLVGLVNRDGVLFLPEMRRPKNKYGFVTAVLSSATPLLLGYDLVMVCGSATLPEPPGVKLLACVAVASCVLGALAAVGAQCVVGDRCTVLLSAAVLCAGALARGLATSFAAFEAGVFVNGVGMGLALMSVPAYAGELSPSSLHRGLTSHPDGFVCLGCILGGLCFSPRFLNLPVRVAWRLTVATGTAIPALLGFAVLLMPELPQWLLTKDHARRVLSRTLSLEDAELRLLETKTELGEPHDVGCDDTVATPAWRTRWREERALWLELLARPTEPVRRNIVSALVAKAFQQASGIGSMFLYVQRAFRDAGVPSDTRMTRALVAFGLVVFAFFAVSTVLLELAWLLVKALAGGCCPRRAPAPADHPSSPHAHRGGVAMGMKRRREQLKWARSLSATMLMSLMALVWLLLGPVQMADASSSSGWPRWLRTAVAAVNRAVRAAILWSFAWVYEVTAVYGNLLACSAIIVFAWFLVYFGVLGAKER

SEQ ID NO: 77019 - protein, 256 aa, Streptococcus pyogenes MGAS8232
MKIGIIGVGKMASAIIKGLKQTPHELIISGSSLERSKEIAEQLTLPYAMSHQDLIDQVDLVILGIKPQLFETVLKPLHFKQPIISMAAGISLQRLATFVGQDLPLLRIMPNMNAQILQSSTALTGNALVSQELQARVRDLTDSFGSTFDISEKDFDTFTALAGSSPAYIYLFIEALAKAGVKNGMPKAKALEIVTQTVLASASNLKTSSQSPHDFIDAICSPGGTTIAGLMELERLGLTTTVSSAIDKTIDKAKSL

SEQ ID NO: 77020 - protein, 303 aa, Helicobacter pylori 26695
MSSPNLSFYYNECERFESFLKNHHLHLESFHPYLEKAFFEMVLNGGKRFRPKLFLAVLCALVGQKDYSNQQTEYFKIALSIECLHTYSLIHDDLPCMDNAALRRNHPTLHAKYDETTAVLIGDALNTYSFELLSNALLESHIIVELIKILSANGGIKGMILGQALDCYFENTPLNLEQLTFLHEHKTAKLISASLIMGLVASGIKDEELFKWLQAFGLKMGLCFQVLDDIIDVTQDEEESGKTTHLDSAKNSFVNLLGLERANNYAQTLKTEVLNDLDALKPAYPLLQENLNALLNTLFKGKT

SEQ ID NO: 77021 - protein, 381 aa, Zea mays
MASPTQGQVITCKAAVAYEPNKPLVIEDVQVAPPQAGEVRVKILFTALCHTDHYTWSGKDPEGLFPCILGHEAAGIVESVGEGVTDVQPGDHVIPCYQAECKECKFCKSGKTNLCGKVRSATGVGVMMNDMKSRFSVNGKPIYHFMGTSTFSQYTVVHDVSVAKINPQAPLDKVCLLGCGVPTGLGAVWNTAKVESGSVVAVFGLGTVGLAVAEGAKAAGASRVIGIDIDNKKFDVAKNFGVTEFVNPKEHDKPIQQVLVDLTDGGVDYSFECIGNVSIMRAALECSDKGWGTSVIVGVAASGQEISTRPFQLVTGRVWKGTAFGGFKSRTQVPWLVDKYMKKEIKVDEYITHNMNLADINDAFHLLHEGGCLRCVLAMQI

SEQ ID NO: 77022 - protein, 200 aa, Synechococcus sp. RS9916
MTATGALRVGQQAPDFTATAVVDQEFKEVTLSQYRGKYVVLFFYPLDFTFVCPTEITAFSDRYADFSSKNTEVLGVSVDSQFSHLAWIQTPRNQGGLGDIAYPLVADLKKEIASAYNVLDEDAGVALRGLFIIDPDGVIMHSTINNLPVGRNVDETLRVLQAFQYVQSHPDEVCPANWTPGEKTMKPDPVGSKEFFAAVN

SEQ ID NO: 77023 - protein, 392 aa, Vibrio campbellii AND4
MTDQPISLEEIRLRLNELDDELLCLLSERRNLSIAVAKSKVKTSKPVRDAVREQQLLVKLIANGRDKYQLDAQYITKLFHTIIEDSVLLQQSYLQNLANPQQSRKPLARVAFLGAKGSYSHLASREYFSRKNTELIELNCEHFKEVTQTVESGHADYGVLPIENTSSGSINEVYDLLQHTTLYIVGELTQPIEHCLVATKDIRLENIKTLYSHPQPHQQCGEFLSRMKGVKLESCASTADAMKKVQELNRDDVAAIGNASSGKLYGLQAIQGNIANQTENHTRFIVVARKPVEVSTQIPAKTTLIMSTSQEAGSLVQTLLVIQRYGINMTKLESRPIMGNPWEEMFYVDLESHLGSNEMQQAIDELTKITKHLKVLGCYPSENVKPTQVKLS

SEQ ID NO: 77024 - protein, 79 aa, Bordetella pertussis Tohama I
MESIEQRVKKIVAEQLGVNEAEIKNESSFLDDLGADSLDMVELVMALEDEFETEIPDEEAEKITTVQQAIDYINSHGKQ

SEQ ID NO: 77025 - protein, 326 aa, Arabidopsis thaliana
MAVASLSICFSARPHLLLRNFSPRPKFVAMAAMSEDPIREWILTEGKATQITKIGSVGGGCINLASHYQTDAGSFFVKTNRSIGPAMFEGEALGLEAMYETRTIRVPNPHKAGELPTGGSYIIMEFIDFGGSRGNQAELGRKLAEMHKAGKTSKGFGFEVDNTIGSTPQINTWSSDWIEFYGEKRLGYQLKLARDQYGDSAIYQKGHTLIQNMAPLFENVVIEPCLLHGDLWSGNIAYDKNNEPVILDPACYYGHNEADFGMSWCAGFGESFYNAYFKVMPKQAGYEKRRDLYLLYHYLNHYNLFGSGYRSSAMSIIDDYLRMLKA

SEQ ID NO: 77026 - protein, 449 aa, Pseudomonas syringae pv. syringae B728a
MNAALNLWKDAHARRLSEYCAVRVIGRVSAVRGILLECKIPSAKVGDLCEVSKADGSLLLAEIVGFTQECTLLSALGPPDGIQVGAPIRPLGVAHRIGVDDSLLGCVLDGFGRPLMGDCLGAFAGPEDRRTTLPVIADALPPTQRPRITRALPTGIRAIDSAILLGEGQRVGLFAGAGCGKTTLMAELARNMDCDVIVFGLIGERGRELREFLDHELDETLRRRSVLVCATSDRSSMERARAAFTATAIAEAFRARGQKVLLLLDSLTRFARAQREIGIASGEPLGRGGLPPSVYTLLPRLVERAGMSENGSITALYTVLIEQDSMNDPVADEVRSLLDGHIVLSRKLAERGHYPAIDVSASISRILSNVTGREHQRANNRLRQLLAAYKQVEMLLRLGEYQAGADPVTDCAVQLNEAINAFLRQDLREPVPLQETLDRLLQLTSQLPE

SEQ ID NO: 77027 - protein, 446 aa, Schizosaccharomyces pombe 972h-
MSGQNNVVGVHYKVGRRIGEGSFGVIFEGTNLLNNQQVAIKFEPRRSDAPQLRDEYRTYKLLAGCTGIPNVYYFGQEGLHNILVIDLLGPSLEDLLDLCGRKFSVKTVAMAAKQMLARVQSIHEKSLVYRDIKPDNFLIGRPNSKNANMIYVVDFGMVKFYRDPVTKQHIPYREKKNLSGTARYMSINTHLGREQSRRDDLEALGHVFMYFLRGSLPWQGLKAATNKQKYERIGEKKQSTPLRELCAGFPEEFYKYMHYARNLAFDATPDYDYLQGLFSKVLERLNTTEDENFDWNLLNNGKGWQSLKSRNAETENQRSSKPPAPKLESKSPALQNHASTQNVVSKRSDYEKPFAEPHLNSASDSAEPNQNSLPNPPTETKATTTVPDRSGLATNQPAPVDVHDSSEERVTREQVQNATKETEAPKKKKSFWASILSCCSGSNEDT

SEQ ID NO: 77028 - protein, 81 aa, Oryza sativa
VFECDMLGVGTEAVAKKLAELTAKGVTTIIGGGNSVAVVEKVEVADVMTHIYTGGGAIVGVVKRKDLPRVGALDEAIPVAV

SEQ ID NO: 77029 - protein, 387 aa, Rhizobium sp. NGR234
MRPIYLDNNATTRVDAEVLQAMLPFFADVFGNASSMHDAGATAGAAINVARRQLQALIGAKFDPEITFTSGGTESNNAAILSGLEAMPERTEIVTSAVEHPAVLTLCTHLEKTRGTKVHKVPVDHQGRLDLDAYQDALTHRVAIVSIMWANNETGTIFPVVKLAEMAKKVGAIFHTDAVQAIGKLPIDLKSTAIDMLSLSAHKFHGPKGVGALYIKRGVPFHALIKGGHQERDRRAGTENTPGIVGLGKAAELALDCMDKDNAIIRSFRDRLEKGLLERVPQVFVMGDPVTRLPNTTSIAFEGVGGEAMQFLLNRHGIACSSGSACTSRSLSTSHVLKAMGTPHRQAVGAVRFSLSGYNCEEDIDRVLRVIPAVVKKLRESRPVFAG

SEQ ID NO: 77030 - protein, 124 aa, Synechococcus sp. RS9916
MAHGTPTWTCIHHCGACCRLAPEERQEALDALTEEQRETYLGMVGEDGWCKHYDSGGRRCRIYAERPDFCRVSSLADLFDVPAEDTDAFAIACCNQQIRSLYGGRSSEMRRFTRAVNRTVKGNA

SEQ ID NO: 77031 - protein, 384 aa, Bacillus halodurans C-125
MSHLFPTYAKWDVTITSGKGTKLYDNQGNEYLDFVSGIAVCNLGHCHPKVVAAVEEQLHSFWHVSNLFHIPIQENVAALLTEQSGMDAVFFCNSGAEANEAAIKLARKATGKHEIVTFTQSFHGRTLGTMSATGQDKIKTGFGPMLETFHHVPFNDIAALKQVVNEQTAAIVLEVIQGEGGVNLIDPEFAASVNHVCQEHGILLIIDEIQTGIGRTGTAFAFQQYELTPDIITVAKGLGNGFPVGAMLGKQHLIDAFSAGSHGSTFGGNPLAMAAAQAVLTEVFQPNFLQAVQEKGKQLLSGLNEALSGLEIVKEIRGNGLLVGIELQEEGAPFIKQLREKGLLVLNAGPNVIRLLPPLVVTSEELHEAVTQLKEVLDQASVHA

SEQ ID NO: 77032 - protein, 505 aa, Zea mays
MDDEDYSWVRRTRFSHSVVRSNSGREQFGAFVEQFNRGAALRQKGSASGFKLHGLNMEPGTRLSTSSLPTTSSFCAQPKPKPKDMSSSDAKPGQHAKAVSDRPSSQEASARKEDDAKASNGKKGIGKLSVAVPRVPAVQSAEVESPGALEFSFHPDEQSLKLQRACSSPAPFPRKKTPGDDALTRSSSLSVLGEAPKTKQRARSPLPSRHVAEVFQEAKSATKRFSTPPPPRRSASSLELNGCPPAPVTVRAPGKLKNRKEGHANGRMKVAATALEVLEKWSVDRSQLLIGHRFASGAHSRLFHGIYKEQPVAVKFIRQPDDEEDAELAAQLEKQFHTEVATLSRLNHPNVIKLVGACSSPPVFCVITEFLSGGSLRAFLHKLDHKALPLGKIISISLDIARGMSYIHSQGVVHRDVKPENIIFDDVFCAKIVDFGIACEEEYCDPLANDTGTFRWMAPEMMKHKAYGRKVDVYSFGLILWEMFSGTIPYEELNPFQAAFAVFDK

SEQ ID NO: 77033 - protein, 260 aa, Bacillus halodurans C-125
MGDIVVIKCGGSVLDSLSDSFFTSVRRLQAEGAKPIIVHGGGPAINGMLAKLEVETTFVDGLRKTTDSVLSVAEMVLCGQTNKKVVRKLQKAGVKSIGLSGSDGELVRVKAIDEAILGYVGEPVHVNGELLHMLVADGFVPVLAPIGVNDEFEPYNVNADTVAGAVATALQAKELIFVTDVAGILKDDELVPALTPEEVESLIEEGTIYGGMIPKVRSAIHSLTGTLEAVSIVNGNDVFFAESGKLIGTTIKKQVIHSQG

SEQ ID NO: 77034 - protein, 633 aa, Zea mays
  misc_feature (208)..(208): Xaa can be any naturally occurring amino acid
KYDYIKRCGSPIRSPDPPAWAPTRASFHRSSSFYRRLALAARWSGGLSLQPILLDSFYCLAAGSMDKQEPVANGEQTIGLAEKPKELPVASKDEKATVPPILVDSNAFNLPSEGQTQAGTSNMDGGHNGAHNFYASQAQPFYYQGSGSENPTQAWDTYPPYMSVEGLEVGPPVVYNEDPSLMFHGGYGYDPYYSPIATPVPNAVSGGXTIMPIDPTQGAFIADTLSPNSFLFGPRPEWFRSSEGTGSFPSPAASPQPSRGVPGSYDQNNFPMASRMSSPHQKPFYGLRSTTDSYGRGFSHGGMFPQASNYGGSVTSFGLNGRSLISTEKGRRRGRGNALICSCNGPLDFLNEQSRGPRATKPKKQPEVDSKDEVPTTGVGRELYNKPDFVMEYTNARFFIIKSYSEDNVHKSVKYGVWASTTNGNKKLDSAYREAKEKGEHCPIFLLFSVNASAQFCGVAEMIGPVDFEKSVDYWQQDKWTGQFPVKWHIVKDVPNNLFRHIILENNDNKPVTNSRDTQEVKLEQGMEMLKIFKNHDDDASILDDFEFYEEREKALQENKARLHQQHLPSSIVIEPKKPLTAPSDLVGHITKSFAEAVRLGEAKTVSHLTEKVSGGDPSIPVKHVEVKQSGLS

SEQ ID NO: 77035 - protein, 634 aa, Erwinia carotovora subsp. atroseptica SCRI1043
MSKEKTFDVICMGRVAVDLYGQQIGARLEDMGSFSKYLGGSSGNVAYGTARQGLRSSMLARVGDEHMGRFLREELNQVGCDTSHLITDKERLTALVLLGIKDRDTFPLIFYRDNCADMAISPEDFTEDYIASSRCLAITGTHLSHPNTRAAVLTALQYARRNGVKTALDIDYRPVLWGLTSLGDGETRFVEAQAVTAQLQQVLSLFDVIVGTEEEFYIAGGSTDTLQALRTVRQHTQAELVCKRGALGCSVFSDAIPDHLDKGITIKGVRVDVLKVLGAGDAFMSGLLRGYLNGEGWEKACAYANACGALVVSRHGCAPAMPSKIELDNYLARAASVPRPDLDEELNHLHRVTTRRKQWDELCVIAFDHRSQLEDMALNCGTEISRIPALKKLILRASYDAAQQAGLEGKAGLLCDGTFGQDALNDITGKGWWIGRPIELPGSRPLIMERGNIGSQLVSWPLEHVVKCLVFFHPEDAHALRREQEMKVMEVYQACRQSGHELLLEVILPAGMPHSDALYLRAIQRFYNLGVRPDWWKLPPLSSDGWEQLTPLLAERDPYCRGVVILGLDAPLETLQQGFSAAVNFPIVKGFAVGRTLFAQPAQKWLRNEIDDAELIEQVKHNYLQLIAVWRQRG

SEQ ID NO: 77036 - protein, 516 aa, Vitis vinifera
MLLLFSQSSANQWLLALGILSFPILYLFLLQRWKKKGIEGAARLPPSPPKLPIIGNLHQLGKLPHRSLSKLSQEFGPVLLLQLGRIPTLLISSADMAKEVLKTHDIDCCSRAPSQGPKRLSYNFLDMCFSPYSDYWRAMRKVFVLELLSAKRAHSLWHAWEVEVSHLISSLSEASPNPVDLHEKIFSLMDGILNMFAFGKNYGGKQFKNEKFQDVLVEAMKMLDSFSAEDFFPSFGWIIDALTGLRARHNKCFRNLDNYFQMVVDEHLDPTRPKPEHEDLVDVLLGLSKDENFAFHLTNDHIKAILLNTFIGGTDTGAVTMVWAMSELMANPRVMKKVQAEVRSCVGSKPKVDRDDLAKLKYLKMVVKETFRMHPAAPLLIPHRTRQHCQINANGCTYDIFPQTTILVNAFAIGRDPNSWKNPDEFYPERFEDSDIDFKGQHFELLPFGAGRRICPAIAMAVSTVEFTLANLLYCFDWEMPMGMKTQDMDMEEMGGITTHRKTPLCLVPIKYGCVE

SEQ ID NO: 77037 - protein, 264 aa, Sulfitobacter sp. EE-36
MHSDPDILRVGHLLADAARAAILPHFRQADLIADNKFQSGYDPVTEADRAAERAMRDILARKRPNDAILGEEYGIAEGTSGLTWVLDPIDGTRGFVSGTPTWGVLIAVSNADGPFFGIIDQPYIRERFVGHSGQAEVSGPSGVHPLRTRGARALSQATVFTTFPEVGTTSEGAAFAEVARHARLARFGMDCYAYALVASGQVDLVIEAGLQPYDIQAPIALVQAAGGIVTDWDGGPAHHGGRAIAAANADIHAEALEFVRNCPI

SEQ ID NO: 77038 - protein, 518 aa, Rhodobacter sphaeroides 2.4.1
MTQHDRLLIIDFGSQVTQLIARRLRELNVYCEIHPYQNVTEAFLKGFAPKAVIFSGGPSSVFAEGAPMPPAGVFDLGVPILGICYGQQVMMHCLGGKVERGHGTAEFGRAFVTPTAERLAILDGWFEEGREQVWMSHGDHVSQIAPGFQVFGTSPNAPFAITGDPARHFYAVQFHPEVHHTPKGAKLYENFVRLAGFKGDWTMGAYREEAIARIRAQVGDQKVICGLSGGVDSSVAAVLIHEAIGDQLTCVFVDHGLLRLGEAEQVVKMFRDHYNMPLIHADESDLFLGALEGVSDPEVKRKTIGRLFIDVFQKHAADVGGATFLAQGTLYPDVIESVSFSGGPSVTIKSHHNVGGLPEKMGLKLVEPLRELFKDEVRALGRELGLPESFIGRHPFPGPGLAIRCPGEITREKLEILRRADAVYIDQIRRHGLYDEIWQAFVALLPVRTVGVMGDGRTYDYACALRAVTSVDGMTADYYPFTHDFLGETATRIINEVQGINRVTYDITSKPPGTIEWE

SEQ ID NO: 77039 - protein, 389 aa, Prochlorococcus marinus subsp. marinus str. CCMP1375
MILAAGKGTRVQPITHVIPKPMIPILQKPVMEFLLELLKEHGFKEIMVNVSHLAEEIENYFRDGQRFGVEIAYSFEGRIEDGELVGDALGSAGGLKKIQDFQEFFDDTFVVLCGDALIDLDLSEAVKRHKEKGALATLITKSVPKDQVSSYGVVVTDEGDRVKAFQEKPSIDEALSNNINTGIYLFEPEIFKYIPSNKPFDIGADLFPKLVQVGAPFFALSMDFEWVDIGKVPDYWKAIRSVLLGDVRQVEIPGKEVMPGVFAGLNVAANWDKINIEGPIYVGGMTRIEDGSTIIGPSMIGPSCYICEGATIDNSIIFDYSRIGPGVQLLEKLVFGRYCVDKNGDHLDLQEAALDWLITDARRQDLGEPSPQQKAMAEFLGTDLIGSGG

SEQ ID NO: 77040 - protein, 405 aa, Triticum aestivum
  misc_feature (246)..(246): Xaa can be any naturally occurring amino acid
  misc_feature (296)..(296): Xaa can be any naturally occurring amino acid
MGVLSRPEEVPALLRLKLAAGRIRRQIPPQDHWAFAYDMLQRVSRSFALVIQQLGPDLRNAVCVFYLVLRALDTVEDDTAIPNEVKLPILRDFYRHIYNPDWLFSCGANDYRVLMDNFRQVSTAFLELGEGYQKAIEEITRRMGEGMAKFICTEVETIDDYDEYCHYVAGLVGYGLSRLFHATGTEDLAPDHLSNSMGLFLQKTNIIRDYLEDINEIPRCRMFWPREIWSKYVDKLEDLKYEENSXKRAVQCLNDMVTNALIHAQDCLQYMSALKDNSNFRFCAIPQIMAIGTCAXCYNNVKVFRGVVKMRRGLTARITDETKSISDVYSAFYEFSSLLESKIDDNDPNAALTRRRVDAIKKTCKSSGLLKRRGYDLEKSMYRMPMLIMIALLLVAIILGVLYGK

SEQ ID NO: 77041 - protein, 342 aa, Zea mays
  misc_feature (99)..(99): Xaa can be any naturally occurring amino acid
  misc_feature (142)..(142): Xaa can be any naturally occurring amino acid
  misc_feature (271)..(271): Xaa can be any naturally occurring amino acid
  misc_feature (311)..(311): Xaa can be any naturally occurring amino acid
  misc_feature (330)..(330): Xaa can be any naturally occurring amino acid
AYSPATPTPILVQEISCYLGLELRQIKIERVVDGGIYVQLEESVHGCHVFQVQSTCPPSNENLMELLIMIDACRKASAKNINAGIPYFGYARADKKVRXEKKKKAKLVANLIMEVGAHRVLACELHSGQSIDYFDIPVDHVXHSQPIILDYLASKTICPEDVVVVSPDMGGVARPRAFAKKLSDAPLAIVDKRRPGHNQAEVVHLIDDVRGKVVVMLSDAPLAIVDKRRPGHNQAEVVHLIHDVRGKVVVMVDGMINTTENISKGAELLHXGARVVYTCSTHAVLNSPPALQRLFSDLFQEVIITNTVPVXQLTVLSVANLLGETIWRGXVHDDCSVSSIFQ

SEQ ID NO: 77042 - protein, 230 aa, Triticum aestivum
MATSALATLSATAAAAGARRALLSRGPSSSLSFASRRLAPAGSLRAGPLPRAATRALSATASPAATTAIAVGDRLPEATLSYFDAPDGELKTVTVRDLTAGKKVVLFAVPGAFTPTCTQKHLPGFVARAGELRAKGVDTVACVSVNDAFVMRAWKESLGVGDEVLLLSDGNGELTRAMGVELDLSDKPVGLGVRSRRYALLADDGVVKVLNLEEGGAFTNSSAEDMLKAL

SEQ ID NO: 77043 - protein, 491 aa, Rhizobium leguminosarum bv. viciae 3841
MSSQIIPVEPFDYVVFGGSGDLAERKLLPALYHRQIEGQFSEPTRVIGASRSPLTHEEYRKFAKDALNEHLKKGEYDEAEVQKFCARLYYVSVDARTDAGWDQLKKLLDEGKDRVRAFYLAVAPGIFGDISQKIHDHKLITKSTRIVVEKPIGRDLASALQLNDTIGRAFKEEQIFRIDHYLGKETVQNLMALRFANALYEPLWNANYIDHVQITVAESVGLEGRAGYYDTAGALRDMVQNHILQLLCLTAMEVPSSMDSEAVRDEKLKVLRALKPLNASNVEQATVRGQYRAGASGSGPVKGYLEELEGGVSNTETFVAIKAEINNWRWAGVPFYIRTGKRLTGRMSEIVITFKPIPHAIFDQAAGRINANQLIIRLQPDEGVKQSLMIKDPGPGGMRLRNVSLDMSFAQAFNVRNPDAYERLLMDVIRSNQTLFMRRDEVEAAWKWVDPILKGWETTGQQVQGYTAGTWGPSQAIALIERDGRTWHDEI

SEQ ID NO: 77044 - protein, 426 aa, Chlorobium tepidum TLS
MTIDLDFDRCHLWHPYTSMADPLPVWPVKRASGVMIELEDGRKLIDGMSSWWAAIHGYNHPVLNRAVTEQLGRMSHVMFGGLTHEPAIELGKILTSLLPDPLDRIFFCDSGSVAVEVAIKMALQYWLAAGKPGKKRLLTVRSGYHGDTFMAMSVCDPVTGMHSLFSGAVPEQLFVEAPACGFNEPWREEAIDKMRQALEDHANTIAAVIIEPIVQGAGGMRFYSPHYLRRLRELCTEHGVLLIFDEIATGFGRTGKLFAMEYASVTPDIVCLGKALTGGYMTLAATVTTGHVADTISGGNPGLFMHGPTFMANPLACAVAVASLKLLLSGDWQSTVWRIERQLAEELAPCTGMTGVRDVRVLGAIGVVELDRPVDMAKIQQAFVERGIWVRPFGRLVYLMPPFIIRDNELTRLTSVICEVIGAEYR

SEQ ID NO: 77045 - protein, 579 aa, Physcomitrella patens subsp. patens
MSRPEPVYPVTESTACLGRHLARRLVEIGCNDIFTVPGDFNLVLLDHLISEPGINNIGCCNEINAGYAADGYARWKGVGCVVVTFTVGGLSVINSIAGAYSENLPVICIVGGPNSNDFGTNRILHHTIGVSDFSQEARCFQAVTCFQAVINCLDDAHQLVDRAISTCLLESKPVYISVSCNLAGIEHPSFTHSTIPYAIKEQRSNKTSLEAALDAAVKFLNHTVKPVLVGGPKLRLGKAKEAFQELVEASGYAYATMPSAKGQPLESHPHFIGTYWGAVSSPFCLEIVESADAYIFVGPIFNDYSSVGYSLFLKKDHMIVVNPDRVQICGKAEFGCVLMKDFCMELSKRITRNSTSFENYKRIHVPEGTIPSSGAQDPLRVNVLFKHIQGMLSHDTAVLAETGDSWFNCQKLKLPAGCGYEFQMQYGSIGWSVGALLGYSQALKGIKRVIACIGDGSFQVTCQDVSTMMRQNQNSIVFLINNGGYTIEVEIHDGPYNVIKNWNYVAMIQAIHNGEGNVWATKVTNEPQLIAAIATATTDKKDAFCFIEVICHKDDTSKELLEWGSRVSAANGRPPSIQI

SEQ ID NO: 77046 - protein, 179 aa, Glycine max
MVSSKIFFLFLLFLAHLHQHASVEGDSSLIKRTCKNTKYYNLCFSSLKSDPSSPNADPKGLAVIMIGIGMTNATSTSSYLSSKLPTPSNNTTWKRVLKECADKYSYAGDALQDSVQDLANEAYDYAYMHITAAKDYPNACHNAFKRYPGLVYPRDLARREDGLKHICDVAMGIIDNLDW

SEQ ID NO: 77047 - protein, 639 aa, Zea mays
MGNTCVGPSITMNGFFQSVSTALWKTPQEGDALPAAANGPGGPAGAGSQSALPKPASDVHHVAVQSEAPEPVKIAAYHSEPAPAVRSEAPEPVKIAASHSEPAPMAAKPGGAAANASPSPSPRPRPQVKRVSSAGLLLGSVLRRKTENLKDKYSLGRRLGQGQFGTTHLCVERATGKELACKSILKRKLGSDDDVEDVRREIQIMHHLAGHPSVVGIRGAYEDAVAVHLVMELCGGGELFDRIVRRGHYTERKAAELARVIVGVVEACHSMGVMHRDLKPENFLFADHSEEAALKTIDFGLSIFFRPGQIFTDVVGSPYYVAPEVLKKRYGPEADVWSAGVIIYILLCGVPPFWAENEQGIFEEVLHGRLDFESEPWPSISDGAKDLVRRMLVRDPRKRLTAHEVLRHPWVQVGGVAPDRPLDSAVLSRMKQFSAMNKLKKMALRVIAENLSEDEIAGLREMFKMIDADNSGQITFEELKVGLEKVGANLQESEIYALMQAADVDNNGTIDYGEFIAATLHLNKVEREDHLFAAFQYFDKDGSGYITADELQVACEEFGLGDVQLEDLIGEVDQDNDGRIDYNEFVAMMQKPTVGGSRRRPICRTASASGSASGSGRRSGWPRPLCLWLPCCLRVGVDD

SEQ ID NO: 77048 - protein, 140 aa, Silicibacter pomeroyi DSS-3
MALERTFSIIKPDATRRNLTGKINAKFEEAGLRIVAQKRIHMTKEQAGVFYGVHAERPFYDELCEFMSSAPVVVQVLEGENAIAKNREVMGATNPADAAPGTIRAEFAESVGENSVHGSDAPETAAVEIAYFFSGIELVG

SEQ ID NO: 77049 - protein, 431 aa, Moritella sp. PE36
MGFSALNLNQNLINTVTKLGYETPTPIQAQAIPAILEGRDIMGGAQTGTGKTAAFALPIIHQLMAEQLTANATEPTAKKQIRALILTPTRELSQQVHKSFVTYSEDSELTSELVYGGVSINPQVKALVQGADILVATPGRLLDLLDRETLTLEFVEKIVFDEADRMLDMGFMEEIRRILKHLPKKRQTMLFSATFDDAIFKLSKSLLNDPLLVEVDTRNAAAEQVEQIVYAVDNDRKRELTSYLIGSRNWHQVLIFTRTKQGADSLAKEMCKDGIKTIAVHGDKSQGARERGLEDFKNGKVRALVATDVAARGLDIEQLKHVINFELPFKAEDYIHRIGRTGRAGLSGTATSLVSIGENWLLEEIETLLDTRLVAQWLPGYEPDLSKPVDDGRGKGGGKGNGRTDDKRRAKNRSYGKKTNNRAKKDTKPSR

SEQ ID NO: 77050 - protein, 408 aa, Bordetella pertussis Tohama I
MELLTILLIAAVLCVPLAQRLGLGAIPGYLLAGGVIGPSGLGLVTDVPDIMRVSEWGVVMMLFVIGLELAPKRLWAMRREVFGAGTLQMVVCGALLGAVFGAGLRHLAGMGWQAAILCGLSLALSSTAVALRLLEERGLVRTPLGRSALGVLLLQDMAAIPMLVAAGLLGSDGDSAPSFEAALVAVVVVLACYRLRLLDWAARSQLHELFTAATLLVVLGTAQLFDYAGLSAGLGGFLVGMLLAESRHRNELEHTIEPFKGLLLGLFFLAVGMSVNVEEALDYWPYVLAGVVALLSLKALVLYGIARLMGLPHYHRLLYALVLAQGGEFSFVIFNEAWDNHLMSLEQRDLLAIVVAISMGAVPIVIRLLERLPGRYGGIGDMAVTPVGFAGSPPPQSAADNEERSGPG

SEQ ID NO: 77051 - protein, 616 aa, Silicibacter pomeroyi DSS-3
MLRIENITYAVEGRPLFDGASAVIPDGHKVGLVGRNGTGKTTLFRLIRGELALETGTIALPRRARIGGVAQEAPASDVSLIDTVLAADTERAALMAEAETATDPIRIAEVQTRLADIDAWSAPARAASILKGLGFDDDEQLKPCSDFSGGWRMRVALAAVLFSQPDLLLLDEPTNYLDLEGALWLESYLAKYPHTVIIISHDRGLLNRAVGAILHLEDRKLTLYQGPYEQFARQRAENLAQAQAMAKKQEARRAHLQSYVDRFRYKADKAKQAQSRLKALARMQPISSPQEAALRAFTFPKPEEMSPPIIHLEGGVTGYGQTEVLKRLNLRIDQDDRIALLGKNGQGKSTLSKLLSDRLPLMAGRMTRSPKLRIGYFAQHQVDELYVDETPLDHLRRLRPGETPAKWRARLAGFGLGAEQAETAVGRLSGGQKARLSLLIATLDAPHMLILDEPTNHLDIESREALVEALTDYTGAVILVSHDMHLLTLVADRLWLVSDGSVKPFEGDLEAYRDFLLARDKPESPKPAEAKPKRASRDTVLALRAELRKCEERVEKLSEMHDKLAAKLADPALYADDKVSDLEVWNRKYAELKDAMERAETLWMEAQEKLDAVQAT

SEQ ID NO: 77052 - protein, 575 aa, Ustilago maydis 521
MEYSSVRAVAEQSARPSSSRSPESNYWRKFRTPVFVKELAPITSIHFVPPVSVYSTTALDEDVSSTGAASTIGSTSTQPTSVSARQKFAVTTGARVQIYSMRNSRVSKTISRFKDVARSASFRSDGRLMVAGDDSGLIQVFDTTSRAILRTMRGHSGPVHVTRFSPNGIEIMSAADDRTVRLWDVPEQKAVHVFEGHNDYVRSAVFSPDNPALMLSGSYDSTVKLWDSRMAEQGGCAMTMNHGASVEDVLVYPTGGGGVALSAGGAVMKVWDLMMGGRCMASISNHQKTITSLALSVNSGAEFSVDNSESIGGMRILTAGLDHLVKVYDPAQDFKVTHTMRYASPILSMAVSPDESHIAVGMADGTLCVRKRDLKASELERREAERAAMNAGAYEFFMQGKAAASNQPGKINTRRATDDIRVDSVRKRKLQDYDRFLKAFRYSDALDAALRKGVAPSVTFGLILELIHRSPRGSLDGLRRAISNRDDVTLEPVLRFLLRHAANPSYVDLVCDTLNVIVDTYASVIGQSPLIDDLFGRIWAKVSDELRLQRDLMQVRGSLEMILAATALGAASAVA

SEQ ID NO: 77053 - protein, 236 aa, Anabaena variabilis ATCC 29413
MTVTADPVTLMKQEVGKAAAALVKSGSIVGLGTGSTTAYTIQYLGDRLKSGELTDIVGIPTSFQSEVLSKQYGVPLTTLDAVDHIDIAIDGADEVDPQKNLIKGGGAAHTREKVVDYLANQFIVVVDSGKLVDRLGSVFAVPVEVIPMAITPVTNAIKQLGGKPELRMGVKKAGPVITDQGNFVLDVRFDSIDDPVNLEKILNNIPGVLENGIFVNCADIVLVGEVKDGQPLVRQL

SEQ ID NO: 77054 - protein, 297 aa, Zea mays
MSTAEQEIPSTSIYIPHSSTLCNDYDAFDIGFITTDEFGNADILEATYPAVAKRLHGDWIQDPAIPVVTGFLGKGWKSGAVTTLGRGGSDLTATTIGKALGLREIQVWKDVDGVLTCDPNIYPHAKTVPYLTFEEATELAYFGAQVLHPQSMRPAREGDIPVRVKNSYNPKAPGTLITRQRDMDKVVLTSIVLKSNVTMLDIVSTRMLGQYGFLARELDHVVEELEKIAIVRLLQQRAIISLIGNVEQSSLILEKTGRVLRKSGVNVQMISQGASKNCLQTPQSELRAPIVNKMASL

SEQ ID NO: 77055 - protein, 506 aa, Brassica napus
MTSINVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVRKADPSRNGTCNDSSWLDFLRKIQERSGLGDETHGPEGLLQVPPRKTFAAAREETEQVIIGALENLFKNTNVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLSNKPRDRRRSKYELVHTVRTHTGADDKSFRCVQQGDDENGKTGVSLSKDITDVAGRTVKKNIATLGPLILPLSEKLLFFVTFMGKKLFKDKIKHYYVPDFKLAIDHFCIHAGGKAVIDVLEKNLGLAPIDVEASRSTLHRFGNTSSSSIWYELAYIEAKGRMKKGNKVWQIALGSGFKCNSAVWVALNNVKASTNSPWEHCIERYPVKIDSDSGKSETRAQNGRS

SEQ ID NO: 77056 - protein, 506 aa, Brassica oleracea
MTSINVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVRKADPSRNGTCDDSSWLDFLRKIQERSGLGDETHGPEGLLQVPPRKTFAAAREETEQVIIGALENLFKNTNVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLSNKPRDRRRSKYELVHTVRTHTGADDKSFRCVQQGDDENGKTGVSLSKDITDVAGRTVKKNIATLGPLILPLSEKLLFFVTFMGKKLFKDKIKHYYVPDFKLAIDHFCIHAGGKAVIDVLEKNLGLAPIDVEASRSTLHRFGNTSSSSIWYELAYIEAKGRMKKGNKVWQIALGSGFKCNSAVWVALNNVKASTNSPWEHCIDRYPVKIDSDSGKSETRAQNGRS

SEQ ID NO: 77057 - protein, 209 aa, Lactococcus lactis subsp. lactis
MNNISLSSKILKVSKGQLEIKNGVFTLYAFMIYYEGRCEEHYALVNSKDWKIDEAVPFRINSACVTSEVFGCEKCDCKWQLDEAIHYITEIGFGIITYHPNHEGLGHGIFEKLNSFNELGADNTSYIDLNCEKEDARNFLPALIILDYFKINEVTLLGNNLKKIHFLMENGVNISGIVNLIYNGNNRTTKKYILLKGRKPEHFALRKDK

SEQ ID NO: 77058 - protein, 506 aa, Brassica rapa
MTSINVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVRKADPSRNGTCDDSSWLDFLRKIQERSGLGDETHGPEGLLQVPPRKTFAAAREETEQVIIGALENLFKNTNVSPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLSNKPGDRRRSKYELVHTVRTHTGADDKSFRCVQQGDDENGKTGVSLSKDITDVAGRTVKKNIATLGPLILPLSEKLLFFVTFMGKKLFKDKIKHYYVPDFKLAIDHFCIHAGGRAVIDVLEKNLALAPIDVEASRSTLHRFGNTSSSSIWYELAYIEAKGRMKKGNKVWQIALGSGFKCNSAVWVALNNVKASTNSPWEHCIDRYPVKIDSDSGKSETRVQNGRS

SEQ ID NO: 77059 - protein, 506 aa, Brassica napus
MTSINVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVRKADPSRNGTCDDSSWLDFLRKIQERSGLGDETHGPEGLLQVPPRKTFAAAREETEQVIIGALENLFKNTNVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLFNKPGDRRRSKYELVHTVRTHAGADDKSFRCVQQGDDENGKIGVSLSKDITDVAGRTVKKNIATLGPLILPLSEKLLFFVTFMGKKLFKDKIKHYYVPDFKLAIDHFCIHAGGRAVIDVLEKNLALAPIDVEASRSTLHRFGNTSSSSIWYELAYIEAKGRMKKGNKVWQIALGSGFKCNSAVWVALNNVKASTNSPWEHCIDRYPVKIDSDSGKSETRAQNGRS

SEQ ID NO: 77060 - protein, 290 aa, Oryza sativa Japonica Group
MKLEVLWRVLERCAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 77061 - protein, 268 aa, Oryza sativa Japonica Group
MCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 77062 - protein, 303 aa, Oryza sativa Japonica Group
MATAGKVIKCKAAVAWEAGKPLSIEEVEVAPPQAMEVRLKILYTALCHTDVYFWEAKGQTPVFPRIFGHEAGGIVESVGEGVTELSPGDHVLPVFTGECGDCRHCLSEESNLCDLLRINTDRGAMIGDGQTRFTARGGQPVYHFLGTSTFSEYTVVHVGCVAKIHPAAPLDKVCVLSCGISTGFGATVNVAKPPKGCTVAIFGLGAVGLAAMEGARISGASRIIGVDLNPAKFELAKKFGCTDFVNPKDYDKPVQQVIIEMTNGGVDRSVECTGNAAAMISAFECVHDVRTPSHPLIHHIYFQ

SEQ ID NO: 77063 - protein, 382 aa, Thermoplasma acidophilum DSM 1728
MQKKLMHVGPSFTSYRIQMAGVSENTGFASPDFLDAMKYSLEGLLYVAGADDSYMPFILPGSGTVAMETVTSLIPRGSKTLLLTNGVFGDRWIPILTAHGLQMDVLSADPGHAVSMADIEEKLEGGDYQNLIMTHVETSTGVRMDIEGVSKIARKHVERIIVDGVASLGAEREDIARLGITAIISASQKALGAPPGAALIVASRSALEDINEFSYFFNLKNWITPMERYLEGKNGYLSTEPVGVILSLNRVFSDIRTTGLEARIDDHRRLSLALNEGIEAAGLKVLAERDLWSNTVTAVLSDHADEIVRRSMDLGIEFATGVHPKLLGKYFRIGHMGYVNDFDALSALSVIERAAAQSGEKVRIGEGVRRAQQVLYDLSHGR

SEQ ID NO: 77064 - protein, 324 aa, Vitis vinifera
MVLISHTGKRRLKDLLLKSDNRTCADCGAPDPKWASANIGVFICLKCCGVHRSLGTHISKVLSVALDDWSDDEIDAMVEVGGNSSANSIYEAFIPEGVTKPKPNSSHEERMRFIRSKYELQEFLKPSLRIASVSSGKSSLQSSFSRKLMDNFRSSNSQKLEGMVEYIGLLKVKVIRGKNLAVRDMLSSDPYVVLTLGPQTVQTQVITSNLNPVWNEELMLSVPMDYGPIKVKVFDHDTFSADDIMGEAEIDIQPLITSAMAFGNAEMFGDMQIGKWLKSHDNALLEDSIINIIGGKVKQEVQLKLQNVESGELDLEIEWLPLDQ

SEQ ID NO: 77065 - protein, 348 aa, Glycine max
MATPNNNNNNPNIINNNNIATAKPGTLGVGVGAVPTPPKSQRGHNKPKCKQCGNVARSRCPYECCKSCCSRNQNPCHIHVLKANSTFPDKAPSSGASPLDQQSLDPPQSTAGRVASLRQLSNSFAQFNNLHLSLRSKKPLTRKDAAAINEWRFAKIKEYKERNVEVENEAFDRYMQNVDLLEEVLAVKSLDENVPSALESNPTTMESNEAMIPGLKLQLRSNSMRSDGLRMRIQQIVDEGLKKLKKSAVDGDINESIDDESNKASERGKGIERLSAISDLMEKINKARTEEDLKPCLEMKTQLFNLDEGASVKDLQDNEMHENETVVTDVVPAEGLDYSLPKFVSSLP

SEQ ID NO: 77066 - protein, 73 aa, Glycine max
AFSMIFSPAVITVNLAGADMVAPFTVLMSMAGFPTRKTNNDITSIASNGGRVQCMQVRPPICKNKSETLSYLA

SEQ ID NO: 77067 - protein, 378 aa, Zea mays
  misc_feature (306)..(306): Xaa can be any naturally occurring amino acid
  misc_feature (346)..(346): Xaa can be any naturally occurring amino acid
MSTHAPRDIQARLWCSSPIARERVLSNGGGRNPQSLVDVDGDHGSATATQEIGAPKRAKWIHERKLFLIQLLKDHNVPGFRTQNAWSKEAWNNIVRRLNEKFGTSYTIGQVKQKEQDLKKDYRSVKELVEQSGFGWNGERMMVEAPDSVWASFAARKNNKSALHWRDKSFPYYDDLSKLYDGRYAEGRTRQGMDHYANKTKKASAPGGQATTVAETYQSPSPTLNGVDELGLQFSFDEEIEGNLGLSQYPSAQVHEKEVPPSSTQITSELPDSRRGKKKKNKSASPPDGFHERYLKLKKEEIDRFXAIEEKKLEDPYSINKCITVLEDLDGLQVGDLLMASDIFKXKDNREVFLSFKNDALRLAWITREIGKIADHQN

SEQ ID NO: 77068 - protein, 78 aa, Zea mays
DERLLSHGDVALIRSDLAILRGPCFINDRSIAFYFAHLSASLQDDDLLLLPSSIPYLLSNLPDSAADAAVAEPVCSPP

SEQ ID NO: 77069 - protein, 172 aa, Triticum aestivum
QSLRKHTKAYLDCHLMVTNPSDYVEPFGKAGASGFTFHIEVARDNWQDLIQSIKSKGMRPGVSLRPGTPVEEVFPLVEAENPVELVLVMTVEPGFGGQKFMPEMMDKVRTLRKKYPSLDIEVDGGLGPSTIDVAASAGANCIVAGSSIFGAADPGAVISVLRKSVEGSQNKN

SEQ ID NO: 77070 - protein, 258 aa, Pseudomonas syringae pv. syringae B728a
MFERLREDIQSVFHRDPAARNAFEVLTCYPGMHAIWLHRFAHILWRNGWKWPARVVSNFGRWMTGIEIHPGARIGRRFFIDHGMGIVIGETAEIGNDVTLYQGVTLGGTTWNAGKRHPTLEDGVVVGAGAKVLGPFTVGAGAKIGSNAVVTKAVPAGATAVGIPGRIIVKSDDEVEARRKAMAEKLGFDAYGVSADMPDPVARAIGQLLDHLQAVDGRLEGMCDALGRLGSDYRAKELPELRDEVFDCVKDCQEGKVG

SEQ ID NO: 77071 - protein, 391 aa, Streptomyces avermitilis MA-4680
MKAAVYEGPRTVAVKDVPDAKIEHPCDIIVKITTTNICGSDLHMYEGRTSFESGRTLGHENMGQVVEVGSAVRKVQVGEYVVLPFNIACGFCKQCERGLTNYCLTMQPEPALAGAAYGFADMGPYQGGQAELLRVPYGDFNALRLGEDAAEWQTDYVMLADIFPTGYHATEMAHVKPGDQTIVFGAGPVGLMAAYSALLKGAGRVWVADHQPDRLRKAEEIGAIPINTAEQKPGEVVKEATLGLGADNGCECVGYQAHDPEGHEDASLTLNGLIDSVRFTGDIGVVGVFLPQDPGGAEAQGELEAQGKVPLDFGLMWFKGQHMGTGQAPVKRYNRALRDLIAGGKAKPSFVVSHELSLDEAPTAYEHFDARDEGWTKVVLHPNGHGNGHKR

SEQ ID NO: 77072 - protein, 389 aa, Anabaena variabilis ATCC 29413
MKAVCWYGANEVRVENVPDPKILNPRDAIIKITSTAICGSDLHIYGGYIPTVQQGDIIGHEFMGEVVEVGSGVDNLKIGDRVVVPSTIGCGRCHYCEHDMWSLCDNSNTKGWLEEKLYGNITSAIYGYSHLLGGYAGAQAEYIRVPFADVGVVKVPPDLPDEMLLFISDAIPTGYMGAEMCDIQPGDTVAVWGCGAVGQFAMISAYMMGAEKVIAIDRFPERLEMARKYAKAEVINYEEVNAGEALKEMTGGRGPDACIDAVGLEAHGVGLEDFYDQTKQKLKLESDRPHVLREMMVACRKGGTLSIMGVYGGFVDKIPFGAAFNKGLTFRMGQMHGQKYMNLLLQLILDGKLDPSFVVSHQLPLEQAPFGYHIFQQKKDNCTKVVLKP

SEQ ID NO: 77073 - protein, 128 aa, Pseudomonas syringae pv. syringae B728a
MAYSEKVIDHYENPRNVGKMNAEDPDVGTGMVGAPACGDVMRLQIKVNEQGVIEDAKFKTYGCGSAIASSSLATEWMKGKTLDEAETIKNTQLAEELALPPVKIHCSVLAEDAIKAAVRDYKQKKGLL

SEQ ID NO: 77074 - protein, 336 aa, Rhizobium sp. NGR234
MLHTTVTQLIGQTPVMSIDVPGRNATLVLKIEKNNPGGSMKDRMARSMVIAALQDGRLPPGGTIVESSSGNTGTGLALAALEFGLRFIAVVDHHAAPDKIRMMRALGAEIRYVEGDFREDEVAVVERQRLAAQLGAQLPGALFMNQSDNPANPEGYTGLVDELVAQLPDGIDAFVGCVGTGGSMTGISQRLKRNNPAVRTIAVEPAGSIVFGKPGHPYYQSGTGTPAGDEVGKVLDYGCIDEGVQVTDTQAFETARYIARRKGLLVGGSTGGAIYKALEFIGAGKLTGTVVTTVADGGEKYLGTIFDEEWMAKRRLLDPAIAAQLDGWLFGKARAA

SEQ ID NO: 77075 - protein, 392 aa, Anabaena variabilis ATCC 29413
MKAVCWHGTNDVRVETVPDPKILNPRDAIIKITSTAICGSDLHIYNGYIPTMQSGDILGHEFMGEVVELGSAVKNVKVGDRVVVPFTISCGSCFFCQRDLWSLCDNSNPNAWMVELQMGHSPAGLFGYSHLFGGYAGGQAEYARVPFADVGLLKIPDNLPDEQVLFLTDIFPTGYMAAENCNIKPGDIVAVWGCGPVGQFAIKSAYMLGAERVIAFDRIPERLQMAKEQCNAEVLNYEEVNIGEALKEMTGGRGPDACIDAVGMEAHGTDLMAFYDQVKQAVRLETDRPTALRQVIVSAAKGGHVSLAGVYGGFLDKIPMGSAMNKGLTFKMGQTHVHKYLRPLLERIQNGEIDTSFVITHTLPLEQAPHGYEIFKHKKDNCIKVVLKPSGN

SEQ ID NO: 77076 - protein, 250 aa, Zea mays
LIAKGCKKVVVVNRSVERVDAIREEMKGIEIVYRPLSEMYEAAAEADVLFTSTASETPLFTKEHAEALPTISDAMDGARLFVDISVPRNVSACVSEIGSARVYNVDDLKEVVEANKEDRLRKAMEAQTIIAEELKRFEAWRDSLETVPTIKKLRSYADRIRASELEKCLQKIGDDALTKKTRRAIEELSTGIVNKLLHGPLQHLRCDGGNSRTLDETLENMHALNRMFGLDTEKAIVEQKIKAKVEKIQN

SEQ ID NO: 77077 - protein, 361 aa, Kluyveromyces lactis NRRL Y-1140
MRPSLSRDASDTGRRHSLLQQSKLLSIRLSNAGKRPSLSRGHAHEKDSITSSHHRLSTGPVNNNPRRSLMVKKPNTAHGTRVPILNDHNDKFENMTLQDFEIGKILGKGKFGKVYCVKHRETGLICALKAMEKKEIVQYTIQKQFRREVEIQGSFKHKNLTQLYGFFYDEKRVYLLMEYVYYGELYKFLKNNGPLNETLASYFVYQMANALDYMHSKNILHRDIKPENILIGFNNTIKLTDFGWSVYNEDGQKRKTLCGTIDYLSPELIKSREYNNKVDVWALGVLTYELLVGSPPFEEDTKEMTYRRILRCDLKFPLNVSPQARDLIVRLLQFEPSKRIPLSEVKSHAWIANNRGSWTDL

SEQ ID NO: 77078 - protein, 517 aa, delta proteobacterium MLMS-1
MSCPPAEPDPPPFSFDNSYARLPAAFYRFCNPTPVAAPRLLKLNAALAGELGLQLEGLDEQELAEIFAGNRLPAGAQPLAMAYAGHQFGSLVPQLGDGRAILLGEVLDGQSRRWDIQLKGAGKTPFSRGGDGRAPLGPVIREYLVSEAMHALGIPTTRALAAVSSGEQVRRERLLPGAVITRVAASHIRVGTFEFFARRGDFASLRTLADYVIPRHYSEINGPEINGPEIIGPEISGAEGHRRYLALLAAVIARQAELVAQWMSIGFIHGVMNTDNTTISGETIDYGPCAFLDHYHPETVFSAIDTGGRYAYHMQPRIAQWNLARFAESLLPLLHDDQEQAIALATALLQDFMPRYEKAWLTRMGNKIGLTAPQPDDRKLIEGLLAAMADNEVDFTLFFRRLANAVENPTEADGIRPLFNRPETWEHWAEGWHKRLAADPLPPAERAKRMRSVNPAIIPRNHRIEQAISKATEAADFSDFTKLNQALNHPWEDNPERDRWLAPPAPEERVRQTFCGT

SEQ ID NO: 77079 - protein, 483 aa, Sulfitobacter sp. EE-36
MQTQPIASHFINGEYVEDTNGTPIEVIYPATGEVIATVYAATPEIVEKAITAARDAQAAWAAMTGTERGRILRRAADIMRERNHDLSILETYDTGKPYQETSVADATSGADALEYFGGLAASLTGEHIQLGEDWVYTRREPLGVCVGIGAWNYPTQIACWKGAPALACGNSIIFKPSETTPLCALKVAEILVEAGLPAGLYNVVQGMGEVGASLVTDPRVDKVSLTGSVPTGRKVYAAAAEGIKHVTMELGGKSPMIVFEDADIENAISGAILGNFYSSGQICSNGTRVFVHRDIKEAFLKRLAERLDTAVIGDPMDPDTSFGPMVSKRQMEIALGYVEKGKAEGARLVYGGAAIDRDGFYMQPTVFADVTDDMSIAREEIFGPVMSVLDFETEAEVMARANATEFGLAAGVFTKDLSRAHRVAAGFEAGTCYINTYNDAPVEAPFGGMKNSGVGRENSKAAIDHYSQLKTVYVRMGDMEAPF

SEQ ID NO: 77080 - protein, 517 aa, Zea mays
KKKKKKKKKKKKKKKKKKKKKKKPLPLLAMTTLAALLLLVAASNVAALVKAVEYHSFVATPLSPHLYTAPSLDADEDVFGGSLAVAEEAAAASDSAVHFRVVHRDTFAVNATAGELLKHRLQRDKRRAARISEAAGAGGGNGRKGVAAPVVSGLAQGSGEYFTKIGVGTPATQALMVLDTGSDVVWVQCAPCRRCYEQSGPVFDPRRSSSYGAVGCGAALCRRLDSGGCDLRRGACMYQVAYGDGSVTAGDFVTETLTFAGGARVARVALGCGHDNEGLFVAAAGLLGLGRGGLSFPTQISRRYGRSFSYCLVDRTSSGAGAAPGSHRSSTVSFGAGSVGASSASFTPMVRNPRMETFYYVQLVGISVGGARVPGVAESDLRLDPSTGRGGVIVDSGTSVTRLARASYSALRDAFRAAAAGGLRLSPGGFSLFDTCYDLGGRRVVKVPTVSMHFAGGAEAALPPENYLIPVDSRGTFCFAFAGTDGGVSIIGNIQQQGFRVVFDGDGQRVGFAPKGC

SEQ ID NO: 77081 - protein, 83 aa, Vitis vinifera
MAEARRLRGHKATATCCIASRDRPGLVATSGEDGCICWFDMRCKDVVLTMDLGVNPISSLCFKPGCLKVANKCIGFLFYNEFG

SEQ ID NO: 77082 - protein, 420 aa, Staphylococcus aureus subsp. aureus COL
MKLTVVGLGYIGLPTSIMFAKHGVDVLGVDINQQTIDKLQSGQISIEEPGLQEVYEEVLSSGKLKVSTTPDASDVFIIAVPTPNNDDQYRSCDISLVMRALDSILSFLEKGNTIIVESTIAPKTMDDFVKPVIENLGFTIGEDIYLVHCPERVLPGKILEELVHNNRIIGGVTEACIEAGKRVYRTFVQGEMIETDARTAEMSKLMENTYRDVNIALANELTKICNNLNINVLDVIEMANKHPRVNIHQPGPGVGGHCLAVDPYFIIAKDPENAKLIQTGREINNSMPAYVVDTTKQIIKVLSGNKVTVFGLTYKGDVDDIRESPAFDIYELLNQEPDIEVCAYDPHVELDFVEHDMSHAVKDASLVLILSDHSEFKNLSDSHFDKMKHKVIFDTKNVVKSSFEDVSYYNYGNIFNFIDK

SEQ ID NO: 77083 - protein, 261 aa, Solanum tuberosum
MAAGRWNLEGCTALVTGGSRGIGYGIVEELASLGASVYTCSRNQKELNECLTQWRSKGFKVEASVCDLSSRSEREEFIKTVANHFDGKLNILVNNAGIVIYKEAKDYTMEDYSLIMSINFEAAYHLSVLAHPFLKASQRGNVVFISSISGASALPYEAVYGATKGAMDQLTRCLAFEWAKDNIRVNGVAPGVIASSMVEMTIQDQEQKENLDKLIDRCALHRMGEPKELAAVVAFLCFPAASYVTGQIIYVDGGFMANGGF

SEQ ID NO: 77084 - protein, 285 aa, Oryza sativa Japonica Group
ASKPTFHIHAILLRLLLLLLLLGFIGPGNLAESIARGVAASGVLPATAIRTAPHRRPERAEAFSSIGAHILETNAQVVDDSDVIVISVKPQIVRQVLVELKPLLSEEKLLVSIAAGIKMEDLQGWSGHRRFIRVMPNTPSAVGQAASVMCLGEMATENDENRVRSLFSAIGKVWTAEEKYFDAVTGLSGSGPAYIFLAIEAMADGGVAAGLPRDLALGLASQTVLGAATMVNKTGKHPGQLKDMVTSPAGTTITGIQELEKGAFRGTLINAVVAATKRCRELSQS

SEQ ID NO: 77085 - protein, 202 aa, Vibrio campbellii AND4
MVLVGRQAPDFTAAAVLGNGEIVDNFNFAEFTKGKKAVVFFYPLDFTFVCPSELIAFDNRLADFQAKGVEVIGVSIDSQFSHNAWRNTAIEDGGIGQVKYPLVADVKHEICKAYDVEHPEAGVAFRGSFLIDEDGLVRHQVVNDLPLGRNIDEMLRMVDALNFHQKHGEVCPAQWEEGKAGMDASPKGVAAFLSEHADDLSK

SEQ ID NO: 77086 - protein, 202 aa, Solenostemon scutellarioides
MQGGIQAIFSRGKNAVLQHVRVVPPAMRALMFPRHESTSAARMEEHGFESTTISDVLTAKGKGADGSWLWCTTDDSVYDAVKSMTQHNVGALVVVKPGEQKSIAGIITERDYLRKIIVQGRSSKSTKVGDIMTEENKLITVTPDTKVLKAMQLMTDNRIRHIPVVNEGGMIGMVSIGDVVRAVVREHREELNRLNAYIQGGY

SEQ ID NO: 77087 - protein, 457 aa, Synechococcus sp. WH 7805
MAVIADRCPQIQVTVVDINQARIDAWNDRDLSKLPVYEPGLDAVVKRARGRNLHFSTGVADAIAAADMVFISVNTPTKTKGLGAGQASDLRWVEACARQVAQSAQGHTIVVEKSTLPVRTAETVQTILASADTSQGDRSFAVLSNPEFLAEGTAIRDLESPDRVLIGGNTEEAIEALASVYAHWVDDSKILRTNLWSSELSKLTANAFLAQRISSINSVAALCESTGADVREVARAIGTDSRIGPKFLQSGPGFGGSCFQKDILNLVYLCRHFGLPEVADYWEQVVILNTWQQHRIARLVVQKLFGTVTGKRLAILGFAFKADTNDTREAPAIRIAKDLLVEGAQLAIHDPKVDSEQIARDLQLQASEAPDGSAGPTRASLSGEGTWWPSASVEKAVTGADAVLILTEWRDYRQLNWSALSKLMRQPAWVFDARSVVSPTEVENAGLSLWRVGEGEA

SEQ ID NO: 77088 - protein, 344 aa, Synechococcus sp. WH 7805
MSGDQSRPILVTGAAGFIGAALVQRLLKRGDRVIGIDNLNSYYDPSLKQARLQTIEAMAPQGAWRFERLALEDGTALMELFAAERPRVVVNLAAQAGVRYSLENPAAYIQSNLVGFGHILEGCRHHGTEHLVYASSSSVYGGNRNLPFHEQQPVNHPVSLYAASKKANELMAHTYSHLYQLPATGLRFFTVYGPWGRPDMAPMLFAKAILAGKPIRVFNHGKMQRDFTYIDDIVEGVLRCCDKPASANPDFDPLAPDPATAAAPHRVFNIGNNEPTPLMRFIEVMEQALGTTAIKDFQPMQPGDVVATAADTTALEAWVGFKPYTPIETGVECFARWYRQYYAV

SEQ ID NO: 77089 - protein, 498 aa, Rhizobium leguminosarum bv. viciae 3841
MREIGHFIGGKQVAGTSGRVSNVYNPATGEVQATVALASVEELRAAVENAKAAQPKWAATNPQRRARVFFKFVELLNKHMDELAEILSKEHGKTIEDAKGDVIRGLEVCEFVCGIPHLAKGEFTEGAGPAIDMYSIRQPVGIGAGITPFNFPGMIPMWMFAPAIACGNAFILKPSERDPSLPIRLAELMIEAGLPAGILNVVNGDKGAVDAILTDPDIGAVSFVGSTPIARYVYGTAAMNGKRAQCFGGAKNHMIIMPDADLDQAVNALMGAGYGSAGERCMAISVAVPVGEETANRLVEKLTPKIESLRIGPYTDDKADMGPLVTKEAYTRVRGLIDRGIEEGAKLVVDGRDFKLQGYEDGYFVGGCLFDHVTPDMDIYKTEIFGPVLSVVRAQNYEEALSLPMKHEYGNGVAIFTRDGDAARDFASRINIGMIGINVPIPVPLAYHSFGGWKASSFGDLNQHGTDSIKFWTKTKTVTARWPSGIKSGAEFVMPTMK

SEQ ID NO: 77090 - protein, 249 aa, Hordeum vulgare
MVKLAFGSFGDSFSATSIRSYVAEFIATLLFVFAGVGSAISYGQLTQGGALDPAGLVAIAIAHAFALFVGVAMAANISGGHLNPAVTFGLAVGGHVTILTGLFYWVAQLLGASVACLLLQFVTHAQAMPTHAVSGISEVEGVVMEIVITFALVYTVYATAADPKKGSLGTIAPMAIGFIVGANILAAGPFSGGSMNPARSFGPAVAAGNFSGHWVYWVGPLIGGGLAGLVYGDVFIASYQPVGHQQEYP

SEQ ID NO: 77091 - protein, 357 aa, Synechococcus sp. WH 7805
MAKILVTGGAGFIGSHTCLVLLDAGHELVVVDNLSNSSLASLNRVASLAGVAPASKAGPTDRLQFVEGEIRDTPCLEAIFQQAEAQGQPIDAVIHFAGLKAVGESVAEPLRYWDVNVHGTLSLLKVMANHGCHTFVFSSSATLYGYPDHGPIPETAAIQPINPYGYTKAAAERLLNDLATSAQELWRIACLRYFNPVGAHPSGQIGEDPLGIPNNLFPFVSQVAVGRRECLHVFGGDWPTPDGTCIRDYIHVMDLAEGHRAALDCLLEEPPQLLSLNLGSGRGISVLEVIQAFAEASKRPIPHAIVSRRPGDAAITVADPAEALRRLGWQTQRSLQDICRDGWAWQSANPQGYASEP

SEQ ID NO: 77092 - protein, 451 aa, Rhizobium sp. NGR234
MITPVPQHNSLEGTPLEPAISSLWSTAKRIDTRVVRGRITRAVGTLIHAVLPEARIGELCLLQDTRTGLSLEAEVIGLLDNGVLLTPIGGLAGLSSRAEVVSTGRMREVPIGPDLLGRVIDSRCRPLDGKGEVKTTEVRPLHGRAPNPMTRRMVERPFPLGVRALDGLLTCGEGQRIGIYGEPGGGKSTLISQIVKGAAADVVIVALIGERGREVREFVERHLGEEGLRRAIVVVETSDRSATERAQCAPMATALAEYFREQGLRVALLLDSLTRFCRAMREIGLAAGEPPTRRGFPPSVFAALPGLLERAGLGERGSITAFYTVLVEGDGTGDPIAEESRGILDGHIVLSRALAARSHFPAIDVLQSRSRVMDAVVSETHRKAASFFRDLLARYAECEFLINVGEYKQGGDPLTDRAVASIGELKEFLRQSEDEVSDFEETVGWMSRLTS

SEQ ID NO: 77093 - protein, 450 aa, Escherichia coli K12
MTKHYDYIAIGGGSGGIASINRAAMYGQKCALIEAKELGGTCVNVGCVPKKVMWHAAQIREAIHMYGPDYGFDTTINKFNWETLIASRTAYIDRIHTSYENVLGKNNVDVIKGFARFVDAKTLEVNGETITADHILIATGGRPSHPDIPGVEYGIDSDGFFALPALPERVAVVGAGYIAVELAGVINGLGAKTHLFVRKHAPLRSFDPMISETLVEVMNAEGPQLHTNAIPKAVVKNTDGSLTLELEDGRSETVDCLIWAIGREPANDNINLEAAGVKTNEKGYIVVDKYQNTNIEGIYAVGDNTGAVELTPVAVAAGRRLSERLFNNKPDEHLDYSNIPTVVFSHPPIGTVGLTEPQAREQYGDDQVKVYKSSFTAMYTAVTTHRQPCRMKLVCVGSEEKIVGIHGIGFGMDEMLQGFAVALKMGATKKDFDNTVAIHPTAAEEFVTMR

SEQ ID NO: 77094 - protein, 503 aa, Coccidioides immitis RS
MTKKLLSRPSEISLSHRPSPAEQCRHRSEDKASSAIVPEAYTKPYCDFMTDNPTIFHAVATFTRRLDDHGFSRLSERDVWTSKLKQGGKYYCTRNDSALIAFIVGRDYESGNGVGVVAGHIDALCAKLKPVSKLPTKAGFVQLGVAPYAGALSSTWWDRDLGIGGRVLVQNPSTGVVESKLVKLGWPIARVPTLAVHFGAPSQGPFNPETQAVPVIGLDNSDIIGQDANAADSGIKPGTFAATQPERLVRAIAKELGVSDYSTIINWELELFDIQAAQVGGLDKEFIFAGRIDDKLCSYSAFEALLASSEKSSTGIVKMVGMFDNEEIGSLLRQGARSNYMSSVIERIVEAFAPNYGPNLLSQTFANSFLVSSDVIHAVNPNFLNVYLENHAPRLNIGVAVSADPNGHMTTDSVSTALLQRVAEKCGSRLQVFQIRNDSRSGGTIGPMTSARTGMRAIDCGIPQLSMHSIRATTGSLDPGLGVKLFTGFFDHFEEVDKEFRQL

SEQ ID NO: 77095 - protein, 129 aa, Triticum aestivum
  misc_feature (30)..(30): Xaa can be any naturally occurring amino acid
  misc_feature (53)..(53): Xaa can be any naturally occurring amino acid
  misc_feature (75)..(75): Xaa can be any naturally occurring amino acid
  misc_feature (84)..(84): Xaa can be any naturally occurring amino acid
  misc_feature (102)..(102): Xaa can be any naturally occurring amino acid
PRSTRVYYQFNSFGTRLSPAKMSTVTRAYXLDQRLAAAKRCSREAAMAGAKGXRAVATVAAAVPTLASVRMLPWXAKAHLNPTXGQALIISTVGRGWAYFIXADKTILSMARKHSFDDAPDHLKNTSFH

SEQ ID NO: 77096 - protein, 295 aa, Carboxydothermus hydrogenoformans Z-2901
MEFESLFKRYRKMVEEGIGRFLPPDDTYPPVIHQAMNYSLKAGGKRLRPVLMLAAGEWSGIAPEKLLPAAVGVECLHTYSLIHDDLPAMDNDDFRRGKPTNHKVFGEAIAILAGDALLTKAFELTAKTLEQGIPAERVVRVIQELAVASGSEGLIAGQVVDLSSSEAKKDPEVLLYIHLNKTARLIRYSLIAGGILAGATEEEIKALDDYGRHLGLAFQIVDDLLDVVGDFQKIGKPVGSDEKNQKLTYVSLFGIEETKKRAEEEINAAKNVLKPYGEKSSFFIKLAEFILKRES

SEQ ID NO: 77097 - protein, 250 aa, Zea mays
FGTRSLHFEGLLEDLGSAPSGSIVLLHACAHNPTGVDPTIEQWEQIRQLMRSKSLLPFFDSAYQGFASGSLDKDAQSVRMFVADGGELLMAQSYAKNMGLYGERVGALSIVCKSADVAVRVESQLKLVIRPMYSNPPLHGASIVATILRDSEMFNEWTLELKAMADRIINMRQQLFNALKSRGTPGDWSHIIKQIGMFTFTGLNSEQVAFMRQEYHIYMTSDGRISMAGLSMRTVPHLADAIHAAVTQLK

SEQ ID NO: 77098 - protein, 210 aa, Hordeum vulgare
DARARSFVARAAAEYDLPLVGNKAPDFAAEAVFDQEFINVKLSDYIGKKYVILFFYPLDFTFVCPTEITAFSDRHEEFEKINTEILGVSVDSVFSHLAWVQTERKSGGLGDLKYPLVSDVTKSISKSFGVLIPDQGIALRGLFIIDKEGVIQHSTINNLGIGRSVDETLRTLQALQYVKKPDEVCPAGWKPGEKSMKPDPKGSKEYFAAI

SEQ ID NO: 77099 - protein, 722 aa, Vitis vinifera
MEYSFGIEESLKELAQLADIVGLMVVGSTSQKLSVPNPRTYIESGKVAEIKSAIHALDVETVTFDDEFSAMQLRDLEKAFGGDVRVCDCPVLILDIFNKRVATHEAALQVTLAQMEYPLPCLIKMGTHLQYTISVTKGMVSHIEVTSYAHGSSYLLGIQIDAAINPGNSGGHAGGPTFTDQGECIGVAFQAQQSTPFTDYRSHMETPSIVFFVVAAASAYVLWFYLLARKLTGPKMWPVVGSLPALFMNRRRIHDWISGNLRETGGAATYQTCTLALPFLAYKQGFYTVTCHPKNIEHILRTRFDNYPKGPTWQTAFHDLLGQGIFNSDGDTWLIQRKTAALEFTTRTLRQAMSRWVNRTIKMRLWRILEKAASEKSSVDMQDLLLRLTFDNICGLTFGKDPETLSPDFPENPFSMAFDSATESTLQRLLYPGFLWRLKKFLRIGAERRLKQSLRVVENYMDDAVAARKERPSDDLLSRFMKKRDVDGNVFPTSVLQRIALNFVLAGRDTSSVALSWFFWLIMNNPRVEEKITTELSTVLRETRGDDQTKWLEEPLVFDEADRLIYLKAALAETLRLYPSVPEDFKYVVSDDILPDGTYVPAGTTVTYSIYSVGRMKTIWGEDCLEFKPERWLSTGGDRFEPPKDGYKFVAFNAGPRTCLGKDLAYLQMKSVASAVLLRYRLSPVPGHRVEQKMSLTLFMKNGLRVYLHPRGLEPPGAATSA

SEQ ID NO: 77100 - protein, 495 aa, Staphylococcus aureus subsp. aureus COL
MAVNVRDYIAENYGLFINGEFVKGSSDETIEVTNPATGETLSHITRAKDKDVDHAVKVAQEAFESWSLTSKSERAQMLRDIGDKLMAQKDKIAMIETLNNGKPIRETTAIDIPFAARHFHYFASVIETEEGTVNDIDKDTMSIVRHEPIGVVGAVVAWNFPMLLAAWKIAPAIAAGNTIVIQPSSSTPLSLLEVAKIFQEVLPKGVVNILTGKGSESGNAIFNHDGVDKLSFTGSTDVGYQVAEAAAKHLVPATLELGGKSANIILDDANLDLAVEGIQLGILFNQGEVCSAGSRLLVHEKIYDQLVPRLQEAFSNIKVGNPQDEATQMGSQTGKDQLDKIQSYIDAAKESDAQILAGGHRLTENGLDKGFFFEPTLIAVPDNHHKLAQEEIFGPVLTVIKVKDDQEAIDIANDSEYGLAGGVFSQNITRALNIAKAVRTGRIWINTYNQVPEGAPFGGYKKSGIGRETYKGALSNYQQVKNIYIDTSNALKGLY

SEQ ID NO: 77101 - protein, 313 aa, Wolbachia endosymbiont strain TRS of Brugia malayi
MSFSSLQDKGMKNSEFLKGEVSFEQKAKILLEALSSIPNFVGETFVIKCGGITISDETLFNTFVHNVVLLKQLGINPVIVHDGEYEIDSVLKILGINSKFVNDIRLTDKDTMRIIEMVLCGSINKKIVQHINSAGGSAIGLCGKDGNLIKAEKISTTLRENGSNNVEKILDMGFIGIPTEINPDILFFIEESDFIPVIAPIGHGKNGETYHIDADGAAGAIAVAVSASKMIIFSDVCEEMDKIDGRKISVKNLNASINCGKIKGERFVEKLTACAKMVEECAGIAHIVNGRIPNIMIDLFTESNSSVSIVNDL

SEQ ID NO: 77102 - protein, 186 aa, Wolbachia endosymbiont strain TRS of Brugia malayi
MFGASDIKSLPNESAPEIAFAGRSNVGKSSLINLLINSKKAARVSSKPGCTRQINFYSMYNDKFRLVDLPGYGCSHASKDETIQYLGLVEYYLIHRRNLRRVFVLIDSKVRLKEIDKDFIYWLTYNNINFDVVLTKIDKVDRENLDAIIESTRKWINNESVSIRQISVRVKYEMTKVRDEFFKFTR

SEQ ID NO: 77103 - protein, 315 aa, Vitis vinifera
MATSRIQPPPPPPQSKLMDLDVTIVSAKHLKNVNWRNGDLKPYAIFWVDPERRFATKPDDCGSTRPVWNEHFSIPINTPPYDSVFTLEIFHSKPSETPKPLVGVLRFPIKDLVDSDESANSIRTLELRRPSGRPNGKIRIKLALRERPPPTPDYHIAPQSSYYYSSAPPPPPPARDYRGFSSSPYTTHPPPPAPAPSSAAPYSYGGYSDPYSGYYGYYSQQPPVPPPRPFFDRPSNYGVPGGPSAPVDYSAYEHKPKGSGKMGLGTGLAVGAVAGALGGLALEEGIKYEEEKVADRVENDLSARDDYSDYHRSEY

SEQ ID NO: 77104 - protein, 503 aa, Glycine max
MAISIPSRQLFIDGEWKVPLLNNRFPIINPATEDIIGHIPAATKEDVDLAVDAAKRAFSHNKGKDWSSAPGSVRARYLRAIASKITEKKDELGKLEAIDCGKPLDEALADLDDVIGCFNYYAELAEGLDAKQNAPVSLPMETFKSYVLKEPIGVVALITPWNYPLLMATWKVAPALAAGCTAILKPSELASVTCLELAEICREVGLPPGVLNIVTGLGNEAGAPLSSHPDVDKISFTGSSATGSRIMTAAAQLTKPVSLELGGKSPIIVFEDVDLDKTAEWTIFGCFFTNGQICSATSRLIVHESIATEFVNRLVQWAKNIKISDPFEEGCRLGPIVSEGQYKKVLNCISTAKSEGATILIGGSRPEHLKKGYFVEPTIITDVTTSMQIWREEVFGPVLCVKTFSTEEEAIELANDTHYGLGSAVMSKDLERCERISKAIQAGIVWINCAQPSFIQAPWGGVKRSGFGRELGEWGLENYLSVKQVTKYIFDEPWGWYQSPSKL

SEQ ID NO: 77105 - protein, 125 aa, Populus trichocarpa
MAGRLSNVASRIMGGNGVVSRSVASSLRLSSGMGLPVGKHIVPDKPISVNDELTWDNGTAFPEPCIDRIADTVGKYEALAWLCGGLGFFASLGLLVVWNDKASTIPFAPKVYPYDNLKVELGGEP

SEQ ID NO: 77106 - protein, 463 aa, Legionella pneumophila str. Paris
MDLFRKKDIKGSLDNESHLAKCLSVFDLTFLGVGAIIGAGIFVLTGIVAATISGPAVIFSYVVAGFACAFAALSYAELAASIGGCGSAYGYAYAGFGELIAWIVGWDLLLEYSIAVSAVSIGWSGYANDFLMALKIFIPTHLLHGPADGGDLNILAILIIAVLTTLLIVGVKSSSRFNNIMVFVKLLVIFIFIAIAFGEVKVENWSSFMPYGWAGVMKGASIIFFAYVGFDAVSTAAEEAINPQRDLPIGIIASLAICTVIYILVSGLLTGIAHYTTLNVSSPISHVLLVLGYKTAAGLVGVGAIAGLTTVMLVLFYGLTRVFLAMSRDGLLPRFLSKTNEHTKTPIRIILLCGILMASLASVTPIGTLAELVNIGTLFAFIVVCGGVLYLRRTHPDMERPFKTPFMPYVPILGIISCFYLILNLPWVTILRFIIWMLVGIAVYFAFSRTNSALSVEGDCAAE

SEQ ID NO: 77107 - protein, 491 aa, Helicobacter pylori 26695
MAQKTLLIITDGIGYRKDSDHNAFFHAKKPTYDLMFKTLPYSLIDTHGLSVGLPKGQMGNSEVGHMCIGAGRVLYQDLVKISLSLQNDELKNNPAFLNTIQKSPVVHLMGLMSDGGVHSHIEHFIALALECEKSHKKVCLHLITDGRDVAPKSALTYLKQMQNICNESIQIATISGRFYAMDRDKRFERIELAYHSLMGLNHTPLSPSEYIQSQYDKNITDEFIMPACFKNYCGMQDDESFIFINFRNDRAREIVSALGQKQFSGFKRQVFKKLHIATMTPYDNTFPYPVLFPKESVQNTLAEVVSQHNLTQSHIAETEKYAHVTFFINGGVETPFKNENRVLIQSPKVTTYDLKPEMSAKEVTLAVLEQMKLGTDLIIVNFANGDMVGHTGNFEASVKAVEAVDACLGEILSLAKKLDYAMLLTSDHGNCERMKDENQNPLTNHTAGSVYCFVLGDGVKSIKNGALNNIASSVLKLMGLKAPATMDEPLF

SEQ ID NO: 77108 - protein, 496 aa, Candida albicans SC5314
MASASTSKELKYAQEFVDFVNASPTPYHAVNSVKSLLSEAGFEEIHERTNWFKSHTLQKGGKYFVTRNGSSIIAFTIGEQFKNGNGIAIVGAHTDSPCLRIKPISKKTSEGFIQIGVEQYGGLIAHSWFDRDLSIAGRVYVNENGQFVPKLLKIDKPLLRIPTLAIHLDREVNTKFEFNKETKLVPIAGQTSIDKNEKESSASASKSCADDPNLQLTPDQFESVQNVISRHNKSLVELIAKELNVEPTQIEDFELILFDHQKSTIGGLNDEFIFSPRLDNLTSCFTAAKGLVESIKNLPKEEGISLISLFDHEEIGSVSAQGADSTFLPDIIQRLTKFDFDNTNSSDNVDYFHETMSKSFLLSSDMAHGVHPNYADKYEGQNRPQLNLGPVIKINANQRYATNSPGIVLLKKVADKVQVPLQLFVVRNDSPCGSTIGPILAAKLGIRTLDLGNPQLSMHSIRETGGTFDILKLTDLFKSFFENYIELDRKILVDHL

SEQ ID NO: 77109 - protein, 479 aa, Streptomyces avermitilis MA-4680
MSTTAQIGVTGLAVMGRNLARNFARNGYTVAVHNRTASRTRDLVEEFGHEGDFVPAETAKDFVAALERPRRLVIMVKAGAPTDAVIEEFAPLLEPGDMIIDGGNAHFADTRRRERELREQDIHFVGTGISGGEEGALHGPSIMPGGSPESYDSLGPMLEKISAKAADGAPCVTHVGPDGAGHFVKMVHNGIEYADMQLIGEAYQLLRDVAGYTPAQIADIFRTWNTGRLDSYLIEITAEVLSHVDAATGKPFVDVVQDQAEQKGTGRWTVQIALDLGVPVSGIAEAVFARSLSGHQELREASRGLAGPKAAPLGESEAAAFADRVEQALYASKIVSYTQGFHEIAAGSDEYDWNIDLGKIASIWRGGCIIRAAFLDRIREAYDARADLPSLLSDDTFAQEIAAAQDDWREVLIAATRQGVPTPGFAAALAYYDALRAERLPAALTQGQRDFFGAHTYRRTDREGSFHTLWGGDRSEVTA

SEQ ID NO: 77110 - protein, 354 aa, Bacillus thuringiensis serovar konkukian str. 97-27
MESMFNKIFLIVALIGVPLSVLGKTLHWPQTIMFAVYCITIIALAGFMGRATESLAIVSGPRIGGLLNATFGNAVELIISIFALQAGLIEVVLASLTGSVLGNLLLVGGLSFFVGGLKYKRQSFNVYDARHNSALLIFAVVVAFVIPEIFSMKMDAGKTYQLSIGVSIIMIIMYLAALLFKLVTHRGVYQHKSDEVAHEEEPEWSKGKALLILAIATIAVAYVSEALVHTFETVAKSFGWSELFIGVIIVAIVGNAAEHASAIIMAYKNKVNIAVEIAVGSTLQIAMFVAPVLVLLSMFFAQRMPLVFTIPELVSMITAVFLTIAISNDGDTNWFEGGTLLAAYVIMGIGFYLL

SEQ ID NO: 77111 - protein, 246 aa, Glycine max
MADRGGERGVGERGGDRGVTKLGRLVKEGRFTKMEEIYLHSLPVKEHQIVETLCPGLKDEVMKITPVQKQTRAGQRTRFKAFVVVGDSNGHVGLGVKCAKEVATAIRGAIILAKLSIVPVRRGYWGNKIGQPHTVPCKVTGKCGSVTVRMVPAPRGSGIVAARVPKKVLQFAGIDDVFTSSRGSTKTLGNFVKATFDCLMKTYGFLTPDFWRETTFTKAPYQEFTDILAKPTKALMLDAPAEKIEA

SEQ ID NO: 77112 - protein, 157 aa, Physcomitrella patens subsp. patens
MAEKRVKLKSSDDEMFEVDEAVAFESQAVKNMIEDTGIDAPIPLPNVSSKILAKVIEYCKYHVENQKPSDDKQATPEEEIKAWDADFVKVDQATLFDLILAANYLNIKNLLDLTCQTVADMIKGKTPEEIRKTFNIKNDFTPEEEEEVRRENQWAFE

SEQ ID NO: 77113 - protein, 422 aa, Physcomitrella patens subsp. patens
MPLTGSAVDVLGVTTLVLVLLLVCAGIGCIAYVLYFRARIQKERLSALQDFNSLWIVRIILIGLAILWSLVELLRLPLLRRPNWVLHSLSFKWQANLCRLHILSSLGFLEPCFFLTALFLVHGSLRKAPFTPRKDWNGKVVGLILLCCLPVFLLQLFFVFISPRVEFKGGSGYILENEGYGGKVPYYFTQAFEKVMVDTQEVVMCRYPLWSTLVLAGFGILYSAYFLLLGWRMVGVVINRYLQRRLYSLLGALLLLLPLHVIFLGLSVLSKPTRLPFELLSFFGFIMVLLCSTIGEGILVIRPIADALAVTWVVYAPSESGRDTDFPEEGPMSVSMSIFGSDDDEASLVGNASLFAKSQSRTADVQDNEYTSARSFLRPLERTGSFSENNVTPFFNPDSSALPGKPLIAHHQPQNPAFYPFL

SEQ ID NO: 77114 - protein, 406 aa, Streptomyces avermitilis MA-4680
MRRGGPSVLGIVLAGGEGKRLMPLTADRAKPAVTFGGTYRLVDFVLSNLVNADILRICVLTQYKSHSLDRHITTTWRMSSLLGNYITPVPAQQRLGPRWYLGSADAILQSLNLVYDERPEYIAVFGADHVYRMDPRQMLGEHIESGAGVTVAGIRVPRAESSSFGVIAPGSDGQTVENFLEKPADPPGLPGDPECVFASMGNYVFTTKVLIEALQRDAEDGDSVHDMGGSILPALTDRGEARLYDFSANHVPGETTRDQGYWRDVGTLDAYYDAHMDLIAERPAFNLFNRSWPIYTHSGQLSPARFNAGGIASESIISAGCLIRGQVTRSVLSPGVVVDPGAVVQGSVLHDNVHVGRGAVVRGAVLDKNVEVPPGATIGVNPGRDADLYTVSKGGVIGLGKGQRVS

SEQ ID NO: 77115 - protein, 199 aa, Nitrosomonas europaea
MLLMIDNYDSFTYNLVQYLGELGEEVMVVRNDEITLEAVQQLNPASVVISPGPCTPDEAGISVELINRFSGKIPILGVCLGHQSIGQAFGGRIVRAGKVMHGKTSLVFHDGKGVFQGMPDPFVATRYHSLVIERSSIPDCLEISAWTEDGEIMGVPHRALPVEGVQFHPESVLSEHGHLLLDNFLHGNSVQKHSSMCEA

SEQ ID NO: 77116 - protein, 81 aa, Brassica napus
  misc_feature (56)..(56): Xaa can be any naturally occurring amino acid
MSDKGRPLPKFGEWDVNDPASAEGFTVIFNKARDEKKTGGKPGSPGKSTDGHAKSXEGGGDPSKTQPKKWLCCMQSPAVDS

SEQ ID NO: 77117 - protein, 466 aa, Escherichia coli K12
MDQKLLTDFRSELLDSRFGAKAISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 77118 - protein, 406 aa, Carboxydothermus hydrogenoformans Z-2901
MLVVQKYGGSSVANPERIKNVARRVAEYYRAGHRVAVVVSAMGDTTDELLDLMGEISPNPPAREIDMLLSTGEQVSVALLAMALHELGVPARSFTGLQAGIYTDEVHTKARITEIKPERVIACLNSGKVAVVAGFQGVNREGDITTLGRGGSDTTAVALAAALKADICEIYTDVDGVYTADPRIVPDARKIKEISYEEMLELASLGAVVLQPRSVDFARNYKVEVHVRSSFNYNEGTVLKEERDLEKKGVVTGVAHDKNVVKIGVFGVPDQPGVAYRLFSELAAHNINVDMIIQSAGKEEGQNDISFTIGKNDLAKTVEILEDVVKKLSARGYTYDEKVAKVSIVGAGMVTYPGVAAKMFEALYEENINIQMISTSEIKVSCIIAEDAVERAVNAIHKKFELGNGV

SEQ ID NO: 77119 - protein, 475 aa, Wolbachia endosymbiont strain TRS of Brugia malayi
MSTPITVAYGDGIGPEIMEAVLSMLREAEAKISIDVIEIGERVYNKEWSYGISPSGWESIERTKVLLKSPTTTSQGKGHKSLNVALRKSLGLYANIRPCTSYHPVIENKFDRFDIVVIRENEEDVYTGIEHRLTGNSYQCTKIITRSGSEKICRYAFNYAKRHNRKKVTCLTKDNIMKMTDGIFHTAFDSIAKEYPDIKAEHYIVDIGMARVATEPENFDVIVTENLYGDILSDIVAQTSGSVGLAGSSNIGSEYAMFEAVHGSAPNIAGKNIANPSGLLNAAVHMLIYIGQADVAKLVHDAWLKTLEDGIHTADLYKEKKSKQKVGTKEFAEAVIDNIGKKPGILPELIISNGVSSKISKIQGNCEQDYKVRKLVGSDITLAWDKSSNFNQIVKLFESSNPKVIAIYSKGLAIWPGDSKSLSDQVTCRFIANNEKKTITNIDVNNLLIKLERNSFDVVRMDKLYLYDEKEGFFS

SEQ ID NO: 77120 - protein, 500 aa, Prochlorococcus marinus subsp. marinus str. CCMP1375
MQNKLLSLNFESSIEGLGSDYWDVVEAAVFPKHVLQYRNDYVLQQLGIDSETITNENFIEAYGKFQGRAPFLALRYHGYQFGNYNPFLGDGRGFLYGQTRDTYGKLQDLGTKGSGQTPWSRGGDGRLTLKGGIREIIAGEALHKLGVTTSRTLSLIETGEKLWRGDEPSPTRSSVMVRIAQTHLRFGTCERFLYLRDPKGLEKLLKYVIKNHYPNIDIINSTSMTDCSANTDAQLIAFYRELVSRVAKLAAGWMSAGFTHGVLNTDNMSLAGESFDYGPFAFIEDWDPNFTAAYFDQTGMYSFGRQPRICYENLKLLQEPLAMLISREAMAETLDNFFTIYASHYRACLNRRLGFPANLEEIIDINPTKSNNNNTEDLIEATLQLLSNWDISYGDFFNQLAQLINDNGLPRNTSSLEPLANYLPLPPRKQWNNWRDIWHYNQERLISLVPNEINAIKSRLYRWNLLNTPVKSKIEAIWKSIDEKNDWVPFHAWINETSID

SEQ ID NO: 77121 - protein, 351 aa, Sulfitobacter sp. EE-36
MLGLQNLERNDFIMKPRKVLITGTAGFIGFHLAKLLLAEGFIVHGFDGMTDYYDVALKQRRHQMLLQSPNFSATEGMLEDQALFDRVADEFAPDVIVHLAAQAGVRYSLENPRAYLDSNVIGTFNVMEAARRLKVKHLMMASTSSVYGANEEMPFIETEKADTQLTIYAATKKATESMGHSYAHIHDLPTTMFRFFTVYGPWGRPDLALYKFVDAMLDGRPIDIYNNGDMYRDFTYVDDLVRAIRLLIDAVPERPEGGVVPKGDSLSPVAPYRVVNIGNSDKVRLLDFVDAIEDCLGQKAQRNYMGMQTGDVPATWANAELLKTLTGYRPQTDFRDGIARFVEWYREYSGK

SEQ ID NO: 77122 - protein, 481 aa, Zea mays
MVQCTQPPPQLKLPESKITEPTDDENQDLPPKPEKRTRMHHIERHRSCVVTLSDIELNGLQPRHLHQPIEISPGGSQCSLHEETPTDTNASHRHAIADAAWEALKRSMVYFRGQPIGTVAAIDKSQGAALNYDQVFMRDFIPSALAFLMKGEHLIVKNFLVETARLQSREKMVDLFKLGQGVMPASFKVHHRNPTQKTESLLADFGETAIGRVAPVDSGLWWIILLRAYTKWTGDNSLAESTNCQRAMHLILRLCLSEGCDTSPALLCADGCSMIDRRMGIYGYPIEIQALFFMAMRCALSLLKQESDADFVNHITKRIQALSYHLHSYYWLDFQRLNDIYRYKTEEYSQTALNKFNVMPESIPDWIFDFMPSRGGYFIGNVSPARMDFRWFCLGNFIAILSSLATGEQAEAILDLVEERWQELIGEMPLKICYPAMENQEWQIVTGCDPKNTRWSYHNGGSWPVLLWLLVAVSVKLGRPL

SEQ ID NO: 77123 - protein, 546 aa, Staphylococcus aureus subsp. aureus COL
MKQRIGAYLIDAIHRAGVDKIFGVPGDFNLAFLDDIISNPNVDWVGNTNELNASYAADGYARLNGLAALVTTFGVGELSAVNGIAGSYAERIPVIAITGAPTRAVEQGGKYVHHSLGEGTFDDYRKMFAHITVAQGYITPENATTEIPRLINTAIAERRPVHLHLPIDVAISEIEIPTPFEVTATKYTDASTYIELLATKLHQAKQPIIITGHEINSFHLHQELEDFVNQTQIPVAQLSLGKGAFNEENPYYMGIYDGKIAEDKIRDYVDNSDLILNIGAKLTDSATAGFSYQFNIDDVVMLNHHNIKIDDVTNDEISLPSLLKQLSNISYTNNATFPAYHRPTSPDYTVGTEPLTQQTYFKMMQNFLKPNDVIIADQGTSFFGAYDLALYKNNTFIGQPLWGSIGYTLPATLGSQLADKDRRNLLLIGDGSLQLTVQAISTMIRQHIKPVLFVINNDGYTVERLIHGMYEPYNEIHMWDYKALPAVFGGKNVEIHDVESSKDLQDTFNAINGHPDVMHFVEVKMAVEDAPKKLIDIAKAFSQQNK

SEQ ID NO: 77124 - protein, 466 aa, Clostridium tetani E88
MKQNILEKKYNYVWNNYDENDMKNVFEIAERYKRFLSECKTERECIKEFIKIAEENEYKNLEDIFRKGEKLNPGQKVYVNNKDKTLALFVIGKKPMVEGMNILGAHVDSPRLDLKQNPLYEDTDLAFFETHYYGGIKKYQWVTLPLALHGVVVKKDGTKKEIVIGEEDDEPVIGISDLLIHLAGDQLEKKLKKGIEGEDLNILIGSIPLKNGESKNPVKDNILKILNEKYDICEEDFVSAELEVVPAGKARDYGLDKSMVIGYGQDDRICSYTSFEAIMSLENTEKTCITLLVDKEEIGSVGATGMQSKFFENAVAEVMDCSNQYSELNLRKALANSRMLSADVSAAYDPNYPSVMEKRNAAYFGKGLVFNKYTGARGKSGCNDANPEFIAELRRIMDEHNVYWQTAELGKVDQGGGGTIAYILAHYGMEVIDCGIALQNMHAPWEVASKADIYEALKGYYAFLIS

SEQ ID NO: 77125 - protein, 436 aa, Helicobacter pylori 26695
MNFQENLAALDLEYLWHPCSQMQEHQNFPIIPIKKAQGIYLYDFNDNAYMDLISSWWVNLFGHNNAYISQQLKNQIDDLEHVLLASFSHKPIITLSQRLCQLTHMDKCFYADNGSSCVEIALKMSYHAHFLKNQTRRKKLFLSLSNSYHGETLGALSVGDVKLYKDTYTPLLLKNLTTPVPKNDHEIENSLNALKRLLDKHSEEICAFIAEPLLQCAGNMHIYSARYLKQAVLLCKQKNIHIIFDEIATGFGRTGSMFAYEQCEIKPDFLCLSKGISGGYLPLSALLTHNEIYNQFYAPYEENKAFLHSHSYTGNALACACANATLDIFEKENVIEKNKALSGFIFNTLQNALKPLMEQQVVSDLRHLGMVFAFEVFIQTKERLSLAVFKKTLKKGLLLRPLNNTIYLMPPYIITHEEVKKAVAGLVEILDELRKG

SEQ ID NO: 77126 - protein, 432 aa, Rhodopirellula baltica SH 1
MLSTQSPPIQTRTLDNGLTVVVQPMPWLRTAAYTLWLPAGITTELVGLSESQLADPEYLACRDGLASLTCEMVQRGAGAYNSRQLVAAEDNLGIDSGNSAATSVAGYSARMPAESLLPAIELLADVVRRPHLPGNQFDDAKMILRQELAAFQDEPTQRLMRRLRERQYGPSLGRGGYASEASLEALSMDDVRQFYTDQYHAGGSVLAVAGNFDANQIFDSIEQSFGDWKSGKRPALPSPAPIDGNEHIELPSSQTHIGFSFDSIPYGSDDYFVMRAGIGILSDGMSSRLFDRVREQRGLCYSVWASTHTIGQHGAVFGYAGTTPARAQETLDVSLREIQHLADDLEQEELSRWKVRIESGLIMEQESAGSRASSLASDQYQLGRVIPTEELEAKIEAITLDQVASYFRQHGPRQFRIVTVGPEALQGGETLA

SEQ ID NO: 77127 - protein, 383 aa, Anabaena cylindrica
MDDKLMLMIPGPTPVPEAALLALAKHPIGHRTSEFSNMMGEVTQNLKWLHQTESDVLMLNVSGTGAVEAGMINFLSPGDRILVGSNGKFGERWVEVGQAFGLNVEAITAEWGQPLDPDKFAQKLQADTNKEIKAVIITHSETSTGVINDLVAINSHVKEHGQALIIVDAVTSLGAYNVPVDALGLDVVASGSQKGYMIPPGLGFVSVSPKAWEAYKTAKLPKYYLDLGKYRKATAKNTTPFTPPVNLMVALHTTLGMMKKEGLESIFTRHERQKNATRAAMKALNLPLFAADECASPAITAVATPGMEADKIRSLMKKRFDIALAGGQDHLSNKIFRVGHLGFVSDRDILSCIASLEVVLLELGHENFNSGAGVAAAARVFSN

SEQ ID NO: 77128 - protein, 420 aa, Rhodopirellula baltica SH 1
MNELKSTTLANGLRIVADIDLRGYSAAVGYFVRAGARDETDIESGLSHFLEHMMFKGTARRSAADVNRELDELGGQSNAYTSEEQTVYYSSVLPKYQDRMVDLLTDMLSPSLDADDFATERNVILEEIAKYEDQPPFGAFERVMECAYGPRGLGRRVLGTTHSIESMQVESMRAYFNRRYRPENIVLAASGNVDFDGLVAQAEKMTQHWLDRPAPSDLASDDLGTTPEGIELTQHLSVPDASQSYRVTLGDGPSMQSELRYAMRLLASIVGDDGGSRLFWDLIDTGRAEVATLWPQEFTDTGALFTYLVCAADDMDSNVRLMNEVFGRVARDGVEQSELDQVINKTVAGCIMQSERPSNRLFGLGSRWLCCGDYLSLDELLDAYRGVTIESVAEAARTYLGQSATEVVASSAEPQSNLVG

SEQ ID NO: 77129 - protein, 384 aa, Synechococcus sp. PCC 6716
MQDKAMLMIPGPTPVPESVLLSLGKHPIGHRSGEFSQIMAAMTAGIKWLHQTQNEVLILAASGTGAMEAGIINFLSAGDRVVVGCNGKFGDRWGEVCDAYGLTTERISAPWGQPLNPDDFKAVLDGHRQKPSKAVIVTHSETSTGVINDLEAINRHVKAHGQALIIVDAVTSLGAVSVPIDEWGLDVVGSGSQKGYMIPPGLAFVSVSPKAWEAYKTATLPKFYLDLGKYRKDAAKHTTPFTPPVNLFFALKTALEMMQAEGLEAIFQRHQRLMQATRAAMKALNLPLYAADSCASPAITAVAPQGVEAENIRSLMKKRFDIALAGGQDHLKGQIFRIGHLGFVGDRDILAAVSALEAVLAELGYTNFTPGAGVAAASRVLSTA

SEQ ID NO: 77130 - protein, 141 aa, Vibrio campbellii AND4
MALERTFSIVKPDAVERNLIGEIYHRIEKANLRIVAAKMVHLTEEQASGFYAEHEGKPFFPALKEFMTSGPIMVQVLEGEDAIARYRELMGKTNPEEAACGTIRADYALSMRHNSVHGSDSPESAAREIEFFFPESEICPR

SEQ ID NO: 77131 - protein, 418 aa, Bordetella pertussis Tohama I
MSYQHIKVPTGGQKITVNADYSLNVPDQVIIPVIEGDGTGADITPVMIKVVDAAVQKAYAGKRKIHWMEVYAGEKATKVYGPDVWLPEETLDAVKDYVVSIKGPLTTPVGGGIRSLNVALRQQLDLYVCLRPVRYFKGVPSPVREPEKTDMVIFRENSEDIYAGIEYMAESEQAKDLIQYLQTKLGVTKIRFPNTSSIGIKPVSREGTERLVRKALQYAIDNDRASVTLVHKGNIMKFTEGGFRDWGYALAQNEFGAQPIDGGPWCKFKNPKTGREIIVKDSIADAFLQQILLRPAEYDVIATLNLNGDYISDALAAQVGGIGIAPGANLSDSVAMFEATHGTAPKYAGKDYVNPGSEILSAEMMLRHMGWTEAADLIIASMEKSILSKKVTYDFARLLEGATQVSCSGFGQVMIDNM

SEQ ID NO: 77132 - protein, 408 aa, Salmonella enterica subsp. enterica serovar Paratyphi B str.
MFKEERRHAIINLLIKDNSVSVSKLSDLYKVSQETIRSDLRYFQKSGMLQRCYGGGILNRDALSKLITENKIDISSTIATPIHQDAKLRRENPKKAGKVCVLGSFNIDVSATVPWFPQSGESILASQFGFYPGGKGANQALAANNAGAAAHFIFKVGKDQFSAFAMNHIIQSGITSYSAYQTDKAPTGSALIYVSAVDGDNIIAIYPGANMMLTTQEINEQHRYIAESDVMLMQLETNIEALTEFIRLGKQENKMIMLNPAPYTKQVTHLLSDIDIITPNETEASFLSGVTITDINDAKKAGNIILQSGVKKVIITLGARGSLLCEHARTLYIPAWSAVVKDAAGAGDAFNGALAAALARQADMVAAIQYASAFASLAVEQVGASSMPQHLQVLHRMRTQSNKVIHIN

SEQ ID NO: 77133 - protein, 768 aa, Glycine max
MGAALLSELATEIVVPVCAVIGIVFSLVQWFLVSRVKLTPDRNGTTSSPRNNKNGYGDFLIEEEEGINDHSVVVKCAEIQNAISEGATSFLFTEYQYVGIFMVAFAILIFLFLGSVEGFSTKSQPCTYDKSKLCKPALATALFSTVSFLLGAITSVLSGFLGMKIATYANARTTLEARKGVGKAFITAFRSGAVMGFLLAANGLLVLYITINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTAMLYPLLISSMGIIVCLITTLFATDFFEIKAVKEIEPALKKQLIISTVLMTVGIAIISWIALPTSFTIFNFGAQKEVKSWQLFLCVGVGLWAGLIIGFVTEYYTSNAYSPVQDVADSCRTGAATNVIFGLALGYKSVIIPIFAIAISIFVSFTFAAMYGIAVAALGMLSTIATGLAIDAYGPISDNAGGIAEMAGMSHRIRERTDALDAAGNTTAAIGKGFAIGSAALVSLALFGAFVSRAGILTVDVLTPKVFIGLIVGAMLPYWFSAMTMKSVGSAALKMVEEVRRQFNTIPGLMEGHAKPDYATCVKISTDASIKEMIPPGALVMLTPLIVGIFFGVETLSGVLAGALVSGVQIAISASNTGGAWDNAKKYIEAGASEHARTLGPKGSEPHKAAVIGDTIGDPLKDTSGPSLNILIKLMAVESLVFAPFFATHGGLLFKIF

SEQ ID NO: 77134 - protein, 383 aa, Wolbachia endosymbiont of Drosophila melanogaster
MNIHEYQAKEVFHKFNVPVPKGFVATSAEEVKTQVSQLKSDVFVVKAQIHAGGRGKAGGVKLAKSVEEAQQFVKDMIGMTLVTHQTGPSGQQVRKVYVEEGSSIKKEYYLSLVIDPKLSRPIFIFSSEGGMDIEEVAKNSPAKIVKFDIDPATSFDSSKLSSRFHLSPEQIEKISNIAKKIYDAFIATDASQIEINPLVETNSGDFIALDAKINFDDNALYRHPEIMELRDYDEEVKEEIEASKYGLSYIKMDGSIGCMVNGAGLAMATMDIIKYYGAEPANFLDVGGGASKETVTEAFKIILSDSNVKGILVNIFGGIMRCDIIASGIVAAAKEMSIKVPLVVRLSGTNFEEGKKILEESGLNIIAADELDEAAQKIVKEVK

SEQ ID NO: 77135 - protein, 826 aa, Candida albicans SC5314
MTGEEDKKQHFDASGASAVDDKTATAILRRKKKDNALVVDDATNDDNSVITMSSNTMELLQLFRGDTVLVKGKKRKDTVLIVLADDDMPDGVARVNRCVRNNLRVRLGDIVTVHPCPDIKYANRISVLPIADTVEGINGSLFDLYLKPYFVEAYRPVRKGDLFTVRGGMRQVEFKVVEVDPEEIAIVAQDTIIHCEGEPINREDEENSLNEVGYDDIGGCKKQMAQIRELVELPLRHPQLFKSIGIKPPKGILMYGPPGTGKTIMARAVANETGAFFFLINGPEIMSKMAGESESNLRKAFEEAEKNSPSIIFIDEIDSIAPKRDKTNGEVERRVVSQLLTLMDGMKARSNVVVIAATNRPNSIDPALRRFGRFDREVDIGVPDAEGRLEILRIHTKNMKLADDVDLEAIASETHGFVGADIASLCSEAAMQQIREKMDLIDLEEETIDTEVLNSLGVTQDNFRFALGNSNPSALRETVVENVNVTWDDIGGLDNIKNELKETVEYPVLHPDQYQKFGLAPTKGVLFFGPPGTGKTLLAKAVATEVSANFISVKGPELLSMWYGESESNIRDIFDKARAAAPTVVFLDELDSIAKARGGSHGDAGGASDRVVNQLLTEMDGMNAKKNVFVIGATNRPDQIDPALLRPGRLDQLIYVPLPDEPARLSILQAQLRNTPLEPGLDLNEIAKITHGFSGADLSYIVQRSAKFAIKDSIEAQVKINKIKEEKEKVKTEDVDMKVDEVEEEDPVPYITRAHFEEAMKTAKRSVSDAELRRYESYAQQLQASRGQFSSFRFNENAGATDNGSAAGANSGAAFGNVEEEDDLYS

SEQ ID NO: 77136 - protein, 420 aa, Sulfitobacter sp. EE-36
MQKIAVIGLGYVGLPLAIEFGKNRPVIGFDINQSRINALREGRDDTLEASEEELREASQLSFTTNPADLADAQIYIVTVPTPIDAHKRPDLTPLIKASETLGKVLKRGDIVIYESTVYPGATEEDCVPVLERISGLTFNEDFFAGYSPERINPGDKTHRLPDICKVTSGSTPDIAEKVDQLYASIITAGTYKAESIRVAEAAKVIENTQRDLNIALVNELAIIFNKMGIDTEAVLKAAGTKWNFLPFRPGLVGGHCIGVDPYYLTHKAEAVGYHPQVILAGRRINDGMGAYVAGQLVKAMLKRRIQVNGAKVLILGLTFKENCPDLRNTRVVDVVHELQDYGIHIDIYDPWSNPEEARHEYGVDLVEAPQDDYYDGIVLAVAHDQFKVMGGNGMRAFGKADHVLYDLKNVLGAQESDLRL

SEQ ID NO: 77137 - protein, 730 aa, Zea mays
MSRVASLSPSLSGDEVEVEEEEEDEGVDGYRKGGYHAVRPGDQFAAGRYVAQRKLGWGNFSTVWLAFDVQSQRYVALKIQKSAPEFAQAALHEIEFLSEITKKDPLNCKCIIQLIDHFKHTGPNGQHICLVFELLGDSLLKLVQYNRYKGIGLDRVRQICKSILVGLDYLHNELGIIHSDLKLENLLLLSTIDPSKDPIRSGLKPCLERPEGNPNGEGGINAIENKLKMRARRVLAKLAEKRKSAVESSRSERSLDGIDMTCKIVDFGNACWADKQFTDFIQTRQYRAPEIILGAGYSFSVDMWSFACIAFELATGEILFTPKEGHGYSEDEDHLALMMELLGKMPKKIATMGTRSKEYFDRHGDLKRIRRLKLSSIERVLVDKYKISESDAREFANFLCPLLDFAPEKRPTALDCLKHPWLHYNEDKTCQSLNNNDAKNIDLAQSPGSITSGNCTNIDLTSKKGSSTGTCDKTVDAKYNTRSITSNATMNTYVQPTSGSFANRLAKNVDVNPNIGSISNRDAKSSDMKAHMGSNTISDAKSSIVKLDTGNITDRNAKPVDIKPNSDNISSRDDKSSNVDTTTSSVVNKDAKRSIRSVVNSYIKNFDAKCNTGSTANSDARDPSDTKSSTKIVSSADNAKCVDIKPINGSDKSNDTSDKSNDTVDANVKSNSGIVANSDASNTDVQTNTGSVNNSDDYSIDSKPNIGRVAASIQRLESSMGKYRADLSQD

SEQ ID NO: 77138 - protein, 551 aa, Shewanella sp. ANA-3
MILLSIEGMTCPSCVAHVKEALDAIEGVNKVEISYENASATITTNGGVSVTDLIGAIEALGYNPLAENTAPNAYCDNENTSNTESNRTQHVAIIGTGSGAFACAIKAAEGGAKVTLIEGADVIGGCCVNVGCVPSKILIRAAQLAQQQRNNPFAGLENHAPQLSRALLAQQQTARVEELRAAKYQNILETNPALSLLKGWAQFKNANTLIVRKNDGTEQEIFADKILIATGSTPTIPPIEGLAETPYWTSTEALFAEELPQHLVVIGSSVVALEIAQAYRRLGSEVTVLARHSLLYSEDPIIGEKLAGCFEKEGIRVLNNTQATQVTHDGNQFTLNTNAGELSCDRLLVSTGRHANTSQLNLDAVGVTTNKKGEIVVNERMETNVAGIYAAGDCSNMPQFVYVAAAAGSRAGINMTGGDAKLDLSTMPAVIFTDPQVATVGLTEEQARAQDIETDSRVLGMENVPRALANFETDGFIKLVTEKETGLLLGAQILAHEGGELIQSAALAIRNRMTVTELADQLFPYLTMVEGLKLCAQTFNKDVKELSCCAG

SEQ ID NO: 77139 - protein, 402 aa, Prochlorococcus marinus subsp. marinus str. CCMP1375
MAKRSLSNLSVEDLCGKRVLVRVDFNVPLNEEGSITDDTRIRAALPTIQHLIEKEARVILSAHFGRPKGKVNEDMRLTPVSQRLSELLGKTVVKTESCIGPDAEKKVHEMSNGDVVLLENVRFIGEEEKNDSEFAKKLASLAEVYVNDAFGAAHRAHASTEGVTNYLSPSVAGYLMEKELKYLQGAIDSPQRPLAAIVGGSKVSSKIGVLESLIDKCDKVLIGGGMIFTFYKARGLSVGKSLVEDDKLDLARALEKKAKEKGVQLLLPSDVVLADNFSPDASSQMVQIDSIPEGWMGLDIGKESVKLFQDALADCKTVIWNGPMGVFEFDKFANGTNSISTTLAELSAKGCCTIIGGGDSVAAVEKAGLASKMSHISTGGGASLELLEGKVLPGVAALDDEI

SEQ ID NO: 77140 - protein, 481 aa, Nicotiana tabacum
MASATASHTLCGIPATSSSTTNKAIAPSSARFLAKTPLRRLGFAGAAADSLFTNHVATKLRSLKSSSKPIRGVASMAKKSVGDLTAAELKGKKVFVRADLNVPLDDNQNITDDTRIRAAVPTIKHLMANGAKVILSSHLGRPKGVTPKYSLAPLVPRLSELLGIQVVKVEDCIGPEVEKLVASLPEGGVLLLENVRFYKEEEKNEPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATSLLEKAKAKGVSLLLPSDVVIADKFAPDANSKIVPASAIPDGWMGLDIGPDSVKTFNDALDTTKTVIWNGPMGVFEFDKFAVGTEAIAKKLADLSGKGVTTIIGGGDSVAAVEKVGVASVMSHISTGGGASLELLEGKVLPGVIALDEADAPVAV

SEQ ID NO: 77141 - protein, 401 aa, Nicotiana tabacum
MAVKKSVGSLKEADLKGKRVFVRVDLNVPLDENFNITDDTRIRAAVPTIKYLMQHGSHVILASHLGRPKGVTPKYSLKPLVPRLSELLGVEVKIANDSIGPEVEKLVAEIPEGGVLLLENVRFYKEEEKNEPEFAKKLASLADLYVNDAFGTAHRAHASTEGVAKYLKPAVAGFLMQKELDYLVGAVANPQKPFAAIVGGSKVSSKIGVIESLLEKVDVLLLGGGMIFTFYKAQGYAVGSSLVEEDKLDLATSLMEKAKAKGVSLLLPTDVVIADKFAADANSKVVPASEIPDGWMGLDIGPDAIKSFGSALDTTKTVIWNGPMGVFEFDKFAAGTEAIAKKLAELSGKGVTTIIGGGDSVAAVEKVGLAEKMSHISTGGGASLELLEGKPLPGVLALDDA

SEQ ID NO: 77142 - protein, 462 aa, Lactobacillus johnsonii NCC 533
MKLNPFRKESLKRYLGTDKHFVKTLGAFDLLTIGIGAVIGTGIFILPGTVAAKEAGPGVTLSFLIAALVCTLASMCYAELSSSIPVAGSAYSYGNILYGEVIGWILGWALILEYMLSVAAVSAGWASYFNSLLHSFGLHIPHHFEGPFDPLNGTYLNLWAVISVLLIGILLSRGMKASMKFNNAAVLIKIAIIFIFIGVGLFFIKPKNYQPFTPYGTTGVLRGATTVFFAFLGFDVVSSSAAEVKNPKKNMPIGIIGTLIVAALLYMGVSVVLTGMVNYKQLDVANPVAYALKVVNQGWVADLLSIGAIVGMSTMMLTMIYSSSRLIYSIGRDGLLPSFLGKIDKHGLPENALWIVTIVIAIMGGLFSLEELTSLVSIGTLLAFTFVSFGVILLRRRKDIPEGDFKVPFYPVIPILSGLACIGMMCFLSVKTYIFASVWFLFGLFIYCVYGYKHSKISKRNN

SEQ ID NO: 77143 - protein, 394 aa, Carboxydothermus hydrogenoformans Z-2901
MNKKSIRDVEVKGKKVFVRVDFNVPLNENREITDDTRIRAALPTLQYLREQGAKLIVASHLGRPKGQFNEKYSLKPVAKRLAELLGIEVKMAPDVVGPEVEKMAGELRPGEVLLLENVRFYPEEEKNDPEFARKLARLAEIFVSDAFGAAHRAHASTAGIASYLPAVAGFLMEKEINFLSRALNNPERPFVAIIGGAKVSDKIGVIENLLGKVDVLLIGGGMANTFLKAMGYETGKSLVEEDKVNLAGELMNKAKEVGVKLLLPSDVVVAPRIEAGVPSKIVAVDSIPAEEMALDIGEKTAKHFREEILKAKTVVWNGPMGVFEVEPFDRGTVAVAEAVAESGALSVVGGGDSVAAVEKAGVADKITHISTGGGASLEFLEGKKLPGVEVLNDK

SEQ ID NO: 77144 - protein, 372 aa, Arabidopsis thaliana
MPEIEIAAGSGDNNDALFGKYELGKLLGCGAFAKVFHARDRRTGQSVAVKILNKKKLLTNPALANNIKREISIMRRLSHPNIVKLHEVMATKSKIFFAMEFVKGGELFNKISKHGRLSEDLSRRYFQQLISAVGYCHARGVYHRDLKPENLLIDENGNLKVSDFGLSALTDQIRPDGLLHTLCGTPAYVAPEILSKKGYEGAKVDVWSCGIVLFVLVAGYLPFNDPNVMNMYKKIYKGEYRFPRWMSPDLKRFVSRLLDINPETRITIDEILKDPWFVRGGFKQIKFHDDEIEDQKVESSLEAVKSLNAFDLISYSSGLDLSGLFAGCSNSSGESERFLSEKVAGDVGGGSGGVCERGESEDEEEEGGRVWV

SEQ ID NO: 77145 - protein, 130 aa, Oryza sativa Japonica Group
MATMGEELYESDVLWPDHQSPHDVVPPTATATATAPTPARRGQQQITRHCSTASSRPVDIPRAAQRWSGGDQGDDCGGGTMVPPHVMVSRRRSTEEGDQAFSLRTGTGRARRDLSHLRNSVLRMTGFIEG

SEQ ID NO: 77146 - protein, 166 aa, Vitis vinifera
MECCGRPNRSDVHLTQEEAARIEEETRDYFDGIAPKRHAKPSRSEHSSQYVDPPSDRQHEDIPEFLKFQHLENDPQKLVYSGSEVTEEFVETEYYQDLNCIDKQHHTTGTGFIKMENADGKSFNLAANSATCCQASCKGNPATNDWIPAAADKVAFSSDKPNRSEN

SEQ ID NO: 77147 - protein, 466 aa, Lactobacillus johnsonii NCC 533
MNENETSKLGFWSIVLLAINSIIGSGIFLTPGSVVQQAGSKALIVYFIAAIFASILAISFAAAAKYVTKSGAAYAYSKAAFGNNVGFYMGILRYFSASVAWGIMAVGVIKSTISIFGGNPNETMSVTIGFLILMAVITVINLFGQKVVKYVMNLATIGKLAALVLIIVAGVVLLIVSGASSNLSQVDQITQNGQKIVPTLTTTGFVMAIVSAFYAFTGFESVASGSDDMKNPAKNLPRAIPLAIIVIAVIYIGVVAVAMMLDPKALMTTKQVVAIAAIFKNEILRDVILVGALVSMFGINVASSFNAPRILEAMARENQFSKALTKRTKNNFPIRTFFISVLFAILIPMAFEYNMVNLITLSAMVRFLGFIVVPLAVIQFYRGKTAEPVLDAQRNVWTDIVVPILSIVLVIFLLVEYNWKAQFGVVNAQGQVTGINWYAIAMMIFGFILLPLIMFIISRKDRKASK

SEQ ID NO: 77148 - protein, 460 aa, Lactobacillus johnsonii NCC 533
MENKQNHPPKLKRSMTAGQMEMISLGGAIGVGLFMGSTSTIKWTGPSVLLAYMFVGLILYIVMRALGEMLYVSPGTGSFADYATEYISPLAGYLAEWANVFQYIVVGISEVVAATEYLKFWWPEVSVFWSGIIIIAFLLLANLASAKAYGTLEFWFAMIKVVTIVIMIILGLLVILLGVGNHGKPIGFSNLWSHGGFFTGGVKGFFFSMAIIAGSYEGIELIGISAGEVANPQEAIVKSVKSVLWRILIFYVGAIFVIVTIYPWNQLSNIGSPFVETFTKVGITAAAGIINFVVLTAALSGANSGIYSSSRMLFKLAHEGEAPKAFGKLSKRIVPDRAIVGITSGILIGFILNLIMSTMNKSMGELFVVVYSSSVLPGMVAWFVILIAELKFRKNNSHLMAEHPFKLPLYPYSNYFAFAMLLVIVVFMFINPETRISVGVGAGVLVLASLVYMLKHRNKK

SEQ ID NO: 77149 - protein, 464 aa, Lactobacillus johnsonii NCC 533
MENKKSMPKLKRSMTAGQMEMISLGGAIGVGLFMGSTSTIKWTGPSVLLAYMFVGLILYIVMRALGEMLYVNPGTGSFADYATEYVHPLAGYLAEWANVFEYIVVGMSEVVAATEYLKFWWPKVNVFWSGIIIILFLVLANLASAKAYASLEFWFAMIKVVTIILMIILGFIVIFFGVGNGGKPTGFSNLWSHGGFFTGGVKGFFFSMSIIVGSYEGIELLGISAGEVANPKKAIVKSVKSVLWRILIFYVGAIFVIVTIYPWNELSNIGSPFVTTFAKVGITAAASIINFVVLTAALSGANSGIYSSSRMLFKLAHDGDAPKTFGHISKRIVPNHAILGISGGILIGFIINMIAATINKSTQDLFVVVFSSSVLPGMIPWFVILLAELKFRRNNQDLLVDHPFKLPLYPISNYFAFLMLIVIVIFMLINPETRVSVLVGAAVLLIATIVYLFRHKKDGVNNGE

SEQ ID NO: 77150 - protein, 345 aa, Oryza sativa Japonica Group
MAETMSTSGSESDSVAAKRSMKPKYSKFTQQELPAWKPLYTPGIVIGAFSLIGIIFIPIGLVSIAASQEVVELVDKYDGECVTANDKVGFIQDTKTDKACTRTITVPKPMKGPIQVYYQLENFYQNHRRYVKSRSDKQLRSKEFSSVIKTCDPEAISEGGAPIVPCGLIAWSLFNDTFTFSVNKKTVQVNKKNIAWSSDRTIKFGSDVFPENFQKGGLIGGGQLNEKLPLSEQEDLIVWMRTAALPTFRKLYGRIETDIMASDEITVVIQNNYNTYSFGGTKALVLSTTSWIGGKNNFIGFAYVAIGTISFLIALAFVGLNMVKPRTLGDPSYLSWNKENPDYVQ

SEQ ID NO: 77151 - protein, 196 aa, Oryza sativa Japonica Group
MAVSPWSCRCGVSRSPGKSRGAPAPSSPDKRSKYSAQSVRAMPMRVLTVGKKRSRGAQLIVEEYKEKLGYYCDIEDTLIKSNPKLTSDVKVQVEAEDMAMMLQLKPEDFVVVLDENGKDVTSEQVADLVGDAGNTGSSRLTFCIGGPYGFGLQVRERADATIRLSSMVLNHQVALIVLMEQLYRAWTIIKGQKYHH

SEQ ID NO: 77152 - protein, 417 aa, Wolbachia endosymbiont of Drosophila melanogaster
MIFILCYFIDNTEHKNLEIKLEHYQKMQAIGQLAGGIAHDFNNILTGIIGFCDLLLLQHSAGDPSFGDIIQIQQNAKRGSNLVRQLLAFSRRQTLQPKIIDVNNTIANLYEMIKRLIGENIKFNIYYGRDLGAVRADQGQLEQVILNLAVNASAAMEKGGELTIRTFNQKIDSLNSTPQDMFSPDKEAIEHGNYVVIEVIDTGCGMTSDTTEKIFDPFFSTKDITSGTGLGLSTVYGIIKQTEGYIYVASKVNHGTKFSIFLPMVYISDESDREEDSEETEKPVVSEIKGNGIILLIEDEDSVREFISKALKRKGFDVIEASIGSEAPEIISKKSQHIDLIITDVIMPEVSGPEIVKEALIHRPNINVIFISGYAEDAFLKSDDINIEDFHFLPKPFTLNELGNKVQSVLHKAKKTV

SEQ ID NO: 77153 - protein, 546 aa, Glycine max
MVFEISTVVSKLQTLSTSDHASVVSMNLFVALLCGCIVLGHLLEENRWMNESITALLIGVCTGIVILLFSGGKSSHILVFSEDLFFIYLLPPIIFNAGFQVKKKQFFVNFMTIMLFGAIGTLISCTIITLGATQIFKRLDVGPLELGDFLAIGAIFAATDSVCTLQVLNQDETPLLYSLVFGEGVVNDATSVVLFNAIQSFDLNQIDPSIAGHFLGNFLYLFIASTMLGVLTGLLSAYIIKKLYIGRHSTDREVALMMLMAYLSYMLAELSYLSGILTVFFCGIVMSHYTWHNVTESSRITTKHSFATLSFVAEIFIFLYVGMDALDIEKWKFVSDSPGTSVATSSVLLGLILLGRAAFVFPLSFLSNLAKKSPNEKISFRQQVIIWWAGLMRGAVSIALAYNQFTMSGHTSLRSNAIMITSTITVVLFSTVVFGLLTKPLIRLLLPHTPHHKESSITITTDPSTPSPKSVTVPLLGSAQESEVDIDGHDIHRPSSIRALLSTPTHTVHRLWRKFDDAFMRPVFGGRGFVPIEPGSPTERNGHQWR

SEQ ID NO: 77154 - protein, 406 aa, Salmonella enterica subsp. enterica serovar Paratyphi B str.
MTFPVEKVRADFPILQREVNGLPLAYLDSAASAQKPNQVIDAESAFYRHGYAAVHRGIHTLSAQATESMENVRKQASRFINARSAEELVFVRGTTEGINLVANSWGTENIRAGDNIIISEMEHHANIVPWQMLCERKGAELRVIPLHPDGTLRLETLAALFDDRTRLLAITHVSNVLGTENPLPDMIALARQHGAKVLVDGAQAVMHHAVDVQALDCDFYVFSGHKLYGPTGIGILYIKEALLQEMPPWEGGGSMISTVSLTQGTTWAKAPWRFEAGTPNTGGIIGLGAAIDYVTSLGLDKIGDYEQMLMRYALEQLAQVPDITLYGPAQRLGVIAFNLGKHHAYDVGSFLDNYGIAVRTGHHCAMPLMAWYGVPAMCRASLAMYNTHEEVDRLVAGLTRIHRLLG

SEQ ID NO: 77155 - protein, 320 aa, Psychrobacter arcticus 273-4
MGLLVDGQWQDKWYDTEASGGRFEREDAGFRNWVTVDGSAGPSGQGGFQAEANRYHLYVSLACPWANRTTIFRQLKGLEDIISMSVVHPFMGDKGWTFAEGTGVVADPIINASYLYEVYTAAEPNYTGRVTVPILWDKKTNTIVSNESAEIIRMFNSAFDDVGAVVGDFLPSDAIVEIDEINAFIYDAINNGVYKTGFATTQEAYEDAVITLFDALDTLEARLAVQRYLLGDRITEADWRLFTTLVRFDAVYVGHFKCNIRRIVDYPNLWGYLRDLYQVPGIKDTVNMDHIKAHYYTSHTTINPTGVIPAGPVIEFDKPH

SEQ ID NO: 77156 - protein, 423 aa, Triticum aestivum
MEEELHALLRDLDALKQLPDPASIDRMRDRVVKMMGPSGAAAATRSKIKDMSAEVVDSNPYSRLMALQRMGIVDNYERIRDYSVAIVGVGGVGSVAAEMLTRCGIGRLLLYDYDTVELANMNRLFFRPDQVGMTKTDAAVQTLSEINPDVVLESYSLNITTVKGFETFLGSLKARSSNGRSTGVDLVLSCVDNYEARMVVNQACNEPRQTWMESGVSEDAVSGHIQLLVPGETACFACAPPLVVASGVDERTLKRDGVCAASLPTTMGVVAGLLVQNSLKYLLKFGQVSPYLGYNSLKDFFPTMEMRPNPQGSNPACLERQKEYMHSKPARDAAAKAKMEAEASAAIEYPVHMDNEWNISVLDDSDTATSSVQRAATDILPEGLVRELPDEDSYVAPPAPASSGAIDDDLEELQRQLDALNSS

SEQ ID NO: 77157 - protein, 517 aa, Vibrio campbellii AND4
MTKNIHDQRILILDFGSQYTQLVARRVREIGVYCELWSWDVEEADIREFNPDGIILSGGPESVTENNSPRAPQYVFDSGVPVLGVCYGMQTMAEQLGGKVAGSTEREFGYAQVKVSGESALFKDLELTQDVWMSHGDKVVEIPADFVKVGETDTCPYAAMANEEKKYYGVQFHPEVTHTKGGLQMLENFVLGACGCERLWTSESIIEDAVARIKEQVGEDEVILGLSGGVDSSVVAMLVHRAIGDKLTCVFVDNGLLRLNEGQQVMDMFGDKFGLNIIKVDAEERFLNALEGKSDPEEKRKTIGHVFVDVFDEESKKLENAKWLAQGTIYPDVIESAASKTGKAHVIKSHHNVGGLPDDMEMGLVEPLRELFKDEVRKIGLELGLPYNMLYRHPFPGPGLGVRVLGEIKKEYCDLLRRADAIFIEELHAADLYNKVSQAFTVFLPVRSVGVMGDGRKYDWVVSLRAVETIDFMTAHWAHLPYDFLGKVSNRIINEVEGISRVVYDISGKPPATIEWE

SEQ ID NO: 77158 - protein, 624 aa, Candida albicans SC5314
MLKTSIRTLKRMTNSKLIELPKSSSFTQRIKPDKRVPSVEVALENEGNITNTPRNITHGGFSWVLPTPRDDYEFMIANPLTMKDLGLSLDEIEDPVFQSIVSGEFYQDKVTFVKENFPMPYAQAYAGWQFGQFAGQLGDGRVVNLFEVPKAVPDGENRDKYEIQLKGAGKTPFSRFADGKAVLRSSIREYIISEHLHAIGVPTTRALALTYLPSTLAQRHGAERCAIVARFAESWVRMGTFDLYRWRGDREGIRDLSDYVINELFTINGVKFQNFERIVKTGPNFFKLNDKLLGELTDYDKMYYETVVRNAETTAICQCYGFLNGVLNTDNTSILGLTIDFGPFSIMDKYNPNYTPNSEDHEGRYGYRNVPTAIWWNLTRLGEDLAELVGAGNELLNDPSFQQGIKEEWEDSIIKRATKIIEIGGEIYQHAFTKKYVETFFNRLGLSHELIDAQNPEIQRTDVIVPMLDVLYKIQTDFNLFFLKLQDLDLDSGDYALIAEKEFLPNYDFNTHRQHKDDLIKQISEWLILYHELRNKTKKYKSTPDPAKYNPKFLPRNWILDQVIQQAESSRGAETTYLEKLQKMSSNPYDETKWGDELKDLEQSWLLQGNKGDEFAMLQCGCSS

SEQ ID NO: 77159 - protein, 387 aa, Oryza sativa Japonica Group
MGFNLLLVPLLLVWCEWMEMFFSSFLNESASSENLFGHPNVERCPFLRNINGATTYSFSSALPVAARGGNGPIFEDGPGFDSAFKLFHGWDGIVPLSGKSYLPDESNSESIDANPEPALLFNPLAARAATISLSAFGPFGFNFFNGKGKRQNKKPNNLNQSNKKPSNPNQNSMKQKGGNSSSHEAMSNEWMENGQCPLARSYRAMSGILPLVAKALQPPAGVKLKCPPAVVAIRAALARTELVKSLRPQPLPAKMVAIALLGMAANIPLGVWREHTKKFSPQWFAAVHAAVPFIGMLRKSVNMPKTAMAFTIAASIIGQTIGSRAERIRLKALAAKGDADSTTVADMYPNKSGNCSDTEGKAWDPLAMKMAGRASGGVAAPTPSMCF

SEQ ID NO: 77160 - protein, 752 aa, Arabidopsis thaliana
MAAGRNIRYPDHELRDQESNSRFSRRDSAYANEDYNHVRNGAIDNGKGRVSNLRHGDRDRIKSGARQEENKMVSSGFRLSKSNPGSREVFIDLGPKRCGFSARSVDREPGELSSESGSDDLIESESLAKVNGVVKEVENRAQSPVEKKRKFSPIVWDRDDHERSNLSRNEKPVEVSPLPPPPPLVKRSSQSPSVSCGGNSHYSPAKSDMHQDPVEVGVSAVSMPALSPSVEMSSLCVVEQSSNAEKDDKQEHATHLEEDENMPTRHISSSRWAAGNSSPTDEVEIVEEVGEKKRRKKPFPVQGRFRNTSQTPEVGELVREGYRSSDSDERGHHSLPGSRDDFEERDAVKSDKMEIDEEEHRRENSVDSLSETDSDDEYVRHETPEPASTPLRSINMLQGCRSVDEFERLNKIDEGTYGVVYRAKDKKTGEIVALKKVKMEKEREGFPLTSLREINILLSFHHPSIVDVKEVVVGSSLDSIFMVMEYMEHDLKALMETMKQRFSQSEVKCLMLQLLEGVKYLHDNWVLHRDLKTSNLLLNNRGELKICDFGLARQYGSPLKPYTHLVVTLWYRAPELLLGAKQYSTAIDMWSLGCIMAELLMKAPLFNGKTEFDQLDKIFRILGTPNESIWPGFSKLPGVKVNFVKHQYNLLRKKFPATSFTGAPVLSDAGFDLLNKLLTYDPERRITVNEALKHDWFREVPLPKSKDFMPTFPAQHAQDRRGRRMVKSPDPLEEQRRKELTQTELGSGGLFG

SEQ ID NO: 77161 - protein, 445 aa, Pisum sativum
GGFSVVRKGTRKSNNDDEKSQSQSKSQSQSQVAIKTLRRLGTSNNLPRKKDGGENSTETMMKFPTMRQVSVSDALLTNEILVMRRIVENVSPHPNVIDLYDVYEDTNGVHLVLELCSGGELFDRIVAQDKYSETEASTVVHQIVAGLEAIHRANIIHRDLKPENCLFLDVGKDSSLKIMDFGLSSVEEFTDPVVGLFGSIDYVSPEALSQGKITTKSDMWSLGVILYILLSGYPPFIAQNNRQKQQMILNGNFSFYEKTWKGISQSAKNLISSLLTVDPAKRPSAQELLSDPWVKGEKAKDDQMDPEIVSRLQRFNARRKLRAAAIASVWSSTIFLRTKKLKSLVGSYDLKEDEIENLRMHFKKICADRDNATLCEFEEVLKAMKMPSLIPFAARIFDLFDNNRDGTVDMREILCGFSSLKNSKGEDALRLCFQMYDTDRSGCIT

SEQ ID NO: 77162 - protein, 159 aa, Glycine max
  misc_feature (122)..(122): Xaa can be any naturally occurring amino acid
  misc_feature (138)..(138): Xaa can be any naturally occurring amino acid
MVGGDSSPPRALDAETREDLKRVSAHRALHMVESGVTLGFGTGSTAAHAFNRFGAFFRTGALRAVAGVPTSLKTEAHAARVGIPMLALAEGGQDPLLIDGRDEDRPGLHLFKGGGGSLLREXMIEGAGARFVVIVDEXKLVPRLGWTGFVPREDVPFGA

SEQ ID NO: 77163 - protein, 66 aa, Glycine max
  misc_feature (41)..(41): Xaa can be any naturally occurring amino acid
SGTTCCTDQDLLIRRGELVPVNIKGAILVGTMNDYLETTLXYTLISRWRELMIIQNGMLEPLLESR

SEQ ID NO: 77164 - protein, 398 aa, Streptococcus pyogenes M1 GAS
MAKLTVKDVDLKGKKVLVRVDFNVPLKDGVITNDNRITAALPTIKYIIEQGGRAILFSHLGRVKEEADKEGKSLAPVAADLAAKLGQDVVFPGVTRGSKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSEGFLGLDIGPKSIAEFDQALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 77165 - protein, 435 aa, Vitis vinifera
MKKAVSSVITRVKARQILDSRGIPTVEVDLYTNKGMFRASVPSGTPIGMYEAVELRDGDKGTYLGNGVTRAVRNVNEKISEALIGMDPTLQSQIDQVMIDLDKTEKKGELGANAILARHFFFPNLAFSYIYTVPLYKHIADLSGQSNLFLPVPAFTVISGGKHAGNTLAAQEIMILPIGATRFEEALQMGAETYHHLKAVITEKYGAHGCHVGEDGGLAPNISRQRRFGSTIGRTGYNEKIKIAIDVAATDFCIGAKYDLDFKSPNKSGQNFKSGEDMIEMYKELCNDYPIVSIEDPFDKEDWEHIRNFYLFRRAVLQVVGDDLLMSNPKRIERARRESTCNALLLKVNQVGTVTEAIEVVKLAKDAHWGVVTSHRCGETEDSFLADLSVGLATGQIKAGAPCRGERLAKYNQLIRIEEELGDQAVYAGEDWRQS

SEQ ID NO: 77166 - protein, 465 aa, Lactobacillus johnsonii NCC 533
MKNFFKKVPVNTFLKADSRLTRHLNARDLVALGIGAVIGTGIFILPGHEAAQHAGPAVAISFLLAAIVSGMVGMAYAEFSSAMPVAGSAYSFGSVIYGEVVGWIIGWGLLLEYFLAVSAEATGFASYFNNNILAPIGIHLPKALEAGPMEGGVINISAVLIVLIVALILYQGANLSKRVENIAVIIKVAIIILFIVIGMFYIKADNYVPFYPKKFQTPPLGIGGISTAAATVFFAFIGFDALAANSAETKDPEKNVVKGIMGTVIIAVLLYVSFSLVLTGMVNYKQLNVDDPAAYALKVVGLTAWNKLITVGALVGIFTAMITMLLGGSRLLYALGRDGLLPDSMGSVHAKKMIPDHAVIVSTIVAAVFAGLVPLMELASLINAGTLIAFALISFGIIPLRHRKDIVNDGFKMPLYPVLPVIAGLLSVYFIWMLPNTTKIMVGIWLIVGIIVYATYGIKHSKLQN

SEQ ID NO: 77167 - protein, 432 aa, Prochlorococcus marinus subsp. marinus str. CCMP1375
MIDSLDLVIDSIFAREVLDSRGNPTVEAEVLLEGGAKGRAIVPSGASTGAYEAHELRDGGTRYMGKGVLRVVEHIEDRIAPSLCGLSASDQVNVDQIMRELDGTENKENLGANAILAVSIATARSAANAFGMPLYRYLGNPMSSLLPVPLMNVINGGAHAANNLDFQEFMLVPHGAESFREALRMGAEVFHTLKKLLSDKGLSTAVGDEGGFAPDLENNNAAGDLLVQAIEKAGFRPGEEISLALDVASTEFFKNGLYHFGEGKFSSEKMVEELKKLVNLYPIISIEDGLSEDDWSGWELLTKELGNKVQLVGDDLFVTNTKRLRQGIDRSIANSILIKVNQIGTLTETLEAIDLSHRMGYTSIISHRSGETEDTTIADLAVATRAGQIKTGSLSRSERVAKYNQLLRIEDQLGAQAVYAGSVGLGPRGLSK

SEQ ID NO: 77168 - protein, 140 aa, Triticum aestivum
  misc_feature (65)..(65): Xaa can be any naturally occurring amino acid
  misc_feature (79)..(79): Xaa can be any naturally occurring amino acid
  misc_feature (106)..(106): Xaa can be any naturally occurring amino acid
SHLTHHYSSCLTHFTTLLASSLPWVLVPPTSLAKMWTVTRAYLDQRLAAAKRCSREAAMAGAKAXAAVATVAAAVPTLXASVRMLPWARAHLNPTGQALIISTVAXGMAYFIVADKTILSMARKHSFDDAPDHLKNTSFH

SEQ ID NO: 77169 - protein, 337 aa, Erwinia carotovora subsp. atroseptica SCRI1043
MHLARFPRLSLGHFPTPLEVLPNLSAYLGGPTIYIKRDDATGLATGGNKTRKLEFLLADAQQQGADVIITQGATQSNHVRQTIAAAAKLGLKTKVLLEKRVEDYGEDYQRSGNVLLDNLLGGDIIDHLPAGTDMQQAMETLAESLRKEGFKPYVIPGGGSSPVGALGYVACAEELLFQSSQQRLRIDHIVHATGSTGTQAGLVTGLAATHSQIPLLGISVRAPKAKQEENVYALAQRTWQLLGIPGELPRSAVRVNSDYVGKGYGIPTEGTLEALRLLAQLEGILLDPVYSGKGMAGLIDLIRQGHFRADENIVFIHTGGSAGLFGYRQLFEQTAAQ

SEQ ID NO: 77170 - protein, 280 aa, Populus trichocarpa
MPTVAPLIIFKLSIFIIVTLQPPPALSLTPCRTSCGSIAINYPFGIDDGCGAPQFRSMLNCSTDLFFLTPSGGYKVQHIDYDKKTMTIYDPAMSTCSILQPHHDFIMTDIQSVTIPPTPDTVFALLNCSIDSPVLNHYKNLCFDFSGHSCDELYGACNAFRVFHLLTNSSPPCCFTGYDTVKFMRMNILDCTHYTTVINTDNLRGIGPLDWVYGIKLSFTVPETGCERCSQSGGTCGYDTETEVMTCLCSSSTNYTRECAGGSFTAGDHRAAILRGHSSM

SEQ ID NO: 77171 - protein, 193 aa, Wolbachia endosymbiont of Drosophila melanogaster
MRPVILCGGSGSRLWPLSKPKQFQKIFSQNTMFHNTLLRLKSDYMPPIIATNIQYESLVMEELHALQEYKVIFEPVKIGTAAAILIAALLCNENETMLILPSDHFIGDLNSFYASTQKASKLASETNSIVTFGVKPHEFNSEYGYINAVYDQKEKCHIVKDFTEKPERKLSNDHYWNSGIFVFRGCPETSKRL

SEQ ID NO: 77172 - protein, 431 aa, Legionella pneumophila str. Paris
MDMDIKHKPLKRELSLFGATMMGLGSIVGTGVFVSIGIAAGVTGPSVILAIALAALVATCNAFSSAQLAANHAVSGGTYEYGYRYLHPAFGFTAGWMFLCAKSASAATAALGFAGYFIHLSGLETVPVIPIALAVSITLILLVLSGLRRTNTVNIIIVMITLITLTVFIISGLPDFMQRGTANLRPFFPVSKQEGLSHFFYATALMFVAYTGYGRIATLAEEVKNPGKFIPAAIIITLMVSAVLYILVGLVAIGAVGVEKLAQVTETNATPLESAAQAIGIPGLSVLVSIGACTAMLGVLLNLILGLSRVALAMGRKGDLPKIFCYVSETRHVPVSSVIGVGVVIIALVLTGSVETTWTFSAFTVLIYYAITNLAALHLPKEEQLYPPLFAIGGLLSCLFLAFWVPIGVWITGISLLVLGLLWKVVANRFL

SEQ ID NO: 77173 - protein, 94 aa, Glycine max
MAWKHSSDGNFTCLTIISPDRDDIVLPIPENENPKGLWFTTKEGSHYRLKFTFNEFDIIIFFQLKKVHIIMPPLTKLTGMVACHNNSSVGSSPS

SEQ ID NO: 77174 - protein, 146 aa, Bacillus thuringiensis serovar konkukian str. 97-27
MNVYKWYKVSRVLYEWKIPFIPGFITYLIRFIFGCYIPFSARIGKRTTLGYGGLGIVIHRRAIIGDNCIINAGVTIGGTSKKNNVPKLGDKVYVGTGAKILGPVSIGNNVVIGANAVVLKDIPDNCMVVGIPAKIVKTDINIDNYL

SEQ ID NO: 77175 - protein, 257 aa, Wolbachia endosymbiont of Drosophila melanogaster
MNLLVSGQPLKAKRYIDEIKKSAPNLYNLCFKYFTPQERFLYLKQRDFAGIEGISIDYLVMEKAKNVAMIEANFDWLDVGTWNSVLELSEKFSKEPASFQHVIREKEPVSTTESNKNLLSGACKQPNKSLISFIHKVKKVKVIRKEVKPWGFCSIILMSENFLIKYLFINPLSCTSKQFHHYRDEYHIVLSGVGYVSLEDKEYAIAKDHMIEIPREVSHRIENRSTSFPLEIVEFQIGEHLSDNDIVRLDDVYGRIW

SEQ ID NO: 77176 - protein, 427 aa, Bacillus thuringiensis serovar konkukian str. 97-27
MKKICVVGLGYIGLPTCAMFAKAGFKVTGVDVNPLIIDTVNDGKIHIEEVGLGELVKEEVSKGNLNASLKPVLADVYIIAVPTPHNYDHTADLKYVQSAVESIKPFLQKGNILIVESTIPPRTINDIVAPAIEEAGWKVGEEIYLAHCPERVLPGRILIELVENARIVGGINEISANKAAEIYKSFVKGNVITTTAVTAEMAKLMENTFRDVNIALANELAKISANLGINALDVISLANLHPRVNLHTPGPGVGGHCLAVDPYFIIEKDPQNAKLISDAREINNSMPNFVVENVGKLLGEGRGKITVMGLTYKGNIDDVRESPAMEIVELLRKEGYEVAVYDPHVVQEAVPYELKTFKEAVDKTQCILVLSDHNEFKNLDEETIIKRAERPIIFDTRNCVQVNNKAILYYNYNNLHEAINNLVFKNI

SEQ ID NO: 77177 - protein, 586 aa, Arabidopsis thaliana
MASTRKPSGHGAEVEAQKRSSSNSSTKSAKAETFEPMQLQRSVTNPRAVGIPESKRLPESFRKRSSDPAVCKPDFSSLSTVLEHVDSLTIDEKKTSGFGSVKTSSASAKLSDGTSSLGKTSGSAKLSGRLDFMESGKSSICRGSTSSDVSDESSCSSFSSTVNKPHKANDLRWEAIQAVRVRDGLLGLSHFRLLKRLGCGDIGSVYLSELSGTKCYFAMKVMDKTSLASRKKLLRAQTEREILQSLDHPFLPTLYTHFETEKFSCLVMEFCPGGDLHTLRQRQPGKHFSEQAVKFYIAESLLALEYLHMLGIVYRDLKPENVLVREDGHIMLSDFDLSLRCLVSPTLVKSAAIESDPLRKNVYCVQPACIEPSCIQPSCTVPTTCFSPRLFSSKSKKDRKPKNDTANQVRPLPELVAKPTDARSMSFVGTHEYLAPEIIKGEGHGSAVDWWTFGIFLYELLFGRTPFKGSGNRQTLFNVVGQPLRFPETPVVSFAARDLIRGLLMKEPQQRLGFKRGATEVKQHPFFEGVNWALIRCATPPEIPKPVELEKGAVSVAEAPSSQKTAAGLVLNAQKGSDNYLEFDFF

SEQ ID NO: 77178 - protein, 497 aa, Oryza sativa
MPTLNLDLPNGIKSTVQAELFINNKFVPALDGKTFATVNPSNGKEIGQVAEASAKDVDVAVKAAREAFDTVWGENTPGDARGKLLMKLADLVEEHVDELAAIESLDNGKAFSIAKGFDVAAVAANLRYYGGWADKNHGKVMEVDTKRLNYTRHEPIGVCGQIIPWNFPLLMFAWKLGPALATGNTIVLKTAEQTPLSALKMCELIVEAGFPAGVVNVVSGFGPVAGAAISQHMDIDKIAFTSSTLVGRNIMKAAASTNLKKVTLELGGKSPNIVFKDADLDQAVRWSAFGIMFNHGQCCCAGPRVYVEESIYDQFMEKMTAYCKGLQVGDPFAENTFQGPQVSQLQYDRIMEYIESGKKDANLHLGGVRKGNEGYFIEPTIFTDVPHDAKIAKEEIFGPVVVVSKFKDEKDLIRIANDSIYGLAAAVFSRDVSRALETAHKLKAGTVWVNCYNMLVPQVPFGGYKASGIGRELGEYALANYTNIKAVHVNLSIPAPI

SEQ ID NO: 77179 - protein, 499 aa, Colwellia psychrerythraea 34H
MENLNSAYWQKLSQNIKFRNQAFINGTFTDSTSNESYQVINPATEEVLASVTACNSQDVDSAVACARETFESGVWADKSPSERKAVILKLAQLIQDNKEELALLETLDMGKPVMDALNIDIGGASAILAWYGEAADKINDEIAPTGPGSLATITKEAIGVVAAIVPWNFPLDLAIWKLGPALAAGNSVIVKPAEQSPHSVLRLAELAIEAGVPAGVFNVVTGHGAVVGKALGLHEDIDVLTFTGSTGIGKLFLQYSAQSNMKSVWLETGGKSPNLVFADCEDLDKAADGAAMGIFFNQGEVCSANSRLLVESSIKDVFVEKMITRAKQVIMGHPLNTNTTMGPIVSDLQASRIFSKIEKAQQEGATLVTGGKRVTIDGSSLYIEPTIFDNVDNSMSIAQDEVFGPVLSVISFDTEAEAIAIANDTPYGLAASIWTDNLSRAHRVARKIKAGTISVNTVDALSPMTPFGGYKQSGIGRDLSIHAFDKYTETKTTWIKFSE

SEQ ID NO: 77180 - protein, 581 aa, Arabidopsis thaliana
MTGLGVRSSSYGSLEKTGLNGVVLPIQITTTTRTKPSKMQKDREGIVHWICKFAGRKKVGMLLLFLISAVVFLRVLYVGKGEDSQEGQGPPSLHFNGSSGVNYSNMLQTNEELNMNIGNISFKAKEVIVFPPPPIHFLGYSLPQGHPCNSFTLPPPPADRKRTGPRPCPVCYLPVEGAVALMPNAPSFSPVLKNLTYIYEEPLNRETEFGGSDFGGYPTLKHRNDSFDIKETMSVHCGFVKGPQPGRNTGFDIDEADLLEMKQCRGIVVASAVFDAFDDVKAPQNISKYAEETVCFYMFVDEETESILKRERGLDGNKKVGIWRVVVVHNLPYSDGRRNGKVPKLLVHRMFPNARYSLWIDGKLELVVDPYQILERFLWRKNATFAISRHYKRFDVLVEAEANKAAGKYDNASIDFQVDFYKNEGLTPYSVAKLPITSDVPEGCVILREHVPISNLFTCLWFNEVDRFTSRDQISFSTVRDKIAAKTNWTVSMFLDCERRNFVVQRYHRAEQERFARQRPPVPNFPPPPPSPPPPVLISSDLPRKMSSGRATPPRRRGRDRRSGQRGHRKANLPVRLPDSA

SEQ ID NO: 77181 - protein, 181 aa, Oryza sativa Indica Group
MERLLLSLQVAGLTSKSMGLRERRDAIRLSSDVAMASARGRAAPWARALVARHAAERRNEPLLRRIMGGDVYERAVSSAGAAVARSRRIVRRSQRVACSSRRKRRSLAMAAASGGGCALAARRMVKGRLRLLRRLVPGGEALRGFSLLSETLDYVVCLKTQVELMHSLCKGSQQKLHLQLG

SEQ ID NO: 77182 - protein, 288 aa, Burkholderia vietnamiensis G4
MPAISELFVYPIKSCAGIALPRAQLLETGLAYDRHWLITTPDGMMITQRTHPRLALIRTALEHDALVLNAPGMPEIRTPLDGDATPATPAMAATVWRDTVDAIDTGAETAAWLTQFVGTPLKLARFGDGARRGCNRKWTGDVDTHTQFADGYPLLVIGQSSLDDLNARLAAKGAPAIPMNRFRPNLVVSDLDAYEEDFVEHLDAAGATPVRLRLVKLCTRCPIPTIDQASGEPNPQWPHEPTDTMQTYRANPNFDGALTFGINAIVVAGAGAWLEVGQALDAQLGFGD

SEQ ID NO: 77183 - protein, 273 aa, Oryza sativa Indica Group
MAPRCSNAVFAAFNVVTLLLGAAVLAAGIYYGAPHRGGGGVTECERFLRAPALALGGAIVAVSLAGLAGACCRATPLLWAYLLLTGLLILAAACFGVFALVVTNAGAGRAVSGRGFREYHLGDYSTWLRRRVEDGGHWARIRSCLVDTGVCRRLKSNQTLDEFVNSNLSPLQSGCCKPPTACNFTYQNETYWIKPPTPSNYSDPDCNSWSNDQSELCYGCQSCKAGVLGNLRSSWKKIAFANAAFVALLLVVYSLGCCALRNNRRHKYSLVGK

SEQ ID NO: 77184 - protein, 551 aa, Prochlorococcus marinus subsp. marinus str. CCMP1375
MALIHGFHLKNVRGDVLGGLTAAVVALPLALAFGNAALGPGGAIYGLYGAVVVGFLAALFGGTPAQVSGPTGPMSVTVAGVVASLAAVGVPRDLSAEQILPLVMAAVVIGGLFQILFGFLRLGKYITLVPYSVVSGFMSGIGVIIIALQIGPLLGITTRGGVIESLTTVFSNFQPNGAAISVAIMTLAIVFLTPRRVSQWVPSPLLALLIVTPLSIALFGDTAIDRIGEIPEGVPSLSIPSFNKYLPIILKAGLVLAVLGAIDSLLTSLVADNISQTRHNSDRELIGQGIGNAVAGLFSGLPGAGATMGTVINVKSGGSTPLSGMVHSIVLLIVLIGAGPLAEKIPTALLAGILIKVGLDIIDWGFLLRAHRLSLKTASVMHGVLFMTVFWDLIWAVLVGVFVANMLTIDSITETQLEGMDADNPLQASNKDLPLPEDEQKLLEDCSGEVMLFRLKGPLSFGAAKGITERMMLIRNYKVLILDITDVPRLGVTATLAIEDMIQEARINSRKAYVAGATGKVKDRLSKFGVQGLIDTRKEALQAAINELKNV

SEQ ID NO: 77185 - protein, 201 aa, Oryza sativa Indica Group
MERLLLSLQVAGLTSKSMGLRERRDAIRLSSDVAMASARGRAAPWARALVARHAAERRNEPLLRRIMGGDVYERAVSSAGAAVARSRRIVRRSQRVACSSRRKRRSLAMAAASGGGCALAARRMVKGRLRLLRRLVPGGEALRGFSLLSETLDYVVCLKTQVELMHSLCKGSPAEAASAAGMKNQMLIYDPVLKTESGTTQ

SEQ ID NO: 77186 - protein, 476 aa, Triticum aestivum
  misc_feature (216)..(216): Xaa can be any naturally occurring amino acid
  misc_feature (364)..(364): Xaa can be any naturally occurring amino acid
MIQLHEHSIAQSTLLTYYYTRPVLVVHDWKHTQARQLANGAVPILQIVSFGSELSNRAPTFDMDLSDFMDGDKPISYEKAKEYFSQDPSQKWAAYVAGTVLVLMTELGVQFTDSMSILVSSSVPEGKGVSSSASVEVATMSAIAAVYGLNIAPRDLAILCQKVENHIVGAPCGVMDQMTSACGEANKLLAMVCQPAEVKELVSIPTHIRFWGLDSXGIRHSVGGTDYGSVRVGTYMGRKMIKCAASDLISQSFPSTPTQSCDASEEYEKYGVDLLKSEASLQYLCNLPPHRYEAAYARDIPEFITGDEFKEKYGDHNDAVTVIDPKRSYSVKAPTRHPIYENFRVEAFKALLTAAKTDEQLSAXLGELMYQCHYSYNACGLGSDGTDRLVNLVQEIQHRKTTSQHEGPSLFGAKITGGGSGGSVCVIGKNSLKSSEEIFEIQKRYKAATGYLPIVFEGSSPGAGKFGYLKIRWRSA

SEQ ID NO: 77187 - protein, 259 aa, Zea mays
MASVASARCYGLLLPPSFAGARCCSRPSSSLRLRPRWGLRRPRTPLACVAPPDSAEPQTDEQAVKAESIQEDAPTSTPEDAGLPALPNKDLNRRVALLSTLGAVALFASQRLNLSEASLKDLAANSVPYEEALSNGRPTVVEFYADWCEVCRELAPDIYKVEQQYKDRVNFVMLNVDNTKWEQELDEFGVEGIPHFAFLDKEGNEEGNVVGRLPKQYFLDNVVALASGDPEIPHARVVGQFSSAESRKVHQVADPRSHG

SEQ ID NO: 77188 - protein, 506 aa, Rhodococcus sp. RHA1
MKMTALSADQGVQRLFGKVNFIAGEWVAATSGRTRDCIDPATGNVIATVDEASPEDAARAVQAARSAFDAGDWPETAVAVRSSLLSRVADLLERDKEELARIETLNTGKTLVESRIDIDDVVSVFRYYARLALVSSDRVVDVGDPAVVSRVVREPIGVCVLIAPWNYPLLQISWKVAPALAAGCTMVLKPSEVTPLSTIAFARLIEEAGVPAGVVNLVQGSGADLGPALTDTGDVDFISFTGGLATGTTILRTAAKHVTKVAVELGGKNPHIVFADAEWESSVDQVLTGVFLHSGQVCSAGTRLIVEESIADDFVAALVSRAEAIRVGPGLDPGTETGPLVSTAQRDKIEAYVALGISEGAALRTGGSRPADPALDGGSYYLPTIFDHCDRSMRIVQEETFGPILTVERFTTEEDAVRLGNDTEYGLAAGVRTSDAARGERVVRRLRHGTVWLNDFGYYTAAAEWGGFKKSGNGRELGPAGLSEYQEVKHIWNNTTSPLAGWFTAT

SEQ ID NO: 77189 - protein, 474 aa, Erwinia carotovora subsp. atroseptica SCRI1043
MHDKLLIEGKLIAGNGEALAVFNPATGEQIAAIPQADLHQIDAAVLAAESAFAHWGQTTPKTRATLLLKIADAIEENAEVFAKLESLNCGKPYHAVLNDEVPAVADVFRFFAGAARCLSGSAAGEYLEGHTSMIRRDPVGVVASIAPWNYPLMMASWKLAPALAAGNCVVLKPAEQTPLTTFYLAHLLADILPAGVVNIVFGRGADIGDALTGHEKVNMVSLTGSIATGAHILAHTAASVKRTHMELGGKAPVIVFDDADIDQVVDGIRSFGFYNAGQDCTAACRLYVQRAVYDEVVEALGKAVATLKIGDPRDETTELGPLITEPQLERVMGFVERAKALPHITVVTGGERVKGTGFYFQPTVLAGAKQDDEIVQKEVFGPVISITSFDDEAQVIGWANASNYGLASSVWTRDIGRAHRLAACLQYGCTWVNTHFMLVSEMPHGGQKLSGYGKDMSMYGLEDYTIVRHIMIRH

SEQ ID NO: 77190 - protein, 355 aa, Arabidopsis thaliana
MEMENHRPGSFTYMGRKFSDLSLNDDSSAFSDCNSDRSGEFPTASSESRRLLLSCASENSDDLINHLVSHLDSSYSIDEQKQAAMEIRLLSKNKPENRIKIAKAGAIKPLISLISSSDLQLQEYGVTAILNLSLCDENKESIASSGAIKPLVRALKMGTPTAKENAACALLRLSQIEENKVAIGRSGAIPLLVNLLETGGFRAKKDASTALYSLCSAKENKIRAVQSGIMKPLVELMADFGSNMVDKSAFVMSLLMSVPESKPAIVEEGGVPVLVEIVEVGTQRQKEMAVSILLQLCEESVVYRTMVAREGAIPPLVALSQAGTSRAKQKAEALIELLRQLRSISNGGARSSSQL

SEQ ID NO: 77191 - protein, 149 aa, Brassica napus
  misc_feature (138)..(138): Xaa can be any naturally occurring amino acid
MARKFFVGGNWKCNGTAEEVKKIVNTLNEAQVPSQEVVEVVVSPPYVFLPMVKSILRPDFYVAAQNCWVKKGGAFTGEVSAEMLVNLNIPWVILGHSERRALLNETNEFVGDKVAYALAQGLKVIACVGETLEQREAXSTMDVVAAQTK

SEQ ID NO: 77192 - protein, 607 aa, Rhodococcus sp. RHA1
MSATPTLKKALSQRQLTMIAIGGVIGAGLFVGSGVVIGDTGPGAFITYALAGVLIIMVMRMLAEMAVANPSTGSFADYARAALGNWAGFSVGWLYWYFWVIVVGFEAIAGATIIQYWIDIPLWLSALVLMILMTATNLFSVSSFGEFEFWFAGIKVAAIVVFIGLGTLFVLGVWPNKSLDFSNLWSHDGFLPFGAMAITVGVVTVIFSMVGAEIATIAAAESADPERAVTKAANSVIVRIAVFFVGSTFLLATILPWNDEDAAASPFVAAFTEMGIPYADHIMNAVVLTAVLSCLNSGMYTASRMLFVLAARREAPAQLVRVTRRGVPAIAILASSVVGFLCVIAAAVSPDTVFVFLLNSSGAVILFVYLLIAVSQIVLRYRTKDSELRVKMWLFPVLSIITAAAIVAILVQMYLQEDVRSQLVLSLLSWAVVIVLFLANKWFVGRRPVVEGVAATTRPHRVLVLANQTVQSKEMLDELRRIDADRDATYFVVVPASPIETGTAATHGPLDVAEATREVAQRRLDDTLATLRAENLEADGELGDYRPLRALAAAVDSFRPDQIVISTLPPEESVWHRFDVVDRARAEHSVPVTHVVVTPVAAEGSPR

SEQ ID NO: 77193 - protein, 297 aa, Bacillus thuringiensis serovar konkukian str. 97-27
MKKVRKAIIPAAGLGTRFLPATKAMPKEMLPIVDKPTIQYIIEEAIESGIEDIIIVTGKGKRAIEDHFDHSFELEQNLLEKGKYEMLEKVQASSKINIHYIRQKEPKGLGHAVWCARKFIGNEPFAVLLGDDIVQAETPCLRQLMDQYEGTQSSVIGVQTVPENETHRYGIIDPVEQNERRYQVRQFVEKPAEGTAPSNLAIMGRYVLTPEIFMFLEDQQTGAGGEIQLTDAIQRLNEIQRVFAYDFEGIRYDVGEKFGFIKTTIEMALQHEELRESLINYMAGILKKKNKYEGEVK

SEQ ID NO: 77194 - protein, 408 aa, Wolbachia endosymbiont of Drosophila melanogaster
MNNFHEMGLPASLRQALDKNNLFVPTPIQIQAIPLALQGKDILGSAQTGTGKTLAFAIPLVAKLLNEPNTGSALVIVPTRELAHQVTNEIRKLLSQNSALRVALLIGGEPIFRQLNQLQKKPQIVIGTPGRIIDHIERKTLITRNVSVLVLDETDRMFDMGFGVQIEEIMKHLPKIRQTLMFSATLPGDIVKLAEKYLNRPERISVDCEATTSVKIKQEIVYASESEKYEKLVTQLCQREGSIIIFVKTKRGADQLANRLHKDDYSALAIHGDLRQHKRERVINSFRRGRNQIMVATDVASRGLDIPHIQHVINYDAPQSQADYIHRIGRTARAGAEGYALSFVTPQDKRRLPALADKEGELNFDCSVQFKKRNSKKVFKRPSTLKTKYGRKKINAFKKKSRVLEKAY

SEQ ID NO: 77195 - protein, 437 aa, Myxococcus xanthus DK 1622
MTPPLVLLGSGYTLTRLAVAEARAGRDVLAATRDAARRAELERAGARVTDLEDALTRTAGAHVVVSVPPDAGLDTRIASALAGQVPARLVYLSSTGVYGRARGHVDEDTPVELSTPSSRERIEAESRYLPLGAMVMRIAGIYGPGRGIHTRLLSGALRLPEGGGGRISRIYVDDLVESIRVVLTRGEPGALYCVADDRSAPSEEPVAWLSQRLGVPMPPRIPLAQLNETLRGDRDISNARLKSLGWAPRYPDFISGYTALLKAEGHGAGPTQLVIRRLVAEDAEAFKALRLRGLRDNPESFAASVEEDSALSLEAVRGWLVGASQCVLGAFDGGQLVGALGLNRESRARLAHKAMVWGMYVAPEVRSRGVGRRLLTALIDEARKMGGLKCLLLAVSVGNAPAHALYRSLGFRTYGVEPNALKVGETFLDEELMVLTL

SEQ ID NO: 77196 - protein, 384 aa, marine gamma proteobacterium HTCC2080
DNAAGTQVPKHTIDRITDFFQRYNSNTGVFNATSIEVDAMFADTTAALADFLGTSDPGEVIIGANMTTLTYQLSRSLAHRFDPGDEIIISRMEHEGNVTPWLQMAEDNGLTVRWLDFDQDTWCVEPEALIPLLNERTKLLALNYASNMTGGVNDVKALASLAQEAGALVYVDAVQFASHRLIDVKNLGVDFLACSPYKYFGPHLGVVYGRRDLLESLHAYKLRCASDDLPYRFSVGTPAFELIAGLLGTLEYFQWLAGLMGVTGSRRELFSAAYSAMGEYEDHLSSVLLEGLLSIPGLRLQGSKSLARRVATFSFIHDKQAPSEIAKALSAQGLYCHWGDNYAVEVGKALGLDPVEGVLRLGLAHYNTEAEVHEALELIRGALV

SEQ ID NO: 77197 - protein, 291 aa, Arabidopsis thaliana
MAKDLDVNESGPPAARDYKDPPPAPFFDMEELRKWPLYRAVIAEFVATLLFLYVSILTVIGYKAQTDATAGGVDCGGVGILGIAWAFGGMIFVLVYCTAGISGGHINPAVTVGLFLARKVSLVRTVLYIVAQCLGAICGCGFVKAFQSSYYTRYGGGANELADGYNKGTGLGAEIIGTFVLVYTVFSATDPKRNARDSHVPVLAPLPIGFAVFMVHLATIPITGTGINPARSFGAAVIYNNEKAWDDQWIFWVGPMIGAAAAAFYHQFILRAAAIKALGSFGSFGSFRSFA

SEQ ID NO: 77198 - protein, 1501 aa, Candida albicans
MSDSKMSSQDESKLEKAISQDSSSENHSINEYHGFDAHTSENIQNLARTFTHDSFKDDSSAGLLKYLTHMSEVPGVNPYEHEEINNDQLNPDSENFNAKFWVKNLRKLFESDPEYYKPSKLGIGYRNLRAYGVANDSDYQPTVTNALWKLATEGFRHFQKDDDSRYFDILKSMDAIMRPGELTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSAVILDTTPLIAIYQCSQDAYDLFDKVVVLYEGYQIFFGKATKAKEYFEKMGWKCPQRQTTADFLTSLTNPAEREPLPGYEDKVPRTAQEFETYWKNSPEYAELTKEIDEYFVECERSNTRETYRESHVAKQSNNTRPASPYTVSFFMQVRYGVARNFLRMKGDPSIPIFSVFGQLVMGLILSSVFYNLSQTTGSFYYRGAAMFFAVLFNAFSSLLEIMSLFEARPIVEKHKKYALYRPSADALASIISELPVKLAMSMSFNFVFYFMVNFRRNPGRFFFYWLMCIWCTFVMSHLFRSIGAVSTSISGAMTPATVLLLAMVIYTGFVIPTPSMLGWSRWINYINPVGYVFESLMVNEFHGREFQCAQYVPSGPGYENISRSNQVCTAVGSVPGNEMVSGTNYLAGAYQYYNSHKWRNLGITIGFAVFFLAIYIALTEFNKGAMQKGEIVLFLKGSLKKHKRKTAASNKGDIEAGPVAGKLDYQDEAEAVNNEKFTEKGSTGSVDFPENREIFFWRDLTYQVKIKKEDRVILDHVDGWVKPGQITALMGASGAGKTTLLNCLSERVTTGIITDGERLVNGHALDSSFQRSIGYVQQQDVHLPTSTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDRLLFLQKGGRTAYFGELGENCQTMINYFEKYGADPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKIFLVVSAALFNGFSFFKAKNNMQGLQNQMFSVFMFFIPFNTLVQQMLPYFVKQRDVYEVREAPSRTFSWFAFIAGQITSEIPYQVAVGTIAFFCWYYPLGLYNNATPTDSVNPRGVLMWMLVTAFYVYTATMGQLCMSFSELADNAANLATLLFTMCLNFCGVLAGPDVLPGFWIFMYRCNPFTYLVQAMLSTGLANTFVKCAEREYVSVKPPNGESCSTYLDPYIKFAGGYFETRNDGSCAFCQMSSTNTFLKSVNSLYSERWRNFGIFIAFIAINIILTVIFYWLARVPKGNREKKNKK

SEQ ID NO: 77199 - protein, 591 aa, Vigna radiata
MSKQTYSFCFCLRRRFSLPVSEAPPEIRTLFDRYSDENGIMTASHVRGFLVEVQKEESVTEEEAQAIIDGHKHLSIFHRRGLNLESFFNYLFSSNNNPPLSPSLGVHQDMSSPLSHYFIYTGHNSYLTGNQLSSDCSDVPIIKALQKGVRVIELDIWPNESKDDVDVLHGRTLTSPVALIKCLRSIKQYAFVASEYPVVITLEDHLTPDLQAKVAEMITQTFGDILFSPGSESLKEFPSPKSLKRRIIISTKPPKEYIEAKEVQEKGEGSQKEKPVDDEEAWGKEVPSLRGGTISDHKNIEDEDDLDNEDDTDEAEYSRQNASDEYRRLIAIHAGKPKGGLTECLKVDPDTVKRLSLSELQLEKAAETHGKEIIRFTQRNILRVYPKGTRIASTNYNPLIGWMHGAQMVAFNMQGYGRSLWLMQGMFKANGGCGYVKKPDFLLKTGLNNEVFDPKARLPVKKTLKVTIYMGEGWFHDFKHTHFDQYSPPDFYARVGIAGVPYDTVMKKTKSVEDNWSPSWNEEFKFPLSVPELALLRVEVHEYDMSEKDDFGGQTCLPVWELRSGIRAVPLYSRKGEKYHNVKLLMRFEFI

SEQ ID NO: 77200 - protein, 340 aa, Psychrobacter arcticus 273-4
MQNKSIPSLPSMNRQPLGFFPTPLIELTRLSKALNGPKIYMKRDDNTGLALGGNKTRKLEFIIGDALAQGADTIVTAGAAQSNHCRQTAAAAASLGLECHLVLGGQEPDQLNGNLLLDKIFGCHIHWAGNNRKGEDIPDIVEQLENAGKKPYVVPYGGSSELGAFAFIEAFKELESQRQEMDISFTHIVFASSSGGTQAGLMLGNKIFNSPYQIVGINIDKGETDKVPFDQYIVSLANSTAALIGADYSFSETDLMLNSDYVGDGYGVIGALENEAIAMTAQTEGILLDPVYTGRAMGGLIDMIRTGKIKKTDSVLFWHTGGAPALFAYASALAVSQSDS

SEQ ID NO: 77201 - protein, 272 aa, Vitis vinifera
MGTLGKAIYTVGFWIRETGQAIDRLGCRLQGNYYFLEQISRHRTLMNLFDKAPIVDKDAFVAPSASIIGDVQVGRGSSIWYGCVLRGDVNSISVGSGTNIQDNSLVHVAKSNLSGKVLPTIIGDNVTVGHSAVLHGCTVEDEAFVGMGATLLDGSIVEKHAMVAAGALVRQNTRIPCGEVWGGNPAKFLRKLTDEEIAFISQSAINYSNLAQVHAAENAKPFDEIEFEKVLRKKFARRDEDYDSMLGVVRETPPELILPDNILPDKAPKVSQ

SEQ ID NO: 77202 - protein, 217 aa, Bradyrhizobium japonicum USDA 110
MTDDKDAKLIEAGRKLFARDWQFIWASPSIQTLPPMDGVEIAFAGRSNVGKSSLINALTGRNALARTSHTPGRTQELIFFEVPGKKDLRLVDMPGYGYAKAPKSQVASWTELIHKFLLGRASLARVYVLIDARHGLKDVDLEILGTLDRSAVSYQIVLTKADQVKPSELASRIAETEAALAKHPAAFPNVLATSSRSATGMAELRAAMAKLLEERSS

SEQ ID NO: 77203 - protein, 591 aa, Vigna radiata
MSKQTYSLCFCLRRRFSLPVSEAPPEIRTLFDRYSDENGIMTASHVRGFLVEVQKEESVTEEEAQAIIDGHKHLSIFHRRGLNLESFFNYLFSSNNNPPLSPSLGVHQDMSSPLSHYFIYTGHNSYLTGNQLSSDCSDVPIIKALQKGVRVIELDIWPNESKDDVDVLHGRTLTSPVALIKCLRSIKQYAFVASEYPVVITLEDHLTPDLQAKVAEMITQTFGDILFSPGSESLKEFPSPKSLKRRIIISTKPPKEYIEAKEVQEKGEGSQKEKPVDDEEAWGKEVPSLRGGTISDHKNIEDEDDLDNEDDTDEAEYSRQNASDEYRRLIAIHAGKPKGGLTECLKVDPDTVKRLSLSELQLEKAAETHGKEIIRFTQRNILRVYPKGTRIASTNYNPLIGWMHGAQMVAFNMQGYGRSLWLMQGMFKANGGCGYVKKPDFLLKTGLNNEVFDPKARLPVKKTLKVTIYMGEGWFHDFKHTHFDQYSPPDFYARVGIAGVPYDTVMKKTKSVEDNWSPSWNEEFKFPLSVPELALLRVEVHEYDMSEKDDFGGQTCLPVWELRSGIRAVPLYSRKGEKYHNVKLLMRFEFI

SEQ ID NO: 77204 - protein, 295 aa, Bradyrhizobium japonicum USDA 110
MTDISPLDQARILSEALPHMQQYDEETIVIKYGGHAMGDEETAKNFARDIVLLEQTAINPVVVHGGGPQIATMLKRLGIQSEFAAGLRITDAATIEIVEMVLAGSVNKQIVGYINEAGGKAVGLSGKDANMVKASKTTRTIVDPGSNIEKAIDLGFVGDPEKVDLTLLNQLIGYELIPVLAPLATSKEGQTLNVNADTFAGAVAGALKAKRLLLLTDVPGVLDKSKKLIPQLSVKDARKLIADGTISGGMIPKVETCIYALEQGVEGVVIIDGKMQHAVLLELFTNQGTGTLIHK

SEQ ID NO: 77205 - protein, 180 aa, Zea mays
  misc_feature (17)..(17): Xaa can be any naturally occurring amino acid
  misc_feature (60)..(60): Xaa can be any naturally occurring amino acid
AFSRCMSRSSAHLRGSXLKLLTVGDVLKSKGKSADGSCFWRTTEDIDYDAVKSMTHHNEXDLVADKPEQNKSISGIVTERDYLRKIIAHERASKSTKGGDIMTEDNKLITVNPDTKVLDAMQLMTENRIRHIPAIDSTGMLGMVSIGYDVRAEVAEHKQELNRLNDYIQGGYYDGAVQRR

SEQ ID NO: 77206 - protein, 501 aa, Wolbachia endosymbiont strain TRS of Brugia malayi
MNFKSVVLCILDGWGNGIGDSKYNAISNANPPCWQYISSNYPRCSLSACGTDVGLPDGQIGNSEVGHMNICSGRVVMQSLQRIDREIKTIENNKNLRSFISDLKDKNGVCHIMGLVSDGGVHSHQKHISTLANKISQHEIKVVIHAFLDGRDTLPNSGKKCVQEFEENIKGNDIRIATVSGRYYAMDRDNRWERTIETYEAIAFARATCHNNVMSLIDNNYQNNITDEFIRPTVIGDYKGIELKDGVLLANFRADRMIQLASILLGKTGYTEVAKFSSILSMMKYKEDLQIPCLFPPAFFTNTLGEIIADNKLRQLRIAETEKYAHVTFFFNCGKEEPFSNEERILIPSPKVETYDLQPEMSAFELTEKLVGKIRSQEFTLIVANYANPDMVGHTGNMEAAKKAVLAVDDCLAKVLNTVKEINDAVLIVTADHGNVECMFDEKNNTPHTAHTLNKVPFIIYPNSCNNLKLKDGRLSDIAPTILQLLGIKKPDEMTGSSLIV

SEQ ID NO: 77207 - protein, 441 aa, Arabidopsis thaliana
  misc_feature (134)..(134): Xaa can be any naturally occurring amino acid
MGEIVVLSSDDGMETIKNRVKSSEVVQWEKYLPKTVLRVLLVESDYSTRQIITALLRKCCYKVVAVSDGLAAWEVLKEKSHNIDLILTELDLPSISGFALLALVMEHEACKNIPVIMMSSQDSIKMVLKCMLRXRDDPTAHAQSLPASQHNLEDTDETCEDSRYHSDQGSGAQAINYNGHNKLMENGKSVDERDEFKETFDVTMDLIGGIDKRPDSIYKDKSRDECVGPELGLSLKRSCSVSFENQDESKHQKLSLSDASAFSRFEESKSAEKAVVALEESTSGEPKTPTESHEKLRKVTSDQGSATTSSNQENIGSSSVSFRNQVLQSTVTNQKQDSPIPVESNREKAASKEVEAGSQSTNEGIAGQSSSTEKPKEEESAKQRWSRSQREAALMKFRLKRKDRCFDKKVRYQSRKKLAEQRPRVKGQFVRTVNSDASTKS

SEQ ID NO: 77208 - protein, 390 aa, Acidovorax sp. JS42
MLLSLKGTFPPAILALADGTVFIGNSIGAAGTTVGEVVFNTAITGYQEILTDPSYCQQIVTLTYPHIGNYGVNAEDIEAEKVHAAGLIIKDLPLLASNFRMTETLPEYLVRAKTVAIANIDTRKLTRLLRTQGAQNGAIVGLAAGEAVTQARIDEAVAAAKAAPNMNGLDLAKVVTTRAAYAWDQTEWKLGEGYGTQTAPRFHVVAYDYGVKLNILRMLAERGCRLTVVPAQTPAAEVLAMNPDGVFLSNGPGDPAACDYAITAVKQIIDSGVPTFGICLGHQIMALASGARTFKMDNSHHGANHPVKDLDSGRVSITSQNHGFAVDMASLPATLRATHISLFDGTLQGLEHKDKPAFCFQGHPEASPGPHDIAYLFDRFTTLMQAAKAQ

SEQ ID NO: 77209 - protein, 250 aa, Wolbachia endosymbiont of Drosophila ananassae
MRHTTIGLNRYDLEHRKGTRKIKNLPSVLGVEAVGVIEKLGKKISDGLKVGDRVGYCTAPPGAYCEKRIIHQKYLIKIPDDISDEVAAAVLFKGMTAHYLVNQSYKVRPGAFVLVHGANGGLGQIICQWAKDKKGVVIGSVSSDEKMKIALQSGCTYAINYNDKDFVSKIMEITQNRGVGAVYDPIGYATSKLSFESLGRFGIYVSYGQISGNAPISFSLLSSRSLFATGTLIYHYSMIDHIVLHMEISR

SEQ ID NO: 77210 - protein, 386 aa, Lactobacillus johnsonii NCC 533
MHFLGELILILLATTLLGQLFSRLNMPAVIGQLLSGILLGPAILGWVKPNEIVSLFSEFGVILLMFLAGLESDLDLLKKYFKLSFTVAGIGVVLPVFFTGIASYLFGMQFLEALFIGIVFAATSVSISVVVLQEANQIHTRAGTAILGAAVVDDILAVIVLSLFTTFSHEGGKSGLTNNFFLNLLIEVIYFVAVWVVFKFIAPHFMKLAEKVEVDYAVVIGSLVLALLMAWAADFVGLSAVVGAFFGGLAIRQTPQYKEVQSSVSAIGYSIFIPVFFVNIGLSMTFASFIKDIWFIIVMTILAVLSKFWAGKYSSELFGFTKNEGNIVGAGMVSRGEVALIVAQIGITHHLFPEDIYSSLILVIIITTVLSPFILNYYIKREVKKN

SEQ ID NO: 77211 - protein, 427 aa, Clostridium tetani E88
MFEKPLADKIRPKILDEVFGQKHILGQGKILRRIINSEKLTNMIFYGPPGTGKTTVANIIANRTNKTLYKLNATNASLADIKNIIADLDSFMGVEGVVLYLDEIQNFNKKQQQSLLEFMEKGQITLIASTTENPYHYIYKAILSRATIFEFKSLLKEDILEALNRALDILKKEDFKNTYIYFSKDALEHIAKVSNGDLRRALNGLELCVYSTKPTLENKIVVDLEVAIECTQRKVLNYDKFGDSHYDILSAFQKSIRGSDADASIHYLARLIEAGDLISICRRLLVIASEDIGLAYPSAISIVKNCVDSAMQLGLPEGRIPLAQATILLATSPKSNSCIEAIDKALMDIRKKDVGDIPNHIKDSHYNGAEILNRGTGYKYPHDCKNNYVEQEYLPKKLKGKKYYIPQENKYEYSIKRYWSSIKKNNL

SEQ ID NO: 77212 - protein, 290 aa, Lentisphaera araneosa HTCC2155
MDFTDLIGKTPLLELKNLSPNKKVKVFAKLEGNNPGGSVKDRAAFYMISDAEMQGTLKPGMKIIEATSGNTGIALSMIASVKGYEIELAMPENSTQERVDAMKAFGAKVTLTESMETAIDYAKSKVEEGGYVMLNQFGNKANPEAHYRGTAPEIWAATQGQVTHFVSSMGTTGTIMGTSRYLKERNPNIQIVGCQPADGAKIPGIRRWPKEYLPTIYEEDRVDKIYDIRQEDAEEMMRQLGRQEGVFCGISSGGSVWAAIELAKTLEEGLIVAIVCDRGDRYLSTGLFGQ

SEQ ID NO: 77213 - protein, 233 aa, Wolbachia endosymbiont strain TRS of Brugia malayi
MSFLIVANWKMNGTRSLFVNFIGKLNDKSNEITSKLVICPPFTSLPGNIELNSNISIGAQNCHYKKSGSYTGEISAEMLKELGCTYVILGHSERTHETNGEIKLKSETAIESGLHPIICVGENLEDRESSKTKEVVEYQCKSRLPIHGEYTVAYEPIWAIGTGHVPSNNAIAEVIEVIQSYTSKKHVIYGGSVSLENIENLSNILNLSGVLIGSASLDFDRFHKIVQQVEKAY

SEQ ID NO: 77214 - protein, 405 aa, Wolbachia endosymbiont strain TRS of Brugia malayi
MTLADKPVLSHAVKKLLTNQYIDYVRVIINRNHEDFYRETIDSLHNYYLSEAVHSFQYVTLKSRKKEEWIPVSSTGMKGRVDTKLLSPVYGGKSRQNSVKLGLESLQKINPDFVVIHDACRPFVSNTLINNLARSMINNQHTGVVPAIEVEDTISLVNDDLIESTIPRERLRAIQTPQIFNFKELLSYHRSNKEFTDDSSLMVEHKKRVVVTRGEKINFKLTTKEDINMAKLLLDEPKYRVGTGYDIHRFIKAQGKAKSFIKICGVEIEYDMKIEAHSDGDVAIHAVVDAILGALGCGDIGAHFPPSFPEWKDRNSSHFLDFAAKKAKEKGYSVSNLDITIVCEEPKISPYKVAMKKFISKTLEIDSEFVNVKATTTEKLGSIGRNEGILAHASVLLYKIAPLHN

SEQ ID NO: 77215 - protein, 321 aa, Lotus japonicus
MDQHGGVATGSHERNELVRVRHGSDHGSKPVKNLNGQICQICGETVGLTANGDIFVACHECAFQLCHPCYEYERNNVSPYCPQCKTRYESHKESSQMEGDDDDDDDEDDVDDLENEVKYGQGNRMKARLQWEEDADLSSSSGHDSQMQNPHLTNGQLMSGENLCATTSGPMGQSKKVQSLPYVDPKQPGLESDEEIRRVPEFGGESAATSASRPDTGSNPGPERVQGAGEGQKKRGRSSADKESKRLKRLLRNRVSAQQARERKKAYLTDLETKVKDLETNNSELKERLSTLQNENQMLRQILKNTTASRRGSNGGTNNAE

SEQ ID NO: 77216 - protein, 93 aa, Zea mays
MSSEQTFIAIKPDGVQRGLVGPIISRFESRGFKLAALKLVSPPRELLEKHYADLSEKPFFPGLVTYMLSGPIVAMVWEGRDAVKTGRTILGAT

SEQ ID NO: 77217 - protein, 158 aa, Clostridium tetani E88
MGRLFKKSKGRGEIIMMPYSDKVMEHFRNPRNVGEISDANGVGEVGNPKCGDIMKIYLKVEDNIIKDVKFKTFGCGSAIASSSMATELIKGKTLEEAWELSNKAVADALDGLPPVKMHCSVLAEEAIHKAINDYRESIGLEPWEMKVHSDHIHDEVHG

SEQ ID NO: 77218 - protein, 196 aa, Streptococcus pneumoniae TIGR4
MIPVVIEQTSRGERSYDIYSRLLKDRIIMLTGPVEDNMANSVIAQLLFLDAQDSTKDIYLYVNTPGGSVSAGLAIVDTMNFIKADVQTIVMGMAASMGTVIASSGAKGKRFMLPNAEYMIHQPMGGTGGGTQQTDMAIAAEHLLKTRNTLEKILAENSGQSMEKVHADAERDNWMSAQETLEYGFIDEIMANNSLN

SEQ ID NO: 77219 - protein, 125 aa, Triticum aestivum
MAASAATATAAAVGAGEVISVHSLEQWTMQIEEANAAKKLVVIDFTASWCGPCRIMAPIFADLAKKFPVAVFLKVDVDELKSIAEQFSVEAMPTFLFMKEGDVKDRVVGAIKEELTNKVGLHAAQ

SEQ ID NO: 77220 - protein, 441 aa, Cryptococcus neoformans var. neoformans JEC21
MQAAVSLVQDYMGTEPTSTKSPYKHRQDGSTMRALAWFGKEDVRMVDAPIPDITQDTDVIVKVTGTTICGSDLHLYHSEMLGMQKGDILGHEFMGIIDRVGPSVNHLKIGDRVVVSFQIACGTCRYCQQKLSSFCDKTNDSSVVVNLWGQRDSAFFGYSHLTGGWPGGQSEYVRVPFGEVNCLKVPAEVPDEQALYLSDVLPTSYHAVVDTGVQKGDIVGIWGLGPIGICCVKWALLKGASKVYAIDTNPTRLALARSLGPEVITVDFKADDVKKRIHDEVPQGLDVCIDATTFHEPKTFLHKVEKALMLETDVSETPNEMIWLVKKMGRVGLIGVYTAYTNHFNIGALMEKGVRFIGNGQAPVHLYWEEILHDYIMTGKFDVGFMISHRVDLEDFPQLYDKFDRRVAGVEKVFVQTKASAPPAKGFPALSKVDDWADKII

SEQ ID NO: 77221 - protein, 577 aa, Physcomitrella patens subsp. patens
MSIADSPAKRKLQEQGLEHVSGLAISETAAWKQLHQHVGEIKKTHLRELMKDEQRCQSMIKEVDGIVVDYSRQRVTTGTMEKLLSLANEAKLSEKIDAMWSGKHINSTEDRAVLHCALRAPREAEIFCDGKNVVPEVWSTLDKIKEFSERVRSGEWVGATGKALTNVVAIGIGGSFLGPLFVHNALETEPSAEKLAEGRSLRFFSNVDPVDSGIALKGLDPETTLVVVVSKTFTTAETMLNARTCRAWITSNLGVDAVSKHMIAVSTNLELVKEFGIDPENAFPFWDWVGGRYSVTSAVGVLPLALQYGFDKVEEFLKGTWSMDQHFRNAPLESNLPVLLGLLSVWNVTFLGYPARAILPYSQALQKLAPHIQQVSMESNGKGVAIDGTPLPYEAGEIEFGEPGTNGQHSFYQLIHQGRVVPCDFIGAVRSQHSVFMPGEKVSNHDELMSNFFAQADALADGKTPEDLKAEGVAAPLIPHKVFTGNRPSLSILLPTLDAFTIGQLLSLYEHRIAVQGFIWNVNSFDQWGVELGKSLASRVRTQLNASRTRDAPLQGFNYSTTYLLTHYLKGKTPVHD

SEQ ID NO: 77222 - protein, 572 aa, Wolbachia endosymbiont of Drosophila melanogaster
MHSGSQHLFDIIILLSAAVFIVIAFWKMNISPVLGYFVAGAVIGSHGFNLIHSAEAMDNLAEFGVVFLLFIIGLELTFERLIAMRIHVFGFGSLQVIVTMVAIWCIALAFGVNTNIATVIGGGLALSSTAIVLQVLQEKGSQASQVGRLSIAVLLMQDFAVVPLIVLVPLLTGNSEHSLISSLAGSLVQAAIALVLIFITGRLLLRPLFSVIAKMESNEIFISTTLLIVLGAAFITEQFHLSLALGAFVAGLLVAETEYRHSVEHAVLPFKDLFLGLFFMTVGMSINTELLLNKLPLITLLSIILIVLKTSIIYILCRFFGFKSAPAIQAGLLLSQGGEFAFILFRLADELNVLPSEIAQVLMMVTTVTMAFTPLLSGLGDWIANSFSTEKTILDDEAVETDTQDLYNHVIVAGFGRVGYMVTKMLTAEHLSYVVVDIQSKIVKEGKSDSFPIYLGDVTRCEILKSVGIERAQALVISIKNEVTIKKVVSLVAANFPHVNIVIRLPDLSNVEVYRDLGASKIIPETSEIGLQLGGAALSLSGISESGVTSLKSRFRKGNYSMLKDLGSDKDE

SEQ ID NO: 77223 - protein, 358 aa, Oryza sativa Japonica Group
MARGIRMKPTYVPHVVSPAAQSPWIYVVICWLIKSDAESVFLCEEKKAMQQPSSTSTQPHASRKQQPVSSSSTHRSNGQLKGNKKQNRDRGIFLRKTQSYHSSQSDSRRKKKKQQQQSSQPVRRARSNRGSKRRRREDSTVRLYRLMGEEDISNDSKSSCGCEDGTVEAPAAAAPKENGRAADPRLQAISDAIRVVPHFPKPGIMFNDITALLLRPAAFKDAVDMFVERYRGMRIAAVAGIEARGFIFGPAIALAIGAKFIPLRKPKKLPGEVISETYILEYGTDCLEMHVGATEPGERVVVVDDLVATGGTLCAAIKLLERAGADVVECACLIGLPKYKNFYKLNGKPVYILVESRK

SEQ ID NO: 77224 - protein, 275 aa, Medicago truncatula
MYLFHFGLARASFSDTASTIYWTIKVTTLDVLKYILYMHVIYNPCLMRYTPGIDIWSIGCIFAEVLTGRPLFPRTNRKNQLDIMTDLLGTPPPESMVNQPVPFSKKFPNIDPLALRILERLLAFDPKNRPSSEEALSDPYFHDLSNIDHEPSTQPISKFEFLNSRILEYQPQMLEEYLRGGDQTRFMFMYPSGVDRFNRQFAHLEEHYGKGGRSSPLQRQHASLPKRETPPGYNVTDAKTSGVQIKWTLEAKLHSTQLIEECQLMCFKEYRSEKK

SEQ ID NO: 77225 - protein, 195 aa, Chromobacterium violaceum
MIARNPIKQDPAMRNTQDDHSRFLSLVLRHQPETIGLQLDDQGWADIGELLARLAAKGRNLGRKQLEKIVLDNDKQRFAISEDGLRIRANQGHSIKIDLGLAACEPPDRLYHGTASRFLDAILAEGLRPGQRQHVHLSADGQTARKVGARHGKPVVLEIDARAMRQAGLAFYRSDNGVWLIDGVPPVFIRQTEAR

SEQ ID NO: 77226 - protein, 370 aa, Psychrobacter arcticus 273-4
MTSDQTKPLRVAINGFGRIGRNVLRALLERFEVLGCAIHVVAINDLAPAETLLHLLRFDSTHGRLSQLGVTADIVQDGITDHQQKPCATAKNDIQLCLTKNNLTYGIRLLSRANPETLPWKDLQVDVVLECTGHYRSYEQASLHIEAGAKQVIIGAAPFDHVDACIVMGVNSHTLTRDLPIISSVSCTTQALVPLIDTLDKAFGVESAMMTEIHAVTADQTVLDQAHRDLRRARASGYNIIPTTSSSIAATERVLPNMVGKINGHSIRVPTIDVAAIDVTFVFEMPNVSIEAIRDVLKSASQAHLATIMDYTEEPLVSSDFIHQTESLIIDGQQLMQVGNQYKVFAWYDNEWGYANRMLDMCLHLASNKL

SEQ ID NO: 77227 - protein, 480 aa, Salmonella enterica subsp. enterica serovar Paratyphi B str.
MTLSFTARWRDELPATYTALLPTPLKNARLIWYNDKLAQQLAIPASLFDATNGAGVWGGETLLPGMSPVAQVYSGHQFGVWAGQLGDGRGILLGEQLLADGSTLDWHLKGAGLTPYSRMGDGRAVLRSTIRESLASEAMHYLGIPTTRALSIVASDTPVQRETQETGAMLMRLAQSHMRFGHFEHFYYRREPEKVQQLADFAIRHYWPQWQDVAEKYALWFEEVAARTGRLIAEWQTVGFAHGVMNTDNMSILGLTIDYGPFGFLDDYDPGFIGNHSDHQGRYRFDNQPSVALWNLQRLAQTLTPFIEIDALNRALDRYQDALLTHYGQRMRQKLGFFTEQKDDNALLNELFSLMAREGSDYTRTFRMLSHTEQQSASSPLRDTFIDRAAFDAWFDRYRARLRTEAVDDALRQQQMQRVNPAVVLRNWLAQRAIDAAEQGDMAELHRLHEVLRQPFTDRDDDYASRPPEWGKRLEVSCSS

SEQ ID NO: 77228 - protein, 508 aa, Psychrobacter arcticus 273-4
MLYAYPNTENSPVQFRKKYDNFINGEWVAPIDGEYFDNSSPIDGKTFCQIARSKEADVEAALDAAHAAKDAWGKTSVTERSNMLLKLADGIEANLEKIAIAESYENGKPVRETLAADIPIAIDHLRYFAGVIRAQEGGISQIDEDTVAYHFHEPLGVVGQIIPWNFPILMAIWKIAPALAAGNCVVLKPAEQTPASILYMLDVIGAADILPKGVLNVVNGFGVEAGKPLASNPRIDKVSFTGETTTGRLIMQYASENIIPVTLELGGKSPNIFFADVMDEDDDFLDKAVEGLVMFALNQGEVCTCPSRALVHESIYDEFMKRCIARVKAIKMGNPLDTDTMIGAQASSDQLEKILSYLDIGKKEGAKVLVGGELAKHDGDIANGYYVQPTIFEGTNDMRVFQEEIFGPVLAVTTFKDDEEAMALANDTLYGLGAGVWTRNGTRAYRFGRGIKAGRVWTNCYHLYPAHSAFGGYKQSGIGRENHLMMLDHYQQTKNMLVSYSPKAMGFF

SEQ ID NO: 77229 - protein, 570 aa, Bacillus cereus E33L
MTLNIQGIAASSGIAIAKAFRLENPEFNIEKKSITNEAAEIARLEAALEKAKTELEAIKDHAFAELGADKAAIFEAHLLVLNDPELVNPVKDKVTSEKVNAEFAMDEVASMFISMFENMDNEYMKERAADIRDVTKRVLAHLLGINFSNPGTISEEVIIIAEDLTPSDTAQLNRKYAKGFTTDIGGRTSHSAIMARSMEIPAVVGTKVVMEKIQNGDIVIIDGLDGEVIVNPSEETLRSFEEKKAKFEEQKAEWAKLKDQATVTSDGHHVELVANIGTPNDVQGIIDNGGEGVGLYRTEFLYMGRDNLPTEEEQFEAYKAVLEGVKEGQPVVVRTLDIGGDKELPYLHLPKEMNPFLGYRAIRLCLDEQDVFRTQLRALLRASVYGNLKIMFPMIATLDEFRQAKAILLEEKAKLVEAGTTVSDSIEVGMMVEIPASAVLADQFAKEVDFFSIGTNDLIQYTMAADRMNEQVSYLYQPYNPSILRLVKMVIDAAHKEGKWAGMCGEMAGDSLAIPLLLGLGLDEFSMSATSILPARTQLSKLSKVEMETLAEKALMMSTAEEVVELVKSI

SEQ ID NO: 77230 - protein, 353 aa, Saccharomyces cerevisiae
MFEGFGPNKKRRISKLAAEQSLAQQPWVEKYRPKNLDEVTAQDHAVTVLKKTLKSANLPHMLFYGPPGTGKTSTILALTKELYGPDLMKSRILELNASDERGISIVREKVKNFARLTVSKPSKHDLENYPCPPYKIIILDEADSMTADAQSALRRTMETYSGVTRFCLICNYVTRIIDPLASRCSKFRFKALDASNAIDRLRFISEQENVKCDDGVLERILDISAGDLRRGITLLQSASKGAQYLGDGKNITSTQVEELAGVVPHDILIEIVEKVKSGDFDEIKKYVNTFMKSGWSAASVVNQLHEYYITNDNFDTNFKNQISWLLFTTDSRLNNGTNEHIQLLNLLVKISQL

SEQ ID NO: 77231 - protein, 190 aa, Wolbachia endosymbiont strain TRS of Brugia malayi
MFIQIEETPNPNTLKFLPGFAILNERETADFSNPDEIKNSKLAADLFQIEHVIRVFFGHDFISVTKSDGISWDILKVEILTTVMDHFTSGGKALDRKGVNDNNIPDEEFFDENDIEIVNRIKELMENYIKPAVAQDGGDIKFRGYKDGIVYVELQGACSGCPSAAITLKQGVQNMLCYHIPEVSGIETTL

SEQ ID NO: 77232 - protein, 255 aa, Oryza sativa Indica Group
MAAAAKTAVQPAVVVGGGRVGQALLSMGPPGADVLVGRGEKVPEDAPGPILVCTRNDDLDAVLDATPRSRWRVQWKKSPDLFLEWVVLGKLNGMLDPWFESKGLVDANQVLAYFAVSKLGEPPVDGITDTNPEGLTAAFGNWAPAVATRLQNGGLTCKVLEKEAFQKQMLEKLIWISAFMLVGARHPGATVGAVEKEYRSEVASLIAELASAAAEERGLTFDAGIEERLCAYSRAVAHFPTAVKEASPAYHKLSI

SEQ ID NO: 77233 - protein, 554 aa, Chromobacterium violaceum ATCC 12472
MNWVSMSRKALAGGGLLLIALPALAGQGAVAAPDQYGAEVAARILKSGGNAVDAAVATAFALAVTYPEAGNIGGGGFMTIYQGGKPYFLDYREVAPKAASRDMYLDKDGKVVPDMSLVGARAAGVPGTVMGLWQAHQRFGKLQWKQLLDPAIGYAEQGFTVAARQYQYRDEAVKLFDGKTNFAQYFGKMKGGETFRQPELAATLKRIARYGAAEFYQGETAKLLVAQMKRDKGLITADDLNDYRAKWREPVRISWHDRTVYTAPPPSSGGVALAQLLTIKQERASDFTGVALNSARYIHLLAEIEKRVFADRADYLGDPDFVKTPVAQLIDPDYLARRAAEINPTAISPTPDIKPGLDPRQTTHFSIVDQWGNAVANTYTLNFDFGSGVVVKGAGFLLNDEMDDFSAKPGVANAFGVVGKDANAIAPGKRMLSSMSPTIVTRDGKVELVIGTPGGSRIFTSIFQVLNNLYDYKLPLKEAVAAQRVHHQLLPKDTIFYDQYAPLAGQAAQELKAMGYTLKDQGWRMGDIQAVRVVGGKTETASDPRGRGVGIVVE

SEQ ID NO: 77234 - protein, 523 aa, Haemophilus influenzae R2866
MTNIHNHKILILDFGSQYTQLIARRVREIGVYCELWAWDVTEQQIREFAPTGIILSGSPESTTEENSPRAPEYVFNASVPVLGICYGMQTMAMQLGGLTETSDHREFGYASVSLENSTALFANLNDNSTASEPKLDVWMSHGDKVTRLPENFKVTGTTPTCPIAAMSDENRRFYGVQFHPEVTHTKKGLELLTNFVVNICGCETKWTAENIIEDAVARIKEQVGDDEVILGLSGGVDSSVVALLLHRAIGKNLHCVFVDNGLLRLHEGDQVMEMFGDKFGLNITRVDAESRFLGELAGVSDPEAKRKIIGKVFVDVFDDESKKLTNVKWLAQGTIYPDVIESAASKTGKAHVIKSHHNVGGLPDYMKLGLVEPLRELFKDEVRKIGLALGLPAEMINRHPFPGPGLGVRVLGEVKKEYCDLLRRADAIFIEELRNSGWYEKTSQAFSVFLPVKSVGVMGDGRKYDWVISLRAVETIDFMTAHWAHLPYDLLGKVSNRIINEVNGISRVVYDISGKPPATIEWE

SEQ ID NO: 77235 - protein, 141 aa, Cathaya argyrophylla
MKALLAKYQGFHSLNSLVDVGGGTGTAIAEIVRAYPSIRGINYDLPHVVATARRLTGVEHVGGDMFEAVPTGDAIFMKWIMHDWSDENCIKILKNCRKAIPDTGKVIIVDVVLDPDQGDDIVQRKKKALDPNLGIAFDLVM

SEQ ID NO: 77236 - protein, 96 aa, Acidovorax sp. JS42
MATAKTASAAPAKKRTPNAAFMKPLTPSPALAAVVGATPLPRTEIISKLWVYIKAHNLQDASNKRMINADAKLKEVFGKPQVSMFEMAGLIGKHVK

SEQ ID NO: 77237 - protein, 194 aa, Saccharomyces cerevisiae
MTVYTASVTAPVNIATLKYWGKRDTKLNLPTNSSISVTLSQDDLRTLTSAATAPEFERDTLWLNGEPHSIDNERTQNCLRDLRQLRKEMESKDASLPTLSQWKLHIVSENNFPTAAGLASSAAGFAALVSAIAKLYQLPQSTSEISRIARKGSGSACRSLFGGYVAWEMGKAEDGHDSMAVQIADSSDWPQMKA

SEQ ID NO: 77238 - protein, 268 aa, Oryza sativa Indica Group
MAGLPARLPSFLLRFDCKCTVLEKEAFQKQMLEKLIWISAFMLVGARHPGATVGAVEKEYRSEVASLIAELASAAAEERGLTFDAGIEERLCAYSRAVAHFPTALSMEQFKWRNGWFYSLTEKALAQGKPDPCPLHTAWLKEIKVRSRYGAIVTTTATLAVAVQLIDQKSTAQMTGMRNFLSMKPAYSSNDGKVKQVTTPREGDFKAMGLPISAGWSADEERGNSCNIFPQEMQQLCPPDLGRTQKGQIPKLQSRELKTQKEEEEHEM

SEQ ID NO: 77239 - protein, 502 aa, Arabidopsis thaliana
MAISFLCFCLITLASLIFFAKKIKHLKWNLPPSPPKFPVIGNLHQIGELPHRSLQHLAERYGPVMLLHFGFVPVTVVSSREAAEEVLRTHDLDCCSRPKLVGTRLLSRNFKDVCFTPYGNEWKARRKFALRELFCLKKVQSFRHIREEECNFLVKQLSESAVNRSPVDLSKSLFWLTASIFFRVALGQNFHESNFIDKEKIEELVFEAETALASFTCSDFFPVAGLGWLVDWFSGQHKRLNDVFYKLDALFQHVIDDHLFPGRSKEHEDIIDSMLDAIHKEGKDSSLELIIDHIKGFLANIFLAGIDTGALTMIWAMTELVKNPKLIKKVQGEIREQLGSNKARITEEDIDKVPYLKMVIKETFRLHPAAPLILPRETMAHIKVQGYDIPPKRRILVNVSAIGRDPKLWTNPEEFDPERFMDSSVDYRGQHYELLPFGSGRRICPGMPMGIAAVELGLLNLLYFFDWKLPDGMTHKDIDTEEAGTLTIVKKVPLQLVPVRVQ

SEQ ID NO: 77240 - protein, 209 aa, Clostridium tetani E88
MSKRPILIGITGGTGSGKSTVSKEICRRFDKELIVMIEQDSYYKDQSHLSIEERVKTNYDHPNAFDTELLVKHLKELSYWSKVEKPIYDFELHNRKNETEIVEPTEIIIVEGILVLEEKEIRDLLDIKIYVDTDADVRIIRRLVRDIKERGRSLDSVINQYLNVVRPMHMQFIEPSKRYADIIIPEGGHNKVAIDIIVGNIKQMVQKSE

SEQ ID NO: 77241 - protein, 571 aa, Pyrococcus abyssi GE5
MEVERIALKYALINAIEHGGKANPKAVIGKVLGENPELRSKAREIVPIINKVVEEVNSLSLDEQKAKLMEIYPEYFEKKEEKKEEKKGLPPLPKAEKGKVVTRFAPNPDGAFHLGNARAAILSYEYAKMYGGKFILRFDDTDPKVKRPEPIFYEMIIEDLEWLGIKPDEIVYASDRLELYYKYAEELIKMGKAYVCTCKPEKFRELRDKGIPCPHRDEPVEVQLERWRKMLNGEYKEGEAVVRIKTDLNHPNPAVRDWPALRIVDNPNHPRAGNKYRVWPLYNFASAIDDHELGVTHIFRGQEHAENETRQRYIYEYFGWEYPVTVHHGRLSIEGVILSKSKTRKGIEEGKYLGWDDPRLGTIRALRRRGILPEAIKELIIEVGLKKSDATVSWDNLAAINRKLVDPIANRYFFVADPVPMEVEGAPEFIAKIPLHPDHPERGTRELRFTPGKPIYVSKDDLDLLKPGSFVRLKDLFNVEIVEVGEKIKAKFHSFEYEIARKNKWRMIHWVPEGRPCEVIIPEGDELIVRKGLLEKDANVKAGEIVQFERFGFVRIDKIEGEKVVAIYAHK

SEQ ID NO: 77242 - protein, 305 aa, Chromobacterium violaceum ATCC 12472
MTPPQFVAFGEALTDFIRVDGDAWQSRPGGAGWNVARVVGRLGVGAAFAGAVSDDLLGRQLLEASAAAGLDTRFLQPLPYPPLLAMVPSSQPPSYFFVGDNSADLHFDPARLPPDGLDALRIAYFGSISLARPPLADRLLELAHELAARGVAIAFDPNMRSAMSEAGYRRRFEALAGLASYIKVSDEDLQLLFPARDQDRALEALRRLAPRAAILYTRGADGMSLLGSGGALEQAALPAAVADTIGCGDASIGGLIASLLKYPARTMAEHLRFAAATAACTAGHAGAYAPDEAMVNAKLTLPSAA

SEQ ID NO: 77243 - protein, 470 aa, Geobacillus stearothermophilus
MVVGDFAIETETLVVGAGPGGYVAAIRAAQLGQKVTIVEKGNLGGVCLNVGCIPSKALISASHRYEQAKHSEEMGIKAENVTIDFAKVQEWKASVVKKLTGGVEGLLKGNKVEIVKGEAYFVDANTVRVVNGDSAQTYTFKNAIIATGSRPIELPNFKFSNRILDSTGALNLGEVPKSLVVIGGGYIGIELGTAYANFGTKVTILEGAGEILSGFEKQMAAIIKKRLKKKGVEVVTNALAKGAEEREDGVTVTYEANGETKTIDADYVLVTVGRRPNTDELGLEQIGIKMTNRGLIEVDQQCRTSVPNIFAIGDIVPGPALAHKASYEGKVAAEAIAGHPSAVDYVAIPAVVFSDPECASVGYFEQQAKDEGIDVIAAKFPFAANGRALALNDTDGFLKLVVRKEDGVIIGAQIIGPNASDMIAELGLAIEAGMTAEDIALTIHAHPTLGEIAMEAAEVALGTPIHIITK

SEQ ID NO: 77244 - protein, 327 aa, Neisseria gonorrhoeae FA 1090
MAAYDSLMVFTGNANPELAQRVVRHLDISLGNASVSKFSDGEVAVELLENVRGRDVFILQPTCAPTNDNLMEILTMADALKRASAGRITTAIPYFGYARQDRRPRSVRVPISAKLVANMLYSAGIDRVLTVDLHADQIQGFFDIPVDNIYATPILLNDIKQQRIENLTVVSPDIGGVVRARAVAKSLNADLAIIDKRRPKANVAEVMNIIGDIQGKTCLIVDDMIDTANTLCKAAVALKERGAERVLAYASHAVFSGEAVSRIASSEIDQVVVTDTIPLSEAAKNCDRIRQVTIAGLLAETVRRISNEESVSYLFNEEVMTGSMLLP

SEQ ID NO: 77245 - protein, 508 aa, Neisseria gonorrhoeae FA 1090
MNTPLPYSDYLIRILTASVYDVAVETPLEPARSLSVRLKNNILLKREDLQPVFSFKIRGAYNKMSKLPKDALACGVIAASAGNHAQGVALSAQRLGCRAVIVMPETTPKIKVDAVKSRGGEVVLRGVSYNDAYDYAMELAEQEGLTYIAPFDDPDVIAGQGTVGMEIVSQHPDPIRAVFVPIGGGGLAAGVAAFIKQVRPEIKVIGVQTNDSCCMKQSVEAGEIVHLKDVGLFSDGTAVKVVGNGTFRLCKELLDEIITVDTDAVCGAVKDIFDDTRSITEPAGALALAGLKAYIAREGAENQTLIAVTSGANMNFHRLRHVSERSELGEGNEGIFAVTIPEERGSFLKFVNILGNRNITEFNYRYGGDEKAHIFVGLQAAGPQDLAVIGSRLDEAGLPNVDLTNNEIAKIHIRYMVGGRTDKVGHERLVSFEFPERPGALARFLNHMQGGWNITLFHYRNHGADYGRILVGIDVPPHDAAAFDGFLESLGYSYHEETQNAAYKLFLA

SEQ ID NO: 77246 - protein, 478 aa, Pseudomonas fluorescens
MSQKFDVVVIGAGPGGYVAAIRAAQLGLKTACIEKYIGKEGKVALGGTCLNVGCIPSKALLDSSYKYHEAKEAFKVHGIEAKGVTIDVPAMVARKANIVKNLTGGIATLFKANGVTSFEGHGKLLANKQVEVTGLDGKTQVLEAENVIIASGSRPVEIPPAPLSDDIIVDSTGALEFQAVPKKLGVIGAGVIGLELGSVWARLGAEVTVLEALDKFLPAADEQIAKEALKVLTKQGLNIRLGARVTASEVKKKQVTVTFTDANGEQKETFDKLIVAVGRRPVTTDLLAADSGVTLDERGFIYVDDHCKTSVPGVFAIGDVVRGAMLAHKASEEGVMVAERIAGHKAQMNYDLIPSVIYTHPEIAWVGKTEQTLKAEGVEVNVGTFPFAASGRAMAANDTTGLVKVIADAKTDRVLGVHVIGPSAAELVQQGAIGMEFGTSAEDLGMMVFSHPTLSEALHEAALAVNGHAIHIANRKKR

SEQ ID NO: 77247 - protein, 466 aa, Arabidopsis thaliana
MNSGDVFILSRSKGHDMLAPFTAGWQSADLDPLVIAKSEGSYVYDDTGKKYLDSLAGLWCTALGGNEPRLVSAAVEQLNTLPFYHSFWNRTTKPSLDLAKVLLEMFTANKMAKAFFTSGGSDANDTQVKLVWYYNNALGRPEKKKFIARKKSYHGSTLISASLSGLPPLHQNFDLPAPFVLHTDCPHYWRFHLPGETEEEFSTRLAKNLEDLIIKEGPETIGAFIAEPVMGAGGVIPPPATYFEKVQAVVKKYDILFIADEVICAFGRLGTMFGCDKYNIKPDLVTLAKALSSAYMPIGAILMSQEVADVINSHSSKLGVFSHGFTYSGHPVSCAVAIEALKIYKERNIPEYVAKVAPRFQDGVKAFASGSPIIGETRGTGLILGTEFVDNKSPNEPFPPEWGVGAFFGAECQKHGMLVRVAGDGILMSPPLIISPEEIDELISIYGKALKATEEKVKELKAQHKK

SEQ ID NO: 77248 - protein, 354 aa, Arabidopsis thaliana
MSCSSSSGSEEDDEGFDAYRKGGYHAVRIGDQFAGGRYIAQRKLGWGQFSTVWLAYDTRTSNYVALKIQKSALQFAQAALHEIELLQAAADGDPENTKCVIRLIDDFKHAGPNGQHLCMVLEFLGDSLLRLIKYNRYKGMELSKVREICKCILTGLDYLHRELGMIHSDLKPENILLCSTIDPAKDPIRSGLTPILEKPEGNQNGTSTMNLIEKKLKRRAKKAAAKISGRRVSIVGLSETPKKNKRNLDGIDMRCKVVDFGNGCWADNKFAEEIQTRQYRAPEVILQSGYSYSVDMWSFACTAFELATGDMLFAPKEGNGYGEDEDHLALMMELLGKMPRKVRDQRITLTDTAT

SEQ ID NO: 77249 - protein, 459 aa, Pseudomonas putida
MQQTIQTTLLIIGGGPGGYVAAIRAGQLGIPTVLVEGQALGGTCLNIGCIPSKALIHVAEQFHQASRFTEPSPLGISVASPRLDIGQSVAWKDGIVDRLTTGVAALLKKHGVKVVHGWAKVLDGKQVEVDGQRIQCEHLLLATGSSSVELPMLPLGGPVISSTEALAPKALPQHLVVVGGGYIGLELGIAYRKLGAQVSVVEARERILPTYDSELTAPVAESLKKLGIALHLGHSVEGYENGCLLANDGKGGQLRLEADRVLVAVGRRPRTKGFNLECLDLKMNGAAIAIDERCQTSMHNVWAIGDVAGEPMLAHRAMAQGEMVAEIIAGKARRFEPAAIAAVCFTDPEVVVVGKTPEQASQQGLDCIVAQFPFAANGRAMSLESKSGFVRVVARRDNHLILGWQAVGVAVSELSTAFAQSLEMGACLEDVAGTIHAHPTLGEAVQEAALRALGHALHI

SEQ ID NO: 77250 - protein, 646 aa, Candida albicans
MTSLQQQQQQQRVKYGPPHHIKRRPYHPILESLEFQTNQHLIQEYSLDIVNTLSQLESLTLVNPAMIDLQPEIQWFMRPFLLDFLIELHSSFKLQPTTLFLCLNIIDRYCAKRIVFKRHYQLVGCTALWIASKYEDKKSRVPTLKELTIMCRNAYDEEMFVQMEMHILSTLDWSIGHPTLEDCLQLAIDSNNLSNNTTNDIENKSVRPNRKSSISSAVTAVARFLCELSLYDKYFLSVPPSLIAITANLLSCSMLQIPHASITLKNLIEQEIINPQQKKQKKAFSSNSSRTTTASYTHQNQSDVRHSSFDEDIDLDSGDEGDDDEDYIDEFYETNNYDDTNATTFDESINKSTTINDENQPPQIHTPFLSGLDEDSILSIKKICLMLIIQLSKVTEVLSKKYENLGVIQVINNFHSNYKFIIQSIYENQELLLNTINDSTNNNEIDYKLIQSSEILLQFPKFDEYLTEDEDENVSTDDEANSQPQGYDGSGSDGNNQLFTPKSPNAFSSNSSLTLNNHPQSMVPVTPPSATSQYSLFSNKNNRTHESTSGLNSTCNTPTHISISSFAPPQPPPGSILKPKLTSINSTNSLKIKKLTSNSNSSNINIHHGHHNTKQEKRYSHISIGSNSSSKYDGFSPIKSISTNGS

SEQ ID NO: 77251 - protein, 392 aa, Legionella pneumophila str. Paris
MDIALAKRVQKVKPSPTLAVAAKAAQMKAQGLDIIGLGTGEPDFDTPQHIKLAAISAIEAGDTKYTAVDGIVELKEAVKNKFKRDNELDYQLNQILVSVGGKQSCYNLCQAYLNPGDEVIIPAPYWVSYPDMVLLADGVPVIIETTPAQRYKINAQQLEQAITPKTRMIFLNSPSNPSGIAYTQNELKELGDVLKKHPQILIATDDMYEHIIWSQAFTNILNACPELYDRTIVLNGVSKAYAMTGWRIGYAAGPAPLINAMKTIQSQSTSNPCSIAQRAAVAALNGSNESIEEMVNAFHQRHDYVADRLQSIDGIEVIPADGTFYIFPSVQAIIEKRGYANDIEFSEKLLNEVGVALVPGSAFGTEGCIRISFATGIDTLKDALNRLQRFCS

SEQ ID NO: 77252 - protein, 337 aa, marine gamma proteobacterium HTCC2080
MERAVAYKIAVMGGGSWGTTVASLVSRNADIMLWARDAATVDDINGNHKNSRYLGDAPLNPKLQATLDPAEAIAGADAVVMGIPSNNFRSVLTDIAPDLPDGAPLISLTKGLERGSRLRMTEICREVAPGRPIGVLTGPNLAREIVAGQAAAGVLALDDPSPQHWLQPVLNVGLFRVYTNPDHIGCELGGVFKNIIAIAVGMGDGLGAGDNTRAALITRGLAEMTRLGTALGGRAETFSGLAGMGDMIATCTSPQSRNRHVGIELAKGRSIEDIIASMHMVAEGVKSAPTVMELAAEHGVDMPISSDVFKVVTGASNARGVYRGLLRTRAAAESEPG

SEQ ID NO: 77253 - protein, 278 aa, Triticum aestivum
  misc_feature (17)..(19): Xaa can be any naturally occurring amino acid
  misc_feature (24)..(24): Xaa can be any naturally occurring amino acid
  misc_feature (44)..(44): Xaa can be any naturally occurring amino acid
  misc_feature (76)..(76): Xaa can be any naturally occurring amino acid
  misc_feature (82)..(83): Xaa can be any naturally occurring amino acid
NQCENVETTRRALRELXXXCTCAXQYLSGVILLRETLYQSTKVXKPFVDILKAGNVLPGIKVTKGTIELAGTQREXTTTQGXXDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDSKKVAPEVIAEYTARTLQRTVPAAVPAIVFLSGGQSEEEATLNLNSFEKKKKKKKKRAAALEYPSRGPSLRVPSFLVQSGPNLAS

SEQ ID NO: 77254 - protein, 465 aa, Candida albicans
MFPNSPDAFHQVRMMQSSIKASNFKLQSMEFRCHSNNVCEYQMEMLHHLLSVEAKTLPSLSLIEQQPEIKLGMRPLLLDFLMEVITILNLSRSTFPLTVNLIDRYCSTRIVKKQHYQLLGLTSLWISCKNLDSKFKVPTLNDLRKICVDSYYKELFVEMEKHILKSLEWVVNAPTFDAFIDLYSNLLISNSSNFEVANIIKKSSHKIKLFSNYIGELFQFYPNIYYDYTSSQIALIAILITVLTLKIPVDLISLLNFYNGLVKTEMFKSNVEQGAEDQFEEILSVDSFKSLFNKSFFKNLIKIIDNPPSSLKIKYFAENGKYSVLMKQLVTTASNTLKCILDPVPTTPKANSFVKHQQQQHHYHPRPPMSINTSMIPLTPVSNSTSPNRFSPDQIFSENESTPGIAFGTMTPDSQSTSPGEKRSYECIDELEIGTSTIAGYTLKNHDTLKRSKSANYGTLFYLQQ

SEQ ID NO: 77255 - protein, 473 aa, Zea mays
  misc_feature (355)..(355): Xaa can be any naturally occurring amino acid
  misc_feature (450)..(450): Xaa can be any naturally occurring amino acid
MEAADYGKLFVGGISWETSEDRLREYFGRFGEVTEAVIMRDRSTGRARGFGFVVFADAAVAERVTMDKHTIDGRMVEAKKAVPRDDHSIVSKSNGSSTGSPGPGRTRKIFVGGLPSSVTEADFRRYFEQFGIITDVVVMYDHNTQRPRGFGFITYDSEDAVDKALHKSFHELNGKMVEVKRAVPKEQSPGPVVRSPVGVGQNYATNRVHSFLNGFNQGYNPNPIGGYGMRVDGRYGLLSGARNGFSSFGPGYGMGMNVEGGMSGTFGASSGFISNSNGRQMGSYFNASSNRLGSPIGYLGLNDVPGSMLSSMSRNVWGNGSLNYPSNPTNMSAFASPGNGSQVSLTGDNWGRSSXAHGMGNISSLGSGNLARGAGDNNFGLPSGSYGRSNSTGTIGEPFFAAGNTYDVNNRDTYGSSSIYGGTAWRFASSEVDMPSLVHDIGNVDPTIKXYMSASHMGNYPVNNNQPSRGISS

SEQ ID NO: 77256 - protein, 428 aa, Medicago sativa subsp. x varia
MKFSEEKNVSNNPTNFEGGLDSRKVGQNRRALGVINQNLVVEGRPYPCVVNKRALSERNDVCEKKQADPVHRPITRRFAAKIASTKTSNAEGTTKRSNLAKSSSNGFGDFIFVDDEHKPVEDQPVPMALEQTEPMHSESDQMEEVEMEDIMEEPVMDIDTPDANDPLAVAEYIEDLYSYYRKVESTSCVSPNYMAQQFDINERMRAILVDWLIEVHDKFDLMHETLFLTVNLIDRFLEKQSVVRKKLQLVGLVAMLLACKYEEVSVPVVGDLILISDRAYTRKEVLEMEKVMVNALKFNISVPTAYVFMRRFLKAAQADRKLELLAFFLIELSLVEYAMLKFSPSQLAAAAVYTAQCTMYGVKQWSKTCEWHTNYSEDQLLECSSLMVDFHKKAGTGKLTGAHRKYCTSKFSYTAKCEPASFLLENEL

SEQ ID NO: 77257 - protein, 509 aa, Oryza sativa Japonica Group
MAPPRAQRTMLVVAGDAPPTAGCAPRTCPTRSLLVFASLTPTDRNACSLTCARWKEVDASTRHRLSLDARAALGYAAQGIFARFTAVSKLALRCARGSGTDSLSDDGARQVAAALPSARLARLKLRGLRQLSDDGLASLAGATPVIRKLSVASCSFGPKAFVAVLRSCPLLEDLSVKRLRGLPDTAGATTAITEEILFPPASSLRSVCLKDLYSALCFVPLVASSPNLRSLKILRCSGSWDLPLEVIAARVPGLVELHLEKLQVGDRGLSAVSACANLEVLFLVKTPECTDAGIISVAEKCHKLRKLHIDGWRTNRIGDHGLMAVARGCPDLQELVLIGVNPTVQSLRMLGEHCRSLERLALCGCETVGDPEIICLAERCAALKKLCIKGCPVSDRGMWALNGGCPSLVKVKLKRCRGVSYECIENLKVVRGGSFSISLDIVLERDAGGAIENGGQEAGQVQITELTDQMAAMDLPTNASNAQSSAQASSRMRSVMSALRRRFGNPPAL

SEQ ID NO: 77258 - protein, 168 aa, Wolbachia endosymbiont of Drosophila melanogaster
MDLSKITAGPNAVNVVIEISANAEPVKYEFNKEFRLLQVDRFLSTSMTYPCNYGFVPNTCAGDGDPVDVLVLTQFPLASSVLISVRPIGALLTKDEKGEDEKILAVPVSSVDSYYDNIKDYSDLSKSLLDKITHFFSHYKDLEKGKTVAVGEWVGVEEAKKIIEKSRN

SEQ ID NO: 77259 - protein, 434 aa, Medicago sativa subsp. x varia
MVNTSEENNSNAVMPRKFQGGMNQVGHGGGRIVGQNRRALGGINQNFVHGRPYPCVVHKRVLSEKHEICEKKQADLGHRPITRRFAAKIAGSQQSYAEKTKNSNPLNLNEFGNSIAIDDELKSPEDQPEPMTLEHTEPMHSDPLEMEEVEMEDIEGEMILDIDSCDANNSLAVVEYIEDLHAYYRKIEYLGCVSPTYMDEQLDLNERMRAILVDWLIEVHDKFDLMQETLFLTVNLIDRFLAKQNVVRKKLQLVGLVAMLLACKYEEVSVPVVSDLIHIADRAYTRKDILEMEKLMLNTLQYNMSLPTAYVFMRRFLKAAQADKKLELVAFFLVDLSLVEYEMLKFPPSLVAAAAVYTAQCTVSGFKHWNKTCEWHTNYSEDQLLECSMLMVGFHQKAGAGKLTGVHRKYGSAKFSFTAKCEPACFLLENKNQP

SEQ ID NO: 77260 - protein, 338 aa, Glycine max
MASSSATGAGSTDPTAARRNTKRPKYSKFTQQELPACKPILTPRAVISAFLLVSIVFVPIGVASLIASRKVVEIVFRYESTCIPHEVTDKVAYIQSPADKTCKISLPVDKHMKSPIYVYYQLDNFYQNHRRYVKSRSDEQLRDRREENSTSACNPEDIANGKAIVPCGLIAWSLFNDTYSFSRDNKNLTVNKNGISWKSDREHKFGKHLFPKNFQSSAIRGGASLNESIPLSKQEDLIVWMRTAALPTFRKLYGKIEVDLNAGDQINVTLQNNYNTYSFNGKKKLVLSTTSWLGGKNDFLGIAYLTVGGLCFFLALAFTVVYFVKAKATWRSLIFVME

SEQ ID NO: 77261 - protein, 466 aa, Buchnera aphidicola (Schizaphis graminum)
MEGTMSSCFRGMLMKLRFSELLNNISSFEKKVNNLSDIFSYGCLISVNGLLLEVIGLTAPIGSRCYVERIIDGKILNISAEVVGFKKEKTLLFSLEETYGVFPGTRVFLKCFKNTYSITGKIPLSTELLGRVLDSKGRPLDGRSQLNPKFFTFLKSNVVNPLNRKPITEVLDTGIRAINALITVGRGQRIGIFSSSGLGKSILLGMMAKYTKADVVIIGLIGERGREVKDFIENILGSNGLSRSVVIAAPADVSPLLQIEAASYATSIAEYFRKKNKHVLLIMDSLTRYAMAQRAVSLSLGELPVSKGYPSSVFSKIPILVERTGNTDNYGSITSFYTVLTESEEDPQDPIAHICRSILDGHIVLSRHYAELGHYPAIDIENSISRVMPNIISKKQYSQACYFKKLIASYQRNRDLINIGAYLKGTDSTLDHAIKIWPILERFLQQKQSEKSSYLSSCEELNQIFI

SEQ ID NO: 77262 - protein, 465 aa, Erythrobacter sp. NAP1
MSDEPQAAIYSPDPAIQSLSDWLASPVEAADFPQTQVRFRNDRAAQSVGLAALSDDQWAQHFGRLEPLEGNLPQPLALKYHGHQFRVYNPEIGDGRGFLFAQMRDGNGRLMDLGTKGSGTTPYSRAGDGRLTLKGAVREILATEMLEALGVNTSKTFSVIETGEQLMRDDEPSPTRSAVMVRLSHSHIRIGTFQRLLAHEEKEDMDALVDYCLEHFPGPPPPDDAPGRDEPAVRLMHNVVERMADLAASYMVAGFVHGVLNTDNMNITGESFDYGPWRWLPKWEPGFTAAYFDHAGLYAFGRQPEALHWNCGQFAVALRLLADTEPLVAAMERFGPLYMEAVARRWTWRLGVKPRGAEFDAQLVAACEKAMRESEAQPDAFFFAHRGGRGAEGELGEALREYEAVEDAHDYWSDDAPQSMVIAEVEEIWSAIDERDDWSPLMDKVSALRRMGEAHGPAPTPAGHA

SEQ ID NO: 77263 - protein, 392 aa, Bacillus cereus E33L
MKLFQPSEIVTSLPTQFFASLVAKVNKVVAAGHDVINLGQGNPDQPTPQHIVKALQDAAEKTIHHKYPPFRGHESLKEAVATFYQREYDVVVNPKTEVAILFGGKAGLVELPVCFTNPGDTILVPDPGYPDYLSGVALAKAQFETMPLIAKNNFLPDYTKIDDSIAERAKLMFLNYPNNPTGATASKDFFDETIHFANKHNILVVHDFAYGAIGFDGQKPVSFLQADGAKDTGIEIYTLSKTFNMAGWRIAFAVGNESVIETINLLQDHMYVSIFGAIQDAAREALLSSQSCVIDLVNSYESRRNALISACHSIGWNVDIPTGSFFAWLPVPEGYTSEQFSDILLEKAHVAVAPGVGFGEHGEGYVRVGLLHTEDRLREAINRIDKLNFFKK

SEQ ID NO: 77264 - protein, 484 aa, Oryza sativa Japonica Group
MDLSPSAAASPSLAKAVETYRKAVATAATVTAYAMLARGMARELVPHDLRAALIWAASLVRARVEPRPAECRTAIIRSIEGNGHGHAQCIESRFFVDAHAYLATKIDPRSMSRFFLGGGGGGRRGRNVLSMVPGDSMTDVFEGVEFKWTSVPAEGRFADTEVSLELSFDAAHTDMALRRYVPFITEEVEQARRRDRELMIFMNEGSSWRGIAHHHPATFDTLAMDPELKQSIVADLDRFLKRKEYYRRIGKAWKRGYLLHGPPGTGKSSLVAAMANHLRFNLYDLDLSEVHSNSALQRLLIGMTNRCILIVEDIDCCFSARSREDGKERKKPTLTNNDGGGGDDDDDEGDDFSEKRLTLSGLLNFIDGLWSTSGEERVIVFTTNYKDRLDAALLRPGRMDMHVYMGYCGWDAFKTLAHNYFLVDDHPLFPEIRALLAGVEATPAEVSEMLLRSEDADAALSGLVEFLEEKKEKKKKQAMCEAGK

SEQ ID NO: 77265 - protein, 627 aa, uncultured bacterium
MPMRRRTRASTCWSLSPAPSPACACADPGPARRGSRARPWHRACNRIGSMSIPDGSTPQGRRTLDWRAWAAGLNLAPFRPRLLDALKDYNRGRFFVDLAAGLTVGIVALPLAMAFAIASGVEPEAGLFTAIIAGFLISALGGSSVQIGGPAGAFIVIVYGIIEQYGLANLLISTVLAGVLMFLLGLFRLGVLVRYIPVSIVIGFTNGIAVLIAVSQFKELLGLMPARMPADVVGQISTLWAHQHQFNVFAFGLGVATLVLLFAWPRLFTAQRLPASPRLARSLTMASRMPGPIVALLLLGVLTAVLELPVQTIGSKFGGIPQALPAFAWPAFTWDGIRQLFMPTVTIALLGSIESLLCARIADNMGDQPRHDPNQELMAQGVANVVAPFFGGIPATGTIARTVTNVRAGATSPVAGMVHAVALLLVVLVAAPLAVHVPLPVLAGILLFVAWNMGEWREFGKLRHFNYTYRTILVGTFLLTVIFDLTVAVQVGLVLACVFFIYRMSTLFRIELLPGHEPQLAVFKLYGVLFFGAVGKVEDLVDQLPAGTRVVVLEAHRLISIDTSGLDALLQLRRALARQDVKLVLCEVNEQPLGLIRRTHHHDTLGPDNVLPDLPTALLRARQLLRH

SEQ ID NO: 77266 - protein, 399 aa, Bacillus thuringiensis serovar konkukian str. 97-27
MLENQINERSLLLHKELVGKIEITSKVEVNSADDLSLTYTPGVAESCKAIAADEETVYDYTARGNMVAVVSDGTAVLGLGNIGPKAAMPVMEGKSILFKKFANVDAFPLCLGTTDVDEIVTLVKNLEPTFAGINLEDIAAPRCFEIEKRLKEETNIPVFHDDQHGTAIVVLAAVINALKVVSKQMDHVKIVINGAGSAGIAIGKLLLKAGAQHITLVSLEGIVCEGEAWMNEAQIEVSKKTNREHVRGTLKEAIHQADIFIGVSAPNVLTKELVQMMNEKAIVFAMANPIPEIFPEDALEAGAAVVGTGRSDYANQVNNVLAFPGIFRGALDVRATDITEEMKLAAAYGIANIITDEERNANYVIPNPLDKRVVPSVAEAVAKAAIDSGVAQIMKIPSY

SEQ ID NO: 77267 - protein, 218 aa, Triticum aestivum
  misc_feature (43)..(43): Xaa can be any naturally occurring amino acid
  misc_feature (140)..(140): Xaa can be any naturally occurring amino acid
  misc_feature (151)..(151): Xaa can be any naturally occurring amino acid
  misc_feature (170)..(170): Xaa can be any naturally occurring amino acid
MVGLSWTRACVLALCIMLFLHPAAAIRFVIDREECFSHNVEYXEGDTVHVSFVVIKADTPWHYSEDGVDLVVKDPNGAQVRDSRDKISDKFEFIVQKRGVHRFCFTNKSPYHETIDFDVHVGHYSYFDQHAKDEHFSPLXFEQIAKLDEAXLYNIQFEQHWAGEAQTDRXQAILNEDLSRGGPPPGAFFESAVLIAASVIQVYLLRRLFERKLGTSRV

SEQ ID NO: 77268 - protein, 173 aa, Brassica napus
  misc_feature (158)..(158): Xaa can be any naturally occurring amino acid
MESVSDLGKLFIGGISWDTDEERLREYFSKYGDLVESVIMRDRTTGRARGFGFIVFADPSVAERVILEKHIIDGRTVEAKKAVPRDDQQVLKRHASPMHLISSPSQHGGGSNRTKKILVGGLPSSITEAEFKNYFDQFGTIADVVVMYDHNTQRPRGXGFITLDSEESWTGSS

SEQ ID NO: 77269 - protein, 647 aa, Lentisphaera araneosa HTCC2155
MFRFDNIRKAYAGRMVLDDTSFHVHPGERAGLVGPNGAGKSTIFRILTGQESSDKGDVKLRKNIRIGWLRQNIPDELKHLPLLEFACKARPDLEAIQERIIELEKGFSQAADQDKLLAQIGDLQHEFEAGGGYLIETAARTCLSGLGFSEAELEKPICEFSGGWQMRAELVRVVISDPDLLLLDEPTNYLDVPAVEWLREFMVNFRGTLLLISHDRYLLNELTDVTYEVYGGQVTRYPGNYDQYKKVRDERMERLEVESEKLERKKEKLEGFVNRFKAKASKATQAKSRMKQLEKLESVDTMVKVSSVDLRLGTPPAGSPVPVELEDMSKTYDGERYIYQNLSMAIQDGEKIAVVGSNGMGKSTLLKILANKLPIEEGKVSFGHKTTIGYHAQELTENFSNSLNLIEQCKSFAADTTEGRCRQLLGSFGFHGDDVFKLTGVLSGGEKIRLSLLKLLLAPQNLLLLDEPTTHLDIQAVESLQDALKEFPGTVCFVSHDIEFIRGVADTIFEVTPEGFRKFHGDYDYYMSKIKDEVTLEEQQEKSKVQESSGLNRKEQRRKEAEERKSLKKKRGPLEKRTQALEKLIADLEAEESALVEEFYQEPPSDRMQVMNNRLDEISTEKESAEAEWEEKLGELELVLAQIEEGS

SEQ ID NO: 77270 - protein, 513 aa, Streptococcus pneumoniae TIGR4
MSILEVKNLSHGFGDRAIFEDVSFRLLKGEHIGLVGANGEGKSTFMSIVTGKMLPDEGKVEWSKYVTAGYLDQHSVLAERQSVRDVLRTAFDELFKAEARINDLYMKMAEDGADVDALMEEVGELQDRLESRDFYTLDAKIDEVARALGVMDFGMDTDVTSLSGGQRTKVLLAKLLLEKPDILLLDEPTNYLDAEHIDWLKRYLQNYENAFVLISHDIPFLNDVINIVYHVENQQLTRYSGDYYQFQEVYAMKKSQLEAAYERQQKEIADLKDFVARNKARVATRNMAMSRQKKLDKMDIIELQSEKPKPSFDFKPARTPGRFIFQAKNLQIGYDRPLTKPLNLTFERNQKVAIIGANGIGKTTLLKSLLGIISPIAGEVERGDYLELGYFEQEVEGGNRQTPLEAVWNAFPALNQAEVRAALARCGLTTKHIESQIQVLSGGEQAKVRFCLLMNRENNVLVLDEPTNHLDVDAKDELKRALKEYRGSILMVCHEPDFYEGWIDQIWDFNNLT

SEQ ID NO: 77271 - protein, 158 aa, Zea mays
MAMGLINANPIIHEKKERRIRQAPETTDENAVESIDQLEIFDHIRDIKDPEHPYSLEQLNVVTEDSIELNDESNHVRVIFTPTVEHCSMATIIGLCIRVKLVRSLPPYYKVDIRVAPGSHATEAAVNKQLNDKERVAAALENPNLLDMVEECLSPTFD

SEQ ID NO: 77272 - protein, 622 aa, Oryza sativa Japonica Group
MGWNKATGFTHGLVSSKNSGDLSPGVYSATPSSDFANPGLFLAWNSSVVYWSTGPWNGDYFSNTPELTARALFTFDFVSNDHEEYFTYRLRNDTMVTRYVLAASGQAKNMIWSSVSEDWVTFYAKPGAQCDVYAVCGAFALCREDMLPFCNCMEGFSIRSPQDWELGDQTGGCVRNVPLNCGVTDRFYAMSDVRFPANAKNMEAGTADGCKQACLNDCSCTAYSYNGSCNVWSDGLFNVARQYNYNQSSSGGILYLRLAAEDDVSESSKHTRGLIIGVVAVASVLILSLFTIVIMFVRRNKRNCSSVGRIICGTVAFRYKDLQHATKNFSERLGGGSFGSVFKGVLTDSTVIAVKRLDGARQGEKEFRAEVRSIGIIQHINLVRLIGFCCEGSNRLLVYEYMPNGSLDSNLFGSKVASLDWSTRYKIALGVARGLAYMHGNCLDCIIHCDIKPQNILLDASFVPKIADFGMSKLMGRDFSQVLTTVRGTIGYLAPEWISGMAISSKVDVYSYGMVLLEIVFGRRNFRGECTSNATYFPVQVVGKLLQGNVQCLLDQNIQSDINSEEVERACRVACWCIQDDELNRPTMAQVVHILEGVLEVDMPPMPKLLQAISGNMDSTKT

SEQ ID NO: 77273 - protein, 472 aa, Rhodococcus sp. RHA1
MNTVHEPPKSTGLQQAMKPRQLVMMSLGGAIGAGLFVGSGAGIAVAGPAVLVSFLIAGFLVVLVMRMMGEMVAADPDSGAFSVHAENAMGPVAGRTIGWLYWVQVVIVVAAEATAAAAITAASIPAVPQWAAALAYMSVLTAVNLAGVSRFGEFEFWFAALKIVAIVAFLAVGSAMILGWIPSFDAPGLSNLTGHGGFAPNGVTGIAAGLLIVVFAFGGTEVMAIAAAETSEPRRNVSRAVRSIVWRILVFYVGSVLIMVTVLPWTADELATGPFVAVLNAAHVPGAGAVMTVVVVIALLSSLNAMLFSGSRMIYSLSERGAAAKVFGRVSGNGVPRVAVLASVTFGFVTVVLNYLAPDRVLPLLLNAVGSTILVLWTFVTVSQIVLRRRAERSGRTDLPLKMWGFPYLSYVALALLAAVAVLALFDDAAGNQLFATLTFTCAITVACWVLGRRQRGAAADSTPEKTPETVG

SEQ ID NO: 77274 - protein, 815 aa, Coccidioides immitis RS
MSAEPDHSHHKHKVNLNDPSGAEKKDELDTATAILKKKKKPNSLIVTDAVNDDNSVIALSNNTMETLQLFRGDTVLVKGKMRRDTVLIVLADDDLDDGSARINRVVRHNLRVKHGDVITVHPCPDIKYAKRIAVLPIADTVEGLTGSLFDVFLAPYFREAYRPVRQGDLFTVRGGMRQVEFKVVEVDPPEYGIVAQDTVIHCEGEPIQREDEEGNLNDVGYDDIGGCRKQMAQIRELVELPLRHPQLFKSIGIKPPRGILMFGPPGTGKTLMARAVANETGAFFFLINGPEIMSKMAGESESNLRKAFEEAEKNSPAIIFIDEIDSIAPKRDKTNGEVERRVVSQLLTLMDGMKARSNVVVMAATNRPNSVDPALRRFGRFDREVDIGIPDPTGRLEILQIHTKNMKLAEDVDLESIAAETHGYVGSDLASLCSEAAMQQIREKMDLIDLDEDTIDAEVLDSLGVTMENFRFALGVSNPSALREVAVVEVPNVRWEDIGGLETVKRELIESVQYPVDHPEKFLKFGLSPSKGVLFYGPPGTGKTLLAKAVANECAANFISVKGPELLSMWFGESESNIRDIFDKARAAAPCVVFLDELDSIAKSRGGSVGDAGGASDRVVNQLLTEMDGMTSKKNVFVIGATNRPEQLDAALCRPGRLDTLVYVPLPNEAERVSILKAQLRKTPVAPDVDLEFIASKTHGFSGADLGFVTQRAAKLAIKQAISMEIERTKEREAAGEDVMDEDMDDPVPELTRAHFEEAMQMARRSVNDTEIRRYEAFAQSMKNSSGSNFFRFPTEQEAGQAGFGDAGNDDSLYD

SEQ ID NO: 77275 - protein, 174 aa, Neurospora crassa
MGNTTSSVPDNIVQGSNFDREEVDRLRKRFMKLDKDNSGTIEREEFLSLPQISTNPLATRMIAIFDENGGGDVDFQEFVSGLSAFSRKGNKEQKLRFAFKVYDIDRDGYISNGELFIVLKMMVGSNLKDQQLQRIVDKTIMEADLDKDGKISFEEFTKMVENTDVSMSMTLDQF

SEQ ID NO: 77276 - protein, 395 aa, Neisseria gonorrhoeae FA 1090
MNTLLKQLKPYPFARLREAMQGISAPEGMEAVPLHIGEPKHPTPKVITDALTASLRELEKYPLTAGLPELRQACANWLKRRYDGLTVNPDNEILPVLGSREALFSFVQTVLNPVSDGLKPVIVSPNPFYQIYEGATLLGGGEIHFANCPAPSFNPDWRSISEEVWERTKLVFVCSPNNPSGSVPDLDGWREVFDLQDKYGFIIASDECYSEIYFDGNKPLGCLQAAAQSGRSRQKLLMFTSLSKRSNVPGLRSGFVAGDAELLKNFLLYRTYHGSAMSIPVQRASIAAWNDEQHVIDNRRMYQEKFERVIPILQQVFDVKLPDASFYIWLKVPNGDDLAFARNLWQKAAIQVLPGRFLARDTEQGNPGEGYVRIALVADVATCVKAAETIVSLYR

SEQ ID NO: 77277 - protein, 131 aa, Arabidopsis thaliana
LIIADKFAPDANSKIVPATAIPDGWMGLDIGPDSIKTFSEALDTTKTIIWNGPMGVFEFDKFAAGTEAVAKQLAELSGKGVTTIIGGGDSVAAVEKVGLADKMSHISTGGGASLELLEGKPLPGVLALDEA

SEQ ID NO: 77278 - protein, 402 aa, Pseudoalteromonas tunicata D2
MTVNRELFDEVMVPNYAPSAVIPVRGEGSHVWDQADNEYIDFAGGIAVNCLGHCHPALVNALKVQSEKLWHVANVMANEPAIRLAKKLVDATFADKVYFANSGAEANEAALKLARRFALDNYGEHKSQIIAFNQGFHGRTFFTVTVGGQAAYSDGFGPKPGNIDHCNYNDLAAFEALISDNTCAVMLEPLQGEGGIISPTVEFIQGVRALCDKHNALLIFDEVQTGVGRTGHLYAYQGLAVTPDILTTAKALGGGFPIGAMLTTTDIAKHLKVGTHGSTYGGNPLACAVAEAAFDTVNTPEVLNGVKEKEALFRQLFTQINDKYHVFKEMRGEGLLLGAVVAEQYQGKARDFMLASIDNGLMALVAGVNVVRFAPSLVIPEADIREGMARFEKAVAQVVNAQ

SEQ ID NO: 77279 - protein, 521 aa, Corynebacterium glutamicum ATCC 13032
MIKRLPLGPLPKELHQTLLDLTANAQDAAKVEVIAPFTGETLGFVFDGDEQDVEHAFALSRAAQKKWVHTTAVERKKIFLKFHDLVLKNRELLMDIVQLETGKNRASAADEVLDVAITTRFYANNAGKFLNDKKRPGALPIITKNTQQYVPKGVVGQITPWNYPLTLGVSDAVPALLAGNAVVAKPDLATPFSCLIMVHLLIEAGLPRDLMQVVTGPGDIVGGAIAAQCDFLMFTGSTATGRILGRTMGERLVGFSAELGGKNPLIVAKDADLDKVEAELPQACFSNSGQLCVSTERIYVEEDVYEEVIARFSKAAKAMSIGAGFEWKYEMGSLINQAQLDRVSTFVDQAKAAGATVLCGGKSRPDIGPFFYEPTVLADVPEGTPLLTEEVFGPVVFIEKVATLEEAVDKANGTPYGLNASVFGSSETGNLVAGQLEAGGIGINDGYAATWASVSTPLGGMKQSGLGHRHGAEGITKYAEIRNIAEQRWMSMRGPAKMPRKVYSDTVATALKLGKIFKVLP

SEQ ID NO: 77280 - protein, 486 aa, Pseudomonas sp. CF600
MKEIKHFINGAFVGSASGRTFEDVNPANGQVIARVHEAGRAEVDAAVQAARAALKGPWGKMSVSERAEILHRVADGITARFDEFLEAECLDTGKPKSLASHIDIPRGAANFKVFADLLKNVATEAFEMATPDGSGAINYAVRRPKGVIGVISPWNLPLLLMTWKVGPALACGNTVVVKPSEETPLTTALLGEVMQAAGVPAGVYNVVHGFGPDSAGAFLTEHPDVNAITFTGETRTGEAIMRAAAKGVRPVSFELGGKNAGIVFADCDLDKAIEGSMRSVFANGGQVCLGTERLYVERPIFDEFVARLKAGAESLVIGTPDDPQANFGPLISLQHREKVLSYYQKAVDEGATVVTGGGVPEMPAELAGGAWVQPTIWTGLADGAAVVTEEIFGPCCHIRPFDREEEAVELANSLPYGLAATIWTENTSRAHRVAGQLEAGIVWVNSWFLRDLRTAFGGSKQSGIGREGGVHSLEFYTELKNICVKL

SEQ ID NO: 77281 - protein, 223 aa, Pseudoalteromonas tunicata D2
MSKFLIAPSILSADFARLGQDVEAVLAAGADVVHFDVMDNHYVPNLTIGPMVCQALRNYGITAPIDVHLMVKPVDSLIPMFADAGASIITFHPEASEHVDRTLQLIKDHGCQAGLVLNPATSLSYLEHVMDRLDVILLMSVNPGFGGQSFIPHTLEKLRQVKALINASGRNIRLEVDGGVNVDNIKEIAEAGADMFVAGSAIFNQPDYKGVIDQMRAQLALVK

SEQ ID NO: 77282 - protein, 397 aa, Burkholderia mallei ATCC 23344
MNTAADSLLRLASRVDAIEPFYVMEIVKEAAVLERAGRDIIHMSIGEPDFTAPEPVVDAAAAALRRGVTQYTSALGIAPLREAIAAHYARAHGLSIAPERIVVTAGASAALLLACLALVGRDDEVLMPDPSYPCNRHFVATAEGRAVLVPSGPETRFQLTADDVKTRWGERTRGVLLASPSNPTGTSLEPAELGRIIDAVRARGGFSIVDEIYQGLSYDGAPVSALSFGDDVVTVNSFSKYFNMTGWRLGWLVVPPALVGTFEKLAQNLFICPSALAQHAALACFEPDTLAIYEARRAEFRRRRDFIVPAIESLGFKVPVMPDGAFYVYAQCGGVAHPAAGDSAALVNAMLHDAGVVLVPGMDFGVHAPRDYIRLSYATAYSRLEEAVERLGKLFGR

SEQ ID NO: 77283 - protein, 455 aa, marine gamma proteobacterium HTCC2080
MNATLDTATLKRLDQDHHFHPFTDFNDYAQNGGRIISRAEHIYIYDSDGHQIQDGMSGLWCCNLGYSMDAIKEAVAAQLHELPFYNNFFRCSNQPAVELASKLVEVTPDGFNHAFFTNSGSEANDTQLKLVHRYFDILGKPNKKHIISRKNAYHGSTIAASSLGGMSAMHDQTMGLNYIHHIDQPHWFERGGDLDEASFGIQAARELEAKIDELGEENVAAFIAEPVQGAGGVIIPPETYWPEIKRILDERDILFISDEVICGFGRTGRWFGCETYGMEPDLITFAKAVTNGFMPLGGSMINDKMADVLLSGGGEFAHGLTYSGHPASCAAGLATLDIYQNTGIIEKTATDLAPHFGMRVKELESHALVGQVRVLGMFAAAELVRDKSSRERLAPESAGAVYCRDRAIEDGLMVRQTGDAMIMAPPFVTTPAEIDTLFEKLTAALDKTAGHYSVT

SEQ ID NO: 77284 - protein, 544 aa, marine gamma proteobacterium HTCC2080
MLEDKPASLYSPPAREQALGALANATLDTLVVGAGINGAVAAAALAGCGAKVGVVDRGDFAGGVSSHSSNLAWGGIKYLESGEWRLVRKLCRSRNRLMDAYPSTVREIRFFTSIGKGFRMWSVFVWLGALLYWFMGSCRMAAPRYLTTGKIRQEAPVVAAEGVVGGLEYSDCYLYDNDSRFVFNFVRRAVDAGGLAANYLAVEGLEWLPDQSCWRATLRDRVTDRLMSLNAKSIVNATGPNTELLNESIGVATEHRHILSKGIHLIVDRVTDAAKVLTFFASDGRLFFVIPMGPKTCIGTTDTPVDDPSVGVTAADRDFVLANANALLNLPKPLTSEDVIAERVGVRPLAVAGDVAGRDWVQLSREHQVEVDSERAFLSVFGGKLTDCLNVGDELVSMIADLGVDIPNPNARWFGESGSGCRAKFMARAAAMELDKLTPDSASEPLSVRFWRRYDRAAFDLLDDIAADLTEAEHVLTGAEYTRAELRLIARREWIVDLSDFMRRRSKVSQVVRHEALLKDPGLEELASLLVGVSAAQQVAAFRG

SEQ ID NO: 77285 - protein, 260 aa, Oryza sativa Indica Group
MSAAATAGTYSPASAAGEKRRERKEELRRHLAEDADWPRADGRSFHDCRPAFMQTGPTTAASGSAYAEFGKTKVIVSVFGPRESKKAMLYSDTGRLNCNVSYTTFATPMRGQGTDNKEYSAMLHKALEGAVMLHTFPKTTVDVFALVLESGGSDLPIIISCASLALADAGIMMYDLVTSVSVSCFGKNIIIDPTSDEEAWQDGSLMVAYMPARKEITQLTLTGEWSDGKITNAVELCMDACSKLCDILREHLKDASSLAE

SEQ ID NO: 77286 - protein, 236 aa, Arabidopsis thaliana
MPSGAKKRKALKKKKQQEAIGTSINGNDEHGSQDGRGSDSSLSSPGSQGNQEFGTKDSSALLSSAVVKGASKEISRDAGVTQGLGPKTGNAIVEKSTNSSSDNRTRPAKNVACGNSVTEITPVVDSVKPVVSISKTVTSEKSGLVETSTHSNLVKKKSEKDEEYHPSPVLENNNSKVVMLPRSAPETSKKVESVRKSEVPVSPEEKPLLLPGPPVVRRTSWLSCCGLFDAMTGSDR

SEQ ID NO: 77287 - protein, 97 aa, Zea mays
MASRSFLIRSPKEEESNAAVREAVLLGAKNGAIAGTVVAVPTLVGCRVLPWAKANLNYTAQALIISAACISGFFITADKTILRNARQNTIGKLDKST

SEQ ID NO: 77288 - protein, 438 aa, Bradyrhizobium japonicum USDA 110
MRIAMIGTGYVGLVSGACFADFGHDVTCVDKDEKKIAALHRGEIPIYEPGLDELVATNVKAKRLDFTTDLSKPVADADAVFIAVGTPSRRGDGHADLSYVYAAAKEIAQSLSGFTVVVTKSTVPVGTGDEVERIIRETNPNADVVVASNPEFLREGAAIRDFKFPDRVVVGTSDERARKVMGDIYRPLSLNQAPLMFTARRTAEMIKYAANAFLATKITFINEIADLSEKVGANVQEVARGIGLDNRIGTKFLHAGPGFGGSCFPKDTKALIKIAQDYDVSLRIVESVLAVNENRKRAMARKVSQALGGSLRGKTIAVLGLTFKPDTDDMRDAPSIPLVTGLIDMGAKVKAFDPVGMEQAKSELPSITYCEDAYSCAQGADALVVVTEWVQFRGLDLDRLKSVMAQPVVVDLRNIYSPEDMRAAGFTYESVGRPSAQG

SEQ ID NO: 77289 - protein, 391 aa, Vitis vinifera
  misc_feature (37)..(37): Xaa can be any naturally occurring amino acid
  misc_feature (318)..(318): Xaa can be any naturally occurring amino acid
MSMKSAQSSYRDRTQEFLNVAERLKKSFSSAAPNAVXSSGAKPDGTRSSLAIQKEFKDRASRIGYGIHQTSQKLAKLAKLAKRTSVFDDPTMEIQELTAVVKQDITALNAAVVDLQLLCNSQNESGNISSDTTSHSTTVVDDLKNRLMSATKEFKDVLTMRTENLKVHENRRQLFSSTASKESTNPFVRQRPLAAKSTATASSSPPPWANESSSSSPLFPRKQGNVESQPLLQQQQQQQQLVPLQDSYMQSRAEALQNVESTIHELSNIFTQLATMVSQQGELAIRIDENMEDTLANVEGAQGQLVRTIYPSVPPSFXLDMSWASPLKQRCYLKLLCYPTALEIWNALNQIYSAMSRARLTEIRVKIQNLRKGGIVGIPPWMIRGTHFYPD

SEQ ID NO: 77290 - protein, 275 aa, Brassica napus
EKATDSFNKNRVLGQGGQGTVYKGMLVDGRIVAVKRSKVLDEDKVEEFINEVSVLSQINHRNVVKLMGCCLETEVPILVYEHIPNGDLFKRLHDDSDDYIMTWEVRLRMAGEIAGALAYLHSAASTPVYHRDIKTINILLDEKYRAKVSDFGTSRSINIDQTHLTTLVAGTFGYLDPEYFQTSQFTNKSDVYSFGVVLVELITGEKSFSVMRSEENRGLASHFNEAMKQNRALDIVDSRIKEECKQEQVLAVAKLARRCLSLKGKKRPSMREDFT

SEQ ID NO: 77291 - protein, 152 aa, Arabidopsis thaliana
MSTKKIMLKSSEGKTFEIEEETARQCQTIAHMIEAECTDNVILVLKMTSEILEMVIEYCNKHHVDAANPCSDDDLEKWDKEFMEKDKSTIFALTNAANFLNNKSLLHLAGQTVADMIKGNTPKQMREFFNIENDLTPEEEAAIRRENKWAFE

SEQ ID NO: 77292 - protein, 494 aa, Wolbachia endosymbiont strain TRS of Brugia malayi
MNIALKYRPGSFKDLVGQDILVRILENAFTLNRIPQSILLSGASGVGKTTTARIIALCLNCSLGPTFEPCGSCKNCLTIKNSSHPDVIEIDAASHTSVDDIKVILGDICYSPISSKFKVYIIDEVHMLSSSAFNALLKTLEEPPPSVKFILATTEIKKIPITIIARCQRFDLYNIPVAKIVERLNDIAQRESYFIEKEASELIARHSGNSMRNALFLMNQAVLYNKGGVISTKSVMDILGLVDKDIIFDLMEAILGSDLQKALSLFDKAVETANPLSIFEGLLQTIQLICRFLVTKEIDSSVTECEKNRIKDLGVKKSLIFFSRLWRMLLKGVQDIKASTCSDVAAEMILISLCYLSDLPSPEQVVKKVLAQSTQQRNTRSAENIQQKSYDFDKILQLLQQNNQIYLYKQLCSNLQLVNCKPGYLKLKAVSQLDSNFCNDLKNYLSQITQQEWVITIDAGYIKKGASSLSYAPAVKGILDTFKGAKVVNIENKE

SEQ ID NO: 77293 - protein, 255 aa, Vitis vinifera
MDRYQRVEKPRTETPINENEIRITTQGRMRNYITYATTLLQEKGSNEIVLKAMGRAINKTVMISELIKRRIVGLHQNTSIGSTDITDMWEPLEDGLLPLETTRHVSMITITLSKKELDTSSTGYQPPIPVDQVKPLNELEYEGDSPGMRGRGRGRGRGRGRGNYNGVGGEYNNGDGWDGGRGFGGRGRGRGRGRGFRGRGRGYGGGDMQYESGGYYDYGDSEVPAQGRGRGRSRGRGRGRGRNFRTEGPPQAIAA

SEQ ID NO: 77294 - protein, 446 aa, Chromobacterium violaceum ATCC 12472
MNHPLTTRSEFDHLDLRAHWMPFSANRNFQRDPRLIVSGEGNYLTDADGRRIFDSLSGLWCCGAGHSRKEIAEAAYRQLSTLDYSPGFQFGHPLSFRLAERVAAMAPGALNHVFFTNSGSECADTAVKMARAYWRLKGQASKTKLIGRARGYHGVNIAGTSLGGMNGNRKLFGPLMDADHLPHTLLPANAFSRGLPEQGAELADDLLRLIELHDASNIAAVIVEPMAGSAGVIVPPQGYLQRLREICTQHGILLIFDEVITGFGRTGSLFGADHFGVTPDIMNLAKQLTNGAVPMGAVVASSEIYDAFMAQATPEYAVEFAHGYTYSAHPVACAAALAALDVLEQENLVARAAELAPHFERGIHGLKGLPHVIDIRNCGLAGAVQIAPSGGDAIVRPYEAAMALWRKGFYVRYGGDALQFGPPFTATPQELDSLFDAVGETLAKLA

SEQ ID NO: 77295 - protein, 497 aa, Chromobacterium violaceum ATCC 12472
MTTLQHLIHGEACDGGSRRAPVFNPSTGEAIAEVQLADAATVAQAVAAAQAAFPAWRDTPPAKRAQVLFRFKQLLEQHEAEIVPLISREHGKTLEDAAGELKRGIENVEYACAAPELLKGEYSRNAGPAIDAWSDFQPLGVVAGITPFNFPAMVPLWMYPLAIACGNTFILKPSERDPSSTLLIARLLHEAGLPRGVLNVVHGDKEAVDALLAAPEVKAVSFVGSTPIAEYIYAEGSRRGKRVQALGGAKNHAVVLPDADLDNTVSALMGAAYGSCGERCMAISVAVCVGDQAADALIAKLTPQIQALKVGPGTSPGLDMGPLVTRAHLDKVSGYIADGVAAGAELVVDGRGITVPGHEGGFFLGGCLFDRVRPDMRIYKEEIFGPVLCVVRVNSLEEAIALINAHEYGNGTCIFTRDGEAARLFADTVEVGMVGINVPLPVPVAYHSFGGWKRSLFGDLHAYGPDGVRFYTRRKAVTQRWPQRASHEASQFAFPSL

SEQ ID NO: 77296 - protein, 149 aa, Isochrysis galbana
VTQLVMPYVMLGFLQATGTDGPGVDRAWRLCMIVPASLHVIASVLIILGRDLPDGNYRELETSGAKQKSQGAKAVMIGFTNINAWILTITYGFCFGVELTMNNKAVLYFYRYYGVTPQIAGVLGSCFGLMNLFARSWGGMLSDMLNAKF

SEQ ID NO: 77297 - protein, 452 aa, Burkholderia vietnamiensis G4
MTDTISASQHEDTNLRTDAAWLDAHWMPFTANRQFKSDPRMIVSAKDAYYTDAEGRKIFDGLSGLWCTGLGHGRTEITEAVSRQIAQLDYAPAFQFGHPKSFELANKIKELTPAGLDYVFFTGSGSEAADTSLKMARAYWRAKGKGTKTRLIGREKGYHGVNFGGISVGGIGANRKLFGQGIDADFLPHTQLAENKFSRGMPDNGADLADRLLDLITLHDASNIAAVIVEPFSGSAGVVIPPKGYLKRLRDICTAHDILLIFDEVITGFGRSGAMTGADAFGVTPDIMNFAKQVTNGTQPLGGVIATKEIYDTFMAAGGPDYMLEFPHGYTYSAHPVACAAGVAALDLLVKEDAVARVRDLAPHFEAAVHGLKGQRHIADIRNYGLAAGLTIAALPGEPARRPYEIAMRCWAKGFYVRYGGDTIQLAPPFIAEKREIDNLVNALSDALNEVD

SEQ ID NO: 77298 - protein, 505 aa, Burkholderia vietnamiensis G4
MKHDSNVTSTLGHLIDGKRVDGGSRMQPVFDPATGESHKSVALADQLTVGAAIASAQAAFPAWRNTPPLKRARVMSRFKTLLEEHADELCALITAEHGKVLADAMGELQRGIENVEYASYVPELLKGEHSKNVGPAIDSWSEFQALGVVAGITPFNFPVMVPLWMWPMAVACGNTFVLKPSERTPSSTLRMAELALEAGLPPGVLNVVNGDKEAVDTILTDARVKAVSFVGSTPIAEYIYSTGCANGKRVQALGGAKNFAVVMPDADIDNAVNALMGAAYGSCGERCMAIPLVVAIGDETGDRIVAGLKAEIEKMKVGPGNGAGVDMGPLVTKQHFDKVTGFVDAGVAAGATLVVDGRGVKVDGHDGGYYLGPCLFDHVKPGMPIYQHEIFGPVLGVIRLNSLDEAMALIDAHEYGNGTCLFTRDGEAARYFSDNIQIGMVGINVPLPVPVAYHSFGGWKRSLFGDLHAYGPDAVRFYTKRKTITQRWPSAGVREGTVFSFPSNR

SEQ ID NO: 77299 - protein, 223 aa, Triticum aestivum
VTSLEQVCTKKQAGTGPEFPGYRRPTRPGKGASCLDRPLLPSPRAPPSPSSSSIPMQQRRGRPSGTDGSDFSYRMVVDSRYQRVADGRSRLARLMLVQTLHQVAGGALLLLSLSKGTEINKFAVLSLAAGLLAILLGEFGRRRTVAVFLRLYTSLSSIAIAFSVTCIIRSDLFVKITKQNTADITSYEMFDVVRVALGVLLQLVVIATTTRLLQNMSPPKRTS

SEQ ID NO: 77300 - protein, 265 aa, Rhodococcus sp. RHA1
MMDIPPLGLGTWPLTGPDATRAVLSGIEAGYRLIDTATIYDNEDAVGVALAECGVPREELFVTTKLRGSDHVSGDIRGAVERSLKNLGLDRLDLFLIHWPLPRHNRYVAAFEAMLACRDAGLVRHVGVSNFLETHLRRVVAETGESPAVNQIQMDPSLARLPVRRADDELGVSTQSWSPLGRGEVLGSPVVTDIARRLDRTPAQVVLAWHFAQGVVPVARSANPARQAENLAALDVRLTAADVDALNRLDRGESAARDVETEEHY

SEQ ID NO: 77301 - protein, 441 aa, Lentisphaera araneosa HTCC2155
MNLSDLQKRDLKHLWHPCAQMKDYESFPPMEIVSAKGSLLQTANDGEMIDIISSWWCKSLGHGHEDIQQSVKNQMDKFEHVILANTSNELIVNLCEKMIALNPAYDKVFFADSGSDGVEVAVKMSLQYQQQNGQEQRKKFMSLQNAYHGETILTLALGDCGLYSAPYAALMPEVKKILDVPYVTGRVEDLEEEDFSELLKPLEEYEDELAGIVIEPVLQGAGGMLFYHPSFIKALREWTSERGVHLIADEILTGIGRLGKARACEFANVVPDFSVFSKSMTAGFTPMSCVLTTNEIFDGFYDEYESGRAFMHSNTYTGNAISAAAAVAAIDYYEREQVFARVAKDSAYMHQLFEDVAKDTGALLNVRSCGFVAAADLDVSLKGLDKKRCGYSLYKKAVKKGLLLRPLGDTVYFLPPLNTSNELLAKSADIMKELIFEELRS

SEQ ID NO: 77302 - protein, 401 aa, Wolbachia endosymbiont strain TRS of Brugia malayi
MSTSAIFFSEGSYIVIMNNIIVKKFGGTSLTDLTRVANLIKKDVDKGYRIIVVVSAIAGLTDQMVFQARQTLNLSHKQALSEYDVMLSAGEQISCGLLAITLLSIGVNAKSWLAWQLPIITDNSYSESKIKTIKIDHLKRSFAEGYTVAIIAGFQGIYDDRITTFGRGGSDISAVALAVAFGVRVCEIFTDIDGIYTADPKIVPKARKLKSISYDEMLEMSSSGAKILHNRSVQLAMKHNIKVQVLSTFKEVEGTAVLHENDVLERHTITGITYSTNEALITFTNFANTLRTLKDMAGANIKIDMIHGSSIVISEFDIDLMKELLNKNEDYVINNNAAKISIIGIGVMSVMYHTLKFFSEKKIEILAITASEIKISIIVQRECAEALVRDLHTELMCTEGG

SEQ ID NO: 77303 - protein, 314 aa, Lentisphaera araneosa HTCC2155
MKKRILITGISGQIGTNLAYNLIDKGFEIFGIDKRQNTWTNDLTTVHQDLSSRYDNFTDGLGCLDYGKVDLVIHLAANAKVHELVEYPTRALDNFMMTFNMIEYCRNNNIPIIYSSTREVYGDIQRYITNEADASFHTTESPYSASKISGEAFLYSYSKCYGLPYICYRFSNVYGRYDNDIERMERVIPLFYEKIKNGEPITIYGEDKVLDFTYVDDCVAGISSGVDKILTGEVQNKTFNLAHGSGNPLRTVADVFQEELGVKADLSFEPSRVGEVTHYVADISSAKKYLGYEPQTDLVNGLRKAAAWYASQSK

SEQ ID NO: 77304 - protein, 362 aa, Burkholderia mallei ATCC 23344
MGTVQCAHGGYNAFLRINRYIMIATRILRRPRVLIVGCGDVGMRCAAQLRARRENLRILALTSRRSRCVELRAAGVVPVVGDLDARATLKRIARVAPVVLHLAPPQATGDVDRRTQALVAALASPRRPSRQLAPAYGRLRAWRTAARSARPPFQASAIVPDALPRPVVVYASTSGVYGDCGGARVDETRAVRPANPRARRRVSAERQLRRATARGALSARIVRIPGIYAANRLPLARLEKGTPALVEADDVYTNHIHADDLASILLRAAVRGKPARVVHASDDTELKMGDYFERVARAFGLRRPPRIARAEAERQLEPMLLSFMRESRRLANARMKRELRIALRYPSVDDFLRTVSAPRPLK

SEQ ID NO: 77305 - protein, 141 aa, Oryza sativa
MKPPMAASPASTAAAVVNAPAATGGLLLPRGRSSWSWSCCNNNNSSMGRRWRAAAVGEVAAEGNTYLIAGAVAVALVGTAFPILFSRKDTCPECDGAGFVRKGGATLRANAARKDLPQIVCPNCNGLGKLGQIDNCQLLII

SEQ ID NO: 77306 - protein, 666 aa, Triticum urartu
MPRTVSDGGEDFDGDVSSQTGSHRHTDSNSTHHHHHHGYKVGFPPAKGLLAEFADGVKQTFFADDPLREYKDQPRSKKLWLSLVHLFPVLDWARSYSFGKFKGDFVAGLTIASLCIPQGHRLCQACLPASTCWTVDSSFVPPLVYAMMGSSRDIAIGPVAVVSLLLGTLLQEEIDPVKNPYEYSRLAFTATFFAGITQAMLGFFRLGFIIEFLSHAAIVGFMAGAAVTIALQQLKGFLGIKKFTKKSDIISVMESVWGNVHHGWNYQTILIGASFLAFLLTTKYIAKKNKKLFWVSAIAPLISVVISTFCVFITHADKQGVAIVKDIKQGINPPSFHLIYWSGPYLAKGFRIGVVAGMVALTEAIAIGRTFAAMKDYQIDGNKEMVALGTMNIVGSMTSCYVATGSFLRSAVNYMAGCKTAVSNVVMAIVVMLTLLLITPLFKYTPNAILASIIINAVVSLVDYETAYLIWKVDKMDFVALLGAFFGVVFASVEYGLLIAVVAISLGKILLQVTRPRTALLGNLPRTTIYRNVEQYPEATKVPGVMIVRVDSAIYFTNSNYVKERILRWLRDEEEQQQEQKLSKTEFLIVELSPVTDIDTSGIHALEELLKALEKRKIQLILANPGPAVIQKLRSAKFTDLIGDDKIFLSVSDAVKKFAPKSALNV

SEQ ID NO: 77307 - protein, 188 aa, Lentisphaera araneosa HTCC2155
MNIANKITVSRFGLTLVFVVLAQFDSNAFFRWAALLVAITAALSDFLDGYLARKHKLITDFGKLMDPLADKILVAAAFFVLCKKSVIPDWFAIIIVTREFAVTGLRQIAASKNIIIQADKFGKIKTVLQFTYLGIIALFWTIKGNTQVIHNKNLSTFINILMLVTAYITLTSGYRYFTNNKNLFNKNI

SEQ ID NO: 77308 - protein, 448 aa, Streptococcus pneumoniae TIGR4
MREYDIIAIGGGSGGIATMNRAGEHGAKAAVIEEKKLGGTCVNVGCVPKKIMWYGAQIAETFHQFGEDYGFKTTDLNFDFATLRRNREAYIDRARSSYDGSFKRNGVDLIEGHAEFVDSHTVSVNGELIRAKHIVIATGAHPSIPNIPGAELGGSSDDVFAWEELPESIAILGAGYIAVELAGVLHTFGVKTDLFVRRDRPLRGFDSYIVEGLVKEMERTNLPLHTHKVPVKLEKTTDGITIHFEDGTSHTASQVIWATGRRPNVKGLQLEKAGVTLNERGFIQVDEYQNTVVEGIYALGDVTGEKELTPVAIKAGRTLSERLFNGKTTAKMDYSTIPTVVFSHPAIGTVGLTEEQAIKEYGQDQIKVYKSSFASMYSACTCNRQESRFKLITAGSEEKVVGLHGIGYGVDEMIQGFAVAIKMGATKADFDATVAIHPTASEEFVTMR

SEQ ID NO: 77309 - protein, 655 aa, Triticum urartu
MPRTILDGGEDFNGNISRTRSHHQTDDHGYKVRFPPAKGLFTELAEGVKETFFPDDPLREYKDQPRSKKLWFGLVHLFPVLDWARSYTFGMFKGDFIAGLTIASLCIPQDIGYAQLAFLPAHVGLYSSFVPPLIYAAMGTSRDIAIGPAAVLSLLLGTLLQEEINPVKNPHEYSRLAFTATFFAGITQAMLGFFRLGFIIEFLSHAAIVGFMAGAAITIGLQQLKGFLGIAKFTKKSDIISVMESVWGNVHHGCNWQTILIGASFLAFLLTTKYIAKKNKKLFWVSAIAPLISVIISTFCVFITRADKQGVAIVKDIKQGINPPSFHLIYWTGPYLVKGFRIGVVAGMVGLTEAIAIGRTFAAMKDYQIDGNKEMLALGTMNIVGSMTSCYVGTGSMSRSAVNYMAGCKTAVSNVVMAIVVMLTLLLITPLFKYTPNAILASIIINAVVSLVDYEAAYLIWKVDKMDFMALLGAFFGVVFASVEYGLLIAVAISLGKILLQVTRPRTALLGNLPRTTIYTNVEQYPEASKVPGVMIVRVDSAIYFTNSNYVKERILRWLRDEEEQQQEQKLSKTEFLIVELSPVTDIDTGGIHALEELLKALEKRKIQLILANPGSAVIQKLQSAKFTKLIGDDKIFLSVGDAVKKFAPKSALNV

SEQ ID NO: 77310 - protein, 164 aa, Zea mays
  misc_feature (14)..(14): Xaa can be any naturally occurring amino acid
  misc_feature (27)..(27): Xaa can be any naturally occurring amino acid
  misc_feature (44)..(44): Xaa can be any naturally occurring amino acid
  misc_feature (51)..(51): Xaa can be any naturally occurring amino acid
  misc_feature (58)..(58): Xaa can be any naturally occurring amino acid
  misc_feature (76)..(76): Xaa can be any naturally occurring amino acid
VRVAARGGGGAFGXAHRAAAFPVGVAXFLKPAVAGFLLRMGLDXLVGAVAXPEPWGGXGGSLVSRSIGVLVSLLAXVDVLLLGGGLIYPFCWARGCSVGCSLVGEGRLGLAPSLLGVAWAVGVSLLLPAGFVVAGRFAADAGSAIGPGPAVPGGWVGLGVGPGA

SEQ ID NO: 77311 - protein, 438 aa, Psychrobacter arcticus 273-4
MYAEETNNVTAIKDIRAREILDSRGNPTIEADVILADGTIGRAAAPSGASTGSREALELRDGDKSRYMGKGVKKAVANVNSQIRSALMDKNVTAQQAIDDAMIALDGTDNKDNLGANAILAVSLAVAKAAAKSQSLPLHQYIADLRNQTSLTMPVPMMNIINGGEHADNTVDIQEFMIEPVGFSSFSEALRAGTEIFHSLKSVLKSQGLNTAVGDEGGFAPNLRSNEEAITVIMQAIEQVGYTAGKDIHLALDCAATEFYKDGKYILAGEGNKSFDSQGFSDYLVGLARQYPIISIEDGLDESDWDGWKYLTEQIGDKVQLVGDDLFVTNPAILQEGIDKHIANAILIKFNQIGTLSETLDAIYLAKKNGYATIISHRSGETEDSTIADLAVGTAAGQIKTGSLCRSDRVAKYNQLLRIEQQVRASYRGREEFIGLRG

SEQ ID NO: 77312 - protein, 425 aa, Myxococcus xanthus DK 1622
MALIVQKYGGTSVGDVARIKSVALRCLAAQEAGHDVVVVVSAMSGETNRLMKLVAQITDRPDEREQDVVVATGEQVSIGLLAMAIHAQQGKATSFLGQQVRIVTDSTFAKARIKSIDAQPIRAALARGHIVVVAGFQGVDESGSVTTLGRGGSDTTAVALAAALNADACEIYTDVDGVYTSDPNMVPSARKLDRITYEEMLELASVGAKVLQIRSVEFAMKYKVPLWVKSSFTDDPGTLVCEEDSSMEDVLVRGVAYDRNEAKITVCGVPDVAGAAAKIFGPLDEKHIVVDLIVQNPSKDGRTDVTFTVGKADFLTAQEVVRKVAEEIGASGIETDGDIAKVSIVGVGMRNHSGVAARMFRALSAEGINIQMISTSEIKVSCVVQAKYTELAVRALHTAFGLDQPMPPEGVSAVSEMAALMGEKV

SEQ ID NO: 77313 - protein, 378 aa, Burkholderia mallei ATCC 23344
MTLASTPDIIAELKAGRMVILVDEEDRENEGDLVLAAEFVTPEAINFMARYGRGLICLTLTQERCKQLNLPLMTYRNGTQYGTAFTVSIEAAEGVTTGISAADRARTIATAVAHDVRPEHIVQPGHVFPIMAQPGGVLVRAGHTEAGCDLTALAGLTPAAVICEIIKDDGTMARLPDLLEFGKEHGLKIGTIADLIHYRSRTESIVERVAERTMQTAHGPFKTVLYRDHPTGSPHIALVRGTPTPNDETPVRVHEPLSVLDLLETGVSTHSWTLDAAMKEIAARELGVIVLLNCGDTKEHLVDVFLAFDEKEKAAELKRRPVDFKTFGIGAQILRDVGVGRMQVLSNPRKLGSMSGYGLEVTGFAPMPGSAAPASGAA

SEQ ID NO: 77314 - protein, 264 aa, Sulfolobus solfataricus P2
MIVVKIGGRVVKNSLDKIILDILNINDKVILVHGGGDIVTDYTKRLGIEPVFVTSPEGIRSRYTTKEELEVYIMAMSLINKSITSKLCSLGKNAIGITGVDGGLLLAERKKRIVVIDERGKKRIIEGGYTGKVKEVRSEIINHLVKLFDIIVVSPIALDVEERTPLNIDGDQAAFAISKALRANVLILLSDVEGVLVEGKVINRLTPSEAKELSKKIGPGMNRKLLMAAESVENGVNKVIIGSGVKDRPIINALELNGTVIANG

SEQ ID NO: 77315 - protein, 482 aa, Glycine max
MTGSLAARLVLRRCRSPASQFFFRREASWPATERTTKDVVTSPPKELPAFDYSPPAYSGPSRDEIIAKRREYLSPSIFHNYKSPLNVVEGKRQYLFDDKGRRYLDAFGGIATVCCGHCHPDVVEAIVEQTKRLQHSTVLYLNHAITDFAEALAAKLPGNLKVAFFTNSGTEANELAILIAKLYTGSHDIISLRNSYHGNGGGTMGTTAQSIWKYNVVQSGVHHAVNPDPYRGLFGSDGEKYVRDVQEIINFGTSGNVAAFISEAIQGVGGIVELAPGYLPAAYDIVRKAGGLCIADEVQTGIARTGSHFWGFEAHGVVPDIVTIAKSIGNGIPLGAVVTTPEIAKALTRRSYFNTFGGNPVCTAAGLAVLRVIEKEKLQENAFVVGSYLKERLNALKDKYELIGDVRGRGMMLGVELVSDGKLKTPAQSETLHVMDQMKELGVLIGKGGYYGNVFRITPPLCFTKEDADFLVDAMDYTFSRM

SEQ ID NO: 77316 - protein, 391 aa, Wolbachia endosymbiont of Drosophila melanogaster
MTISPILPVYSPVNINFSHGKGIYLYDVDGERYVDFHSGIAVSSLGHTNSRLISALKLQGEKLWHISNTYNIPAANNFAEKLINNSFADTVFFSNSGSEAVECGLKIARIYQNGKGNKNRHRILTFHGAFHGRTFLTCATNDKQKFSELLNPYIDWCDNIEPNIESVKKAISSGIGVILIEPIQGQGGIKVMNEVFMKELRRLCDENDILLFFDCVQCGAGRTGKLFAYEHIGVEPDICALAKGIGGGFPLGACLATENAAKYMAVGMHGSTFGGNPLATSVGNAVLEELLSPGFLKNVEIRGKYLKNKLEDLASKFPIIEEVRGKGLMLGIKVKADNQKFAEELSHRGLLTVGVTSDNVVRILPPLIITEKEIDEGIEILTQYLSEKSSD

SEQ ID NO: 77317 - protein, 366 aa, Oryza sativa
PTQRRILRGRGARGESGERHDAGSARPARQRGPPSIQTKPPLRISSGPSFLPQPIMLETGQEFTFTIKRGVGTETCVSVNYDDFVNDVEVGDMLLVDGGMMSLLVKSKTEDSVKCEVIDGGELKSRRHLNVRGKSATLPSITDKDWDDIKFGVENQVDYYAVSFVKDAQVVHELKDYLRSSNADIHVIVKIESADSIPNLHSIITASDGAMVARGDLGAELPIEEVPLLQEEIIRMCRSMGKAVIVATNMLESMIVHPTPTRAEVSDIAIAVRDGFMAILLSHYRPSGTIFAFTDQERVRQRLALYQGVCPVQMEFSDDAEKTFGDALSYLLKHGMVKEGEEVALVQSGRQPIWRSQSTHNIVRKV

SEQ ID NO: 77318 - protein, 453 aa, marine gamma proteobacterium HTCC2080
MTSEAFDFDLFVIGAGSGGVRAARVAASLGARVAIAEDRYMGGTCVNVGCVPKKLYVYASEFSKGFTDSAGFGWQGDAPTFDWPTLRDRKKAEISRLNAIYERLLEAPGATIISGRAQLSDPHTVTIEGQTFRAEKILIATGTWPYLPDLPGKQHMLTSNEIFDLEHFPKRLLIVGGGYIATEFAGIFNGLGAEVVQAYRGDLFMRGFDDDVRRFLAQEVRKTGVDLRFNTNPKSIDTSTNGYRVVFEDDTEVEVDAILCATGRRPNIADLNLQCTSVALNENGFIAVNDEFQTAEASVYALGDLIGGEQLTPVALAEGMAFAHREFGSGGHEVDYDFIPTAVFSQPNVGTVGYTEEEARQSFGRLDIYRSEYRPMKHTLSGRDERSMMKLIVDQASQRVLGVHMVGPDAGEILQGMAIALRMGATKRDFDQTIGIHPTAAEELVTLRDVDSD

SEQ ID NO: 77319 - protein, 413 aa, Pseudoalteromonas tunicata D2
MSDFREQALKYHAEPVPGKISIELTKPAETAKDLALAYSPGVAEPVREIAANPADAYKYTAKGNLVAVISNGTAILGLGNLGPLASKPVMEGKALLFKRFAGIDSIDIEVKHRTTEDFINTVENIADTFGGINLEDIKAPECFEIEKALIERCDIPVFHDDQHGTAIVTAAGMLNALEVQGKNLHDAQIVCLGAGAAAIACMELLIKCGAQREHIYMLDRKGVIHTRRDDLNEYKELFANNTDKRTLQDVITDADVFVGVSGPNLISADDLKLMADKPVVFACSNPDPEIHPDEANAARTDLIMATGRSDYPNQVNNVLCFPFIFRGALDVRAKRINDEMKIAAVNAIRQIAKEPVPAEVLQAAGVDSLEFGAHYIIPKPMDPRLLPRVALAVAQAAVASGVARIPLPENYMQ

SEQ ID NO: 77320 - protein, 400 aa, Haloarcula marismortui [sequence omitted]

SEQ ID NO: 77321 - protein, 457 aa, Prochlorococcus marinus str. MIT 9313
MVLHSVLSVLSSHDVEVAETLIGVLNFLLIFVAARTLAELLVRLHLPTIVGELLAGVLIGASGLHLLVPPSTHSHLNEGLVSLISALASIPPEAVPDLYYETFPSLQAVATLGLYALLFLTGLESELEELVAVGVQAFTVAMAGVVLPFALGTFGLMALFQVELIPAIFAGASMTATSIGITASVFGELGYLKTREGQIVIGAAVLDDILGIVILAVVVALATGGNLEIAPIVKLVVAATVFVVLAIVLSRTAAPAFDWVIDRLKAPGAVVVASFVILVLCCFIATAIGLEAALGAFAAGLILSSSKNNHAIQQSVLPIVTLFATIFFVLVGAGMDLSVINPLDPASRSALVVAGFLVVVAIVGKIAAGWAFWIDKPTNRLVVGLGMMPRGEVGLIFLGLGTSAGLLSPSLEAAVLLMVISTTFLAPLLLRLVLKDKTPGGGNSIPDDVAANPVGLV

SEQ ID NO: 77322 - protein, 245 aa, Oryza sativa Indica Group
MKAAASPLRAALLLFLSSSPSPRLALPMNPSSSSSSRGAASYHSKAAAFASPQPRGGGGGRGGRRGGGRGRGGDGSDRIDALGRLLTRILRHMASELNLEMRTDGYVRVRDLLKLNLQTFAKIPLKSHTVDEIKEAVRRDNKQRFGLLEEDGELLIRANQGHTVTTVTSESLLKPILSADEVSGMRQSVNILIYLDVSMALQDGMKLYISDNKVILTEGFDGVVPVKYFEKIETWPGRAPIPFEK

SEQ ID NO: 77323 - protein, 364 aa, Actinobacillus pleuropneumoniae serovar 1 str. 4074
MKFICNQCQQIAPVSTRQAKCQCGGLWTLDYQPPKFDLNEIDQYEWNLFRYRKFIALQDESWRDISLGEGMTPIVRFDENVLLKMDYFMPTLSFKDRGAAVLISHCKSIGVDSVVQDSGGNAGNSVAAYCAKAGIQCEIFVPEGTSPKKINMIEAHGAKANVIKGSRDHCADVCRAKVENEGVYYANHVYNPFFYEGTKTYIYETFEQLGRIPKHIVVPVGNGTLFIGVIKGLEHLLESGVIDEMPTIIALQSEYCDPLLQAVKKGQKFAEQVEIKPTIAEGIAIGQPMRASEILAYAEKYAIRFVHAPEDKILAARNALAKKGIYCEHTTAANYAAYLHYCELYGAVEDCLITICGAGLKSDH

SEQ ID NO: 77324 - protein, 179 aa, Actinobacillus pleuropneumoniae serovar 1 str. 4074
MNQLDLIKSSIKSIPDYPKAGIIFRDITSLLEVPEAFKATVDAIVAEFKDKGITKVVGTESRGFIFGAPVALALGVPFVLVRKPKKLPRAVISQSYALEYGEDTLEIHLDSVKENDNVLMVDDLLATGGTIDATAKLIRRLGGKVEHAAFVIWLPDLGGKERLEKEGINSFTLVEFAGH

SEQ ID NO: 77325 - protein, 522 aa, Oryza sativa Japonica Group
MPSAHPLPASSQATTAWATRTLTSTRSVGRTPTLSTPHAPGPYTSSTNAEAIATQPYPLTDKWATNLHPGPITSHRIATPNPNNNLIPDTRAEAEEEVGDRSIAIDRLSDWLIDRHAASAADEAGGGGGAAAADDAAGAAHAAAAGCGGGGGGAAAAGALVPPAPPAPGPPRGAAGGPISLPLSLLPFRSAIEPIVSGNLPPGFDSSTCRSVYVGNIHLQVTDSLLHEVFQSIGPVEGCKLIRKEKSSFGFVDYYDRRSAAIAIVSLNGRQLDARVMWDQKTGRSRGFGFVSFRNQQDAQNAINELNGKWLGNRQVRCNWATKGANAGEEKQNTDSKGMIELTNGSSEGGKDNANEDGPENNPQYTTVYVGNLPHDVNSNDVHRFFHSLGVGSIEEVRVTRDKGFGFVRYSTHEEAALAIQTGNGQLIGGRQIKCSWGSKPTPPGTASAPLPPPAPAPFNPGMSATDLLAYERTLALSKMAANPALMSQHAALKQAAAMGMGAGASQAIYDGGYQSANAVFY

SEQ ID NO: 77326 - protein, 481 aa, Ralstonia solanacearum GMI1000
MLPDPAQTGARAPASQPNPNVNLWQAHLHQTAQRARLARPVVTCGKLTRVAGLVMEAVGLKLPVGSACRVELPYGRHVLAEVVGFAEERAFLMPQTDLVGVVPGARVFPLEPQHLPLDTADPTIAHSKFLPVGPRLLGRVVDANGEPLDGKGPLGASEELAWGSLAPAPLNPLKRKPIERVLDVGVRAINGLLTVGQGQRLGLFAGSGVGKSVLLGMMARYTQADVVVVGLIGERGREVKEFIDEILGDEGLARSAVVAAPADNSPLMRLQGAAYAHTIAEYFRDRGCNVLLIVDSLTRYAMAQREIALAIGEPPATKGYPPSAFAKLPALVERAGNGMVDAAGRGGSITAFYTVLAEGDDQQDPIADAARAILDGHFVLSRKLAEQGHYPAIDIEQSISRVMSAIVPREQLDAARRFKQLYARYQRNRDLIAVGAYARGSDPVTDQAIARYPSMEGFLQQGMFENESRERTLEKMNAVLS

SEQ ID NO: 77327 - protein, 269 aa, Chlamydomonas reinhardtii
MMLKASPAARAAARPAARNVRMMAAPVSTQLSQDELKKQAAWKAVEYVKSGMVVGLGTGSTAAFAVDRIGQLLKEGKLQNIVGVPTSIRTYEQALSLGIPLATLDEQPKLDVAIDGADEVDPNLDVVKGRGGALLREKMVEMASAKFVCIVDDSKLVEGLGGSKLAMPVEIVQFCHKYTLQRLANLPEVKGCEAKLRMNGDKPYVTDNSNYIVDLYFQTPIKDSQAASKAILGLDGVVDHGLFLDMVDVCIIAGATGVTVQERPNPKKH

SEQ ID NO: 77328 - protein, 267 aa, Triticum aestivum
MDRYQRVEKPREEAPIGANEIRITAQGRTRNYITYALALLQEEATDEIVIKAMGRAINKTVAIVELLKRRIAGLHQNNSIESINITDTWEPLEEGLNVLETTRHVSLITITLSKKELDTSSPGYQLPIPADQVRPPTEFDQDAEDVPSGRGRGRGRRGRGRGRGGFSDGGADYDDENGDMEGPRGYRGRGRGRGRRGSFGPGRGYGGDGYGYVNEEAGGYHGMEHNGPPVQGYEGDGGRGRGRGRGRGRGRGGGRGRGPFPQGPPQE

SEQ ID NO: 77329 - protein, 2209 aa, Lactobacillus johnsonii NCC 533
MKKKREKYTWLLLSTALITSGQILGGGEQIIKASVESQTNSVKKSKTAVEHSTTALSRQAVEAQLAAQGVNFERLTPEEQQEVYVDVIVQLEALPASENGSIDSQTASRAEIEQASNKVIAAQSGIKDEVQKITNQAIDKSYGYVVNGFATKAKVGDIKKLREIKGVKSVTLAKVYFAADTSANNMANVSTVWSNYQYKGEGTVVSIIDTGIDPNHKDLRLSDESKVKLTAKDIDGFTENSGYGRYFTSKVPFGHNYSDNNDIITDDDPKEQHGMHVAGIVAANGTGKNSASSVVGVAPEAQLLAMKAFSNSDSSSTTDSTSVIGAVDDSAKLGADVLNMSLGSVSGEQTEDDPEIAAVEKAVKHGTAAVISAGNSGTSTSNQEGVNKDFYGNPDMETIGSPGTSRSATTVASAENTKVTTDGMTVSTADGKKIFGPSVTQLSPNTSHDAFDSKKFYIVKDASGKLGMGTPSQYTADVKGKVAVVSRGEITFTDKQKYAQAAGAAGLIIVNNAGGNTPLTSVLYNEGFPTAGLSTDDGNKLVAYVEAHPDELLRVNVEVQPLNNVIREEDLMSSFTSYGPVSDLSFKPDITAPGGNIWSLQNNNGYINMSGTSMASPFIAGSQALLVQAMNDKTGKFYETYQKMSGSERAALIKNIQMNTANIEVDVDHGSVIESPRRQGAGLVNVEAAINAILHNPSTVSGSNGYPGVELKDFQDRQHQFTIKFTNRTNKDIEYGLNENGKFSDVYTSETDPKTGVLFEKKIDGASLTPSEKIVVPANSTKEVTINLSLPDNFKENQYVEGFMAFTGSDNSHLKIPYMGFFGDWAAPAIFDGLNGLAFNPGNNNLGTIVTAGNKNGAVGYAGLNQDEDGNYRVDPDAIALSTADGASVSWVRPQYFLFRNANDVKAEILNQDGEVINTLVSLAHVTKSYWAASSQRYAKFNYAPAWDGTYFNQQTNKTEKVPDGTYTYRVTGTVDGTKKQQHYDIKVKVDSVKPEVKNLKLGSHKDQTGKVSYVLKAEAKDNFSGLNGQANTYVNGELNRSVAYDIVGSSSDGYQKIEVPLSDEQVKTLRAGKNDLAIAVFDNATNAGTNSGTSNKPGEINFGLIIDNNLPQKITTVSDGYDMTDDSYTISGTYPEKVYGTYTDKDGKEHDLNISYDEASERFVTKLPLSVSDYDTNVKFYADEEHETLITQKRINVSLVPPKLESLKVDDQETYTGNEEAKLSQTSEDTVEVSGKVSDDTDKVAVKVAGKTYSAKPTKEHTFKVKVPVSYGENTMNIVLTDKDGNSSSVKQIVKSSDRGKTVVSAKDVTFDNGIKFGTTSVNTETENYDPKTGKLTLTGKVNRPTTTVRIGDHTVKVKADGTFKLVLDLGKHGAKVFPVLIGDTTVNDTVQERLTFYVDSNNPELTLNQEKDQSGYVPVYTNKEEFKLQGTISDDYPYYSLLINDNNVDANWDDVDYNGNKNLKKSFSHSVKLKEGKNTFNVVVVDNNDNRSEVQTLVVYYKKAQKLASPQITATTASDKKSVTVTGKAKDGNVLYSTDNGNKYNVLPEDGVTVKNNGKLLFKTVDKYGNESEVVEYDVKTIGKEESTVDKSVAQARKDLRKKLDQARALGNTGKYTHESAKKLAQARQEASKALKDKNATLQELKQASEQLEEAIKNLVEKPVDQNKDKDKVEDKDSQVNALKEKLEETVKAGEKFDKDKYTDDSVEKVTKALDEAKVVLANKDANSTDVQDAIDSIVNATKSLKEKQVSPEKTTQQEDTPKENKDTEEVLAAKNALKEKADKLSHLDTTKYTSESAENLSNALKKVNQVLTNKDANKAQVQEALDSLSQAEKDLVEKTESNKDVETAKEQLREELNKHKDEDKSQYTDDSAKVKDNAEKISEGVLDSKDAQADEVNKAKDSLVEAEKGLVKKEENKPAESDTQEVDKAREALEQEVNKNANVNLDGYTPESQDKFKEILNGVRDVLNDKNASASSLEKAEKVLETATGVLTQVEHQVELPKVEQPVVTPEKKQTEQEEAKKSESSSVSTSKDEVKEPEEKKQDAHSVSDKGTGTSVEKKGQTPADALSQVEHQAELSKNEQEEAKKSESHSASTSKDEVKEPEEKKQDAESVSDKESSTLVGKKHQVARSAQESSKKNADNKVPTHKNSNKAQNTTNSSTRSTKSSNNKELPKTGERETFFGLLVTGITALFASLGTVLRIKNKK

SEQ ID NO: 77330 - protein, 216 aa, Legionella pneumophila str. Paris
MSELKIKAAKAAIAYIEDDMVIGVGTGSTVNFFIKELAAIKHKIEACVASSKATEALLRAEGIPVIDLNSVQDLPIYVDGADEVNERGEMIKGGGGALTREKIVANVATQFICIVDESKVVKRLGEFPVAVEVVPMARSFVARQIVKLGGDPEYREGFVTDNGNIILDVFNLNFSTPMALEDSLNVIPGVVENGVFAKRLADKVLVASASGVNNLK

SEQ ID NO: 77331 - protein, 442 aa, Pseudomonas syringae pv. tomato str. DC3000
MKVTVFGTGYVGLTQAACLAKVGHTVCCVDVDEKRIQALREGACPIFEPGLADLLQSGLACQRLQFTTNAAHASRFAELIFIAVGTPPLADGRADLSQVLAVMHTVLEHADGARIIVNKSTSPVGTVDRLLAEIAASPRCDDGFEVISNPEFFKEGSAVGDCLRPDRIIVGGASQSALELLRELYQPFSRNREKFVVMDARSAELTKYAANCLLATKISFINEMANLAEQVDADIEQVRLGIGSDPRIGYDFIYPGCGFGGSCFPKDLQALIGTAAEHGVETSLLSAVEQVNRRQKHRLFEKIRTHYQGELAGKVFAVWGLAFKPNTDDIREASSHALLEALWASGARIQAHDPQAMQAIRLHYGERDDLKLVDCKEHALEGADALVVVTEWQDYRVLNLDRLGTTLRDRVIFDGRNLFDPVQLREAGFVYHGIGRGQRINV

SEQ ID NO: 77332 - protein, 332 aa, Pseudomonas syringae pv. tomato str. DC3000
MTVLVTGAAGFIGFHVAKHLCEQGIEVVGIDNLNDYYSVELKHSRLAILERMPGFVFKRLDITDATGLSTLFEHNTFEQVIHLAAQAGVRYSMEQPDAYIQSNLVGFSNVLEACRQHRPSHLIYASSSSVYGANTRLPFRVEDAVDRPLSLYAATKRANELAAYSYCHLYGLRATGLRFFTVYGPWGRPDMALFKFTQAMLREEPVDIYNHGEMARDFTYIDDIVESILRLRLRPPEPAGGEPAHQLFNIGRGQPVKLLEFVDCLEKALGLKAQRRYLPLQAGDVLQTWADVTALARWIDFQPHVSVDSGVSAFVEWYREHYQSGPPPLSLQ

SEQ ID NO: 77333 - protein, 482 aa, Rhodococcus sp. RHA1
MPPSGGADRRQFYINGQWREAVDPELFTIAEAATERPLGVAAMGGPSEIDEAVLAARAALDNGPWGRSTPHERAETMRRFADSLERRGESTARLVSQQNGMIRPLSIISNAAAPVAVLRSMAELAEARTFETRRPSKKGHTIVRQEPVGVVGAIVAWNYPQLLAMAKIAPALAAGCTIVLKPAPETALDAYVLGEAAEDAGLPPGVLNIVAGGVRAGEALVAHPGVDKIAFTGSTAAGQAIGEAAGRSLKRVSLELGGKSAAVVLPDADLDVFARSLDDAVFKNGGQTCTTNSRILVPHGRSQEVLDVLAAYVDDLAMGDPLDDAVTLGPMVSDRHRERVRNYIRLGESEGFQLVRGGAEPPDGLTQGWFVSPTIFGGVDNNSRLAQEEIFGPVISVIPYGSEDEAVRIANDTVFGLGGVVFTEDHEHGLDIASRIRSGTMGINYFSMDMGSPFGGVKHSGIGREFGPEALDYYLEYRSIYV

SEQ ID NO: 77334 - protein, 467 aa, Pseudomonas aeruginosa UCBPP-PA14
MTHDTGLRRGLNARHIRFMALGSAIGTGLFYGSASAIQMAGPAVLLAYLVAGAAVYMVMRALGEMAVHEPVSGSFGHYASSYLGPLAGFVTGWTYAFEMIIVCLADVTAFGIYMGFWFPDVPRWIWVLSIVLFIGGLNLCHVKVFGELEFWLSLVKVGAIVAMILAGLGIMFFGFSLDGAATSATGVHNLWQHGGFLPNGWAGLVASLSVVVFAFGGIEIIGITAGEAQDPQRVIPRAINAVPLRILLFYVLTLFVLMAIFPWQQIGSNGSPFVQIFDGLGIESAAAILNVVVITAAISAINSDIFGAGRMLYGMARQGQAPVGFSRVSRHGVPWMTVLLMAVALLLGVALNYLIPQSVFLLIASIATFATVWVWLMILLAQVGMRRRMGPRQVAALKFPVPLWPFAPAAAIVFMLFIFVVLGYFPDTRPALWVGAIWIAVLVIAYRRWVRPKGDAAHGVLQAQGGL

SEQ ID NO: 77335 - protein, 396 aa, Myxococcus xanthus DK 1622
MKLAHRLQAIKPSPTLALNSRAKALVAKGVDVVVLAAGEPDFDTPDYVKQAAVDALRAGFTKYTPTNGIPELREAICAKLERDNGLRYTPDQVLVTSGGKQGLYNFCQAALEEGDEVIIFAPFWVSYPDMVRLAGATPVIVPTREEDGFAPDPDAIRRALTPRTRAVIINSPGNPTGAVYSRAALERIAEVLRPHDCLIVTDDIYEKLLYTDERLGISDVAPDLVPRLVVVNGMSKAYSMTGWRMGYVAGPKPLLAGMQMVQDQSTSNASSIGQKAALAALQGPPDTIAAMVKEYRERRDFFIAGLNALDGVRCRMPEGAFYAFADVRGLLGRSYKGKPVTSAMQLSEILLDDFRVAAVPGEPFGAEGYVRMSFVTSREVLQKGLARLGELVKALS

SEQ ID NO: 77336 - protein, 151 aa, Hypocrea lixii
MSTAARRRLMRDFKRMQTDPPAGVSASPIPDNVMTWNAVIIGPADTPFEDGTFRLVMQFEEQYPNKPPQVKFISQMFHPNVYANGELCLDILQNRWSPTYDVAAVLTSIQSLLNDPNTGSPANVEASNLYKDNRREYIKRVRETVERSWED

SEQ ID NO: 77337 - protein, 247 aa, Triticum aestivum
  misc_feature (50)..(50): Xaa can be any naturally occurring amino acid
MAAAVRVRVESTGVSLTRQSCSSHKGCAKKVIISAPSKDAPMFVCGVNEXGYKSDIDIVSNASCTTNCLAPLLRVINDRLGIVEGLMTTVHAMTATQKTVDGPSSKDWRGGRAASFNIIPSSTGTTKAVGKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYSTRVVDLIRHMHSSK

SEQ ID NO: 77338 - protein, 387 aa, Bacillus cereus E33L
MEQFINPRVKDIQISGIRQFSNMIQNYDNLISLTIGQPDFPTPSLVKEAAKRAITENYTSYTHNAGLLELRKAACNFVKDNYDLHYSPETETIVTIGASEAIDVAFRTILEPGTEVILPAPIYPGYEPIIRLCGATPIFIDVRETGFRLTAEALENAITEKTRCVVLPYPSNPTGVTLSKKELQDIADVLKDKNIFVLSDEIYSELVYEQTHTSIAHFPEMREKTIVINGLSKSHSMTGWRIGLLFAPSYLAGHILKVHQYNVTCATSIAQYAAIEALTAAKDAPKMMRHQYKKRRDYVYNRLIQMGLTVEKPTGAFYLFPYVGHLTSSSFDFALDLVEEAGLAVVPGTAFSEYGEGYLRLSYAYSIETLKEGCDRLEAFLQQKAKS

SEQ ID NO: 77339 - protein, 638 aa, Xanthomonas campestris pv. campestris str. ATCC 33913
MISLRNFSMRRGERLLLSNVDLTMHAGYRVGVVGRNGTGKSSLFAAVKGELEADKGDVDLPGKVRTASVSQETPSLPDPALSFVLGGDIEVSAILQKEAEATAREDWEAVANAHQTMAELGAYDAEARAGKLLHGLGFPADTHHRAVSSFSGGWRVRLNLARALMMPSDLLLLDEPTNHLDMDAVLWLEQWLLKYPGTLLLISHDREFLDNVATHTLHLHGGTAKLYVGGYTDFERQRIEHLRQQQIAHDKEQAERAHLQSFIDRFKAQASKATQAQSRMKRLAKMAGTEAVRAEREFRIQFAQPNRLPFSLIRLNHLDAGYAASPRESGIGDGESQKRGSSDAITVLHDVGFGLEAGDRIGLLGPNGAGKSTLVKTLVGELAPLSGERSAHPDLRIGYFAQHTVESLHEGQSPMDHFRDLSPDGSNQAFRDFLGKWNFAGDRAFEVVDGFSGGERARLALALIAWQQPNVLLLDEPTNHLDLEMREALAEALSDFEGAIVMVSHDRHLIGLVCDSFWRVADGVVEPFDGDLDEYAAWLRSRPAAQGTKQKMAEVAPTPPPPTKPLPPKKAVNPHRLASAEKRVGELEAALADLDRQLANPANYPDADKTAVLGRERETTAQQLAAAEAAWMELLDGA

SEQ ID NO: 77340 - protein, 411 aa, Pseudoalteromonas tunicata D2
MNVAALRQQFPALNQNYNGQTPIFFDGPGGSQVPQTVLEAMNAYLGFYNSNLGGAFFSSEKTVDLMLQARQAVADLLNSPSADQIVFGANMTSLTFSFSRAISRDWQVGDEIIVTNADHFSNVSSWQLAAEDKGVKVNTALINETDCTLDYDHFTSLLSDKTKLVAVTYASNTTGSINDIKRIVEAAHKVGALVYVDAVHFAPHELIDVQALNCDFLACSAYKFFGPHVGIVYGKREHLEGFTPYKVEPAKDVIPGRWETGTQSFEGLAGVIAAIDYIAAISELPKTEPRRIRLADAFAISKAHEIALSHHFLTRLTEFPQITLFGISDIERLAERTPTFALTFADHTPNQVSQFLGQAAMCVWDGHFYAQGLCEQLGVLHTGGVVRIGCMHYNTIAEIDALFERIALLLK

SEQ ID NO: 77341 - protein, 484 aa, marine gamma proteobacterium HTCC2080
MNQGPKTHRRTKIVATVGPGSDSEDMLNRLIAAGVDVFRLNFSHGSAEHHAEVAARIRRQAGYAGRYIGVLADLQGPKIRISGFAAGSVEITAGDPFCLDLDTAHDAGDQRRVGIEYRALPEQVVIDDILLLDDGKLRLRVDDVSERAVDCTVLIGGQLSSRKGVNKLGGGLAAPALTEKDRSDIAGMAGVDPDFVAVSFVSSSEDINLARTLLADVGVSPAIIAKIERAEVVADYDLLDSIIETAEGVMVARGDLGVEVGDAQLIGIQKDLIKRTRRLDRLVITATQMMESMISNSMPTRAEVFDVANAVLDGTDAVMLSAETAVGQFPIEVVTAMSEAALGAETHPVARTSRYRLDREFSSPQEAIALSAMYGANHFAEVRGIATLTERGVTPTTMSRLSSGLPIFGLSRQHKTLQKLALCRGVIPLYFDATAFAAEDIEGRVMEFLLDGGYLSRGDFILLTMGSTMGKTGTTDLLKFLPVE

SEQ ID NO: 77342 - protein, 557 aa, Erythrobacter sp. NAP1
MAAQYAFVMKGMTKSFPGANKPVLSNINLQFYQGAKIGIVGPNGAGKSTLMKIMAGIDTDFSGEAWAGENITVGYLPQEPELDPTKTVLENVRDGARETAELVERFNAVSAQMAEPDADFDALGDEMAELQTKIDAVDGWTLDNQLEIAMEALRCPPSDASVENLSGGEKRRVALTRLLIQKPSILLLDEPTNHLDAESVEWLENHLKEYAGAVLMITHDRYFLDNVVEWILELDRGSYFPYEGNYSTYLEKKAKRLEQEAREESGRQKSLNRELEWIRQTPAARQTKSKARIRKFEQLQDAQGDRKPGKAQIVIQVPERLGGKVIEAKNISKAYGDKLLFENLSFMLPPGGIVGVIGPNGAGKSTLFRMITGQETPDSGTIEIGDTVHLGYVDQSRDDLNPKNNVWEEISDGLDYMQVNGHDTSTRAYVGAFNFKGADQQKNVGKLSGGERNRVHMAKMLKQGGNVLLLDEPTNDLDVETLGALEEAIENFAGCAVVISHDRFFLDRLATHILAFEGNSHVEWFEGNFEAYEEDKRRRLGDAADRPTRLAYKKLTR

SEQ ID NO: 77343 - protein, 484 aa, Prochlorococcus marinus str. MIT 9313
MATPPLIPVILCGGTGTRLWPLSRASYPKQYWALSGSSEETLLQQTQQRLKGIEGLSAPLLICNEEHRFIVAEQMRQIDVEPNAILLEPMGRNTAPAVTVAALQATERGEDPILLVLAADHVIRNATQFRHIIEAGRIPAEAGRLVTFGIVPTAPETGYGYIEAAESFGNGEPKAVPIARFVEKPDRIAAEQFLANGCFTWNSGMFMFKASAILSELERLSPEVVSCCRAALEQEVPDLDFLRLEREAFAKCPNVAIDVAVMEKTELGTVLPLDAGWSDVGSWSALWNTTDRDLNGNVLRGHVIAESSRNCYLRSEHRLVVGLGVEDLVVVETDDAVLIANRNQAQDVKTIVKQLEADGSPEGKAHRKIYRPWGHYTSVVKDSRWQVKHIELKPGASLSLQMHHHRAEHWIVVKGTALVEKDGDKQLVGENQSTYIPLGCKHRLTNPGRMPMELIEVQSGPYLCEDDIVRFEDRYGRSESVIVN

SEQ ID NO: 77344 - protein, 143 aa, Triticum aestivum
  misc_feature (124)..(124): Xaa can be any naturally occurring amino acid
MATKEVKVVPAGDVDADGEELVPALASLEPVYGAGSALDEARLRFARLADRFRALYAAGPALFARSPGRVNLIGEHIDYEGYSVLPMAIRQDMIVAIRRADGLVRVANVDDKYATCVYPADPDXEIDIKNHKGALLIVDTRNV

SEQ ID NO: 77345 - protein, 177 aa, Zea mays
  misc_feature (98)..(98): Xaa can be any naturally occurring amino acid
  misc_feature (123)..(123): Xaa can be any naturally occurring amino acid
  misc_feature (166)..(166): Xaa can be any naturally occurring amino acid
MATKEDVQDPRIPKIASSIRVIPDFPKPGIMFQDITTLLLDTEAFKDTVDIFVERYKGKGISVVAGVEARGFIFGPPIALAIGAKFVPMRKPKKLPGXKVISEEYSLEYGTDKIEMHVGAVEXPGERAIIIDDLIATGGTLAAAIRLLERVGVTIAECACVIESPXVKGREKLGETP

SEQ ID NO: 77346 - protein, 374 aa, Oryza sativa Indica Group
MERYKVIREIGDGTCGNVFRAYNTETNEIVAVKKMKRKFFQWEECISLREVKECNLYDVIRERQAAFSEEEIRNFMVQILQGLAYMHNNGYFHRDLKPENLLVTDGTVKIADFGLAREMCTSSDMWAVGAILAELFTLSPLFPGGSETDQLYKICAVLGTPDHTVWPEGMNLPRSSSFNFFQIPPRNLWELIPNATLEAIDLIQVGNWVPRPLHASHTKTIETRPNPRLELNLWDFGTEPEDNYLDLTLSLKPSFPGTDFSNNVPEHTKEEILLYPGFENPPVQSGFWPLVASDRPMGDVPAMSSWPQAYVVDGQATLPAVGFSGSPFGLSPLQPNLFENRSFATPIRQARIDAANDELWASWALDESDMDVRV

SEQ ID NO: 77347 - protein, 337 aa, Urtica dioica
MANHPCFSKTILGMALLLLLAAASVHGKVPRIGFYDETCPKAESIVTKAVKKGLKENPRIAPGILRIAFHDCFVRGCDASVLIEGPGTEKTSGANRNIQGYNVIDDAKTELERVCPGVVSCADILTLAARDATVLTGGASWKVPTGRKDGLVSLVAEAGPLPGPRENVSEQIRKLDEIGLNTQDLVVLLGSHTLGTTSCALFRFRLYNFTNATESGADPSIDPKFLPTLRKLCPDGGNGSVRVHLDNRSGEKFDTTFYKNLKRGRGVLQSDQVLWTDLRTQPFVRRLLDSEAYDALNFKVEFGKAMVKMSLIGVKTNPKESEIRKVCTAVNSLVSSY

SEQ ID NO: 77348 - protein, 161 aa, Thermosynechococcus elongatus BP-1
MMKIRIGNGYDIHRLVPERPLILGGIRLEHACGLLGHSDADVLTHAIMDALLGALSLGDIGHYFPPSDPQWAGADSQVLLAKVAALIAERGWRVGNIDAVVVAERPKLKPYLDPMRDRLATTLGIDRDQISIKATTNEKLGPVGREEGIAAYAVALLQSGM

SEQ ID NO: 77349 - protein, 461 aa, Burkholderia vietnamiensis G4
MVSGNEKDGLKRGLKNRHIQLIALGGALGTGLFLGIAQTIKMAGPSVLLGYAVAGVVAFFIMRQLGEMVVDEPVAGSFSYFADKYVGHFTGFLSGWNYWVLYILVSMAELSAVGIYVQYWWPGVPTWVSALVFYVAINLLNLASVKSYGETEFWFSIIKVAAIVGMIGFGGWLLVSGHAGPEASIANLWQHGGFFPNGVSGLVMSMAAIMFSFGGLELIGITAAEADDPKHSIPRATNQVIYRILIFYIGALAVLLSLYPWEKVVTGGSPFVLIFHALSSNLVANVLNVVVLTAALSVYNSGVYSNSRMLFGLATQGNAPKVLCSVNRRGIPLAALGASALATGVCVLVNYFMPGKAFEVLMGLVVSALIINWAMITLIHLKFRQAKRIAGEQTSFRSLGYPFTNYLCLAFMAGILVVMYLTPDLRLSVYLIPVWLAVLAIGYRFRQKNARYALGDGASAR

SEQ ID NO: 77350 - protein, 442 aa, Synechococcus elongatus PCC 7942
MSNDKTPNSPESTPSTPADEVLDGLLAELSPEASAEPNPADDSGNPFTTIFKSVTDKATELGSAATEGLSNLQESATELAAETKEKFGNFAEAHKDDLGQLLTSAQGKAASFGEAVSDRFGELGESATESFGNLQEGAAGFAAGAKEKFGDFAEASQEKLSEIAETTQDKAASFGEAVSDRVEGLRGSAAEKLGNLQEGASELAAGAKEKFGDFAEASQEKLSEIVETTQGKAASFGEAVSDRVEGLRGSAAEKLGNLQEGASELAAGAKEKFGDFAEASQEKLSEIVETTQGKAASFGEAVSDRFGELGESAAEKLSNLQEDASEFAASAQEKLSTFTNARQEELGNLTKSAQSDVQDTANTVSEQLEQAPEAVSTAADSLKGAQEKLEAAVVASQSVAEKLKPAEVQSQSSLQLASESPSPSFFGRLLRKIKGFFRKLFG

SEQ ID NO: 77351 - protein, 347 aa, Chlamydomonas reinhardtii
MQQVARSPSAQTTRNHPSAQPRARVLANAGLFGISLPFLKAGPPKPSKAEARAEAKKELLDRIATLDRGASATADDKADVERLASTLEDLNPTAKPLAAPELLSGKWRLLYTTSASILATNRPPFLRPQGPIYQTIDAERLKARNNESFPFYNQVTADLTPLTSSKVTVQFKTFTLFKLINITAPPAAKGELAVTYLDEDLRISRGDKGNLFVLDMADRAARLEGQWALAPSLASAATRSLQDSLGHFPGTTAPPAPTAPAAGSRAPPRAVSPRTRRRAAPRTRLPTPSAPGRAAPPPRPVRAGAAAPAAPAAARRPGRPGGSCATPPCAAGRRGRVGVGMSGGQEG

SEQ ID NO: 77352 - protein, 199 aa, Chlamydomonas reinhardtii
MERRGAQDIKQQLTTELEGLDRGIFGVPAAKKARILALISELEQHNAQPAPTSDLDLVQGDWRLMYSTITITGAKRTKLGLREFVKLGEFTQHIDTANRLAVNRIEFSVSGLSSLRGSLTIRANYSVASPQRVDISYLDSALTPAQLQKIFEANLDLLLSIFNPEGHLDITYLDPQPAAPGAWRVGRDNKGNVFLLQRP

SEQ ID NO: 77353 - protein, 290 aa, Arabidopsis thaliana
MADLLPPLTAAQVDAKTKVDEKVDYSNLPSPVPYEELHREALMSLKSDNFEGLRFDFTRALNQKFSLSHRYVACIYSYCCTISVMMGPTEVPAQSPETTIKIPTAHYEFGANYYDPKITNEEHMSQAMFNFDYMGSDYRAQLQLGQSALIGATYIQSVTNHLSLGGEIFWAGVPRKSGIGYAARYETDKMVASGQVASTGAVVMNYVQKISDKVSLATDFMYNYFSRDVTASVGYDYMLRQARVRGKIDSNGVASALLEERLSMGLNFLLSAELDHKKKDYKFGFGLTVG

SEQ ID NO: 77354 - protein, 938 aa, Boehmeria nivea
IPLLTNGQPISGEIPCATPDNQSVRTTSGPLGPGDKHLPYVDPRMPVPVRIVDPSKDLNSYGLGNVDWKERVEGWKLKQDKNMMQMTSRYQEGKGDMEGTGSNGEEHQMADDARQPLSRVVPIPSSHLTPYRIVIILRLIILGFFLQYRATHPVKDAYPLWLISVICEIWFALSWLLDQFPKWYPVNRETYLDRLALRYDREGEPSQLAPVDVFVSTVDPLKEPPLVTANTVLSILAVDYPVDKVSCYVSDDGSAMLTFESLSETAEFARKWVPFCKKHNIEPRAPEFYFAQKIDYLKDKIQPSFVKERRAMKREYEEFKVRINALVAKAQKMPEEGWTMQDGTAWPGNNPRDHPGMIQVFLGHSGGLDTDGNELPRLVYVSREKRPGFQHHKKAGAMNALIRVSAVLTNGAYLLNVDCDHYFNNSKAIKEAMCFMMDPAYGKKTCYVQFPQRFDGIDLHDRYANRNIVFFDINLKGLDGIQGPVYVGTGCCFNRQALYGYDPVLTEEDLEPNIIIKSCCGSRKKEKGINKKYIDKKRAAKRTESTIPIFNMEDIEEGVEGYDDERALLMSQKSLEKRFGQSPVFIAATFMEQGGIPTSTNPTTLLKEAIHVISCGYEDKTEWGKEIGWIYGSVTEDILTGFKMHARGWISIYCMPPRPAFKGSAPINLSDPLNQVLRWASGSIEILLSRHCPIWYGYNGRLRLLERLAYINTIVYPLTSIPLLFYCALPAFCLLTGKFIIPEISNFASMWFILLFVSIFATGILELRWSGVSIEDWWRNEQFWVIGGTSAHLFAVFQGLLKVLAGIDTNFTVTSKASDDDGEFAELYVFKWTSLLIPPTTVLIINLVGIVAGVSYAINSGYQSWGPLFGKLFFAIWVIAHLYPFLKGLLGRQNRTPTIVIVWSILLASIFSLLWVRIDPFTSDATKAASRGQCGVNC

SEQ ID NO: 77355 - protein, 339 aa, Burkholderia mallei ATCC 23344
MNTTTLSTKLNAFARLNLIDAPTPLQYLPRLSAHVGRDIHVKRDDCTPLAMGGNKLRKLEFLAADALGQNADVLVTAGAIQSNHVRQTAALVAQLGLGCVALLENPIAAARDDYLQSGNRLLLDLFDVRAHVVDGLDDVDRQLEAAARRLRDEGRRPYVIPIGGSNPLGALGYVRAGLELAQQIRAAERDFAAVVLASGSAGTHAGLAFALAHALPGLPVIGVTVSRTDAQQRPKVRHLLDGMSGLLDVALPAGARIDLWDDYFAPRYGEPNRAGIDALRLLARTEGLLLDPVYTGKAMAGLIDGVARGRFDGNGPVLFVHTGGAPALFAYQDTCRASR

SEQ ID NO: 77356 - protein, 861 aa, Zea mays
  misc_feature (367)..(367): Xaa can be any naturally occurring amino acid
MASSDSNPTDAFEYMLLEKDPDLYRTVFSGPSQTSPWIDPSVLKLKHRIGRGPFGDVWIATHHQRTEDFDQYHEVAVKMLHPIKEDQLQIFSARFHEIFSKCQGLGNVCFLHGISTQNGRICIAMKFYEGSIGNKMARLKGGKLPLSEVLRYGADLARGVLGLHTRGILILNMKPCNFLIDENDCAVLGDFGIPSLLFGLSLPNPDLIQRLGTPNYMAPEQWQPNIRGPISYETDSWGFACSVLEMLTGIQPWRGKSADEIYQLVVLKKEKPIFPCSLPPDIENVLSGCFEYDFRNRPLMKDILHAFESAKGADHDNIGWGNSENAMVDRITMPNRINWLHFKDKLQVGDKVRSRKLKNSCGPETIXIPDGTIVGIEDDGERDAYVLVRVHALHNPLKVRFSTVERVTYGFAAGDWVRLREEDKKRSQVGILHSIDRDGAVAVGLIGVDTPWKGNYSDLQMAEAYCVGQFVRLKASISSPRFEWQRKRGGLASTGRISQIHPNGLLVVKFPGKFNLGEVCSCLADPSEVEVVSFDKCEGIVKKYEHLEDFHWAVRPLFVAIGFLTAIKLGVFVGKSISRPRSRKVASISDQSGDYQQQHQQQVELLDFLPRQTQRSSSSGWREGPVRWRAGGWQTSEDECILECEGGEAAGRRNAWVSGSQHESRAERAARSGETTTVEATTMPDEVRMGMDDKLWRLGFLAYWSEQILVQKQPYSMSYSRTWMTAFFCSRHRRGRRTGHVTGNRDTKGNQNMQIVISGGRCHFFRALGIIMPQMQLCAWRCHFHEAQECRCQYYKNLLPVVTIAFCIFDINIARLLHCLTELHLREDQQFFSCISNSTISVLRKKHDHLEQTKQENPTLL

SEQ ID NO: 77357 - protein, 242 aa, Triticum aestivum
YSRLCSSPHSGPAEGMGSDGTGARRRLPPANGLSKEGAPPQPVPPRLLTLPTVLTIGRVAAVPFLISTFYMEGPWAATATTGIFLAAAITDWLDGYIARKMHLGTPFGAFLDPVADKLMVAATLVLLCTKPLETSLLTNGPWLLTVPSIAIIGREITMSAVREWAASQNTQVLEAVAVNNLGKWKTATQMTALTLLLASRDPSLHVQGALVPPGVALLYASAGLAIWSLVVYIRNIWRILLK

SEQ ID NO: 77358 - protein, 459 aa, Pseudomonas syringae pv. tomato str. DC3000
MSSGRIVQIIGAVIDVEFPRDSVPSIYNALEVKSAAGTTLEVQQQLGDGVVRTIAMGSTEGLKRGLEVTDSGAAISVPVGKATLGRIMDVLGNPIDEAGPIATEERWGIHRPAPSFAEQAGGNDLLETGIKVIDLVCPFAKGGKVGLFGGAGVGKTVNMMELIRNIAIEHSGYSVFAGVGERTREGNDFYHEMKDSNVLDKVALVYGQMNEPPGNRLRVALTGLTMAEKFRDEGNDVLLFVDNIYRYTLAGTEVSALLGRMPSAVGYQPTLAEEMGTLQERITSTKNGSITSIQAVYVPADDLTDPSPATTFAHLDATVVLSRDIASLGIYPAVDPLDSTSRQLDPNVIGQEHYDTARGVQYVLQRYKELKDIIAILGMDELSETDKQLVNRARKIQRFLSQPFFVAEVFTGASGKYVSLKDTIAGFKGILNGDYDHLPEQAFYMVGGIEEAIEKAKKL

SEQ ID NO: 77359 - protein, 461 aa, Sorghum bicolor
MDERRTILMDRYEIGRQLGQGNFAKVYFARNLTDGQSVAIKMIDKDKITRVGLIVQIKREISIMRLVKHPNVLQLFEVMASKSKIYFVLEYAKGGELFNKISKGKFSEDVARRYFHQLISAVDYCHSRGVYHRDLKPENLLLDENENLKVSDFGLSALAESKRHDGLLHTTCGTPAYVAPEVLSRRGYDGTKADIWSCGVILFVLVAGYLPFHDPNLIEMYRKISKAEYRCPRSFSGELKDLLFRMLDPDPSTRISISRIKRSTWYRKPIEVNSAKIKHDTTRDKVCNGEATTSNSIECSNSEETRGSSSLPNLNAFDIISLSTGFDLSNLFEEKYGRREERFTTRQPAGTVFAKLNELAERLKLKIKKKENGVLKLASPKEGIKGFLELDAEIFELAPSFLLVELKKTNGDTIEYQRLVKEEIRPALKDMVWAWQSDRHQQRNESVQGEQQLSSPLPPQQ

SEQ ID NO: 77360 - protein, 461 aa, Rhodococcus sp. RHA1
MRRELRFVMSKILAVPPAQSQLQPVSGRSGLPGVGHVLEYIRDPLALMQKHWDRYGEVSWFSMVGRRWVAVLGPDACQEVLQNKDRAFVNGDGWSVLIGPFFHGGLMLLDSEEHLRHRRIMQQAFTRSRLENTVDVLNPAIDSALDAWTPTNGFRAYTALKALTLDLATDIFMGGAEGSTESEISSVKKAFVDCVQAATSVVRYPVPGTRWKRGLDGRRVLEDFFRQYLPARRSHETDDLFSVLCHIESEAGQRFSDDEVVDHMIFLLMAAHDTSTITISTMMQYLGQHPQWQDRCRAESLALGTPAPSYADLDGLDSLDLVMKECLRIVSPVPVMARRAVRDTQVQGHFVPAGTYAAVVPHFTHHMPQYWPEPERFDPERFAEHRREDKVHRYAWEPFGGGVHKCLGMHFAGAEIKAIMHHLLLRFDWHVDADYVAPLNFTSLPFPSDGQPVDLRLLATS

SEQ ID NO: 77361 - protein, 853 aa, Arabidopsis thaliana
  misc_feature (218)..(218): Xaa can be any naturally occurring amino acid
  misc_feature (728)..(728): Xaa can be any naturally occurring amino acid
MVSSIIAVAEGKKMELEPNKSLSADMPSLLSRSSEAFNGGTGYRSSSDLSMFSSSLPTLFHEKLNMTDSDSWLSFDESSPNLNKLVIGNSEKDSLEDVEPDALEILLPEDENELLPGLIDELNFTGLPDELDDLEECDVFCTGGGMELDVESQDNHAVDASGMQISDRGAANAFVPRKRPNTAGRVSVEHPNGEHPSRTLFVRNINSSVEDSELSALXLSRLGRSEVCTLHVKSRGFVMISYYDIPSCSMPANAVALTRNTLLRKRTLDIHFSIPKENPSEKDMNQGTLVIFNVDTTVSNDELLQLFGAYGEIREIRETPNRRFHRFIEYYDVRDEETALKALNRSEIGGKCIKLELSRPGGARRLSVPSQSQDLERTEVTNFYNQVGSHVANSPPGNWPIGSPVKGSPSHAFTRPHGLGMVRPVNSDNMPGLASILPAHPSSFHGFSPVSNDQGLLNHSNQTILNKGLMHNISYGQPHSLPEHITGGISNSMRFIAPHSSGFGTSSDHRYRWGSPPQHMNYPGYTGVSSSSSSTERPFTVRHGFPFAERQASLLGKYQHHVGSAPSSIHFNTQMNCYTGSPEIPLGFSDMGINRNYNSAHGKANLGVSLPGNSSEQDFTGFGMSSMPTVPFGGSRGLQSVRPEPFAEQGRIHNHESHNQNQFIDGGRYHIDLDRIASGDEIRTTLIIKNIPNKYTYKMLVAEIDEKHKGDYDFLCLPTDFKLFSGYXNKCNMGHAFINMVSPLHIVPFQQTFNGKIWEKFNSGKVASLAYAEIQGKSALASYMQTPSSMKEQKQLFPEVSYHDDGQDANDHEQLFSSIWNITAPDSDWSYTMDLIENPRENGNSKNAAEESS

SEQ ID NO: 77362 - protein, 769 aa, Sulfolobus solfataricus P2
MSASSGEEQKPQRKELILRVMEARQKDVGRGKVRIDIDLLSQIDVSPGDVVEIEGTRKTAALAWPLSPEDTTTGEKDIIRMDGITRKNAGVSIGDKVIVRKAIVKPASTVKLAPSNFSITVDPGFISYVKKRLKEFPLVEGDTVLIPVLGQAIPFTVVQVKPAGIVLVNDDTIISISDKPVEPSRYPRVTYEDIGGMKNIIEKVRELVELPLRHPELFKRLGIEPPKGILLYGPPGVGKTLLAKAIANETDAYFTSINGPEIMSKFYGESEQRLREIFEDAKKHAPAIIFVDEIDAIAPKRDEVIGEVERRVVAQLLTLMDGLENRGNVIVIAATNRPSAVDPALRRPGRFDREIEIPLPDKQGRLEILQIHTRNMPLSKDVDLEKLADMTHGYTGADLSALVREAAMNSLRRYLPKIDLNQDKIPPEILESMEVKMEDFINAFKEIVPSGLREIYIEVPEVKWTDIGGLEEIKEELKEVVEYPLKYSELYQNSGIEPPKGILLFGPPGTGKTMLAKAVATESGANFIAVRGPEILSKWVGESEKAVREIFRKARMYAPAVIFFDEIDSIAPIRGISYDSGVTERIVNQLLAEMDGIEKLENVVVIAATNRPDILDPALLRPGRFEKLIYVPPPDKRARTEILKVHTRNIALGEDISLEDVAEKTEGYTGADLAALVREATMRAIRESMKICIDKTNENCKPTDAECRDKTMKECMKVNGVKVSLRHFEEAMRKVKPSVTQDMLQFYQNWVEKARQQLPKTTVKPSTYA

SEQ ID NO: 77363 - protein, 80 aa, Prochlorococcus marinus str. MIT 9313
MSQEAILEKVRSIVTEQLSVEAGEVKPESSFQNDLGADSLDTVELVMALEEAFDIEIPDEAAEGITTVGDAVKYIEDKQA

SEQ ID NO: 77364 - protein, 380 aa, Synechococcus sp.
MTIRVAINGFGRIGRNFLRCWFGRQNTDLEVVAINNTSDARTAAHLLEYDSVLGRFNADISYDENSITVNGKTMKIVCDRNPLNLPWKEWDIDLVIESTGVFVTAEGASKHIQAGAKKVLITAPGKAEGVGTYVIGVNDSEYRHEDFAVISNASCTTNCLAPVAKVLHDNFGIIKGTMTTTHSYTLDQRILDASHRDLRRARAAAVNIVPTTTGAAKAVALVIPELKGKLNGIALRVPTPNVSVVDLVVQVEKPTITEQVNEVLQKASQTTMKGIIKYSDLPLVSSDFRGTDESSIVDSSLTLVMDGDLVKVIAWYDNEWGYSQRVVDLAELAARKSGRLGLVQTLLISSQDSLPLTGGFFVAKREHPRSQDSINPSGPD

SEQ ID NO: 77365 - protein, 837 aa, Arabidopsis thaliana
MKSLHFCLLFMIVSFTVSRPVEAQDQAGFISLDCGLVPKETTYVETSTNITYKSDANYTDSGLVGKINDAHKTLVQQPLWALRSFPEGERNCYNFNLTVNSTYLIRGTFLYGNYDGLNQSPSFDLHIGASKWTSVNIVGVTDTVMPEIIHVLTQKRLQVCLVKTGKTTPFISSLELRPLINNIYIAESGSMVLQNRVYFPSDSTSIVRYDEDIHDRVWNPVSDDDSSSISTDLQVQTNNLYDVPQFVMKTAAIPKDASAPWSLVWTIDNTTALSYVYMHFAEIQDLKANDLREFDITYNGGKLWFSQFRPNKLSILTMFSQVPLTSSNGEYNFTFEMTSNSTLPPLINALEIYTGLEILQLQTDKDEVSAMMNIKTTYDLSKKISWQGDPCAPQLYRWEGLDCSYPDTEASRIISLNLNASGLNGTITSDITKLTQLSELLGEKVKMNPTAKKESKKVPIVPIAASVAGVFALIVILAIFFIVKGKKGKSAEGPPLSVTSGTAKSETRSSNPSIMRKDRKITYPQVLKMTNNFERVLGKGGFGTVYHGNMEDAQVAVKMLSHSSAQGYKEFKAEVELLLRVHHRHLVGLVGYCDDGDNLALIYEYMANGDLRENMLGKRGGNVLTWENRMQIAVEAAQGLEYLHNGCTPPMVHRDVKTTNILLNAQCGAKLADFGLSRSFPIDGECHVSTVVAGTPGYLDPEYYRTNWLSEKSDVYSFGVVLLEIVTNQPVINQTRERPHINEWVGFMLSKGDIKSIVDPKLMGDYDTNGAWKIVELGLACVNPSSNLRPTMAHVVIELNECVAFENARRQGSEEMYTRSSTNFSHTSASEFSPGAR

SEQ ID NO: 77366 - protein, 367 aa, Burkholderia thailandensis E264
MKIFKLPDLGEGLQEAEIVEWHVKAGDTIDADRPLVSVETAKAIVEIPSPQSGRVAKLFGQPGDIVHLGAPLVAFEGEGGGEDAGTVVGRMTVGEHVVQEPPTALGAGAGALKAIPAVRALARKLDVDLAMVTPSGADGVITAADVQRVAKVLAELGPPEVLRGVRRAMAQNMARAQSEVAAATVIDDADIHAWPAGADVTMRLVRALVAGCRAEPGLNAWFDGQAGRRHVVAKIDVGIAVDLPDGLFVPVLRDVAHRDAADLRRGLDRMRADIRARRIPPDELRGNTITLSNFGMIGGKYAAPVVVPPTVAILGAGRVHDAVVAADGAPAVHRVLPLSLTFDHRVVTGGEAARFLAAAIADLQLAQ

SEQ ID NO: 77367 - protein, 466 aa, Brassica napus
ARVAVYKVCWEGGCFSSDILAAIDKAIDDNVNVLSMSLGGGTSDYYRDSVAIGAFAAMERGILVSCSAGNSGPSSSSVSNVAPWITTVGAGTIDRDFPAVAVLGNGKNYSGVSLFKGDPLPDKMLPFVYAGNASNAANGNLCGPGTLIPERVKGKIVMCDRGVNARVQKGEVVKAAGGLGMILANTAENGEELVADAHLLPATAVGEKAGDIIRHYVLTDPNPTASVLIRGTVVNVQPSPVVAAFSSRGPNSITPDILKPDLIAPGVNILAGWTGSKGPTGLASDARRVEFNIISGTSMSCPHVSGLAALLKSVHPEWSPAAIRSALMTTAYKTYKDGKPILDVTTGKPSTPFEHGAGHVSPTTAINPGLIYDLTTVDYLGFLCALNYTPSQIRSVSRRNYTCDPSKSYSVADLNYPSFAGNVDGSGVFKYTRTVTSVGGAGSYSVKVNSETTEVKISVEPAVLNF

SEQ ID NO: 77368 - protein, 423 aa, Kluyveromyces lactis
MRVIRQLHTSKRLLQSLVDKQKYQATTYARPNHLVLTRGKNAILYDDVNNKEYIDFTAGIAVTALGHANPEVAEIMYKQSKKLIHSSNLYYNEECLKLSENLVEATKSFGGQYDASRVFLCNSGTEANEAALKFAKRYGILKSPSKQGIIAFQNSFHGRTMGALSVTSNPKYREPFGSLIPGVEFLNINDELTKLDQQVSSLKEKTAGLIVEPIQGEGGVFPIPLDSLVGLKKICEDHDIIVIYDEIQCGLGRSGKLWAHSYLPKEAHPDIFTTAKALGNGFPIAATVTNDKVNDILKVGDHGTTYGGNPLGSAVGNYVVNVIAEQKFLDEVNKKGEIITNRLRKLQERFPEHIKDIRGKGLMIGCDFDEAPAKIVDAARDSGLLIITAGKTTVRFVPALTIEDNLLEKGLNIFEKAVEKVYS

SEQ ID NO: 77369 - protein, 597 aa, Bradyrhizobium japonicum USDA 110
MASLDSVSLAILLGAVLVMAGILSSLLALRFGAPLLLVFLVIGMLAGDSGPGQIQFDDVRTTYLVGSVALALILFDGGLKTRFASIRTVLAPSVVLATVGVLLTALITAPFAKYALDLNWTESLLVGAVVASTDAAAVFLLVHTQGLRLRPRVGATLEAESGTNDPFAIFLTLMLVEYISLGSSSAGHVLMEFLQEAVLGAVVGFFGGRLVVIALNQVALPQGLHAPFVTTGALVIFGGSQIMHASGFLAVYLAGIIIGNRPTRAHNSVVTFLDAATWLAQIVMFVLLGLLVSPSRLGASVLPAVAVALVLMLVARPLAVFVCLAPFRFNWRERIFIAWTGLRGAVAIFLASIPMLVGLSKAYLYFDVAFVVVIISLLLQGWTLAPAARKLHVALPRAERGPRRVELDLPGQLEQQLVGYPVQSKSLYFRRGLIPSWSKPTLVIRNENILTPTEADPIAPGDYIYLLAPPEKAESLDRFFVDMQPSTAPDPHLLGDFMVSGEHTLAELAEIYGVKVSEDEGKLTLADYFDVHLDRAPKEGAELALDEIVLVARSISGGRVNVVGLRLPEDEETPAPLTRWQALRRKLAELWTSVAGV

SEQ ID NO: 77370 - protein, 219 aa, Klebsiella pneumoniae subsp. pneumoniae MGH 78578
MTQDELKKAVGWAALQYVQPGTIVGVGTGSTAAHFIDALGTMKGQIEGAVSSSDASTEKLKSLGITVFDLNSVDRLGIYVDGADEINGHMQMIKGGGAALTREKIIASVADKFICIADASKQVDILGKFPLPVEVIPMARSAVARQLVKLGGRPEYRQGVVTDNGNVILDVHGLEILDAIALENAINGIPGVVTVGLFANRGADVALIGTADGVKTIVK

SEQ ID NO: 77371 - protein, 500 aa, Rhodococcus sp. RHA1
MQDQSIDDLLNTGLFVDGQWIRSSSGETRDCINPADGSVVATVDEASPEDATRAVAAARAAFDQGTWPCTPVAERTALVARIADLLERDKETLARIETLDTGKTLEESRIDIDDVVSVFRYYAQLAAVEADALVDVGRPEVISRVVREPIGVCVLIAPWNYPLLQISWKVAPALAAGCTMVLKPSEVTPLSTIAFTALIAEAGVPAGVVNLVQGSGAVLGAALTGTPDVDFISFTGGLATGRVILETAAKNVTKVAVELGGKNPHIVFADADGDDSVDQVLTGVFLHSGQVCSAGTRLIIEESIADRFVAALAARAEKIRMGNGLDPTSRTGPLVSEAHREKVERYVALGLSEGARLVTGGARPADPALADGSYYLPTIFDHCDRTMRLVQEETFGPILTVERFTTEEEALRLGNDTEYGLAAGVRTADSARGERMVRGLRHGTVWLNDFGYYTAAAEWGGFKMSGNGRELGPTGLAEYQETKHIWHNTSPTAAGWFDNG

SEQ ID NO: 77372 - protein, 485 aa, Lentisphaera araneosa HTCC2155
MRELSRTKIVSTLGPTTKGRLKELIEEGVDVFRLNFSHGSHEEHAERIQEVISAATELKRTVGILGDLQGPKIRCGKIIEGGIQLEAGQELVITTDEILGEGSRISTVFQALPREVKVGDPILMDDGLLEAVVERIEGNEIFCKMLVAGKLTSNKGINLPETDIQSPALTEKDERDLKFIIENDAIDFVALSFVRKGEDLDIIHAAMDKIGKRKPVISKIEKPSALVDIDAIIEKSDALMVARGDLGVEIPSEKVPVAQKTMIRKCIEQGKPCIVATQMLDSMIRNPRPTRAEASDVANAVLDGASAVMLSGETASGSYPVEAVQMMTKIIRETERNFMTKPGMWGYEQPEIRNDVDALCKSIVDLSETLNVKGIICITNTGKTALRIARFRPACPIFAFASHENNVLRKLSLPKAVVPMPLKDLTYDESTLTQMEEALDRHPFLDNGDQVILAAALPFDKTSNTNLIKLHTIGKDSMLLSKKTN

SEQ ID NO: 77373 - protein, 449 aa, Pseudomonas syringae
MNAALNLWKDAHAKRLSQYCAVRVIGRVSAVRRILLECRIPSAKVGDLCEVSKADGSLLLAEIVGFTQECTLLSALGPPDGIQVGAPIRPLGVAHRIGVDDSLLGCVLDGFGRPLMGRLPRRVRRPRRPPHDSAGDRRRPAADPATAHHPGLATGIRAIDSAILLGEGQRVGLFAGAGCGKTTLMAELARNMDCDVIVFGLIGERGRELREFLDHELDETLRRRSVLVCATSDRSSMERARAAFTATAIAEAFRARGQKVLLLLDSLTRFARAQREIGIASGEPLGRGGLPPSVYTLLPRLVERAGMSENGSITALYTVLIEQDSMNDPVADEVRSLLDGHIVLSRKLAERGHYPAIDVSASISRILSNVTGRKHQRANNRLRQLLAAYKQVEMLLRLGEYQAGADPVTDCAVQLNEAINAFLRQDLREPVPLQETLDRLLQLTSQLPE

SEQ ID NO: 77374 - protein, 65 aa, Pyrococcus abyssi GE5
MIVPVRCFTCGKVIGDKYYEFKRRVEAGEDPEKVLDDLGLERYCCRRMLLSHVELIDDIMHYRVY

SEQ ID NO: 77375 - protein, 338 aa, Ralstonia solanacearum GMI1000
MIAKSIVDCIGGTPLVQLARLYDGRKAEVFAKLEMLNPAGSIKDRPARYIIERGLAEGSIAPGTHIIESSSGNLAIALAMVCRIKGLRFTAVVDPKISPTNLKILRCYGAGIERVTRKDSQGGYLETRIERVRQMLASEPGAVWINQYGNPRNWESHFHGEGDEIARALDRPADMLVLGVSTSGTVLGIARRLRREWPGLRVVAVDAVGSVLFGAKPGPRELPGIGASRVPELLCRDDIDDVIHVDDYDAAMGCRRLLEREGIFAGGSSGAVVVAIDRLLARATRPLRIVTLLPDRGERYLDSVYDDEWLARIAASRAGGAVSAASPSLHVPSLEEVL

SEQ ID NO: 77376 - protein, 228 aa, Arabidopsis thaliana
MPFIASMGIYVVSRDVMLDLLRNQFPGANDFGSEVIPGATSLGLRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETATEKSLLSAKGSVPIGIGKNSHIKRAIIDKNARIGDNVKIINSDNVQEAARETDGYFIKSGIVTVIKDALIPTGTVI

SEQ ID NO: 77377 - protein, 129 aa, Myxococcus xanthus DK 1622
MKLGYIILYVPDVSATIAFYEKAFGLARRFIHESGGYAEMETGTTALAFVEEGAAKEHGFTVRHLRPKEEAAAIELALVTADVAAAYTRAVEAGAEATQPPKQKPWGQTVAYVRDLNGVLVELCSPMKE

SEQ ID NO: 77378 - protein, 446 aa, Rhodococcus sp. RHA1
MECDAWNAPAVIGCDAKRGGVPTFWCCFQFRALSRLPQRHDSFGRSHVIACGRRAGIHRETQHQGVEMKALVYDGPREVHVKDMPDARIEQPTDVLVKITSTNICGSDLHMYEGRTDLEPGMVLGHENLGIVAEVGNAVVKVSPGDRVCLPFNIGCGFCRNCEEGLTAFCLTVHPDPKMAGAAYGFAGMGPFWGGQAEYLRVPFGDFNCLRLPEDAQDKETDYVMLSDIFPTGWHCTRLADMQPGDSMVVYGAGPVGLMAAYSAMIQGASKVMIVDRHPDRLKLAEQIGVIPIDDSKGDPVEQVLEQTRGQGADKGCECVGYQAHDPQGHEDAAMTMNRLVDSVRFTGHIGVVGIFLPQDRNGPDELERHGKIAFDMGKFWFKGQKVGTGQANVKHYNRQLRDLIHQGRAKPSWIVSHELPLAEAESGYQHFDARDDGWTKVVLHP

SEQ ID NO: 77379 - protein, 342 aa, Pyrococcus abyssi GE5
MSVIQNIIGRVVVLRGGMYSVEVDVATDEGFGRFASPIEENPMLHIAEARRAVSEVDEIIGPELIGFDAVEQELIDSYLWEIDGTEDFSHIGANTALAVSIAIARAAANSKDMSLYSYIGGTFATELPVPIIQFASDENFEYYILVRDLLEVTDIVDAVNKIISEVGNKVSIEELSKASESVGMELGLEVALGIKMKRELEIEDVLNIVEDNNVAYIKPLGPPELFLELIAGTHGVFIDGEYLFRANNILDRRYYNALSIKPINLGTLTDLYNFVNDVKSEKITPILAEAKYEPADDTFPHLALGLRCPAMLISWNSVEKINELNRIAEELGERGRIITFEE

SEQ ID NO: 77380 - protein, 426 aa, Sulfolobus solfataricus P2
MSKDEELLQNYCSILFTYKTIGISNLHLYYFRETEIKSLKQLINAEFAILQTCNRVEIYLYSDTNTLKEVNKIIQYLNNIHNEPIGNQARVLCGKDAAKHLFLVASGADSLSIGEYEILSQIRSTIDMFKKLGFSGKYLQIFFERAIKVGRKVREETSISKGKVGIYSLAIDEAKKRFNDFYDRRILVIGAGEMAQKITSMLHNEGAKDVTIMNRTIEKAKQLALKFGYNYEKLDLDKLGNFDVAFISIYHENLRLENKWNTLIVDITVPPLFTGNNVITLEELERISNLNFKAREEELAKINKLVEDGINELLYDYKKEIYTEFMSKIMKRIETIRENEILRAYKELEKLGINDQQAKEILDLMTRSIIKKSFQPLFDNIRSLIFNGENSINYINFLIDIFKDGNISGFETEKIKEKQVSERSSI

SEQ ID NO: 77381 - protein, 515 aa, Myxococcus xanthus DK 1622
MSTSKSPEGVASPWKALATDLPASLVVFLVALPLCMGIALASGAPIVSGLIAGVIGGIVVGLFGGVPLQVSGPAAGLAVMVFGFIQQMGLAMTCAAVAVAGVVQMILGGLKVARGALAISPAVIHGMMAGIGILIVLGQVHIVMGGAPQSSAWQNVKELPGQIADLHGSATLLGLLTIGLMVAWQFVPGKLKKVPGPLVAVVSATAAATFMGADVARVDLPENIFSSIQLPTFPKGDWVAFGTAVLSLALVASAESLLSAVATDKMHTGPRANLDRELFGQGLANTISGLAGGLPITGVIVRSATNITAGAKTRLSGTLHGVWLLLFITLLGSVAGLVPLTVLAGLLVFVGAKLVNVHHIRELQKRGELAVYLVTVAGVVGVNLLAGIGMGLAFAALRLLWHLGSVKVDVHQQAHASYQVRISGALTFVGVPKLSTALAQVPTGSKVELDLAVQTLDHSGHEALESWCDTHCKTGGSVFAESLEDVWSRKGTVKPSSPVVVDGPNHNSLVSGGAQ

SEQ ID NO: 77382 - protein, 343 aa, Pyrococcus abyssi GE5
MLVCTKCGRTFDEKFLLRCTCGGTLLVKRHYTSFSPRNYLDMRRYIDYLPVDSVFLPKLTPAITPIVKDSEDLYLKLDYLQPTGSFKDRGTYVTIAKLKEEGINEVVIDSSGNAGISLAAYGLSEGIKVHVFLSYDANKEKISRLSALNAKLHFVDGDRMKVHEEAIRFSRDGNLTYVSHWMNPYFLEGTKTIAFEIYEQIKLPDYVFIPVGSGTAFLGIWKGFKELIEMGEIESMPSLVAVQAEGFESLCKRSKRKNTLADGIAIPEPPRIEEMKQAIKESSGFCISVGKEETLASLHWLRKRGILVEGTSAVTLAAYWKAKELELIDGVSLLILTGSAKNF

SEQ ID NO: 77383 - protein, 774 aa, Yersinia pestis CO92
MSKENIVTRENTAVSENAVSEPTVNNDVGASATNSVTHPAFTLNVRPDNIGIITIDVVGDKVNTLKAEFADQIATILQQAHALPKLQGLVIVSGKPDSFIAGADITMIAACRTAHDARVLAQKGQSILAQIAAFPVPVVAAIHGACLGGGLELALACHSRICSLDDKTVLGLPEVQLGLLPGSGGTQRLPRLVGVSKALDMILTGKQIRPRQALKMGLVDDVVPRDILLDVAIQRAKAGWLNRRALPWQERLLSGPLGKALLFRIVRKKTLAKTRGHYPAAERIIDVVRKGLDQGGPSGYEAEARAFGELAMSPQSAALRSLFFATTSLKKETGSAATARAIHRVGVLGGGLMGGGIANVTATRAGLPVRIKDINPQGINQALKYTWDALGKRVRSKRMRPTEQQRQMMLISGSTDYRGFERVDIVVEAVFEDLSLKQQMVADIERFGAAHTIFASNTSSLPISQIAALAQRPEQVIGLHYFSPVDKMPLVEVIPHEKTSEETIATTVALARKQGKTAIVVADRAGFYVNRILAPYINEAARCLLDGEPIESVDNALVDFGFPVGPMMLLDEVGIDVATKIMPILVEQLGPRFAAPPSFDVILKDGRKGRKNGRGFYLYSNPTKNSSPTKNGNSPAKRNSFKWRKNKVKPVDASIYTLLGVTPKAHLGAGVITQRCTMLMLNEAVRCLDESIIRNPRDGDIGAVFGIGFPPFLGGPFRYLDSLGADKVVQALRLLVQQYGERFEPCQRLVTMAEQQQQFYPVDANIDEVTDVAS

SEQ ID NO: 77384 - protein, 176 aa, Rickettsia prowazekii
FNSLYILWTGVAIIVMTIIGNNVMRMHNWFVAAVISPVIIMVTGVLFFGLIVFDQQILSLFDGAILMSPLALAVSIGGIQNILAKGTKYSIWDTSREMLYIPLDDELKTKGKAAVDVISAKVGKSSSGLVQSIIFTLVPNATFTSISPILMVVFTFVCFAWIYAVRKIYFEYQKIA

SEQ ID NO: 77385 - protein, 759 aa, marine gamma proteobacterium HTCC2080
MIETLRKIVQAVSEADDLEQALSLIVHEVRRAMATDVCTVYLSDRATTRLVFRATEGLNRDKIGAFSLARTEGLVGWVASRGEMLNLEDASAHPSFQLVPGLGEESFNSFMGAPIIHQRDLLGVLIVQQADSRRFSDDEEAFLITISAQLAGIIAHAEVSGLAALPDTSSKTITRIVGVAGSPGIGIGEGVFVSPTADLSAVPTRKADNRKAELRAFRAALARVRDDIEVVSDNLKDELSPEDHALFGVYLNILDDSTLGGEVASLIKSGEWAQGALSQVLLKHIKHFERMEHSYLRERAVDVRDLGTRVLTYLQDDSENRRDWPEKTILIAEEITASALGEVPRDNLVGVVSLRGSANSHAAIIARGMGVPAVMGAADLPYSRLDARTLVVDGHNGRVYINPPPEALRRFQQLVDDDLALSEELSVLRTDPGQTLDGHTVPLWVNTGLTADLPRALESGADGVGLYRTEVAFLLRDKFPSEEEQRQLYREQLEAFAPAPVTMRSLDIGGDKSLPYFPINEDNPFLGWRGVRVTLDHPEIFLAQIRAMLKANEGLGNLRILLPMISAIEEVDESLALIQRCHDEVMAEGYTQEFPPVGAMIEVPSAVWLTDVLAHRLDFLSVGSNDLTQYLLAVDRTNSRVADMYHGLHPAVLGALAKICIDARQRSCPVSICGELAGDPRATPLLIAMGFDQLSMNAASLPRVKKVLNSVTLTEAKEVLEQLKGLHSVSQVKHLLDDLMQRRGLERYVRPGQEQERAE

SEQ ID NO: 77386 - protein, 461 aa, Corynebacterium glutamicum ATCC 13032
MSDTPTSALITTVNRSFDGFDLEEVAADLGVRLTYLPDEELEVSKVLAADLLAEGPALIIGVGNTFFDAQVAAALGVPVLLLVDKQGKHVALARTQVNNAGAVVAAAFTAEQEPMPDKLRKAVRNHSNLEPVMSAELFENWLLKRARAEHSHIVLPEGDDDRILMAAHQLLDQDICDITILGDPVKIKERATELGLHLNTAYLVNPLTDPRLEEFAEQFAELRKSKSVTIDEAREIMKDISYFGTMMVHNGDADGMVSGAANTTAHTIKPSFQIIKTVPEASVVSSIFLMVLRGRLWAFGDCAVNPNPTAEQLGEIAVVSAKTAAQFGIDPRVAILSYSTGNSGGGSDVDRAIDALAEARRLNPELCVDGPLQFDAAVDPGVARKKMPDSDVAGQANVFIFPDLEAGNIGYKTAQRTGHALAVGPILQGLNKPVNDLSRGATVPDIVNTVAITAIQAGGRS

SEQ ID NO: 77387 - protein, 626 aa, Zea mays
MMRGHTWLALLVVVVLALADAAAGRFVVEKNSIQVTSPDELKGKYECAIGNFGVPQYGGTLHGLVEYPKSNRKACQSFDISFKPKQAGGRPTFVLVDRGECFFTTKAWNAQNAGAAAVLVVDDKSEPLITMDNPEEGKEHLENITIPSVLITKKLGESLKKSAENGDMLSVLLDWRESLPHPDERVEYEFWTNSNDECGPKCDMQMDFVKSFRGTAQILEKKGYTQFTPHYITWYCPEAFVDSKQCKSQCINHGRYCAPDPEQDFSQGYDGRNVVVQNLHQICVFKIANETGKPWLWWDYVHDFALRCPMKDKKYNHDCASDVIKSLGLDIEKINKCVGDPEANEENVILKAEQDAQIGHGKRGDVTILPTLVINNRQYRGKLDKVAVLKAICSGFEETTEPAVCLSEEVQTNECLENNGGCWLDKANNVTACKDTFRGRVCECPIVRGVKFVGDGYIHCEASGIGRCEINNGGCWQESKDGKTISACSNEVSEGCKCPVGFKGDGEKSCEDIDECKEKLYCQCKGCSCKNTWGSYECSCGDDNMLYMREHDTCISKEGTATTVGWSFLWVIFFGLVFAGVGAYAVYKYRLRSYMDSEIRAIMAQYMPLDNQEGANQHQVVHANDI

SEQ ID NO: 77388 - protein, 358 aa, Pseudoalteromonas tunicata D2
MSQSNYNIAVLAGDGIGPEVMAAAEQVLDAVSQKFSFTLNRTHHAIGGAAIDQFGQALPDATLAACEQADAILFGSVGGPKWEKLPPAEQPERASLLPLRKHFGLFCNLRPAQLLPALSAASPLRADISEKGFDILCVRELTGGIYFGEKGRSGEGESESAFDTQTYSRKEIARIAHFAFSAARLRRNKVTSVDKANVLASSVLWREVVTEVSKDYPDVALEYIYVDNAAMQLVKNPGQFDVLLCDNLFGDILSDECAMITGSMGLLPSASLNQSGFGLYEPAGGSAPDIAGKGIANPIAQILSAALMLRYSLKQEEAARTIEKAVAEAVAAGVGTPDIYPQAGCTTADVAAAIVARI

SEQ ID NO: 77389 - protein, 350 aa, Oryza sativa Indica Group
MATTSSKNERWSLAGATALVTGGSKGIGRAIVEELASLGATVHTCARTEAPLNRCREELTAKGLAVTVSVCDVSLRADREALAGTVRELFGGKLSILVNCAGMSFLKPAVELTPDDCSQVMGMNFESCFHLSQLAYPLLKASQRGCIVNISSIASVVAFCSLPNAVYSAAKDCSCLNSAGRATVVRNRGNRGMQGRVERRAMNQVTRNLAAEWANDGIRVNCVAPGFIRTPLLSEFVEGNELGRAEFSRVPMGRLGEPEDIASLVAFLSMPASSYITGRDDSVGHSNRCWKQSLGMVAFPLAALLKEASSSLPPLNSVGKQWHQGQDVDRSDRLALANGKDKVAKGAHHI

SEQ ID NO: 77390 - protein, 481 aa, Pseudomonas sp.
MFHVPLLIGGKPCSASDERTFERRSPLTGEVVSRVAAASLEDADAAVAAAQAAFPEWAALAPSERRARLLRAADLLEDRSSEFTAAASETGAAGNWYGFNVYLAAGMLREAAAMTTQIQGDVIPSNVPGSFAMAVRQPCGVVLGIAPWNAPVILGVRAVAMPLACGNTVVLKSSELSPFTHRLIGQVLHDAGLGDGVVNVISNAPQDAPAVVERLIANPAVRRVNFTGSTHVGRIIGELSARHLKPAVLELGGKAPFLVLDDADLDAAVEAAAFGAYFNQGQICMSTERLIVTAVADAFVEKLARKVATLRAGDPNDPQSVLGSLIDANAGQRIQVLVDDALAKGARQVVGGGLDGSIMQPMLLDQVTEEMRLYREESFGPVAVVLRGDGDEELLRLANDSEFGLSAAIFSRDVSRAMELAQRVDSGICHINGPTVHDEAQMPFGGVKSSGYGSFGSRASIEHFTQLRWLTIQNGPRHYPI

SEQ ID NO: 77391 - protein, 317 aa, Bradyrhizobium sp. ORS278
MSAKNGSIKLVAGNSNPPLAAAIASELGLALTKAVVRRFADMEIFVEIQENVRGSDVFIIQSTSYPANDLLMELLIITDALRRASARRITAVVPYFGYARQDRKSGSRTPISAKLVANLITHAGVDRVMTLDLHAGQIQGFFDIPTDNLFAAPLMVRDIKDRFDLSSVMVVSPDVGGVARARGLAKRINAPLAIVDKRRERPGESEVMNVIGDVSGRTCILIDDIVDSGGTLVNAADALLKYGAKDVYAYITHGVLSGGAATRISSSRLKELVITDSILPTEAVRGAPNVRALPIAPLIAEAIGRTAAEESVSSLFD

SEQ ID NO: 77392 - protein, 600 aa, Bradyrhizobium sp. BTAi1
MSFINPDPFTTRPEIDGTFGVVTSTHWLATAVGMAMLERGGNAFDAGVAAAFTLQVVEPHLNGPGGDVPIILHDVKRGRTEVICGQGPAPAGATIAHYKREGLDMVPGTGLLAACVPGTFESWMLLLRDYGTMRLRDVLEPAIGYARDGYPLVERVSATIQTVEQLFKTHWPTSAALYLPHGEVPKPGTLFTNPQLAETYARILSEGESAGGDRDAQIERARKAWSQGFVAEAIDRFCRTQEVMDVSGTRHKGVLTADDMARWQPSIEAPLTYEYGRYTVCKAGVWSQGPVLLQQLALLKGFALDGLDPTGPDFIHWQIEAAKLAFADREAFYGDPNFADIPIQTLLSDAYNDERRKLITEKASLELRPGKLDGYGAKVQLREAQGHREAVGAMGSGEPTVGRFGEVRGDTVHFDIIDRDGNMISATPSGGWLQSSPVIPELGFCLGTRAQMFWLEEDHPAALVPGKRPRTTLSPTMALRDGEPYVAWGSPGGDQQDQWNTQFFLRHVHAGMNLQEAIDAPAWHSEHFPISFWPRTARPGVLVVENRVPKTTVEELRRRGHVVEVGPDWSEGRLTAASRVSRRRRAAANPRGMQGYAAGR

SEQ ID NO: 77393 - protein, 272 aa, Bradyrhizobium japonicum USDA 110
MSYVEATDTSLRKTGQIKLHGPSAFAGMRKAGALVAKCLDELTDIVGPGVPTERIDQFVRDFAFSHGAYPATLMYRGYRYSTCTSLNHVVCHGMPGDRPLKEGDIVNIDVTFIVDGWYGDSSRMYAIGPIARKAERLIEVTYEAMMRGIAAVKPGATTGDIGHAIQSFVEPQGMSVVRDFCGHGLGRMFHDEPNIIHIGRPGEGVQLKPGMFFTIEPMINLGKPHVKILSDGWTAVTRDRSLSAQFEHSVGVTATGVEIFTLSERHGEKQIG

SEQ ID NO: 77394 - protein, 86 aa, Triticum aestivum
AETLVADLENGAGLLLENPGFYKEEDKNDPKIAQKLASLAHLVGNDACITAHRAHAWTEGVTKLLTPFDGGFLLQNELDYLYGAVA

SEQ ID NO: 77395 - protein, 233 aa, Symbiobacterium thermophilum IAM 14863
MGVHAEFVLSAVAQGQFPQDGLPEVALVGRSNVGKSSLINALVRNRKLARTSNTPGRTQALNFYRVWPQGKPRPEGEPQPDKDAGRTALSGPVLQAARESGAFYLVDMPGYGFARVSEAQRREWARLIEGYLLTRGALRGVLQIVDLRHPPTRDDVTMREWIRHHRLPSLCVATKADKIGRTAWPRHRQVIARELGLDGDGEPLVLFSAETGLGRDDVWRWIREHVQDWTFDM

SEQ ID NO: 77396 - protein, 248 aa, Gossypium hirsutum
MAGIAFGRFDDSFSLGTVKAYLAEFISTLVFVFAGVGSAIAYNKLTTDAALDPDGLVAIAVCHGFALFVAVAIGANISGGHVNPAVTFGLALGGQITILTGIFYWIAQLLGSIVACFLLKAVTGGLTVPIHGLGAGVGAIQGVVMEIIITFALVYTVYATAADPKKGSLGTIAPIAIGFIVGANILAAGPFSGGSMNPARSFGPAVASGDFNGIWIYWVGPLIGGGLSGLIYGNVFMNSDHAPLSNDF

SEQ ID NO: 77397 - protein, 406 aa, Thermosynechococcus elongatus BP-1
MGLEWIQPADRLGALPPYVFARLDELKLKARQQGLDLIDLGMGNPDGSAPRPVIEAAIAAFEEPSYHGYPPFEGTAVFRQAITRWYQRRYNVSLDPEGEALPLLGSKEGLTHLALAYVNPGDVVLVPSPAYPAHFRGPAIAGANIYPLILKREKGWLIDLSEIPSDIARQAKVLYFNYPSNPTAAIAPRSFFEEVVAFAREYQILLVHDLCYAELAFDGYQPTSLLEIPGAKEIGVEFHTLSKTYNMAGWRVGFVVGNRHIIQGLRTLKTNLDYGVFSVLQKAAEVALSLPDSYIASVCDRYRQRRDFLIQGLNELGWQLTPTQATMYLWVPVPLGMSSTDFALKLLQETGIVVTPGNAFGEGGEGYVRISLIADCDRLGEALKRMAQANIRFDSLSHSLTPSSHD

SEQ ID NO: 77398 - protein, 453 aa, Prochlorococcus marinus str. MIT 9313
MRAAVAFAGADVSAMTWFSLRLRLEPPQEHQHSDLGHSLALYFLAFGALLLVAVLLDDMAARVRVPGILMVLILGLLVDNHLTVASDAADALPPLLSLVHADQITQAALVLVLFFGGLTTNWAEMRSVIPSALRLASFGALFTALLITLAMLGFGLAEGSAGWVVLFPQALFVGAMLSSTDASATFALLRPLAGRLPKPVLDLIETESGFNDPVAVVLAGVAMALAGGEGVAPAALVTVVLRQFLLGILLGFLGGSLTTQVLGSRRSLNTNSMLPVVSLALLMVLAGGTTLMGGSALLAAYVAGLVLGNGSSTDQLVLAEAHSSFAKMAELLLFLCMGLVVSPEDVVRAAGGAFLLFLLMQVVRWLIVHFLLLRSSFSLGQRTFVCWAGLRGAVPIALAIQVWASSSVSWGKTMPPLALAVVLFGLLFQGFALVPIANRLGLASPLKAPLSAP

SEQ ID NO: 77399 - protein, 219 aa, Triticum aestivum
MAACAAPPCVRISCSTPSPTALRRPRRRRVASARCSLAAAPGLRAPPELVDSILSKVKGTDRGVLLPEEGHQEVADVAQQLGKYCIDEPVKSPLIFGDWDVVYCSVPTSPGGIYRTPLGRLVFKTDDMVQVVEAPDIVRNKVSFSIFGLDGAVSLTGKLNVLDSKWIQVIFEPPELKVGSLGFRYGGESEVKLEITYVDEKIRLGKGSRGSLFVFLRQD

SEQ ID NO: 77400 - protein, 527 aa, Oryza sativa Indica Group
MATLLSKLLALPQQWQLLLLLLLLPIASLLLVIGRNTGGRRRRRHLRLPPGPARLPVLGNLLQLGALPHRSLRDLARRHGPVMMLRLGAVPAVVVSSPEAAQEVLRTHDADCCSRPSSPGPMRLSYGYKDVAFAPYDAYSRAARRLFVAELFSAPRVQAAWRARQDQVEKLIGKLTRPEPEPVELNDHIFALTDGIIGAVAFGSIYGTERFASGGRKRFHHLLDDVMDMLASFSAEDFFPNAAAARLFDHLTGLVARRERVFQQLDAFFEMVIEQHLDSDSSNAGGGGGNLVGALIGLWKQGKQYGDRRFTRENVKAIIFDAFIGGIGTSSVTILWAMAELMRSPRVMRKVQAEIRATVGDRDGGGMVQPDDLPRLAYLKMVVKETLRLHPPATLLMPRETMRDVRIGGYEVAARTRVMVNAWAIGRDAARWEEAEVFDPDRFEAKRVEFNGGHFELLPFGSGRRICPGIAMAAANVEFTLANLLHCFDWALPVGMAPEELSMEESGGLVFHRKAPLVLVPTRYIQL

SEQ ID NO: 77401 - protein, 254 aa, Oryza sativa Indica Group
MADLHPPEPDTNGGSAAAAAAAAAAPLGDPAAEASGAQAAAGPPYSKRRRRPSVRLGDIGVHSAAAADVPLPQRRHHKTSSSSHPRPPRRAHPEDALDPLNHSSAAAHRRGQKPAQRRPRTAWIPAAPGTDGYEEEAEHYYDDADQSDSAAAAAARARVSGSRDASGDESDGVADWGLPNGRLPGSMGYGGVKAWLDGLGLSRYAPVFEIHEVDDEVLPLLTLEDLKDMGIGAVGSRRKLYAAIQKLQRSDSVS

SEQ ID NO: 77402 - protein, 503 aa, Brassica napus
MAITVPRRQLFIGGQWTEPLRRQTLPVVNPATEDIIGYIPAATSEDVELAVEAARKALTRNKGNDWSKASGAVRARYLRAIAAKVTERKSELANLEAIDCGKPLDEAAWDMDDVAGCFEYYADLAQGLDSKQKAPLSLPLDTFKGYVLKEPIGVVGLITPWNYPLLMAVWKVAPALAAGCTAILKPSELASVTCLELADICREVGLPPGVLNILTGLGTEAGAPLASHPHVDKIVFTGSTATGSNIMTSAAKLVKPVSLELGGKSPIIVFDDVKIDKAVEWTMFGCFWTNGQICSATSRLLVHEKIADEFLDKLVKWTKNIKISDPFEEGCRLGPVVSKGQYERVVKFVSNARKEGATVLCGGARPGHLKKGYFVEPAIISNVTTSMEIWRDEVFGPVLCVKTFSTEDEAIQLANDSQYGLAGAVLSNDLERCDRVSKAFEAGIVWVNCSQPCFCQAPWGGTKRSGFGRELGEWGLENYLSVKQVTQYISNEPWGWYKSPSKL

SEQ ID NO: 77403 - protein, 146 aa, Oryza sativa Indica Group
MASSSDPWMKEYNEASRLADDINSMIADRGSLPQSGPEIIRHTSAIRRKITILCTRLDSLEALLSKIPPKSLSDKELHKRQDTLSNLKSKTKQMATSFNMSNFANREDLLGQNKKAADDMSRVAGLDNQGIVGLQRQIMKGDKYVT

SEQ ID NO: 77404 - protein, 348 aa, Oryza sativa Indica Group
MKFGGSSVASAERMREVADLILSFPEETPVVVLSAMGKTTNNLLLAGEKAVSCGAPKASEIPELAVIKELHVRTIDELGLDRSIVSAHHVLNMKDFRQLKHGLLEELEQLLKGVAMMKELTPRTRDYLVSFGECMSTRIFAAYLNKLGKKARQYDAFDIGFITTDDFTNADILEATYPAVAKRLQGDWIDDPAIPIVTGFLGKGWKSCAVTTLGRGGSDLTATTIGKALGLREIQELDHVVEELEKIAVVHLLQHRSIISLIGNVQRSSLILEKAFNVLRRNGVNVQMISQGASKVNISLVVHDSEAKQCIQALHSAFFENGFLSEVEEEDLQHNGSPVSPNGVIYGN

SEQ ID NO: 77405 - protein, 581 aa, Oryza sativa Indica Group
MAVALRFAAAVARDSPAAAAPPRVGRGEQQYLACAAAARPGGRCSRRRGLVARCQSGAAAVVLNKDDAASVAAVASSATGFTVAMKFGGSSVASAERMREVADLILSFPEETPVVVLSAMGKTTNNLLLAGEKAVSCGAPKASEIPELAVIKELHVRTIDELGLDRSIVSAHHVLNMKDCRQLKHGLLEELEQLLKGVAMMKELTPRTRDYLVSFGECMSTRIFAAYLNKLGKKARQYDAFDIGFITTDDFTNADILEATYPAVAKRLQGDWIDDPAIPIVTGFLGKGWKSCAVTTLGRGGSDLTATTIGKALGLREIQVWKDVDGVLTCDPNICANAIPVPYLTFEEAAELAYFGAQVLHPQSMRPAKEGGIPVRVKNSYNRRAPGTVITKTRDLSKSILTSIVLKSNITMLDIVSTRMLGQYGFLAKVFSIFEDLGISVDCVATSEVSISLTLDPSKLWCRELIQQELDHVVEELEKIAVVHLLQHRSIISLIGNVQRSSLILEKAFNVLRRNGVNVQMISQGASKVNISLVVHDSEAKQCIQALHSAFFENGFLSEVEEEDLQHNGSPVSSNGVIYGN

SEQ ID NO: 77406 - protein, 382 aa, Klebsiella pneumoniae subsp. pneumoniae MGH 78578
MTDLDLAGKRVFIRADLNVPVKDGKVTSDARIRASLPTIELALKQGAKVMVTSHLGRPTEGEYNEEFSLLPVVNYLKDKLSNPVRLVKDYLDGVEVAAGELVVLENVRFNKGEKKDDEELSKKYAALCDVFVMDAFGTAHRAQASTHGIGKFADVACAGPLLAAELDALGKALKEPARPMVAIVGGSKVSTKLTVLDSLSKIADQLIVGGGIANTFVAAQGHNVGKSLYEADLVDEAKRLLGTCDIPVPTDVRVATEFSETATATLKSVNDIKDDEQILDLGDVSAQKLAEILKNAKTILWNGPVGVFEFPNFRKGTEIVANAIADSEGFSIAGGGDTLAAIDLFGIADKISYISTGGGAFLEFVEGKVLPAVAMLEERAKQ

SEQ ID NO: 77407 - protein, 365 aa, Bradyrhizobium sp. ORS278
MGFKCGIVGLPNVGKSTLFNALTETAAAQAANYPFCTIEPNVGEVAVPDPRLEKLAAIAKSGQIIPTRLTFVDIAGLVRGASKGEGLGNQFLANIREVDAIAHVVRCFEDSDITHVEGKIAPLADIETIETELMLADLDSLEKRVDNLAKKAKGGDKDAKEQHDLVTRALVLLRDGKPARLLERKPEEERAFGMLGLLSSKPVLYVCNVEEGSAKDGNSFSQAVFARAKEEGAIAVVISAKIESEIATLSREERVDFLETLGLEEAGLDRLIRAGYQLLDLITYFTVGPKEARAWTIHRGTKAPAAAGVIHTDFEKGFIRAETIAYADYVALGGEAGAREGGKLRLEGKEYVVADGDVMHFRFNN

SEQ ID NO: 77408 - protein, 404 aa, Haemophilus influenzae R2866
MRLFPKSDKLEHVCYDIRGPVHKEALRLEEEGNKILKLNIGNPAPFGFEAPDEILVDVLRNLPSAQGYCDSKGLYSARKAIVQYYQSKGILGATVNDVYIGNGVSELITMAMQALLNDGDEVLVPMPDYPLWTAAVTLSGGKAVHYLCDEDANWFPAIDDIKAKVNAKTKAIVIINPNNPTGAVYSKELLQEIVEIARQNNLIIFADEIYDKILYDGAVHHHIAALAPDLLTVTLNGLSKAYRVAGFRQGWMILNGPKHNAKGYIEGLDMLASMRLCANVPMQHAIQTALGGYQSINEFILPGGRLLEQRNKAYDLITQIPGITCVKPMGAMYMFPKIDVKKFNIHSDEKMVLDLLRQEKVLLVHGKGFNWHSPDHFRIVTLPYVNQLEEAITKLARFLSDYRQ

SEQ ID NO: 77409 - protein, 342 aa, Klebsiella pneumoniae subsp. pneumoniae MGH 78578
MTIRIAINGFGRIGRNVVRALYESGRRAEITVVAINELADAAGIAHLLKYDTSHGRFAWDVRQEREQLFVGDDSIRLLHEPTIAALPWRELAVDVVLDCTGVYGSREHGEAHLQAGAKKVLFSHPGGNDLDATVVYGVNQDELRAGHRIVSNASCTTNCIIPIIKLLDDAYGIESGTVTTIHSAMHDQQVIDAYHPDLRRTRAASQSIIPVDTKLAAGITRIFPQFNDRFEAIAVRVPTINVTAIDLSVTVKKPVKACEVNQLLQKAAQGAFHGIVDYTELPLVSTDFNHDPHSAIVDGTQTRVSGAHLIKTLVWCDNEWGFANRMLDTTLAMAAIGFRFDA

SEQ ID NO: 77410 - protein, 489 aa, Klebsiella pneumoniae subsp. pneumoniae MGH 78578
MDELDIFIGGQWRRGGGNLMHSQFPADGAINAALHAASLDDLQEAIDCADRAWREPTWRAMLPHQRAKILHKVADLIEAQLDELTQKQSRDNGKPLAEARGLVMSAAGTARYFAAACELLEGELPTPRQADLLTLSRYEPLGVVAAITPWNSPIASEMQKVAPAIAAGNAVILKPAEATPLMALELAKIFEQAGLPAGLLSVLPGKGSIIGDALARHPKVRKISFTGGTTTGRHLAHVAAEKLIPASLELGGKSPTIVLEDADIEQAARGICYGIFSSGGQACIAGSRLFVHDKVYPQLMARLLELTQGLRVGHPFSAGTHVGPLINDKHRQSVLEYVELAKREGGSVLCGGEIPADPALAAGSYFLPTIIEGLNNQARVCQEEIFGPVLVAMRFHDEAALIREANDSVFGLAAGIWTRDTGRALRLSEQLEAGTVWINTYKVFSISTPFGGFKESGLGREKGIQGLKAWMQQKSIYLATGNSVNHWCD

SEQ ID NO: 77411 - protein, 388 aa, Lentisphaera araneosa HTCC2155
MKYNTYLSSKNEYSLSKYHNLANQLKADGHHVINLTTGDPIERTYPEAYKAMEESLTNRKISQYPSFKGKVSLRQSIADWAQRNHKIEFNPDTQVCSTNGSKEAVFHLALLFDWSEGQEIWAPSLSYPVYASSAGLFNIPFRELPVSRETNFLPDLDTISANDWHKCQMFWINSPHNPTSAIASKDYLQKLLKLAEQYDFLVCSDECYNDIFYKDLPSSILDFPESQNWLCIRSLSKRSHMTGFRSGALLSQNTELMKKILLMRPALGVGTPDFIQDAAIAAWNDDQHPKQFSEEYKIKQKIIREALESKGFEIFGGDASFYLWFSHPQFSSSEQLMELFIEQHLVLTPGTAFGKDGEGFIRMVYCSTLNQCEEIAKRIQSLNIKGPS

SEQ ID NO: 77412 - protein, 296 aa, Viscum album subsp. album
VAPVDSGFWWIILLRAYTKSTGDSSLADLPECQNGMRLILNLCLSEGFDTFPTLLCADGCCMIDRRMGVYGYPIEIQALFFMALRCALLLLKQDAEGKEFAERIVKRLHALSFHMRSYFWLDSKQLNDIYRYKTEEYSHTAVNKFNVIPDSLPDWVFDFMPIHGGYFIGNVSPARMDFRWFCLGNCIAILSSLATPEQSTAIMDLIESRWQELVGETPLKVCYPALETHEWRIITGCDPKNTRWSYHNGGSWPVLLWLLSAACIKTGRPQIARRAMELAESKLMGDNWPEYYDTRR

SEQ ID NO: 77413 - protein, 309 aa, Lentisphaera araneosa HTCC2155
MKANDVLELCGNTPLVKINKLTEGAYAEVYAKTESSNPGFCVKDRIAKAMIDDAIANGTLKPGMTVIEPTSGNTGIGLAMTCAVRGYKLILCMPDSMSVERRQLMRIFGAELVLTPGADGMKGAINKAAELAEDIDGAWIPQQFENASNPAIHEKTTAKEIIADMNGDFDYFVAGVGTGGTVTGCARTFKKEVPNVKIVAVEPETSAVLSGEGPGKHKIQGIGAGFIPGVMEPELLDEVIKVSDEQSGETARQLAQKEGILCGISCGASMTAALELAKRPENKGKKIVCILPDTGERYLSTWLFEDYKM

SEQ ID NO: 77414 - protein, 122 aa, Burkholderia sp.
MDQYALKQRAALAGADYVQAHAPKGALLGVGAGSTVNILIDALVAQQAFGRHFRGAVSSSRATTARLESCGVPVFELNQADALPLYLDGADEIDPHGRMIKGGGGALTGEKIVAAAAKVFVC

SEQ ID NO: 77415 - protein, 548 aa, Pseudoalteromonas tunicata D2
MSNRTALPSWQSLQLLAKNIQGVHLKQLFSDDAERFERYSIAIDGLLFDYSKNLITPEIHEQLLALAKDVNLIEWREKMFRGERINFTENRSVLHTALRQRADNPFMLDGENINQAVHTELKKMSVFVEQVRSGAWLGYDNQAITDVVSIGVGGSNLGPQMATEALKPYADDRLNVHYVSNADGVQIHQVLARLNPATTLFVVSSKTFTTSETMTNARTALAWLNAATDVEGAVAKHFVAVSSNLTKTAEFGIDSANVFAMWDWVGGRFSLWSAIGLPIALYLGFDTFTELLAGAADADEHFFNTELSQNIPVIMALLSVWNTSFLGAKAQAILPYDQTMHMLPAYLQQAEMESNGKSVTFAGDSVDYTTVPLIWGMTGINGQHAFYQYLHQGTTIVPADFIGSIEPSVAVGHHHQVLMSNFFAQTQALMNGVDANEVRAALGKKGLSDTEIEQLVAHKVHQGNRPTTSIILDKIDARGLGRLIAFYEHKIFCQGILLEICSFDQWGVELGKGLASNIEAELATNNIVLGHDSSTNGLVNYFKQKRTI

SEQ ID NO: 77416 - protein, 296 aa, Viscum album subsp. album
VAPVDSGFWWIILLRAYTKSTGDLSLADAPECQKGMRLILALCLSEGFDTFPTLLCADGCSMIDRRMGIYGYPIEIQALFFMALRCSLAMLKHDTEGKEFIERITKRLHALSFHMRSYFWIDFQQLNDIYRYKTEEYSHTAVNKFNVIPDSIPEWVFEFMPTRGGYFIGNVSPARMDFRWFALGNCVAILSSLATPEQSLAIMDLIEARWEELVGEMPLKICYPAIESHEWRITTGCDPKNTRWSYHNGGSWPVLLWILTAACIKTGRPQIARRAIDLAESRLLKDSWPEYYDTQR

SEQ ID NO: 77417 - protein, 489 aa, Pseudoalteromonas tunicata D2
MLNPFDIIIFGGGGDLSLRKLLPAWYRAYQEGNLPAGSRIMPTVRELADRAEFIEKVDNALQAHLSTGEYNKKDWAVFAEFIHPIAINVTEIDENWTLLKERLEAEASDRSRVFYLSLPPAVYGRCCELLSQMELITETSRVVVEKPIGYCGASAEEINSQVALYFKEEQIFRIDHYLGKETVQNLMALRFSNVLFENLWDAKTIDNIQISISETVGLETRAGFYDKAGALRDMVQNHLLQLLCLVAMESPHKLNANSIRAEKLKVLEALRPIVGKEVKENIVRGQYVPGTMNGKVVPGYLEELGDNSTTETFVAIRAHIDNWRWAGVPFYLRTGKRLKKRCAEIVVEYKSVSHNVYEQNVGPIQPNRLVIQIQPEESIQLTLMSKRLDSLEMQLEPVTLNIELAEDYNNNYQGDAYKRLMLDAAANNPALFIHRDEVRQAWKWIDPIVEQWQKSGVPALYRAGSWGPIDADELLAERNHTWYNAGDNV

SEQ ID NO: 77418 - protein, 467 aa, Theobroma cacao
  misc_feature (217)..(217): Xaa can be any naturally occurring amino acid
MEGGSKKVKSLALVWLIFALLHPLRLISANVEGDALHSLRTNLNDPNNVLQSWDPTLVNPCTWFHVTCNNDNSVIRVDLGNAALSGQLVPQLGLLKNLQYLELYSNNISGQIPSDLGNLTSLVSLDLYLNSFSGPIPESLGRLSKLRFLRLNNNSLSGPIPMSLTNITSLQVLDLSNNRLSGEVPDNGSFSLFTPISFANNLDLCGPVTGRPCPGSXPFSPPPPFVPPPPISSPSGNSVTGAIAGGVAAGAALLFAAPAIAFAWWRRRKPQEFFFDVPAEEDPEVHLGQLKRFSLRELQVATDSFSNKNILGRGGFGKVYKGRLADGSLVAVKRLKEERTPGGELQFQTEVEMISMAVHRNLLRLRGFCMTPTERLLVYPYMANGSVASCLRERPPSQPPLDWPTRKRIALGSARGLSYLHDHCDPKIIHRDVKAANILLDEEFEAVVGDFGLAKLMDYKDTHVTNH

SEQ ID NO: 77419 - protein, 418 aa, Pyrococcus abyssi GE5
MRIAVIGLGYIGLPTAIMFASSGHDVIGYDIRRDVVEKVNRGIAHIVEPEIGERLREVVSKGKLRATSDYNDLKGADAFIICVQTPLSNGVPDLTYLESAIKTIAKVIEKEALVVIESTVPPGTTERMAKLLEELTGLKEGEDFYVAHAPERVMPGRIFKELVYNSRIIGGVSEKASILAEKLYRSFVKGRIFLTTATTAEMVKLMENTFRDVNIALANEFAFLAHKYGVNVYEAIELANTHPRVKIHRPGIGVGGHCLPKDPYLLLANVDEDLGLIRKARKINESMPRFAAKLLFEALGEANVDPGDAVVLVLGLAYKGDTDDVRNSPALEFIKIIEKDVKEVRTYDPYVNGTHTILEEAVKGVDAIIIATDHSMFREIEWDKLGNLMRNKIIIDGRNLVKEPPKGFIFKGIGRGDV

SEQ ID NO: 77420 - protein, 353 aa, Burkholderia mallei ATCC 23344
MILVTGGAGFIGANFVLDWLAQSDEAVLNVDKLTYAGNLGTLKSLQGNPKHVFARVDICDRAAIDALLAQHKPRAIVHFAAESHVDRSIHGPADFVQTNVVGTFTLLEAARQYWSALGTDAKAAFRFLHVSTDEVFGSLSPADPQFSETTPYAPNSPYSATKAGSDHLVRAYHHTYGLPVLTTNCSNNYGPYQFPEKLIPLMIANALGGKPLPVYGDGQNVRDWLYVGDHCSAIREVLARGVPGETYNVGGWNEKKNLDVVHTLCDLLDEARPKAGGSYRDQITYVTDRPGHDRRYAIDARKLERELGWKPAETFETGLAKTVRWYLDHQEWVDEVVSGDYRKWVETNYAQRA

SEQ ID NO: 77421 - protein, 256 aa, Brevibacterium sp. HCU
MNRLGGKVAVITGGAAGMGRIQSELYASEGAQVAVVDVNEQEGRATADAIRASGGVANYWKLDVSDESEVEIVVSDIAKRFGAINVLVNNAGVTGADKPTHEIDERDLDLVLSVDVKGVFFMTKHCIPYFKQAGGGAIVNFASIYGLVGSQELTPYHAAKGAVVALTKQDAVTYGPSNIRVNAVAPGTILTPLVKELGSRGPDGLDGYTKLMGAKHPLGRVGTPEEVAAATLFLASEEASFITGAVLPVDGGYTAQ

SEQ ID NO: 77422 - protein, 544 aa, marine gamma proteobacterium HTCC2080
MEGPRANETRSHHDVITDLHVLSPFDFRGKAAMTDAYIKRILNARVYDIAHETPLSDAPLMTRRLGNQIFLKREDLQPVFSFKLRGAYNKMINLDEPSRRRGVVAASAGNHAQGVALAAQKLSVKAKIVMPVTTPAIKVDAVRNYGASVILHGDTFDEAAHLAAEIVEAEGMTFLHPFDDPDVIAGQGTVAVELSRQAPAPLDYVFVCVGGGGLIAGMATYLRYVWPKTQIIGVEPEDAACVRAALDKGRRVRLREVGLFADGCAVAQVGKETLRLIKSHVTDVITVTTDEICAGVKDIFEDTRAIAEPAGALAVAGMKKYTALHGLQGVTMAATVSGANTNFDRLRYISERTEIGERREAVISVTIPERAGAFRRFCNELGKRNITEFNYRYVDDRVAQVFVGLSVTPNSADLEQLTNKLEKKGYSIDNLTDNETAKLHVRHMVGGQAPCIGGSECVFRVQFPERPGALLKFLNALGNDFDISLFHYRNHGAAYGRILVGFRLADERRSALLKVLADVGYPHWEETSNPAYEAYLKPKTASAD

SEQ ID NO: 77423 - protein, 352 aa, Brevibacterium sp. HCU
MKAFAMKAQGAALEEIELDRPKPMGREVLLKVTHAGVCHTDTHVQDGGYDLGSRGTLDMSTRGVTYPCVMGHETVGEVVEVGEDVTDVAVGDTCLAFPWIGCGECGKCAHGHENACDNGRALGIIQFGGFAEYLLLPDQRYAIDVAGVDPAWAATLACSGVTSYSSARKATATVNPDEPIGVMGVGGVGMMTVAALVALGHKNIIAIDVSDENLASAQELGATLTVNSKNATSHDLVEAAGGQFIAIIDLVNTGDTVALAFDALSRAGKIVQVGLFGGEFVVPTAIMALKGLTLQGNYVGTVEEVREVVELARQGSLPKLPITGGTLNVDGVNDGLERLRTGRARGRTVLTP

SEQ ID NO: 77424 - protein, 379 aa, Magnaporthe grisea 70-15
MPPPPTPQNELSLVPNISKTTLDSGVTGPGTETSGILRENGKEEAKPQLLPSPKNDASPNIAWSLPTPPLKQRMASGFKSLFESAKKLATGDNGDANSGPAAPHSLFPKTAPAVDGEDCDHDCDSCTVKYPKSFSIDTEDVLYGHVKGWSTHLLVATGKTDWVRDVADEKGSVMQAVEASDKPDNGPPINLPGSVDVVNPDPSLPPPLRTLTSRPCPHSVLVLLCSQRTRDARCGQSAPLLRKELERHLRPLGLYRDLDDERPSGVGIYFISHVGGHKYSANMMIYRRPDPWGLDGVERKTVGDEGIQKLLESGKSKAASAVANGEGADVGAGQCIWLARISPQHCENIVKYTILQGKVVKPETQLRGGFDRQKGLMSW

SEQ ID NO: 77425 - protein, 341 aa, marine gamma proteobacterium HTCC2080
MNQRIAINGFGRIGRTVLRAWTARKSLRQTVSIAAINEIADPETVAHLTQYDSTHGRFPGTVARTDDALIVNGQSIALLRQTHIDKLPWRDLGIDLVIESTGAFSDRVTAEQHINSGARRVLFSQPAQSDVDATIVWGLNQSELQANHQIISAGSCTTNALCPVLKIIDDVFGIEAGTITTVHSAMNDQPVLDAYHHTDLRKTRAAFHSIIPVDTGLAVGIPRILPGLADKLTAHALRVPTLNVSALDITLQTRDNCNAASVNEALIAAAESSLVGILGIATEPLASCDFNGESCSGVVDASQTQVAGDRLVKILVWFDNEWAYAQRLLDIVQYVGALNKS

SEQ ID NO: 77426 - protein, 515 aa, Pseudomonas aeruginosa UCBPP-PA14
MTATPKPLVLIILDGFGHSESPDYNAIYAAKKPVWDRLLATQPHGLISGSGMDVGLPDGQMGNSEVGHMNLGAGRVVYQDFTRVTKAIRDGEFFENPVIAAAVDKAVAADKAVHILGLLSPGGVHSHEDHLVAMAQMAARRGAGKIYLHAFLDGRDTPPKSAQPSLERLDATFAGLGKGRIASIIGRYFAMDRDNRWDRVQAAYELIVDGKAEFTADSSVAALEAAYARGESDEFVKATAVVPAGAEAVRVEDGDAVIFMNFRADRARELSRAFVEPAFKEFPREQAPQLAGFVMLTQYAASIPAPCAFPPEPLTNVLGEYLAKHGKTQLRIAETEKYAHVTFFFSGGREEPYEGEERILIPSPKVATYDLQPEMSAPEVTDRIVEAIEQQRYDVIVVNYANGDMVGHTGVFEAAVKAVECLDTCMGRIVEALDKVGGEALITADHGNVEQMEDESTGQAHTAHTCEPVPFVYVGKRKLSIREGGVLADVAPTMLTLMGLEQPAEMTGRSIVTLG

SEQ ID NO: 77427 - protein, 318 aa, Hevea brasiliensis
MEFPVINLGKLNGEERAATMAKIKDACENWGFFELLNHGIEPEFMDTVERMTKGHYRKCMEQRFKEMVASKGLEGVQTEIKDMDWESTFFLRHLPESNIAQVPDLDDEYRKVMKDFAAKLEKLAEELLDLLCENLGLEKGYLKKAFYGSRGPNFGTKVSNYPPCPKPDLIKGLRAHTDAGGIILLFQDDKVSGLQLLKDGQWIDVPPMRHSIVINLGDQLEVITNGKYKSVEHRVVAQTDGTRMSIASFYNPGNDAVIYPAPALVEKEAEEKKQVYPKFVFEDYMKLYAGLKFQPKEPRFEAMKAVESNVNLGPIATA

SEQ ID NO: 77428 - protein, 384 aa, marine gamma proteobacterium HTCC2080
MKLMHELDLSGKRVLIREDLNVPIKDGRVTSDARLLATLPTIRQALTSGAAVMLMSHLGRPEEGTWEDRFSLAPVAHRLSELLEVEVKLVTDWESAVPQQGQILLLENVRFNSGEKQNSDALGQRYAALCDIFVMDAFGTAHRAQASTHGVARFAAVACAGPLLAAELAALKSALAQPARPMLAIVGGSKVSTKLAVLEQLAKTCDSLIVGGGIANTFLAAAGYPVGRSLHEPDLIDTARELLQKSHIPLPLDVVVAKEFSENATPMLKLASEVAEDDMILDVGPQSASAMVEQLKQAETILWNGPVGVFEFESFSHGTEELARGVAASQAFSLAGGGDTLAAIDQFGVSDQVSYISTGGGAFLEYVEGKTLPAVAILEERALQ

SEQ ID NO: 77429 - protein, 322 aa, Prochlorococcus marinus str. MIT 9313
MPIAADITALVGRTPIVRLNRLPQLSGCHAEVLAKLESFNPTASVKDRIAGAMIQAAEEAGTIAPGRTVLVEPTSGNTGIALAMVAAARGYRLILTMPDTMSTERRAMLRAYGAELQLTPGSDGMTGSIELAKELVATIPEAYLLQQFDNPANPQVHERTTAEEIWNDCEGRLDGLITGVGTGGTLTGCARLLKQRNPSLRVFAVEPALSPVLAGGSPAPHRIQGIGAGFIPSVLDLSLIDEILPVSDDDAMEMGRRLAREEGLLSGVSSGAAVAAALQVGSRAEMVGKRLVVVLASFGERYLSTPMFSAASAVPAQRDGYL

SEQ ID NO: 77430 - protein, 370 aa, Hevea brasiliensis
MATLRNLLKKKSLTSNELAIRRFVSSEAAAESPSFAQRIRDLPKNLPGTKIKTEVSQLIGRTPLVYLNKMSEGCGAYIAVKQEMMQPTASIKDRPAFSMINDAEKKNLITPGKTVLIEPTSGNMGISMAFMAAMKGYKMVLTMPSYTSLERRVTMKAFGAELIVTDPTKGMGGTVKKAYDLLESTPNAFMLQQFSNPANSKIHFETTGPEIWEDTLGHVDIFVMGIGSGGTVSGVGQYLKSQNPNVKIYGVEPAESNVLNGGKPGPHQIMGNGVGFKPDILDMDVMEKVLEVSSEDAVKMARRLALEEGLMVGISSGANTVAALRLARMPENKGKLIVTVHPSFGERYLSSVLFEELRNEAATMQPVPVD

SEQ ID NO: 77431 - protein, 355 aa, Burkholderia thailandensis E264
MDRREQSHHIGRRGGARTPPTRRKRGNLAEPVTFIWRPCAQARPCVLPMSKSARNWGLEQIVADLRESREKLHRTRHPRGIRELPSRDAVCTIVSGLRASMFPTHYGAPDLTDETVDYYVGHTLESTLRLLSEQIRRALRFLPEHAETPLAALDERAFEIAREFGTQLPRIRALLVSDIQAAYTGDPAAQHITEILLCYPGVLAMMHHRLAHALYRLGVPLLARFINEIAHSATGIDIHPGAQIGPSFFIDHGTGVVIGETAIIGERVRVYQAVTLGAKSFPADGDGILVKGNARHPIVEDDVVIYAGATILGRVTIGKGSVIGGNVWLTHSVPPGSSVAQGKIRESDKDQAEKD

SEQ ID NO: 77432 - protein, 370 aa, Hevea brasiliensis
MATLRNLLKKKSLTSNELAIRRFVSSEAAAESPSFAQRIRDLPKNLPGTKIKTEVSQLIGRTPLVYLNKMSEGCGAYIAVKQEMMQPTASIKDRPAFSMINDAEKKNLITPGKTVLIEPTSGNMGISMAFMAAMKGYKMVLTMPSYTSLERRVTMKAFGAELIVTDPTKGMGGTVKKAYDLLESTPNAFMLQQFSNPANSKIHFETTGPEIWEDTLGHVDIFVMGIGSGGTVSGVGQYLKSQNPNVKIYGVEPAESNVLNGGKPGPHQIMGNGVGFKPDILDMDVMEKVLEVSSEDAVKMARRLALEEGLMVGISSGANTVAALRLARMPENKGKLIVTVHPSFGERYLSSVLFEELRYEAANMQPVPVD

SEQ ID NO: 77433 - protein, 251 aa, Arabidopsis thaliana
ADPTHPFASSTAKRGPVPIVKGKKHKPVFPGSSSTKHAPYHPSDQPPRGQVMNRLPSVPASSSEPTNGIDPESFLGRRVRTKWPEDNTFYDAIITQYNPVEGRHALVYDIATPSETWEWVRLSEISPGDIEWIGEDPGLGNRYNGQGHGLNRTTGPNCVPQRGSGLEKNTIRKGFRTSQNGTGKKKHLDIRIRQTDVLIREVERVLRSHNPDPYEVERAKRVLEEHEHALVGAIAKLGDISDGENEGAFRR

SEQ ID NO: 77434 - protein, 337 aa, Bradyrhizobium sp. BTAi1
MSLTFAIPNELAADYRFAPGQYLTLKTMLGGEEIRRSYSICSGPDDNEIRIAVKRVDGGAFSSFVTDELKRGDEIDVMTPTGRFGVALQPEAARTHVGFAAGSGITPILSIVKAVLAREPHSRFFLFYGNRTTAGMLFREQLEELKDRFLERFSVFHVISGEEQDLPILHGRLDGEKVRMLLRSLVPAESVDHVFICGPTGMSEDIEVACRAMGIADERVHIERFVSGSGGKPRPKMVVPDSAPPKAIAALIIDGKRREVPVADGEAILDAALRAGVDLPFACKGGMCSTCRAKLVEGNAEMELNYSLEPWELQAGFVLTCQARPVTERVVVDYDHM

SEQ ID NO: 77435 - protein, 328 aa, Zea mays
MAATLLHAATASLQSSSQPARAGAGAATAFHPLASTPSIRLARSSFSSNRRLEVSLRAVSAGHCFAGRGAPRGRRVVAALAGEQTEGSEVGDDKDNSNEEIKPEEAQEAWKVMLEQFKAEALRMQALSMQAYDVYSKRAREVLLEASEKLKIQADKAQKDLSVIATEVSQEGQEYLVMAARNSPDSIKDIATTFRALGRLNWPSEYEDYHVGIPFGTFLTVGGFLNFMLTGSTSALRFGIVLGLALLTLGISSLRSHREGDRRPRLLVKGQAAIALVIFFREFSVLLQNGWFPKIFIVLLSGVVAAFYFYRIATGNPKDLSSKNDSAN

SEQ ID NO: 77436 - protein, 414 aa, Azoarcus sp. EbN1
MSTSHITVPTGGQKIIPGQPIPDNPIIPFIEGDGIGVDITPVMIKVIDAAVAKAYGGKRKIHWMEVYAGEKSTQVYGPDEWLSKETLDALKEYSVSIKGPMTTPVGGGIRSLNVALRQELDLYQCVRPIQYFKGVPSPLKNPELTNMVIFRENTEDIYAGIEWQADSEQARKVIAFLQNEMGVRKIRFPATSGIGIKPVSVEGTQRLVRAALKYVIDNDRKSLTIVHKGNIMKFTEGLFRDVAYELAQKEFGAQPIDGGPWCKFKNPNTGREIVVKDSIADAFLQQILLRPAEYDVIATTNLNGDYISDALAAQVGGIGIAPGANISDQYACFEATHGTAPKYAGLDKVNPGSLILSAEMMLRFMKWTEAADLVIKGMEAAIGDKVVTYDFARLMEGAQEVSCSAFGDAMIARM

SEQ ID NO: 77437 - protein, 86 aa, Salmonella enterica
VDAMRTRIISMRQTLVKELKAEMPDRNFDYLLQQRGMFSYTGLSAEQVDRLRDEFGVYLIASGRMCVAGLNASNVHRVAKAFAAVM

SEQ ID NO: 77438 - protein, 247 aa, Taxus x media
MAAVKAAVSPSPSPSPKLFGAGKGIGRVSRAALCKPASTFNLLSIKSQPKRSPISIARFDREDEDGVVACKASPSTVTFTTKDASPPALPFRIGHGFDLHRLEPNLPLIIGGINIPHGRGCDAYSEGDVLLHCIVDAILGALGLPDIGQIFPDPDPKWKAATSSVFVNEAAILMPEAGYELGNLDATLILQRPKLRPHKEVIQSNLCALLGASSSVINIKAKTHEKVDSLGENRSIAAHTVVLLMKK

SEQ ID NO: 77439 - protein, 224 aa, marine gamma proteobacterium HTCC2080
MDQQGMKEAVALAALEWVKALPGDNLVLGIGTGSTAECFIRLLPAIKQRINITVSSSQRSAALLQELQIPLGDLNDVGQLDAYIDGADEANQRLQLIKGGGAALTREKIIAAAAKRFLCIADASKKVATLGAFPLPVEVIPMARSFVARELVKLGGQPIWRDGVVTDNGNVILDVHGLSIDHALETEEAINHITGVVCSGLFARRPADVLMLGTPQGVETLQAN

SEQ ID NO: 77440 - protein, 604 aa, Glycine max
MWKLVRYAAASNLARSRRFSAAIPGPCIVHKRGADILHDPWFNKDTGFPLTERDRLGLRGLLPPRVISFEQQYDRFMNSFRSLENNTQGQPDKVVSLAKWRILNRLHDRNETLYYRVLIDNIKEFAPIIYTPTVGLVCQNYSGLFRRPRGMYFSAKDKGEMMSMIYNWPAHEVDMIVLTDGSRILGLGDLGVQGIGIPIGKLDVYVAAAGINPQRILPVMLDVGTNNQKLLEDRLYLGLRQPRLEGEEYLSIIDEFMEAVHARWPKAIVQFEDFQMKWAFETLKRYQKKFCMFNDDIQGTAGVALAGLLGTVRAQGRPLTDFVNQKIVVVGAGSAGLGVLKMAIQAVAKISGCSELAAKSQFYLIDKDGLVTTERNNLDPAAAPFAKNPRDIEGLTEGASIIEVVKKIRPHVLLGLSGVGGIFNEEVLKAMRESVSTKPAIFAMSNPTMNAECTAIDAFKHAGENMVFASGSPFENVDLGNGIVGHVNQANNMYLFPGIGLGTLLSGAHLITDGMLQAAAECLASYMAEEDILKGILYPSVDSIRDVTAEVGAAVLRAAVEEELAEGNGDVGPKELSHMSKDETVEYVRSNMWYPVYSPLVHEK

SEQ ID NO: 77441 - protein, 489 aa, Oryza sativa Japonica Group
MHRAPLHTLAPRRVLPPHALCTIITAMVTTKLARVRRPITLNPKSKRPLPPVVNVIALLEHLPRLCTKGVIPVYKGSVFTVSLFGLKATFLVGPEVSAHFYQGMDSEISQGDLYEFTVPLFGKGVGFDIDNATRTEHLRFFIDAIKTSKLRNHVNSMVQEVEDYFAKWGENGIVDIKHEFEKLLMLISGHCLLGKEVRDNMFDEVFSLFHELDSGVGLGSVIFPYIPIPSHIRCDKAHAKLAKIFSKIVRSRRDSNRPAEQDVLQYLIDSKHRDGNSTTEQEVTGWIISMVFAGKHTSTNSTTWTGACLLTHDKFLTEALDEQKHMIQKHGDHIDYNVLLDMDILHCCIKEALRMHPVAPIIYRKAQKSFVVRTREGDAYDIPEGHNLLSPMIFNNRLPYIYKDPHMYDPDRFAPKREEDKVGGMFSYTSFGGGRHICIGEAYAYMQIKVIWSHLLRNFELKLESPFPKTNWSKILLEPWGKVMARWQG

SEQ ID NO: 77442 - protein, 540 aa, Triticum aestivum
MQLSRLNQHTFLSLLKAAASVSSRRLPSLHAVYIKLGFLAHTRVTNGFIQGYCATRRVTDARRVFAEMPRQDTVSFNSMIHGYAVSGDVASACRLFEQVPAPTPVTWTSMVAGLCRAGDVGSARRVFDKMPERDLVSWNAMISGHVGNRQPVEALCLFGRMMKEGFVPNRGTVVSALSACASAGALETGKWVHVFIEKNRLRWDEFLGTALIDMYAKCGAVELALEVFASLRARNTCTWNAMINGLAMNGYSAMALDMFRQMELDGRVVPDEVTFVGVLLACSHGGSVDAGREHFNMISKKYGIGLILEHYACMVDLLARSGHLQEAHKLITEMPMKPDVVIWRALLGGCRLHKNVKMAEIVITEMAATCSGDHVLLSNLYAAVGRWNGVEDVRRTMRSKGIEKIPGCSSVEMDGSIHEFISGDKSHPSYDDIHAKLIEIGGRMQQQGHVTEITEVFYDIEDEEKEQALGHHSEKLAIAFGLIGGPPDATIRIVKNLRFCMDCHKFAKLVSKIYQREIVVRDRARFHHFRGGTCSCNDFW

SEQ ID NO: 77443 - protein, 131 aa, Debaryomyces hansenii CBS767
MSGGKGKAGSSEKASTSRSAKAGLTFPVGRVHRLLRKGNYAQRVGSGAPVYLTSVLEYLAAEILELAGNAARDNKKSRIIPRHLQLAIRNDEELNKLLGHVTIAQGGVLPNIHQSLLPAKKAKAGNASQEL

SEQ ID NO: 77444 - protein, 415 aa, Magnetospirillum magnetotacticum MS-1
HLLDPAPATPYDVEAIRAEFPILSEKVYGKPLVYLDNAASAQKPRAVIDAMVSCMETGYANVHRGLHYMANAATEGFEGARETTRQFLNARSTDEIIFTRNATEAYNLVASSMGWAGLIGEGDEIILSIMEHHSNIVPWHFLRERRGAVIKWAPVDDDGNFLVEEYEKLFSPRTKMVALTHMSNVLGTVTPGEEIVRIAHAHGVPVLLDGAQSAVHRPIDVQALDCDFFVFTGHKVYGPTGIGVLYGKKEWLDRLPPYQGGGEMIRTVTQDAITYNDPPHRFEAGTPAIIEAVGLGAALEFMMKLGRENIAAHEAMLTAYAQERLGAMNSVRQIGHSRNKGGVIAFEVKGAHAHDIATVIDRQGVAVRAGTHCAMPLLTRFGVTSTCRASFGLYNTTQEIDALAEALAKAETLFA

SEQ ID NO: 77445 - protein, 113 aa, Oryza sativa Japonica Group
MKEATSSGGGGGGGAGVNDPRQPSTARQYTPPKLSPQDLPIDYAGFLAVVFGVLGVMLRYKVCSWIAIIFCAQSLVNMKNFENDLKQLSMAFMFAVMGLVTNYLGPPRPGTKR

SEQ ID NO: 77446 - protein, 400 aa, Zea mays
YRFLVDGVWRCDETKPFVRDEYGLISNEVLVENNVLPVVQPEPSIRGTNMDKGTILKTMPLEPSSQNPSMQIAVIRHVVSGILLHNTIYDVVPLSSKLTVLDTQLPVKQAFKIMHDEGLALVPLWDDRQGTITGMLTASDFVLILRKLQRNIQVIGNEEPISAWKEAKLQFYGGPDGAAMQRRPLIHVKDSDNLVDVALTIIRNEISSVPIFKCMADSSGVPFLNLATLQGILKFLCSKLQEEAEGCSLLHNQLLSIPIGTWSPHTGRSSSRQLRTLLLSSPLNTCLDILLQDRVSSIPIVDDNGSLRDVYSLSDIMALAKNDVYARIELEQVTVQNALDVQYQVHGRRQCHTCLQTSTLLEVLEGLSIPGVRRLVVIEQSTRFVEGIISLRDVFTFLLG

SEQ ID NO: 77447 - protein, 351 aa, Vitis vinifera
  misc_feature (113)..(113): Xaa can be any naturally occurring amino acid
  misc_feature (143)..(143): Xaa can be any naturally occurring amino acid
MDKLLRLLFILFLITLPTLVLGDCTCDKDDGDRDKNKALRYKIAAIIAILAGGAIGVCIPILGKTIPALHPEKNVFFIIKAFAAGVILATGFIHVLPDAFENLTSPCLNENPXGDFPFTGFVAMVSAIGTLMVDACATSYYSXSHFKKAQQAVGDEEKAGEHEGHVHVHTHATHGHAHGSASSAEEMGSAELIRHRVISQVLELGIVVHSVIIGISLGASESPKTIKPLVAALTFHQFFEGMGLGGCIVQAKFKLRAAAIMALFFSLTTPVGIAIGIGISNVYDENSSTALIVEGIFNAASAGILIYMALVDLLAADFMNPRMQGNGRLQVGANISLLVGAGCMSLLAKWA

SEQ ID NO: 77448 - protein, 524 aa, Propionibacterium freudenreichii subsp. shermanii
MAENNNLKLASTMEGRVEQLAEQRQVIEAGGGERRVEKQHSQGKQTARERLNNLLDPHSFDEVGAFRKHRTTLFGMDKAVVPADGVVTGRGTILGRPVHAASQDFTVMGGSAGETQSTKVVETMEQALLTGTPFLFFYDSGGARIQEGIDSLSGYGKMFFANVKLSGVVPQIAIIAGPCAGGASYSPALTDFIIMTKKAHMFITGPQVIKSVTGEDVTADELGGAEAHMAISGNIHFVAEDDDAAELIAKKLLSFLPQNNTEEASFVNPNNDVSPNTELRDIVPIDGKKGYDVRDVIAKIVDWGDYLEVKAGYATNLVTAFARVNGRSVGIVANQPSVMSGCLDINASDKAAEFVNFCDSFNIPLVQLVDVPGFLPGVQQEYGGIIRHGAKMLYAYSEATVPKITVVLRKAYGGSYLAMCNRDLGADAVYAWPSAEIAVMGAEGAANVIFRKEIKAADDPDAMRAEKIEEYQNAFNTPYVAAARGQVDDVIDPADTRRKIASALEMYATKRQTRPAKKHGNFPC

SEQ ID NO: 77449 - protein, 425 aa, Nitrosomonas europaea ATCC 19718
MLIEVKVPALSESVAEATLINWHKQPGEYVERGENLIDIETDKVVLELPAPQSGILAEIIRNDGATVTSGEIIARIDTAAKETKTAAQQPAPIDSGHLEITESTVASMHPAQPLMPSAKKAAEENGLTMEEIAAIHGTGRGGRITRQDVLAHVRNKNSAVTDQQSDSRTDQSAAGIPQADTSPIPVDQTEKPDRLEKRVPMTRLRMRIAERLVQSQSTAAILTTFNEVNMQAIMDLRARYKDSFEKEHGIKLGFTSFFVKAVVAALKKFPIINASVDGNDIIYHDYYDIGIAVASPRGLVVPIIRDADKLTFAGIEKQIADLARRAQEGKLTLEELTGGTFSITNGGVFGSMLSTPIINPPQSAILGIHATKQRPVVENGQIVIRPINYLALSYDHRIIDGREAVLSLVAIKEALEYPVSPLFEG

SEQ ID NO: 77450 - protein, 347 aa, Sulfolobus sp. RC3
MRAVRLVEIGKPLVLKDIDIPKPKGAQVLIKVEAAGVCHSDVHMRQGRFGNLRIVEDLGVKLPVTLGHEIAGKIEEMGDEVVGYSKGDLVAVNPWQGEGNCYYCRIGEEHLCDSPRWLGINFDGAYAEYVLNPHYKYMYKLRRLNAVEASPLTCSGITTYRAVRKASLDPTKTLVVVGAGGGLGTMAVQIAKAVGGATIIGVDVREEAVETAKRAGADYVINASVQDPLAEIRRITEGKGVDAVIDLNNSEKTLSVYPKALAKQGKYIMVGLFGADLHFHAPLITLSEIQFVGSLVGNQSDFLGIMRLAEAGKVKPMITKTMKLEEANEAIDNLENFKAVGRQVLIP

SEQ ID NO: 77451 - protein, 561 aa, Synechococcus elongatus PCC 7942
MTLPEDFQFDAIADAIAEIKAGRSVVVVDDENRENEGDLICAAQFATPEMINFMAVEARGLICLAMTGDRLDQLDLPLMVDRNTDSNQTAFTVSIDAAPHLGVSTGISAEDRARTIQATINPLTKPHDLRRPGHIFPLRSREGGVLKRAGHTEAAVDLARMAGLYPAGVICEIQNPNGSMARLPDLIDYARQHRLKLISIADLISYRLQHERFVIRETIATLPSEFGQFTIFAYRNSLDGSEHVALVKGDPSRFSQQPVMVRVHSECLTGDAFGSLRCDCRMQLQAAMKMIENAGQGVIVYLRQEGRGIGLINKLKAYSLQDLGLDTVEANARLGFPADLRNYGVGAQILNDLGVTRIRLITNNPRKIAGLKGYGLEVVDRVPLLIEATPYNSSYLATKGEKLGHLLLKTHLAAIALHLTPELQNNPYRQTLIGQIRSLVQGEGLFLQEELRSVASALFGPQVLTLQVGLAQSEAIAADWYRSPDSPLADQLQHCLEQMAAIDGLEDLEFLLADGHDPLTSLQVQLDRQSLPLPDLSRQFKTLKLQQIYHLQLQERPSFVS

SEQ ID NO: 77452 - protein, 362 aa, Bradyrhizobium sp. BTAi1
MRIRSMSKKPYRIAVIPGDGIGKEVMPEGLRVIEAAAKKHGVAVQFDHFDFSSYDYYEKHGQMMPDDWKAQIGSHDAIYFGAVGWPAKIADHVSLWGSLIKFRREFDQYVNLRPVRLMPGVPSPLAGRKPGDIDFWVVRENTEGEYSSVGGRMFPDTDREFVTQQTVMTRTGVDRILKFAFELAQSRPKKHLTSATKSNGISITMPYWDERVEAMAKNYPGVKWDKYHIDILTANFVLHPDWFDVVVGSNLFGDILSDLGPACTGTIGIAPSGNINPERNFPSVFEPVHGSAPDIAGQGIANPIGMIWSGAMMLEHLGEKTAAQAIVGAIERTLAERTLRTRDLGGNADTEACGKAVAEMVD

SEQ ID NO: 77453 - protein, 471 aa, Cryptococcus neoformans var. neoformans B-3501A
MAPITVKKICCIGAGYVGGPTCAVIALKCPQIQVTIVDLNQQRIDAWNSDNLPIYEPGLDEVVKATRGKNLFFSTDVDKGIEDADLIFVSVNTPTKKSGVGAGYAADLKFLQLATRRIAEVATSSKIVVEKSTVPCRTAESMRTILEANCRPGCHFDILSNPEFLAEGTAISDLFNPDRVLIGSLQTEQGIDACQALSGVYANWVPKERILTVGLWSSELSKLAANAMLAQRISSVNALSAICEATGANIDEVSYAVGKDTRMGSKFLKASVGFGGSCFQKDILNLVYLSESLHLPEVAKYWRAVVEMNEYQKSRFARKVVDTLFNTITGKKIAILGWAFKKDTGDTRESPSIGIANHFLSEKARIAVYDPQVTESQIWLDMTDVRSYGEIPAEPIQPHLTICKSVEEACANAEAIVICTEWDEFKTLDWKKIYDNCPRPAFVFDGRLILNRQELTNIGFKVVTIGTGDRI

SEQ ID NO: 77454 - protein, 337 aa, Arabidopsis thaliana
MKLVNNTVCQMIMGRSCSEENGEAERVRGLVTKTDALTKKFILAGILRKPLQKIGISLFKKELMDASCKFNEVLEKILVEYKEKVEEHHQGTDMMDKLLEVYGDEKAEYKITRDHIKSLFVDLFFAGTDTWTHAIQWIMAEIINNSYILERLREEIDSVVGKTRLIQETDLPNLPCLQATVKEGLRLHPPVPLVLRTFKEGCTIGGFYVPEKTTLVVNGYAMMRDPEYWEDPQEFKPERFLASSRSSQNDEIRDELLKYLPFGNGRRACPGANLADISVGTAIGVMVQCFDWEIKGDKINMDEAPGKITLTMAHPLNCTLVPRTLIPVTSTVQIPSS

SEQ ID NO: 77455 - protein, 426 aa, Pyrococcus abyssi GE5
MEPATWILFTIGVALILAKIGDAIIERFELPGVLGELIMGMLLGNLVYFGIVSKDYLPITMGSSEVIDFLAKLGIIFLLFLGALDTDVEQLKKTGLTATISTLMGVFVPLILGYFALRYMGYSHREAFAGGVLLTATSIGLTVRVMMDLGVLRSEVGAASLSASVMDDFLGIALIIFAVGSGSLLGLSMKIIAFFIITGILGWYSIDKYIRFAERLHVEKGILGMAVGMMFLFAALAEGWFAAAIEGSFMMGLILSKLPEGKRIMEEVRSIGYGLLIPIFFIHTGAMLNLTVFRNADAIKLALVLSTIAVIGKVAGRGFGAWITAWGRGRDFLFTRENFKMSLQMGIGSIPRTEVALVDLMVAIHGGAISPDDVPKFIAATLIFITVSVLITPPLLKWAFREEVEAQRKARIESRKERIEKKKKAR

SEQ ID NO: 77456 - protein, 420 aa, Pyrococcus abyssi GE5
MVEQDPFEIAVKQLERAAQYMKISEEALEFLKRPQRIVEVTIPVEMDDGSVKVFTGFRVQYNWARGPTKGGIRWHPEETLSTVKALAAWMTWKTAVMDLPYGGGKGGIIVDPKKLSDREKERLARGYIRAIYDVISPYEDIPAPDVYTNPQIMAWMMDEYETIARRKTPAFGIITGKPLSIGGSLGRNEATARGASYTIREAAKVLGWDDLKGKTIAIQGYGNAGYYLAKIMSEDYGMKVVAVSDSKGGIYNPDGLNADEVLKWKREHGSVKDFPGATNITNEELLELEVDVLAPAAIEEVITKKNADNIKAKIVAEVANGPVTPEADEILFEKGILQIPDFLCNAGGVTVSYFEWVQNITGYYWTLEEVREKLDKKMTKAFYDVYNTAKEKNIHMRDAAYVVAVQRVYQAMLDRGWVKH

SEQ ID NO: 77457 - protein, 173 aa, Pyrococcus abyssi GE5
MVVYELNGKKPKIHPSAFIDESAVVIGDVVLEEKTSVWPSAVLRGDIERIYVGKYSNVQDNVSIHTSHGYPTEIGEYVTIGHNAVVHGAKIGNYVIIGIGSVILDGAKIGDHVIIGAGAVVPPNKEIPDYSLVLGVPGKVVRQLTEEEIEWTKKNAEIYVELAEKHLKGRRKL

SEQ ID NO: 77458 - protein, 259 aa, Magnetospirillum magnetotacticum MS-1
MSGTDTGTAETETTADFGYERVRLSEKQGRVDEVFRSVARRYDLMNDLMSGGLHRAWKSHLISMLRPSRTRPYRHLDVAGGTGDIAFRTLAAGGPETHVTVLDINEAMLRVGAERAGQKYDGRIDFVTGNAETLPLPSGHFDSYTIAFGIRNVPRIDLALREAHRVLKPGGRFLCLEFSRVDLPVLEKIYDAYSFHVIPRIGERVAGDRESYQYLVESIRKFPSPDSFARMIEAAGFAHVSHRRLSGGIVAIHSGWKIS

SEQ ID NO: 77459 - protein, 632 aa, Acidobacteria bacterium Ellin345
MSYQVLARKYRPQKFSEVIGQDHVTRTLKNAIEQQRIAHGYIFSGHRGIGKTTIARILAMALNCQSADHPVSEPCGVCDSCKEVKAGQSVDVIEIDAATNRGIDEIRELREAARYRPARDRFKIYILDEAHQITDAAFNALLKTLEEPPGHIVFMMATTEPEDIPQTIRSRCQHFSFHAVKFDDIVLQLRDIAGKEGIGAEDDALAMLAEAGDGSMRDALSIMDQAIAACGNQLKTDDVRGLMGTVSSDVLEDIMNGVHANSSESVLTTIDKLLIEGHSPLHFAKQAVRFLRNAMVAKVAGKDSALLQISSDERERVARVAEQFSEEDLARFLQIMLRTHSDLGYKQEQRFHLELGLLKLVHAQRMLPLEELLSGSASAAPSSAPRASVAAPVSRPSSPAPSAATSRPSPFESSRTAAAPRPSPFEVDRARKNEPKAEADAEITAKTPEFTAPAAPTPMSAAPARGYEPQSAPAPMVTSSVGSAVAVAEVAPPPPAAAPAGETNIPAIRDAVLNELETAGQNVLVHTLETGVWAANANEITVKVALSPAMIDLSMGPEVKKLVTAAVNKATGRPLKFSMVGGADPATLAKPAPRTAVGPSARSRAMQHPLVNYMQEKFGAEVRTVIDKKEER

SEQ ID NO: 77460 - protein, 140 aa, Oryza sativa Indica Group
MAWEVLKRHFSRKRAVDVRRINPKVPKEEAVAISGRLLQIFTDHGPLTVGNTWNHAKDAGISGLNSKTHMKILLKWMTGRRIVKLNCVGTGNSKKFLYSPYSADADKSEEAAAEELSKAAASQGGKATKGQQKKRATALH

SEQ ID NO: 77461 - protein, 187 aa, Zea mays
MTPPAAASPGRKSPAAVLFLCVVTISLLMFILLASYTPRLQPHGRSPHRRLKLHPKNSAAVASSYGAGAVHDSGGNRHAAPFDPAIAELERRLEDKEWEREHYRILHGDAEKDDHMKEWEEFLKEEEDFINDDDRFNVSDRIRALFPKIDLSPKDGFVSLDELIRWNLDQARSDQLHRSAREMELYD

SEQ ID NO: 77462 - protein, 176 aa, Vitis vinifera
  misc_feature (55)..(55): Xaa can be any naturally occurring amino acid
MEKEMIAKSFISSAAYAPSLLPLLSPSRNLNFRCLSPLKANPQRCVVGGTKRLCXVVAARGNLESTGVPTSVPVRVALELLQAGHRTPEEFSAGHASGAINVPYMLRFGSGMAKNPKFLVEVSSHFRKDDEIIVGCQKGKRSLMAVNDLLAAGFTAVTDIAGGYDAWSQNGLPTDS

SEQ ID NO: 77463 - protein, 263 aa, Prunus ilicifolia
AHYKTEVDVGNAIAEAIRSGLVKREELFITSKASNHGHVVEACKNSLEKLQLDYLDLYLVHYPLATKHSGVGTTASLLDENKVLDIDVTVSLESTWHDMEKTVSLGLVRSIGLSNYELFLTRDCLSYAKIKPQVSQFETHPYFQRESLVRFCKKHGVTPMAHTPLGGATANVKSFGSISPLEDPVLLGLAKKYKKSVAQIALRWNIERDTPVIPKSSKVERLKENLEVLNFKLEKEDIELINTIDKKSRTTLPSKTWGLDVYA

SEQ ID NO: 77464 - protein, 275 aa, Bradyrhizobium sp. ORS278
MTSVGNNELQHTTGTIVLAGAGKMGGAMLSGWLAGGLDPARVVVIEPMPSAEITALVAKGVRLNPADAAPAEVVILAVKPQMFREAGPALKRWVGGATLVLSIMAGTTIASLQDVVGGAVVRAMPNTPAAIGRGITVAVPAANVSASQRALTDALLRATGAVEWVDDEMLMDAVTAVSGSGPAYVFLLAEELARAGVAAGLPEALATKLARDTVSGAGELLHRSDLSSATLRRNVTSPGGTTAAALSVLMAADGFQPLLERAVAAATARSKELAK

SEQ ID NO: 77465 - protein, 250 aa, Prunus andersonii
LKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVNAFGSISPLEDPVLIGLAKKYQKSVAQIALRWNIERGTPVIPKSSKVERLKENLEVLNFKLEKEDIELINTIDKKSRTTL

SEQ ID NO: 77466 - protein, 272 aa, Fulvimarina pelagi HTCC2506
MVQRNASKLTAVRDVDPIWNSLREEAAAMAKAEPTLAGFVYATILNQNSFEAALAHRIAQRMDHGDVPAYMITQAFEQMFDDDPELSEIIRTDIQAVLDRDAACDRYIEPLLYFKGFHALQTHRLAHWLWKHERRDFALFLQSRSSSVFQCDINPCARFGRGIFLDHSTGIVVGETAVVADDVSILQEVTLGGTGKEDGDRHPKVGKGVLIGAGAKILGNIKIGDCSKVAAGSVVLRDVPQYSTVAGVPARVVVVRKGCEPPARVMDQRIER

SEQ ID NO: 77467 - protein, 170 aa, Zea mays
MAPTVMMASSATAVAPFQGLKSTASLPVARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 77468 - protein, 154 aa, Triticum aestivum
  misc_feature (69)..(69): Xaa can be any naturally occurring amino acid
  misc_feature (84)..(84): Xaa can be any naturally occurring amino acid
  misc_feature (96)..(96): Xaa can be any naturally occurring amino acid
  misc_feature (118)..(118): Xaa can be any naturally occurring amino acid
  misc_feature (127)..(127): Xaa can be any naturally occurring amino acid
  misc_feature (145)..(145): Xaa can be any naturally occurring amino acid
RAPFALFDPSKKTAAEMVYYALLVGAELDGLTNLQPSGGCDDPSFPYYLKLKCENCGEVTAKSTYVTLXEQVDLPKGHGTAHLXVQKCKLCGRDGXQLVMIPGSRGRHFTIEQEPRKXEKTCLMGVXDCRGYEPVEFLLGAGWKXDPVHGPFGN

SEQ ID NO: 77469 - protein, 440 aa, Arabidopsis thaliana
MKLLHLIFLLALTTGISAVLIYIIGVSNLYESNRFTNEDLEALQSLQNGFQKCVSANGLGLQAAMGRDYCKVSINFPKDTVPKWKDPKSGELEGLSYEFDLCEAVATWEQVRNSSTILTKEYIDALPNGWEDYAWRRINKGIQLNRCQNKSLCIEKLSLVLPETPPYFPRQFGRCAVIGNSGDLLKTKFGKEIDTYDTVLRENGAPIQNYKEYVGEKSTFRLLNRGSAKALDKVVELDEKKQEVLLVKTTIHDIMNKMIREVPIKNPVYLMLGASFGSAAKGTGLKALEFALSTCDSVDMYGFTVDPGYKEWTRYFSESRQGHTPLHGRAYYQMMECLGLIKIHSPMRADPNRVVKWVPSRSTIRSARIAAEKLLRRVGAGSADPLASCSIVKKRNKNKRPMVSHLRKPVSDHQKFVRSTSMYPVEHSPGHGQLCITPAD

SEQ ID NO: 77470 - protein, 171 aa, Pinus taeda
MPNPKVYFDMSVGGAPAGRIVMELFADVTPKTAENFRALCTGEIGVGKSGKPLHYKGSAFHRVIPGFMCQGGDFTAGNGTGGESIYGNKFPDENFVKKHTGPGILSMANAGKNTNGSQFFICTAKTEWLDGKHVVFGQVVEGLDVVKAIEGVGSSSGRTSKPVVIADCGQL

SEQ ID NO: 77471 - protein, 379 aa, Oryza sativa Japonica Group
MATAGKVIKCKAAVAWEAGKPLSIEEVEVAPPQAMEVRVKILYTALCHTDVYFWEAKGQTPVFPRILGHEAGGIVESVGKGVTELAPGDHVLPVFTGECKEFDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 77472 - protein, 412 aa, Oryza sativa Japonica Group
MATAGKVIKCKAAVAWEAGKPLSIEEVEVAPPQAMEVRLKILYTALCHTDVYFWEAKGQTPVFPRIFGHEAGGIVESVGEGVTELSPGDHVLPVFTGECGDCRHCLSEESNLCDLLRINTDRGAMIGDGQTRFTARGGQPVYHFLGTSTFSEYTVVHVGCVAKIHPAAPLDKVCVLSCGISTGFGATVNVAKPPKGCTVAIFGLGAVGLAAMEGARISGASRIIGVDLNPAKFELAKKFGCTDFVNPKDYDKPVQQVIIEMTNGGVDRSVECTGNAAAMISAFECVHDGWGVAVLVGVAGKDAAFKTHPTNFLNERTLRGTFFGNYKPRTDLPGVVEMYMNKELELEKFITHSVPFSEINTAFDLMLSGESSAAASGWRTSHPDRCRRRRIDGGGDCINGENKRLKLPMLQQ

SEQ ID NO: 77473 - protein, 443 aa, Populus trichocarpa
MHNFEIRPLPGRPTRGWNRAGLKKKIGKGKTQCDPAEPAGGGPVVKTWDQEVCSLCGLRFEPCGYLYDGHWRLTWSLTSGPMGLVEVVRETWGMSGKRVKDYSLYTGALGTAYLLFKAYQVTKNQNDLNLCSDIIKACDSVSRDSGRVTFICGLTGCGRAGVCALGAVAAKHAGDGRLLDHYLAQFKEIKLPSDLPYELLYGRAGFLWACSFLNKHIGKETISTSRKRAVVDEIIKAGRLARKGKCPLLYEWHGKRYWGAAHGLAGIMLVLMDLELTPDEVEDVKGTLHYMIKNHFPSGNYPSSEGNKSDCLVHWCHGAPGIALTLAKAAEVFGDKEFLQAAMEAGEVVWNRGLLKRVGICHGISGNTYVFLSLYRLTGNVEYLYRAKAFACFLHDRAQKLVSEGKMHGGDRPYSLFEGFGGMAYLFLDILEPSEARFPAYEL

SEQ ID NO: 77474 - protein, 247 aa, Brassica napus
MADSTQPLLSDSNSSGSKLPPPRTLDETIEQCIGDFGWAQFLQAVLVSFAWVFDAQQTFITVFTDSQPTWHCLDSDRCNSSSNFCTLPNQTWSWDFNPHVSTISEWGLQCAGSLVKGLPASSFFLGCLVGGLALSTLADSSLGRKNMLLLSCLIMSLSSMLTAFSTSIWVYAFLRFLNGFGRATVGTCALVLSTELVGKKWRGQVGAMGFLCFTLGFLTLPLLGYINKRNSWRYLYVWTSIPTLIYC

SEQ ID NO: 77475 - protein, 338 aa, Microcystis aeruginosa PCC 7806
MASPKDFISPVNSEQELVYPFRNYLNYLHAKYSDLQTGNIADYIPELALAAPEWFGISVISTDGQIFEVGDCQQTFTVQSISKAFVFGLALEDHGREYVNSKVGVEPTGEAFNSIILDEKTNRPYNPMVNAGAIATTDLITGQNATERLKRILEMFKRYTGRDHGINVPVFLSEKSTGNRNRAMAYLMLNFGMVSDKIEETLDLYCQQCAILVHAHDLALMAATLANGGVNPITGIRAIDEHYVQDVISVMLTCGMYDASGEWAYRVGLPAKSGVGGGITAVVPHQLGIGTFSPLLDEKGNSIRGVKICQDISEDFGLHLFNVAKPERDLKTWLEGNS

SEQ ID NO: 77476 - protein, 167 aa, Brassica napus
MAAKQSYFFLFLSLVPLCSSTTHDVINPPTVFPTNPTTTPPATTFPPVTITPTNPSPALPLNPPVTVVPPTLTPPVTTNPVTQYPPTQPSGTVPVIPPPVVSTSPSVSGQSWCVAKPGASQTSLQLALDYACGSGKADCSQIQQGGSCYSPISLQNHASFAFNSYYQ

SEQ ID NO: 77477 - protein, 138 aa, Sulfolobus solfataricus P2
MVAQRTFVMIKPDGVKRGLIGEIISRFEKRGLKIVSLKMVKMSRDTAEKLYEEHKGKSFFEELVNYVTSGPVVCMVIEGDDVVQVIRRMIGNTDPKEAPPGTIRGDYALSKSENVIHASDSIEKAQREMSLFFDKSDL

SEQ ID NO: 77478 - protein, 220 aa, Vitis vinifera
MVGQQSLIYSFVARGTVILAEYTEFTGNFTSIAAQCLQKLPASNNKFTYNCDGHTFNYLVENGFTYCVVAVESAGRQIPIAFLERVKDDFNKRYGGGKAATAVANGLNKEFGPKLKEHMQYCVDHPEEISKLAKVKAQVSEVKGVMMENIEKVLDRGEKIELLVDKTENLRSQAQDFRQQGTKMRRKMWMQNMKIKLIVLGIIIALILIIVLSICHGFKC

SEQ ID NO: 77479 - protein, 216 aa, Sulfolobus solfataricus P2
MPLYVIDKPITLHILTQLRDKYTDQINFRKNLVRLGRILGYEISNTLDYEIVEVETPLGVKTKGVDITDLNNIVIINILRAAVPLVEGLLKAFPKARQGVIGASRVEVDGKEVPKDMDVYIYYKKIPDIRAKVDNVIIADPMIATASTMLKVLEEVVKANPKRIYIVSIISSEYGVNKILSKYPFIYLFTVAIDPELNNKGYILPGLGDAGDRAFG

SEQ ID NO: 77480 - protein, 358 aa, Frankia sp. EAN1pec
MGLSIGIVGLPNVGKSTLFNALTRNEVLAANYPFATIEPNVGVVGVPDPRLAKLGEVFSSARVVPATVSFVDIAGLVRGASEGQGLGNRFLANIRESDAICQVVRVFSDPDVVHVEGTVDPSADIETINTELVLADLQTIGARLPKLEKEARLDRSKQSLLAAMKAAHEVLDAGRPLSSEPSIDRAELRELFLLTAKPFLYVFNVDEDVLADPGRHKELADLVAPADAVILCAKVEAELIELPEADAAELLASLGQEESGLVQLARIGFHTLGLQTYLTAGPKESRAWTIPAGATAPEAAGVIHSDFQRGFIKAEIVSYDDLMAAGSMAAARAAGRVRMEGKDYVMADGDIVDFRFNV

SEQ ID NO: 77481 - protein, 251 aa, Prunus andersonii
AHYKSEADVGNAIAEAIQRGLVKREELFITSKASNHGHVVEACKNSLKKLQLDYLDLYLVHYPLATKHSVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVNAFGSISPLEDPVLIGLAKKYQKSVAQIALRWNIERGTPVIPKSSKVERLKENLEVLNFKLEKEDIELINTIDKKSRTTL

SEQ ID NO: 77482 - protein, 505 aa, Alteromonas sp.
MIYAKPGSEGSVVSFKESYGNFINGEWVAPVKGEYFTATSPVDGSDIAQVPRSTSEDVELALDAAHAAKKGWAEKSVAERSNVLLKIADRIEENLELLAVAETWDNGKAVRETLNADIPLCADHFRYYAGCIRSQEGTIGEIDKNTVAYHFHEPYGVVGQIIPWNFPLLMAAWKLAPALVTGNVVVLKPAEQTPVSILLFAELIQDLLPPGVLNIVNGFGAEAGQALATSTRIAKIAFTGSTPVGGHILRCAAENLIPSTVELGGKSPNLFFADIMDHEPEFIDKCAEGLVLGYFNQGEVCTCPSRAIIQEDIYDAFMEKVLEKIQKIKRGNPLDTETMVGAQASNEQFEKILKYIDIGKSEGAQVVTGGEKEQLPGFDDGYYIQPTILKGENHMRVFQEEIFGPVIAVQTFKTEEEAIEIANNTSFGLGAGVWSRDANVAFRVGRAIEAGRVWTNCYHLYPAHAAFGGYKKSGIGRETHKMMLDHYQQTKNLLVSYDINPLGFF

SEQ ID NO: 77483 - protein, 252 aa, Prunus mexicana
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNLERGTPVIPKSSKVERLKENLEILNFKLEKEDIELINTIDKKSRTTL

SEQ ID NO: 77484 - protein, 289 aa, Oryza sativa Japonica Group
MEGKEEDVRPRANRYSERQPIGTAAQGAGDDKDYKEPPPAPLFEPGELKSWSFYRAGIAEFVATFLFLYITILTVMGVSKSSSKCATVGIQGIAWSFGGMIFALVYCTAGISGGHINPAVTFGLFLARKLSLTRAIFYIVMQCLGAICGAGVVKGFQQGLYMGNGGGANVVASGYTKGDGLGAEIVGTFILVYTVFSATDAKRNARDSHVPILAPLPIGFAVFLVHLATIPITGTGINPARSLGAAIIYNKDHAWNDHWIFWVGPFVGAALAAIYHQVIIRAIPFKSRS

SEQ ID NO: 77485 - protein, 251 aa, Prunus fasciculata
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVSLGLVRSIGLSNYELFLTRDCLSYAKIKPQVSQFETHPYFQRESLVRFCQKHGVVPMAHTPLGGATANVKAFGSISPLEDPVLIGLAKKYQKSVAQIALRWNIERGTPVIPKSSKVERLKENLEVLNFKLEKEDIELINTTDKKSRPL

SEQ ID NO: 77486 - protein, 392 aa, Prochlorococcus marinus str. MIT 9313
MKAMILAAGKGTRVQPITHVIPKPMIPILQKPVMEFLLELLKEHGFKEVMVNVSHLAEEIENYFRDGQRFGVEIAYSFEGRIEEGELIGDALGSAGGLKKIQDFQQFFDDTFVVLCGDALIDLDLSEAVKRHRAKGALASLVTKRVPKDQVSSYGVVVTDENDCVQAFQEKPSTDAALSDTINTGIYLFEPEIFEHIPSDQPFDIGSDLFPKLVEMGLPFFALPMDFEWVDIGKVPDYWRAIRSVLQGEVRQVGIPGKEVRPGIYTGLNVAANWDKINVQGPIYVGGMTRIEDGATIIGPSMIGPSCCICEGATVDNSIIFDYSRIGAGVQLVEKLVFGRYCVGKNGDHFDLQEAALDWLITDARRQDLVEPSPQQKAMAELLGTDLTPAPS

SEQ ID NO: 77487 - protein, 252 aa, Prunus fasciculata
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVSLGLVRSIGLSNYELFLTRDCLSYAKIKPQVSQFETHPYFQRESLVRFCQKHGVVPMAHTPLGGATANVKAFGSISPLEDPVLIGLAKKYQKSVAQIALRWNIERGTPVIPKSSKVERLKENLEVLNFKLEKEDIELINTIDKKSRTTL

SEQ ID NO: 77488 - protein, 601 aa, Erythrobacter sp. NAP1
MTDSDPDLPDTEEETAPSAAELEAAGQDSMFGGDDVGATGPATPDSAETKAEPAPRDEGAQPYRVLARKYRPQTFSELVGQEPMVRTLANAIERDRLAHAFLMTGVRGVGKTSTARLIAKALNCVGPDGNGGPTIDPCGVCEFCTAIAEGRHIDVIEMDAASHTGVDDVREIIEQVRYAAVSARYKIYIIDEVHMLSRNAFNALLKTLEEPPAHVKFLFATTEVEKLPVTVLSRTQRFDLRRIPASLLAEHFGNVCKAEGVEAEEEALRIIAAAAEGSARDGLSILDQAIAHADMDTEGKVTAERVRSMLGLADKSAQRRLLGTVLEGDAKGLLAGVDEQYALGVEPLALMRALMDLVHRVTVAQVSGGEPDAPSEEERTALAEFASKLGAPELHRLWQLLLKGHEEVRTSPDPLVALQMALLRVLHAAQMPDPGKLAARIEEMAKNGVSAAPAETGGESAPAPTASSSVYASFEWGALVDQIDNAGQLRVAQMMRDRIRVIELAPEKLIFEQADNYSDDPAPDIRDALFKLTGKRWLVERGSGDAQPSLREAADAEAQATQDRIRANPLVKAAFEAFPDAELVDPEQTLARASGSGRKWN

SEQ ID NO: 77489 - protein, 290 aa, Oryza sativa Indica Group
MEESRADGRNPNQLRPFSCTRNPLDRAHGSARWAQGDTIVLAAVYGPKPGTRKGENPEKASIEVVWKPMTGQIGKQEKEYEMTLKRTLQSICLLTVHPNTTTSVILQVVGNDGSVSFCRNVLLSIVSGCLLDYEHSLVFAGIPLKHLAVAIGCGVLEDGEVILDTNKAEEQQLKSFAHLVFPNSRKSASSKEPNQKEEDSERGLITSITHGVMSGRLFQLHREGPCCIVTDLAFYEDNIAEAGTWRCLRGGNHAIENASTLQKHKVVAAHVLNMKRVGTLGALLMFEIGS

SEQ ID NO: 77490 - protein, 252 aa, Prunus subcordata
AHYKSEADVGNAIAEAIHSGLVKREELFITSKASNHGHVVEACKSSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNIERGTPVIPKSSKVERLKENLEILNFKLEKEDIELINTIDKKSRTTL

SEQ ID NO: 77491 - protein, 146 aa, Nitrosomonas europaea ATCC 19718
MKTVKHLLQEKGHTVVAIGPDDSVFNAMQKMAADNIGALLVMKDEKLVGILTERDFSRKSYLLDKPVKDTQVKEIMTRQVAYVDLNNTNEDCMALITEMRVRHLPVLDDGKVIGLLSIGDLVKDAISQHQFVINQLERYIYDTREI

SEQ ID NO: 77492 - protein, 130 aa, Triticum aestivum
WSSIISTDNYWQLACGDSHCLAVTMAGEVLSWGRNQNGQLGLGTTEDSLLPQTIQAFEGISVKMIAAGAEHTAAVTEDGEIYGWGWGRYGNLGLGDRNDRLVPEKVSSVEGEKMVLVACGWRHTITVSSS

SEQ ID NO: 77493 - protein, 474 aa, Opitutaceae bacterium TAV2
MKSSKTHIHDLIVIGGGSAGFNAARVASGLGKNVAIVDGAPDLGGLCILRGCMPSKTLLHAADVLHHARHGGKLGIRAPGASIDMRALHRWKKKVIGEFSDYRVQAMQSGRYTLHRSHARFIDSHTLKLDNGDSLRGQKILIATGSRVSVPPIPGLDDTPHWTSDDVLDLDYVPESVIVLGGGIVACELAQFLNRIGSKVTLIQRSPHLLREHSPEAADVVAQAFRDEGIRLHTGTRILSVSGENGRQVRVVFEHPHLNKTHTCRARHLFNALGREPATDGLNLDAAGVALDERGRIRVNRWQQTTQPHIYAGGDVCGPHEIVHLAVAQGELAARHAFGARLPSGKPLKPIDESLLLGVVFTDPALATIGWQEHLLRKRGQPFVAASYPFNDHGKSIVMDATYGHVKVIADPVRGRLLGAEIVGRDAGELIHAFSGPLAMRATVHDLLRAPWYHPTLAEIITYPLEEIADQLKS

SEQ ID NO: 77494 - protein, 187 aa, Triticum aestivum
  misc_feature (99)..(99): Xaa can be any naturally occurring amino acid
  misc_feature (148)..(148): Xaa can be any naturally occurring amino acid
MEPNADKLRGLRITSLDDEDDDEIELPATVAAAASGYDDDDEDEDEEAEVMLGFLEKPKHPGLLRHLFPSKAGGIPAWLDPVNLPSGNSSCCGFCGEPXHFVLQIYAPIESNAAAFHRTLFMFMCPSMACLHRDQHEQWTRNQGNPRXSVRVFRCQLPRTNVFYSSKPPSHNNSDKPLCAGAALCHW

SEQ ID NO: 77495 - protein, 223 aa, Zea mays
FGSSDPATGAWAELPDMLFSKSQAMPTAIADLLKPVAAGVTSYGGKLHVPQSFYSWPFAVDVGGEVFDPETNSWEQMPAGMGEGWPARQAGTRLSAVVEGDLYALEPATSSSGGCEIKMYDAQEDAWKVAVSQVRAGAFDESDSPCLLAAFLGKLHLVVKDMGSRISVVQMDSLMKPVDSPALSAATTCRTPDVSSEQTHVWKAIASKNIAAAELVSCQVLSI

SEQ ID NO: 77496 - protein, 345 aa, Corynebacterium glutamicum ATCC 13032
MTTAAPQEFTAAVVEKFGHDVTVKDIDLPKPGPHQALVKVLTSGICHTDLHALEGDWPVKPEPPFVPGHEGVGEVVELGPGEHDVKVGDIVGNAWLWSACGTCEYCITGRETQCNEAEYGGYTQNGSFGQYMLVDTRYAARIPDGVDYLEAAPILCAGVTVYKALKVSETRPGQFMVISGVGGLGHIAVQYAAAMGMRVIAVDIADDKLELARKHGAEFTVNARNEDSGEAVQKYTNGGAHGVLVTAVHEAAFGQALDMARRAGTIVFNGLPPGEFPASVFNIVFKGLTIRGSLVGTRQDLAEALDFFARGLIKPTVSECSLDEVNGVLDRMRNGKIDGRVAIRF

SEQ ID NO: 77497 - protein, 298 aa, Vitis vinifera
MILRQKELREKRTFRRRIPLRRGRVSPRLPVPDHIPKPPYLSSTSLPELSSEHQIHDSEGISRMKAACELAARVLDYAGTLVRPSVTTNEIDKAVHQMIIEAGAYPSPLGYGGFPKSVCTSVNECMCHGIPDSRQLQDGDIINIDVTVYFNGYHGDTSKTFLCGNVTDGLKRLVRVTEECMERGIACCKDGASFKKIGKRISEHAEKFGFGVVERFVGHGVGTVFHSEPVILHHRNDKSGHMVEGQTFTIEPILTIGSTECITWSDNWTTVTADGFPAAQFEHTILITRTGAEVLTKY

SEQ ID NO: 77498 - protein, 376 aa, Solanum demissum
MMQDVWTQLGPTIAAIMFIWTMYQNYFPHELRGHIRRYTDKLVSYFYPYMHIIFYELETEGWFERSKAYVAIERYLSKNSSTQAKRLKANAVKDGQSLVLTMDDHEEITDEYKGEKYDVYELELTSVKDNTELRKLLIDTTGLYLMLGNMDNYRLHSKKDEDEKNLVSKKEVVKGVLLQQIVQAAVATVLFVLACDSGTHKLALALSLMIAEIQLFVAMLMLDTWQYFMHRYMHQNKFLYKHIHAQHHRLIVPYAFGALYNHPLEGHILDTIGGALAFLVSGMSPRTSILFFSFATIKTVDDHCGLWLPGNLFHIFFKNNSAYHDIHHQLYGTKYNYSQPFFVTWDRILGTYMPYELEKRPEGGFEAKLLKDCKEH

SEQ ID NO: 77499 - protein, 252 aa, Prunus pumila var. besseyi
AHYKSEADVGNAIAEAIQSGLVKREELFITSKASNHGHVVEACKNSLKKLQLDYLDLYLVHYPLATKHSGVGTTASLLGENKVLDIDVTVSLETTWHDMEKTVDLGLVRSIGLSNYELFLTRDCLSYAKIKPQVSQFETHPYFQRESLVRFCKKHGVVPMAHTPLGGATANVNAFGSISPLEDPVLIGLAKKYQKSVAQIALRWNIERGTPVIPKSSKVERLKGNLEILNFKLEKEDIELINSIDKKSRTTL

SEQ ID NO: 77500 - protein, 618 aa, Frankia sp. EAN1pec
MRLPDFPWDHLVSYKEKARSHPYGLVDLSVGTPVDATPAVVRHALAGAADSPGYPLTTGTPDLREAAAGWLARRLGVLVEPSAVLPVLGTKELVAQLPSQLGLEPGDRVWVPTPAYPTYEVGALLARCEPVVGPAEGVALVWLNSPGNPTGRVLSVDEMRAVVTWARERGVIVASDECYIELGWEARAVSVLHPDVCGGSHEGLLAVHSLSKRSNLAGYRAGFVTGDPDLVDGLLQLRKHAGLMMPSPVQAATTAALADDMHVADQRARYANRRAVLAAALAVAGFTIDHSEAGLYLWATRGEDCWATVDALSSVGVLVAPGSFYGESGRRHVRVALTAPDAQIATVPERMTMLPAAGAPSGAQAAPGWGQQPAGYPPAGPPGPAASGPHPVGAGRGGDQGWSSGRPSGYGAGEPARADQSSVGSFDRYRASQPDPGARPSQDYRPTQDFGSAQEYRQPEEYRQSQDFRGGRDIRSGQPGDPYRDPQGAHGRSGSYSGAGEGAAGQGTPPPYQTGQLPVPSYENGGGSAPQQQPPLPYQTGQMAVPPYQTGQLPVPPYETGQLPVPPYETGQLPVPPYETGQLPVPPYQTGQMAVPRPGGGEQGDRNTPGWGSEPDVR

SEQ ID NO: 77501 - protein, 252 aa, Prunus salicina
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVIPMAHTPLGGATANVKAFGSISPLEDPVLIGLAKKYQKSVAQIALRWNLERGTPVIPKSSKVERLKENLEILNFKLEKEDIELINTIDKKSRTTL

SEQ ID NO: 77502 - protein, 252 aa, Prunus armeniaca
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYKRSVAQIALRWNLERGTPVIPKSSKVERLKENLEILNFKLEKEDIELINTIDKKSRTTL

SEQ ID NO: 77503 - protein, 578 aa, Debaryomyces hansenii CBS767
MLQNKEETISLGTYLFERIHQLKVQSIFGVPGDFNLTLLDKIDEVKNLTWRGNANELNAAYAADGYSRVRSTESSANGFACLVTTFGVGELSALNGIAGSYAEHVGLLHVVGIPATSAQDKQLLLHHTLGNGDFTVFRRMSSSITQTTGMVADAASGPQEIDRVIREAYINQRPSYLAFPTNMVELEVPKSALDTPIDLSIPDNDPETENEVLDRVTELISNSKNPIILVDACCARHGATGEARKLIDLTKFKFAVTPMAKGAKYIDEDHDRFAGVYVGTLSYPSVKEQVESSDLILSLGAMLSDFNTGSFSYSYQTKNVVEFHSDYTKIRSANYPNVRMKHVLQKLLESNKLKEAASKYEPVKVEKDPFPEEKRDELSKITQQWLWSKLSGWLRENDIVITETGTSSFGIIQTQFPKNTLGISQILWGSIGYTVGATCGAVMAAEEIDPNRRVILFVGDGSLQLTVQEISSMIKNKTKPYIFVLNNNGYTIEKLIHGETADYNSIQPWDHLKLLETFKAEDYESIRVSTVKELLDLFSDHKFAKNDKIRLIELMFDTMDSPQNLIEQARITAQTNSN

SEQ ID NO: 77504 - protein, 1078 aa, Vitis vinifera
MNHVMEPLFLKVPIVSFEAARGVLFINPGGVPILFHSSSDLQISPHFLPFSLPFFPLSFQPSPIRIYFSHRPKKLIYCDRRRVSEFQTFFKGCISGRGCCDKNSSLFAAQWLFNQRKRKACSRLINCPFEAIGKKEDDLWVLTIKNGEHNHEPFKDMSQHPYSRRFSEDEVRQIKLMTDAGIKPRQVLKALKKNNPELQSTPRHLYNLKAKIRQGNISEKSFKSWRPNRSVPVNTTNPLESSSKHNIHPVPNLIGGKFVDSQACEIIDVINPATQEVVSEVPLTTYEEFKAAVSAAKQAYPSWRNTPVTTRQRIMFKLQELIRRDIDKLAMNITIEQGKTLKGAQGDVLRGLEVVEHACGMATLQMGEFVPNASNGIDTYCLREPLGVCAGICPFNFPAMISLWMFPIAVTCGNTFILKPSEKNPGASMILAALAMEAGLPHGVLNIVHGTNDIVNYICDDDDIKAVSFVGSNTAGMNIYARAAARGKRVQSNMGAKNHAIIMPDASMEATLNALVAAGFGAAGQRCMALSTAVFVGGSIPWEEELVACAKALKVNAGTEPGADLGPVISKEAKDRICRLVQNDVGSGARLVLDGRNIVVPGYEYGNFVGPTILCDVTTNMECYKEEIFGPVLLCMKADSLEEAITIVNRNKCSNGASIFTTSGVAARKFQNEVEAGLVGINVPVPVPLPFSSFTGSKLSFAGDLNFCGKAGVQFYTQIKTVAQQWKDLPSRGVLLANPPLSETDITSRGVSLGLLPTSERDLSSQGVSPAVPPTSERDLHINGASLPVPPTTDLDMQSQGGSLASPATSEMDVPDQEMSLSMPSETERDLRTQGMSLGTPQASERMYLPQKSHWNDTLLPTSQRTETIAPTSERIYAPTTSHRNDNMVTVTQRTDMAMVPSSEGVYMPTTSHRNDNMVPSSQRTDATVHPTERVYVLATSHRNDNMVQTSQRTDITMHAASERVYMPATSHRNDNMGSTSQRPDIAVHPTEKIYMSATSHRNDSMAPTSQRTDIMPQASERMYMPSAVHRNGGMPPTSERLYIPGTSQRMYTQNPMISIDEFSGQGASLTFPTSQRI

SEQ ID NO: 77505 - protein, 450 aa, Symbiobacterium thermophilum IAM 14863
MAYEFKLPDVGEGLHEAELLRWLVKEGDTVTEDQPIMEVQTDKATVEITSPVNGRVVKLLGQPGDILKVHSVVVIFDDGSPGALPTAGEVASGVAAAAPAGAQPQASLDVPAPAAQPAPAPAAPPAPAPAPAAGAGPADRPRRALATPATRRLARELGVDINQVPGTGPAGRVTSDDVRAFAARRTAPAPAQAPTQAPTEAAAPTPATPAPAAPAEADDERIPLRGIRKVIAERMVKSKYTAPHVTTVEEVDMTELMAFRAQAKELAARKGIKLSFMPFIIKAVVAALREFPYLNASIDDEAQEIVLHKRYHIGFALDTDAGLLVPVIKDADRKPVFAIAQEMNDLIARGREGKLAPDEMRGSTFTISNQGSIGGLFFTPVINYPEVAILGIGKTQPRPVVRDGEIVIRQMAHLALSFDHRLIDGGMATRFLNRLAELLSDPTLLMMEAM

SEQ ID NO: 77506 - protein, 335 aa, Mycoplasma hominis
MKKTRIAINGFGRIGRLIFREIFNDPEFEIVAINDLTDAATLAHLLKYDTAHGKMNENIWHTENSIVVNGKEYRVYSEKDPLNLPWKELNVDIVIEGTGRYVTKEGAELHIQAGAKKVFITAPAKSEGVKTVVYSVNEDIITPEDKILSGASCTTNCLAPIANVLEKNFGIEKGFMTTVHSYTADQRLQDAPHKDLRRARAAASNMVPTTTGAAIAIGKVIPSLDKKLNGLSLRVPTITGSFVDLTVELKKDATVQEINEAMKKSASESLEYSTEPIVSSDIIGAKAGSIFDSLLTSVLEVEGKKLYKVYAWYDNESSFVAQYVRTLRHIGKLTK

SEQ ID NO: 77507 - protein, 195 aa, Glycine max
MAKGRRLPTIWSELFLRTYVYCQGSAAVNPSELREEDVWGPGDDAGEREWDPHLAAMSNGGGSRRRIPRDTDVHRRVGGLYLAFEAPASGASPRIVHQFRAREEMALTPRVRHRATSAPMNVPDWSKIVRVDSVDSLNDDYNDEDESEMVPPHEYLARSQTMVANSVFEGVGRTLKGRDLSRVRDAVRSQTGLDG

SEQ ID NO: 77508 - protein, 220 aa, Prunus emarginata
  misc_feature (104)..(104): Xaa can be any naturally occurring amino acid
NAIAEAIQSGLVKREELFITSKASNHGHVVEACKSSLKKLQLDYLDLYLVHYPLATKHSGVGTTASLLDENKVLDIDVTVSLETTWHDMEKTVSLGLVRSIGLXNYELFLTRDCLSYAKIKPQVSQFETHPYFQRESLVRFCKKHGVIPMAHTPLGGATANVKAFGSISPLEDPVLLGLAKKYQKSVAQIALRWNIERDTPVIPKSSKIERLKENLEILN

SEQ ID NO: 77509 - protein, 470 aa, Symbiobacterium thermophilum IAM 14863
MGSIKTGTDVVVIGAGPGGYVAAQRASQLGLDVTLIEREELGGTCLNHGCIPSKALISVGDLLYKVNNAAERGLVVKGSVEVDFAKTQEWKETKVIKRLTSGVASLMKAGQVEVVKGTARFTDPHSLEVELNDGGTAAYTFKHAIIATGSTAVNPSFFPLDGENVVDARGALAFREIPPRFVVVGGGYIGVELGIAYAKLGSKVTIVEATGQLLPGTDPDLVNVLMRRLRRLGVTVMLNARASGGLQNGKVKVQDGEGKVHEIEADKVLVSVGRVPYTEGLHLDKAGVRVDEKGFIPVDEQMRTNVPHIYAIGDVCSPVMLAHKASAQGRVAAEAIAGRPSAADWQTVPAVIFTDPEIAYVGLTEAQAREKGYDPVVSRYNFAAVGRALTMGESDGMVKLVGDRQSGLLLGAQMVGPEVSELIGEIALAIEMGAQMEDVALTPHYHPTLSEGILEAALSWMHSIEKAGRK

SEQ ID NO: 77510 - protein, 238 aa, Zea mays
VPRSSSGTSPATSTHQIENYNEPYLNALNEYDDGRDLTSYDFEADCFSSPYDDANKKKLAYRHRAIGEKYAKGLEKVLDGHMVKVCNDQYSLTDKYTDGWLSSAHKLLEEALGKSASAPSANSSSINCIVTSGSLIPSLAKCLLYHLDDVVSSENVYSSWEVGKLQCFKWIKERFDGPNVRFCAIGDGHEECSAAQVMKWPFIKIEFRPEAHHRFPGLDLPTVQTYMDVIYESSSKDG

SEQ ID NO: 77511 - protein, 198 aa, Bradyrhizobium sp. ORS278
MPSKTSTSLPNILTYARIAAIPVVVGCIYAQSIMDYPLWLRWVAVAVFIAAGITDYLDGYYARIWNQQSAFGRMLDPIADKLLVASCLLMLAADNSIHGWTLWAAIVILCREILVSGLREYLAALRVSVPVTKVAKWKTTMQLIAIGFLLAGEAGDQVVPVVTMIGIVLLWASAIFTIYTGYDYFRAGIHHLIEEDSR

SEQ ID NO: 77512 - protein, 487 aa, Herminiimonas arsenicoxydans
MGKITGFMEFQRLQEASEEPKKRTKHYKEFTVHLSDAEAKVQATRCMDCGIPFCNNGCPVNNIIPDWNDLVYSGAYKQALDTLHSTNNFPEFTGRICPAPCESACTLGINSDPVGIKSIEHFIIDKGWESGWVVPQPPSIKTGKKVAIVGSGPAGMAAAQQLARVGHDVTLFEKNDRIGGLLRYGIPDFKMEKSHIDLRVKQMEAEGVTFRTGVLVGKDFPANIINWAKETISPEQLDKDFDAVILTGGAEQPRDLPVPGRELRGVHFAMDFLPLQNKVNAGDKVKDQILATGKHVIVIGGGDTGSDCVGTSNRHGAASIVQFELLPQPPETENKPMVWPYWPTKLRTSSSHEEGCERDWAVATKRLEGKNGKVEKLIAARVEWKDGRMQEVPDSEFEMKADLVLLAMGFVSPVAQVLDAFSIDKDARGNAKATTDGDGCYRTSVDKVFAAGDMRRGQSLVVWAIREGRQCAREVDAFLMGESVLPR

SEQ ID NO: 77513 - protein, 191 aa, Cryptococcus neoformans var. neoformans B-3501A
MSIENLHIADETEIPAGATVELHSRPERKARKALEGLGLKRVQGIQRVTLRRARNVLLVVSSPEVYKSPGSDCYIVFGEAKVEDPNSAAQLQAQAQLAASSQAAQQAHAHGGFKEGVPKSLEELMQDAPSADSSAPAPSGEATDASASGDFKVSDEEIQLIVAQTGVDEAKAREAYISEKGDLINAIMKLQ

SEQ ID NO: 77514 - protein, 403 aa, Pseudomonas fluorescens Pf-5
MAEQGSPRRFARIDRLPPYVFNITAELKMAARRRGEDIIDLSMGNPDGPTPPHIVEKLVTVAQREDTHGYSTSKGIPRLRRAISRWYKDRYEVDIDPESEAIVTIGSKEGLAHLMLATLDQGDTVLVPNPSYPIHIYGAVIAGAQVRSVPLVPGVDFFAELERAIRGSIPKPKMMILGFPSNPTAQCVELDFFERVIALAKQYDVLVIHDLAYADIVYDGWKAPSIMQVPGAKDIAVEFFTLSKSYNMAGWRIGFMVGNPELVSALARIKSYHDYGTFTPLQVAAIAALEGDQQCVRDIAEQYRQRRNVLVKGLHELGWMVENPKASMYVWAKIPEAYAHLGSLEFAKKLLAEAKVCVSPGVGFGEYGDDHVRFALIENQDRIRQAVRGIRGMFRADGLAPKS

SEQ ID NO: 77515 - protein, 480 aa, Glycine max
MVKICCIGAGYVGGPTMAVIALKCPSIEVAVVDISKSRIAAWNSDQLPIYEPGLDGVVKQCRGKNLFFSTDVEKHVYEADIVFVSVNTPTKTRGLGAGKAADLTYWESAARMIADVSKSDKIVVEKSTVPVKTAEAIEKILTHNGKGIKFQILSNPEFLAEGTAIQDLFNPDRVLIGGRETPEGQKAIQTLKDVYAHWVPEGRILTTNLWSAELSKLAANAFLAQRISSVNAMSALCEATGANVTQVSYAVGTDTRIGPKFLNSSVGFGGSCFQKDILNLVYICECNGLPEVAEYWKQVIKINDYQKSRFVNRVVSSMFNTVATKKIAILGFAFKKDTGDTRETPAIDVCKGLLGDKARLSIYDPQVTEDQIQRDLWMNKFDWDHPIHLQPTSPTTEKKVSVVWDAYEATKDADGVCILTEWDEFKTLDYQKVYDNMRKPAFVFDGRNIVDVEKLRDIGFIVYSIGKPLDPWLKDMPAVA

SEQ ID NO: 77516 - protein, 150 aa, Glycine max
  misc_feature (48)..(48): Xaa can be any naturally occurring amino acid
ELHSKGIFILNLKPFNVLLNGNDQAILGDVGIPSLLLGSSFISSDIAXRGFGPPNYMAPEQWEPEVRGPISFETDSWGFGCTIVEMLTGNQPWYGCSVGRIYQSVVEKHEKPNIPSGLPSSVENVLRGCFEYDLRNRPLMVDILSVFKVL

SEQ ID NO: 77517 - protein, 526 aa, Streptomyces murayamaensis
MPTTPTTQSSAEVSDRLDELSERKEQAVRGPSDKATEAQHAKGKLTARERIELLLDKGSFTEVEQLRRHRATGFGLEAKKPYTDGVITGWGTVEGRTVFVYAHDFRIFGGALGEAHATKIHKIMDMALAAGAPLVSLNDGAGARIQEGVSALAGYGGIFQRNTRASGVIPQISVMLGPCAGGAAYSPALTDFVFMVRETSQMFITGPDVVQAVTGEEISQNGLGGADVHAGTSGVAHFAYDDEESCLAEVRYLLSLLPSNNREMPPLAQTSDPVDREGTALLDLVPADGNRSYDVRGVIEELVDDGEYMEIHANWAPNLVVALARLDGHVVGVVANQPSAMAGVLDIKASEKGARFVQFCDSFSIPLITLVDVPGFLPGVDQEHDGIIRRGAKLLYAYCNATVPRISVVLRKAYGGAYIVMDSRSIGADLSFAWPTNEIAVMGAEGAANVVFRREIAAAEDPDAMRKQKIDEYKNELVHPYFAAERGLVDDVIDPRETRSVLCRSVTMLIAKDAELPRRKHGNPPQ

SEQ ID NO: 77518 - protein, 269 aa, Sulfolobus solfataricus P2
MVDADGIYYLGPEGSFTHEAASLFKGKDLKAESTISLVFKRVYERESSIGIVPIENSLEGPVNETLDNLYNYDNIYVIGEIEKKIELVLAARSDNLSQIKRIYSHPHAFNEAREKLKELGFNEYIPVESTSKAAKIVSQDSEAAAICSNFAAKLYNLKVLITISSHNNYTRFIVLSKEMNSNGNKSMILFTVPHKPGALYKVLQVFYEYNINISMIYSRPLKSIPWQYYFYLEYEGGISNREFIEKLVKSTSVLKIKGSFSKLNNDPGF

SEQ ID NO: 77519 - protein, 466 aa, Mycobacterium tuberculosis CDC1551
MPRIRKPPSRSLPEPSAALANTTTRNLWLHFARHGAGIQHPVIVRGDGVTIFDDRGKSYLDALSGLFVVQVGYGRAELAEAAARQAGTLGYFPLWGYATPPAIELAERLARYAPGDLNRVFFTSGGTEAVETAWKVAKQYFKLTGKPGKHKVISRSIAYHGTTQGALAITGLPLFKAPFEPLTPGGFRVPNTNFYRAPLHTDLKEFGRWAADRIAEAIEFEGPDTVAAVFLEPVQNAGGCIPAPPGYFERVREICDRYDVLLVSDEVICAFGRIGSMFACEDLGYVPDMITCAKGLTSGYSPLGAMIASDRLFEPFNDGETMFAHGYTFGGHPVSAAVGLANLDIFEREGLSDHVKRNSPALRATLEKLYDLPIVGDIRGEGYFFGIELVKDQATKQTFTDDERARLLGQVSAALFEAGLYCRTDDRGDPVVQVAPPLISGQPEFDTIETILRSVLTDTGRKYLHL

SEQ ID NO: 77520 - protein, 129 aa, Brassica napus
  misc_feature (5)..(7): Xaa can be any naturally occurring amino acid
  misc_feature (12)..(14): Xaa can be any naturally occurring amino acid
  misc_feature (16)..(16): Xaa can be any naturally occurring amino acid
  misc_feature (18)..(18): Xaa can be any naturally occurring amino acid
  misc_feature (21)..(21): Xaa can be any naturally occurring amino acid
  misc_feature (23)..(24): Xaa can be any naturally occurring amino acid
  misc_feature (26)..(26): Xaa can be any naturally occurring amino acid
  misc_feature (29)..(29): Xaa can be any naturally occurring amino acid
  misc_feature (31)..(32): Xaa can be any naturally occurring amino acid
  misc_feature (35)..(36): Xaa can be any naturally occurring amino acid
  misc_feature (38)..(39): Xaa can be any naturally occurring amino acid
  misc_feature (45)..(47): Xaa can be any naturally occurring amino acid
  misc_feature (49)..(52): Xaa can be any naturally occurring amino acid
  misc_feature (57)..(57): Xaa can be any naturally occurring amino acid
  misc_feature (63)..(63): Xaa can be any naturally occurring amino acid
  misc_feature (69)..(69): Xaa can be any naturally occurring amino acid
  misc_feature (86)..(86): Xaa can be any naturally occurring amino acid
  misc_feature (92)..(93): Xaa can be any naturally occurring amino acid
  misc_feature (102)..(102): Xaa can be any naturally occurring amino acid
  misc_feature (106)..(106): Xaa can be any naturally occurring amino acid
  misc_feature (110)..(112): Xaa can be any naturally occurring amino acid
  misc_feature (123)..(123): Xaa can be any naturally occurring amino acid
  misc_feature (125)..(125): Xaa can be any naturally occurring amino acid
MASSXXXSAACXXXPXQXTMXAXXTXLKXSXXFPXXRXXNNDITXXXSXXXXVSCMXAWSPVXKKKFEXLSYLPDLTEVELGKEVXYLLRNXXIPCVEFELXHGFXNREXXXTPGYYDGRYWXMXKLPL

SEQ ID NO: 77521 - protein, 449 aa, Saccharomyces cerevisiae
MGLCASSEKNGSTPDTQTASAGSDNVGKAKVPPKQEPQKTVRTVNTANQQEKQQQRQQQPSPHNVKDRKEQNGSINNAISPTATANTSGSQQINIDSALRDRSSNVAAQPSLSDASSGSNDKELKVLLLGAGESGKSTVLQQLKILHQNGFSEQEIKEYIPLIYQNLLEIGRNLIQARTRFNVNLEPECELTQQDLSRTMSYEMPNNYTGQFPEDIAGVISTLWALPSTQDLVNGPNASKFYLMDSTPYFMENFTRITSPNYRPTQQDILRSRQMTSGIFDTVIDMGSDIKMHIYDVGGQRSERKKWIHCFDNVTLVIFCVSLSEYDQTLMEDKNQNRFQESLVLFDNIVNSRWFARTSVVLFLNKIDLFAEKLRKVPMENYFPDYTGGSDINKAAKYILWRFVQLNRANLSIYPHVTQATDTSNIRLVFAAIKETILENTLKDSGVLQ

SEQ ID NO: 77522 - protein, 405 aa, Sulfolobus solfataricus P2
MNYLEYFDRIRLAKEKIEKYVHITPIDYSTTFSRIINAKVYLKLENLQKTGSFKVRGAFNKLLSLKEEEKKNGVIAVSAGNHAQGVAYAASTLNIKSTIVMPETAPASKYLATKSYGAEVVLYGKYLHESMKKAEELIQNTGLIFVHPYSDLDVITGQGTIGLELYDIEPDYVIIPIGGGGLISGISIALKYRFPNVKIIGVQSSSSPSMKVSKDLGRLVEIEPSYSIADGILVKSPSELTFSIINELVDDIVLVDDEEIAEAIVLLLERSKTLAEGAGAAALASLISGKVKVNGIDKKVISLVSGGNIDLSLLSTLTEKFLYRQKRVVKVRVIVPDKPGQLNKVLSYVVKIRGNIIDIVHDRHSSDVLPGYTKIYITFELQSSEAITLLLTNLANEGIDVKIVE

SEQ ID NO: 77523 - protein, 192 aa, Triticum aestivum
MVPGMAPKPAPPMPAQPKKPQHMLVLGTGFVGRYVSERLLSQGWRVSGTCTSAAKKMELELLGMTASVLDATTSNIADLHALQDATHLLISIPPIPGVGDPLLSSHADLQTTLTSGNLQWLCYLSSTSVYGDCGGAWVDEDHVVNPKSASSKLRYAAEQGLVGSCRRAGSIGFYTSFGWNIWAWKKCFGYHS

SEQ ID NO: 77524 - protein, 217 aa, Oryza sativa
  misc_feature (150)..(150): Xaa can be any naturally occurring amino acid
  misc_feature (171)..(171): Xaa can be any naturally occurring amino acid
MAAAEAAAALEGSEPVDLVKHPSGIIPTLQNIVSTVNLDCKLDLKAIALQARNAEYNPKRFAAVIMRIREPKTTALIFASGKMVCTGAKSEQQSKLAARKYARIIQKLGFAAKFKDFKIQNIVGSCDVKFPIRLEGLAYSHGAFSSYEPXLFPGLIYRMKQPKIVLLIFVXGKIVLTGAKVRDETDTAFENISPVLTEVKKRPAMKTLWEATTPTLP

SEQ ID NO: 77525 - protein, 559 aa, Debaryomyces hansenii CBS767
MSKKSFVKGPSGLPKELNNDKQWNYSLVNIWVASLALKLLLSVGYHSTDFDVHRNWLAITYNLPISKWYIENTSQWTLDYPPFFAYFEWVLASFVPDFVKRDGCLKIVEKGLYSLPTVLFQRLSVIVSEVVLFVSLQWYINSSKTHTEAKRAFVVASSLVLSPGLLIIDHIHFQYNGMLYGILVLMINSARLKKYLMCGFWFSILICFKHIYLYLAPAVFIFLLRAYCLNLNFGKTKSSNILKIVRWKNLFKLSSIVIAVFSIAFGPFIYYEVMPQLIERLFPFNRGLTHAYWAPNVWAIYSAIDRLLIQIYYRIPISRPILLKIFKFNPQYLWDTKLVNKTTRGLIGDVEFLILPTITSQLTFFLTLFYQVMALIPLFLQPTFRRFMGSLTLCGFASFLFGWHVHEKAVLVVIFPMTFLVSRDRDLLGPFNLLVSCAYISLFPLIFTCDEWLIKITYMLLWYIVYYFSLKKVVRLPKTNGGYGKVILDRVNNGYILGLVPVITIVSLIDLFEHKFEILRKLQFMKLLIISVYCGIGIISSWNGFSWLYFVDESIWTDE

SEQ ID NO: 77526 - protein, 281 aa, Microcystis aeruginosa PCC 7806
MNILTKLLFPETKTPEQVGSPRVQKSRRGIETKSAAEIVIMRQAGKIAATVLKEIAQIAQPGMTTADLDAHAEKRIRAMGATPSFKGYYGFPASICASVDNEVVHGIPSSKKRLKAGSVLKVDTGAYYQGYHGDSCITIAIGSVSPKAAKLIRVAEEALYKGINQVKAGNYLLDIAGAIEDHVQANGFQVVEDFTGHGVGRNLHEEPSVFNFRTNQLPNVKLRAGMTLAIEPIVNAGSKHTRTLRDRWTVVTMDNALSAQFEHTVLVTAAGYEILTDRNNL

SEQ ID NO: 77527 - protein, 252 aa, Prunus fremontii
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVNAFGSISPLEDPVLIGLAKKYQKSVAQIALRWNIERGTPVIPKSSKVERLKENLEVLNFKLEKEDIELINTIDKKSRTTL

SEQ ID NO: 77528 - protein, 319 aa, Oryza sativa Japonica Group
MDPATTELRFDTPLLRIYNDGRVERLFGTETTPAGFDGATGVTSKDVVIDDATGVSARLYIPDLPASGPGHHRKKLPIVVYFHGGGMVLDSAASPTYHRYLNSLVSKAGALAVSVNYRLAPEHPLPAAYDDAWAALSWTASAADPWLSEHGDVGRVFLAGDSGGANVVHNVAIMAGAGQSSLPPGATVEGVIILHPMFSGKEPIDGENAETRELTEKLWPLICADAEAGLDDPRLNPMAEGAPSLQKLGCRKLLVCSAESDIVLARAAAYYQAVMASGWPGMAEWLESKGEEHVFFLNKPDCEESVALMDRVVAFLAGN

SEQ ID NO: 77529 - protein, 347 aa, Oryza sativa
VTSSPSQQSFTTIESAGSATAATSIETAESTTAARDVSPPAAVSAARDVSPPPAAARDVSPPSAAASAARDVSPPSAAASAARDVSPPPAVAPAAARDVPPPPAVVPAAALDVPPPAVVPMAAEMEVDDVDVHEVPECIASMIDRGSVESHRLFLARRTAMEMLRDRGYSVPEAEIARTLPEFRAWWAEKPGIERLAFTTTLVSDPSKKVQLVFCPPEPVKIATIREIYLQTKEENLSRLVLILQSKILSRAREAIKEIFKFKVDIFQATDLLVNITKHVLKPKHEVLSADQKAKLLKEYNVEDSQLPRMLETDAVARYYGFDKGTVVKVIYDGELTGKRVAYRCVF

SEQ ID NO: 77530 - protein, 252 aa, Prunus dulcis
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVSLGLVRSIGLSNYELFLTRDCLSYAKIKPQVSQFETHPYFQRESLVRFCKKHGVVPMAHTPLGGATANVKAFGSISPLEDPVLIGLAKKHQKSVAQFALRWNLERGTPVIPKSSKVERLKENLEVLNFKLEKEDIELINTIDKKFRTTL

SEQ ID NO: 77531 - protein, 447 aa, Bradyrhizobium sp. ORS278
MLDKSPRPAVTVPNDLAAHWMPFTANRAFKKNPRLLAGAKGMHYITVDGRNIIDAAAGMWCCNAGHGRTEIAEAIGKQAAALDYAPPFQFGIPQAFELANRIADLAPAGLDHVFFCNSGSEAADTALKMALAYHQINGQGSRTRLIGRVRGYHGVGFGGTSVGGIVNNRKLFGTLLTGVDHIPATYDREKQAFTKGEPEYGAHFAEELENLVALHGANTIAAVIVEPMAGSTGVIPAPKGYLKRLREITQKHGILLIFDEVITGFGRLGHAFAAERYGVTPDLLTFAKGVTNGAAPMGGVLVRDTIHDAFMSGPEHMVEFTHGYTYSAHPIACAAGLATLDIYRDHKLFEHAKAIEPKWADAVMSLKGLPNVLDIRTVGLTAGIDLAPLPDAVGKRGYSAMEQAFHNTDLMLRIAGDTLALTPPLIINEDQIGEIVEKVGKVIKAVA

SEQ ID NO: 77532 - protein, 233 aa, Prunus persica
NAIAEAIQSGLVKREELFITSKASNHGHVVEACKNSLKKLQLDYLDLYLVHYPLATKHSGVGTTASLLDENKVLDIDVTVSLETTWHDMEKTVSLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNIERGTPVIPKSSKVERLKENLEVLNFKLEKEDIELINT

SEQ ID NO: 77533 - protein, 252 aa, Prunus maritima
AHYTSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSMAQIALRWNLERGTPVIPKSSKVERLKENLEILNFKLEKEDIELINTIDKKSRTTL

SEQ ID NO: 77534 - protein, 231 aa, Prunus maritima
  misc_feature (6)..(7): Xaa can be any naturally occurring amino acid
NAIAEXXQSGLVKREELFITSKASNHGHVVEACKNSLKKLQLDYLDLYLVHYPLATKHSGVGTTASLLDENKVLDIDVTVSLETTWHDMEKTVDLGLVCSIGFSNYELFLTRDCLSYAKIKPQVSQFETHPYFQRESLVRFCKKHGVVPMAHTPLGGATANVKAFGSISPLEDPVLIGLAKKYQKSVAQIALRWNLERGTPVIPKSSKVERLKENLEILNFKLEKEDIELI

SEQ ID NO: 77535 - protein, 543 aa, Symbiobacterium thermophilum IAM 14863
MRMNRTEMIRRLASESFDLLVVGGGITGAGVAREAALRGLKVGLVEASDFAFATSSRSTKLIHGGLRYLKNFEFRLVRESVVERQNLLVMAPHLVKATTFLFPVYEGDPDPLWMLNIGLTLYDWFAGRSNPIPHRMLKPGPLREREPWLRADRLKGGALYADCRTDDGRLTLEVIQSAAAHGAAVANYVRLTAFRKDSRGRIVGATVRDELTGDTFDVRADRVLAAAGPWADAVRQLDDPGAPTLLRLTKGVHLVVPHDRLPIRHAVVMRGRDGRMMFAVPSGNCTYIGTTDTDHHGDPAAYSITRWDVEYVVDAARRLFPEAGLTTDDIIAGWSGFRPLLKPAKEADPSATTRDYKLFHSPSGLVTVAGGKLTAFRAMASHIVDDLFPATRSAAHLAASTAPLPGAQGKLPDGGLKRQLAAEVGGAERLIDLLADRYGAVLAQVAAEAREVAAPDPELRWRLAQARYAVKAEMAMHLVDVVRRRTDLMLFTAHNGRPWLPALAGEMGALLGWSEAQKQAEIAAAEQEIDGMFAWRQEAAAGA

SEQ ID NO: 77536 - protein, 69 aa, Zea mays
MADWGPVLIGLVLFILLSPGLLFQIPGKGRIIEFGNFQTSGLSILIHAVIYFALLAIFLLAVGVHIYLG

SEQ ID NO: 77537 - protein, 196 aa, Arabidopsis thaliana
MKQSSFSSSSSSRNSTSLTNRLKTIFKKAEELSILCAIDVCVIYYGPDGELRTWPKERNTVKDMASRYKEATKRKKKRTLSTLQERLRIVESQKQQNKNLVHQSLTPSYLNQIQHLNPSNFSPYMYNHGDAATLSQLPLSASLSNQLQLPESLDAAWFWSEHVFGQHHQQQQLSTSWRVKHTRILTVSFGTSICSE

SEQ ID NO: 77538 - protein, 228 aa, Triticum aestivum
  misc_feature (129)..(129): Xaa can be any naturally occurring amino acid
  misc_feature (139)..(139): Xaa can be any naturally occurring amino acid
  misc_feature (176)..(176): Xaa can be any naturally occurring amino acid
MGEEANCDAVMEDGNGNDNGKAKENGHATAVVAMPDVKVKAEDAVVAPGDPRLQGISDAIRVVPHFPKQGIMFNDITTLLLRPGVFKDALDMFVERYRGMGIAAVAGIEARGFIFGPAIPLAIGAKFIXPLRKPKKLPXGEVISETYVLEYGTDCLEMHVGAIEPRERVLMVDDLXGTGGTLCAAINLLGRAGADVRECACLIGLPNFKDFYKLTGKPCLCPGGVSGI

SEQ ID NO: 77539 - protein, 316 aa, Gracilaria lemaneiformis
MAIPKVGINGFGRIGRLVLRAAIEKNTCTVVAINDPFIDLEYMAYMFKYDSTHGRYPGTVEASGGKLVVDGNVIQIFGCRDPAEIQWSAAGAEYVVESTGVFTLKEKAEKHFVGGAKKVIISAPSKDAPMFVCGVNEEKYTPDLNVISNASCTTNCLAPLVKVIHEKYGIEEGLMTTVHATTATQKTVDGPSHKDWRGGRGAGANIIPSSTGAAKAVGKVMPELNGKLTGMAFRVPTPDVSVVDLTVRLAVDTTYDDIKATMKAASEGKMEGILKYTEDSVVSTDFIHDDASCVFDAGAGIMLNSKFCSVLYDMMG

SEQ ID NO: 77540 - protein, 526 aa, Candida albicans SC5314
MSSTTFNDIIDSVLPYLTKWYTILIGAGLIFVLSTNLKNAYYSYKLGCKNPVHLKRAGWTGIPALIDAIKAKNSGKLAEFGGDTFDELNSKNFYLNVAGVLKIIFTIEPENIKAVLATQFNDFSLGTRHAHFYPLLGDGIFTLDGEGWKHSRAMLRPQFAREQIAHVKSLEPHIQILAKQIKLNKGETFDLQELFFRFTVDTATEFLFGESVHSLYDDKLGIPPPNDIPGRDNFATAFITSQHYLATRSYSQTFYWLTNNKEFRDCNAKVHHLAKYFVDKALNSTEKEIEEKSQGGYVFLYELVKQTKNPKVLQDQLLNIMVAGRDTTAGLLSFAMFELARNPKVWNKLREEIEANFGVGEEARVEDITFENLKKCEYLKAILNETLRLYPSVPINFRTSTKDTTLPTGGGPNGTSPIFVPKGSTVAYTVFKTHRLEEYYGKDSHDFRPDRWFEPSTKKLGWAYLPFNGGPRICLGQQFALTEASYVISRLAQLFPVLESRDEQYPPNKCIHLTMNHDEGVFVSMN

SEQ ID NO: 77541 - protein, 287 aa, Oryza sativa
MEGKEEDVRLGANRYTERQPIGTAAQGAEEKDYREPRRRRCSTAEELTSWSFYRAGIAEFVATFLFLYISILTVMGVNKSASKCATVGIQGIAWSFGGMIFALVYCTAGISGGHINPAVTFGLFLARKLSLTRAVFYMAMQCLGAICGAGVVKGFQRGLYMGSGGGANAVNPGYTKGDGLGAEIVGTFVLVYTVFSATDAKRNARDSHVPILAPLPMFAVFLVHLATIPITGTGINPARSLGAAIVYNRAHAWHDHWIFWVGPFIGAALAAIYHVVVIRAIPFKSRD

SEQ ID NO: 77542 - protein, 286 aa, Triticum aestivum
  misc_feature (250)..(250): Xaa can be any naturally occurring amino acid
HYRTSLYKKAGCYRSGIPGISSTHASGIVPGIKVDKGLVPLVGSNDESWCQGLDGLASREAAYYQQGARFAKWRTVVSIPNGPSELAVKEAAWGLARYAAISQDNGLVPIVEPEIMLDGEHGIERTFEVAQKVWAETFYYMAQNNVMFEGILLKPSMVTPGAECKDRATPEEVASYTLKLLQRRIPPSVPGIMFLSGGQSEVEATLNLNAMNQAPNPWHVSFSYARALQNTALRRGGGRPENVAAAQEAXLLLRAKANSLAQLGKYTSDGEAAAAKENMFVKNYSY

SEQ ID NO: 77543 - protein, 87 aa, Glycine max
DSSMISSPMLPLSTVARAGMYAPFSGLESMAVFPTRMTNNDITSFASYLGILQCMSGCAPDVKKTFDTLSYLPDLDDALLDYEVSIL

SEQ ID NO: 77544 - protein, 439 aa, Physcomitrella patens
  misc_feature (122)..(122): Xaa can be any naturally occurring amino acid
  misc_feature (313)..(313): Xaa can be any naturally occurring amino acid
MKKVPGDRYGQWKLLVPALYDWLTNHHLMGPSLSCRWGPQLEAGSSKTRQLLFYSERTDGECPNTIVVAQCDIMKPRTAAAEQISQFKEGGKSPHLKKLKTIIHPGEVNRIREIPQNSNILXTHTDSPKVLIWNTKTQPNRATTSAASESKPDLVLIGHTDNAEFALNVSRTAPYVISGGKTPKSITPTAAGSKQSGTAGGAADTTNVYTRGIFKGHTDTVEDVQFRPSSMNEFCSVGDDSCLLLWDARTGYQPISKVVKAHNADLHCVDWNAHDENLILTGSADNSVRLFDHRKILARGQAIPVEQFEGHSXAVLCVQWCPDRASVFGSCAEDGLLNVWDYEKVGKALDTTNLKQPVKVPPGLFFQHTGHRDKVVDFHWDSRDPWTIVSVSEDANTPGGGGTLQIWRMIDFIYRPEDEVLAELDEVRPQLVSQNTPAS

SEQ ID NO: 77545 - protein, 458 aa, Synechococcus sp. CC9605
MLLPTLLSEISSHDFEVAETLIGVLRFVLIFIAARTLAEILVRFELPTILGELLAGVIIGASGLHLLVPPETQVQLSGAFSNVLGGLAHVPPEEIGLIYNESFGSLRSVSNLGLYSLLFLTGLESELDELMAVGAQAFSVAVVGVVLPFALGTFGLMALFHVDPIQAIFAGASMTATSIGITASVFGELGYLRTREGQIVIGAAVLDDILGIVILAVVVSLAAGGSLEIAPIVQLVVAAVLFVVVALVLSRKAAPAFDWMIDQLKAPGAKLVGSYLLLGASCFIATAIGLEAALGAFAAGLIASTSRHRHEIQAAVMPIVGLFATVFFVLVGAGMDLSVINPSDPEARSALVIAGFMFIVAIIGKVVAGWAVFGKQKTNHLVVGLGMLPRGEVGLIFLGLGTAAKLLSPGLEAAILLMVIGTTFLAPVLLRLVLKGKPPEDGDQVPEELAADPLAGAS

SEQ ID NO: 77546 - protein, 384 aa, Arabidopsis thaliana
MVAEAEVVFQQSLPAVLEIELFDGVSSAVKSPVSSPKLGFTQSTASVSGSLTTSPVQADIFPEGDCDPSVLDYIPTIRSGSFADIGPKRNMEDEHIRIDDLSSQVGSLFELPKPSAFYAVFDGHGGPEAAAYVRENAIRFFFEDEQFPQTSEVSSVYVEEVETSLRNAFLQADLALAEDCSISDSCGTTALTALICGRLLMVANAGDCRAVLCRKGRAIDMSEDHKPINLLERRRVEESGGFITNDGYLNEVLAVTRALGDWDLKLPHGSQSPLISEPEIKQITLTEDDEFLVIGCDGIWDVLTSQEAVSIVRRGLNRHNDPTRCARELVMEALGRNSFDNLTAVVVCFMTMDRGDKPVVPLEKRRCFSLSPEAFCSLRNLLDG

SEQ ID NO: 77547 - protein, 399 aa, Frankia sp. EAN1pec
MPHPRSATTEDVDPRPRFPLPPALPSSDAIQSALATVLDPEIGRPITELDMVDSAHVRDDGSVDVVVLLTVSGCPMRDEITSRVTRAVNGVDGVRDVRVTLEVMTAEQRTALHEKLRGGTPQRVIPFAQPGSMTRVYGVASGKGGVGKSSVTVNLAAAMARSGLAVGVLDADIYGHSVPRMLGIDRAPTQVEKMIMPPQAHGVKVISTGMFTRGNQPVTWRGPMLHRALEQFLSDVFWGDLDVLLLDLPPGTGDIAISLAQLVPSSELLLVTTPQLAATEVAERAGTIAVQTHQNVVGVVENMAYMPCPHCGERVDVFGEGGGAAVAERLTRVLGHEVPLLAQVPVDVRLRQGGDSGKPLVLSDPDSEAGKALRAVAERLTFRSRGLSGRSLDISPARR

SEQ ID NO: 77548 - protein, 404 aa, Thiomicrospira crunogena XCL-2
MKFSDIRDAFPILKLQENGQPLVYLDSGATSQKPLSVIEAIDHYYRAENANVHRGVYGLSERATESYEGARQKVQHFLNAASTKEIIFVRGTTEAINLVAQTWGRENLSAGDEVLITEMEHHSNIVPWQLLRDQLGIKLVVVPINDQGEISLSDYQSLLSEKTKLVSVVHMSNALGSINPVKEMTALAHSVGAKVLLDGAQAVPHMAVDVQSLDCDFYAFSAHKMYGPTGIGVLYGKEALLEAMPPYQGGGDMIYSVTFDKTEYNELPYKFEAGTPHIAGGIGLGAAIDFMLDIGLENIAQYENQLLTEATEKLQQIEGLRIIGQAANKGGVISFVIDGVHPHDMATLMDQDGIAVRASHHCAMPVMQRFNVPATIRASLGVYNNSEDIDRLIASIKEAVDMLV

SEQ ID NO: 77549 - protein, 252 aa, Prunus maritima
AHYKSEADVGNAIAEAIQSGLVKREELFITSKASNHGHVVEACKNSLKKLQLDYLDLYLVHYPLATKHSGVGTTASLLDENKVLDIGVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNLERGTPVIPKSSKVERLKENLEILNFKLEKEDIELINTIDKKSRTTL

SEQ ID NO: 77550 - protein, 437 aa, Haemophilus influenzae 86-028NP
MEILMKSGDLNKYDLVKNTLVLVLAGGRGSRLHELTDKRAKPALYFGGNRRIIDFALSNCINSGLNRIGVVTQYAAHSLLRHLQTGWSFLPQERGEFVDMLPARQQIDDSTWYRGTADAVYQNMAIIKNHYRPKYILILAGDHIYKQDYSVMLMDHVNSGAKCTIGCIEVPRSEAHEFGVMAVNENLKVKAFVEKPKDPPAMVGKPDVSLTSMGIYVFDADYLYKMLDREVGTPNTSHDFGKDVLPKCLEEGALYAHPFSRSCMGRNTEGEIYWRDVGTLDSFWQSNIDLVSENPQLDIYDQSWPIRGNPVQAYPSKFFYKHSNVHPVDNSLIGGGCVITDASISNSVLFDRIKIDSFSKVDHCVVLPQVKIGKNCVLKNCIIDRECEIPDGMQIGVDMEEDKNRFRISSTGKVILVTPKMLKILEGHEIGEEGHLD

SEQ ID NO: 77551 - protein, 475 aa, Chlamydomonas reinhardtii
VLVLGDFGRSPRMQYHTLSLSQQSGTSVHVIAYGGSAPIAELRAAQNVKMHIVPEPPSLFKRLPRLMLLICKVLHQLLWLLWMMLVTLPKPGHILLQNPPAIPTMAVCWLAARRHRAKLIIDWHNYGYTILALTQGARHPLVRLARSYEHFWGKRGDGHFCVTQAMQQDLQTKWGVNATVLYDRPPAFFKRTPLPAAHTLFRKLGTALEQPAFDDFLTHRSAAAAAGRTQEAAEVTVVTTKRPGQAVCARPDRPAVVVSSTSWTPDEDFGILLEAAAAYDQLVEAAAEAAAEAAAAAGTASAGTAAPAPVPALPDLLLLITGKGPQKEMYMARVAGMALRHVAIRSLWLEAADYPLLLGAADVGVCLHASSSGLDLPMKVVDMFGAGLPVCALSYSCIRELVVPGVTGLLFSTGQELAAQLAGLLGGFPAEPSEQLKALAANVASREQGLRWDENWREVAAPVMGYGAGETEQQH

SEQ ID NO: 77552 - protein, 252 aa, Prunus maritima
AHYKSEADVGNTIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNLERGIPVIPKSSKVERLKENLEILNFKLEKEDIELINTIDKKSRTTL

SEQ ID NO: 77553 - protein, 163 aa, Solanum demissum
MEQVIGDDGESGGDRHASIFVIGRQLFVAMLMLDTWQYFMHQYMHQNKFLYKHIHAQHHQLIVPYAFGALYNHPLEGLILDTIGGALAFLVSGMSPRTSIFFFSFATIKTVDDHCGLWLPGNLFHIFFKNNSAYHDIHYQLYGTKYNYSQPFFVTWDRILGTY

SEQ ID NO: 77554 - protein, 329 aa, Oryza sativa Japonica Group
MSDAGAGGDSDEVIHDAPNFIRVYKSGRVERFLRIDFAPPSTDAATGVSSKDVVVVPGDGVSARIYLPSTPASGYGRRLPVLVFFHGGGFCLGSAFDAATHGHANRLAARAGVIVVSVEYRLAPERPVPALYDDAWAALQWVASHAAGEGQEPWLTAHADFGRVHVGGESAGANIAHHAAMRAGAEELGHGVKVNSLVLIHPYFLGGDGDGYSESDEMGMALLRELIRLWPVVCPGTSGCDDPWINPMADGAPSLAVLGCRRALICIGGKDAMRDRGRLYCEKLRECGWRGEVEIWEADGQGHGFHLLWPTCTQAEAQLRVIAEFLSHG

SEQ ID NO: 77555 - protein, 339 aa, Streptococcus gordonii
MKHKILVTGGAGYIGTHTVVELIKAGHELVVVDNFSNSSKKSLEAVEKIVGQSITLYEADICDKEALLKVFKDFKPTGVIHFAGLKAVGESSQIPLTYYENNVAGTLTLLRVMEEVNCKNIIFSSSATVYGDPLTVPILEDFPVSATNPYGRTKLMAEEIMTDIYKADSTWNIVLLRYFNPIGAHESGDLGENPNGIPNNLLPYVTQVAVGRLEQVQVFGNDYPTVDGTGVRDYIHVVDLAKGHVAALKKFDGKQGLNIYNLGTGKGYSVLEIIHSMEKAVGKLIPYKIVERRPGDIATSYANPAKAKAELGWEAQFDISRMCQDAWRWQSKHPNGFDE

SEQ ID NO: 77556 - protein, 250 aa, Posidonia oceanica
MPFSRIAMGRREEVTHGDALKATLAEFISTLIFVFAGEGSGIAYNNLSGDGDTTASSLIAAALAHGLGLFVAVSVGANISGGHVNPAVTFGAFVGGNITFLRGILYWHGQLLGSIVACLLLKFVTGGMTTGGFAVSGVSVWNALVFEIVMTFGLVYTVYATAIDPKKGAIGTIAPLAIGLIVAANIFVGGVFTGASMNPAVAFGPALVSWNWVNHWIYWVGPLVGAAIAGIVYQLLFINHTHEQLPTTDY

SEQ ID NO: 77557 - protein, 231 aa, Prunus maritima
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATASVKAFGSISPLEDPVLIGLAKKYQKSVAQIALRWNLERGTPVIPKSSKVERLKENLEILNF

SEQ ID NO: 77558 - protein, 598 aa, Streptococcus suis 89/1591
MLTTQSQLSLKQWKKKDWHKNMTEMLKGIAASDGVAVAKAYLLVQPDLSFETVTVEDTNAEEARLDAALEASQNELSVIRENAVASLGEEAAAVFDAHLMVLADPEMIGQIKETIRAKKTNAETGLKEVTDMFIAIFEGMEDNPYMQERAADIRDVAKRVLAHLLGVRLPNPATIDEESIVIAHDLTPSDTAQLNKQFVKAFVTNIGGRTSHSAIMARTLEIAAVLGTNNITEIVKDGDVLAVNGITGDVVINPSEEVIAEFKVAGEAYAKQKAEWALLKDAQTVTADGKHFELAANIGTPKDVEGVNDNGAEAVGLYRTEFLYMDSQDFPTEDEQYEAYKAVLEGMNGKPVVVRTMDIGGDKELPYFDLPHEMNPFLGFRALRISISETGNQMFRTQLRALLRSSVHGKLRIMFPMVALLTEFRAAKAILEEEKANLLAEGVAVADDIQVGIMIEIPAAAMLADQFAKEVDFFSIGTNDLIQYTMAADRMNEQVSYLYQPYNPSILRLINNVIKAAHAEGKWAGMCGEMAGDQQAVPLLVGMGLDEFSMSATSVLRTRSLMKKLDTAKMEEYAHRALTECATAEEVLELQKEYVDFD

SEQ ID NO: 77559 - protein, 393 aa, Streptococcus suis 89/1591
MAEKILMREGRLIVPDCPVIPYIEGDGIGRDIWSVSQKVIDAAVKKAYAGQRSIQWREVLAGEKAYELTGTSLPNETLEIIREHLVAIKGPLGTPIGKGHRSLNVALRQELDLYACVRPIRYFKGVPSPLKEPEKTDITIFRENTEDIYAGIEWEAGSDEVAKVISFLQEEMGVVNIRFPESSSIGIKPISEEGSKRLIRSAIEYALEHQLKIVTLVHKGNIQKFTEGGFRKWGYELAKEEFATELAEGTLVVNDIIADNFLQQILLAPENFQVVALTNLNGDYASDALAAQVGGIGISPGANINYQTGHAIFEATHGTAPDIAGKDLANPCSLLLSACMMLEYIGWKEAATLIIQALEDAFINKNVTLDFAKILDVAHQSTSQFSEVLIDSI

SEQ ID NO: 77560 - protein, 290 aa, Posidonia oceanica
MEGKEEDVKLGANKFSERQPIGTAAQTGDDRDYKEPPPAPLYEPGELISWSFYRAGIAEFMATFLFLYITILTVMGYEKVDNKCKTVGTQGIAWAFGGMIFALVYCTAGISGGHINPAVTFGLFLARKLSMTRALFYMVMQCLGAICGAGVVKGFVNKDNFAMWKGGANVVSHGYTKGDGLGAEIVGTFLLVYTVFSATDAKRNARDSHVPILAPLPIGFAVFLVHLATIPITGTGINPARSFGAAVIYNKQHAWDDHHWVFWVGPFIGAALAAIYHQIVIRAIPFKTGP

SEQ ID NO: 77561 - protein, 356 aa, Streptomyces sp.
MTAEPTVAARPQQIDALRTLIRLGSLHTPMVVRTAATLRLVDHILAGARTVKALAARTDTRPEALLRLIRHLVAIGLLEEDAPGEFAPTEVGKLLADDHPAAQRAWHDLTQAVARADISFTRLPEAIRSGRPTYESVYGKPFYEDLAGRPDLRASFDSLLACDQDVAFDAPAAAHDWTNVRHVLDVGGGKGGFAAAIARRAPHVSATVLEMAGTVDTARSYLRDAGLSDRVDVVEGDFFEPLPRRADAIILSFVLLNWPDHDAVRILTRCAEALEPGGRILIHERDDLHENSFNEQFTELDLRMLVFLGGALRTREKWDGLAASAGLVVEEVRQLPSPTIPYDLSLLVLAPASTGA

SEQ ID NO: 77562 - protein, 252 aa, Prunus takesimensis
  misc_feature (18)..(18): Xaa can be any naturally occurring amino acid
AHYKSEADVGNAIAEAIXSGLVKREELFITSKASNHGHVVEACKNSLKKLQLDYLDLYLVHYPLATKHNGVGATASLLDENKVLDIDVTVSLETTWHDMEKTVSLGLVRSIGLSNYELFLTRDCLSYAKIKPQVSQFETHPYFQRESLVRFCKKHGVIPMAHTPLGGATANVKAFGSISPLEDPVLLALAKKYQKSVAQIALRWNLERDTPVIPKSSKVERLKENLEVLNFKLEKEDIELINTIDKKSRTTL

SEQ ID NO: 77563 - protein, 291 aa, Bradyrhizobium sp. BTAi1
MFKDNLLEGRRILVTGGGTGLGKAMAARFLQLGAEVHICGRRKIVCDETATELMDLYGGRVTSHGVDIRNAMAVEEMIEAIFQEGGLTDLINNAAGNFISRTEELSPRGFDAVANIVMHGTFYVTHAVGKRWIAAKQPGNVVSITVTWVRNGSPYVVPSAMSKSAIHAMTMSLATEWGRYGIRLNTIAPGEIPTEGMSKRIKPGDEAGARTKAMNPMGRVGTMEELQNLAVFLISGGCNWINGETIAMDGAQALAMGGNFYQLRDWSDDDWTKAKDSIKAQNEKDRATRTS

SEQ ID NO: 77564 - protein, 662 aa, Herminiimonas arsenicoxydans
MLSPLELTLLLLAAAVLGVVAFRSMHLPPMLGYLVAGILIGPHTLGWAEDSSTTHALGEFGVVFLMFSIGLEFSLAKLSAMRRTVFGLGMAQVLLTIVLTMIFGWLVAHFSSRLSSISWQAALAVGGALAMSSTAIVSKVLTERLELESEHGRRSIGILLFQDLALVPLLILIPALANPKGDLLVTLGWAACKAVIVLVLLLFVGHKVMRGWFRLVVKRRSQELFMLNLLLITLGAAWITEMAGLSLALGAFVAGMLISETEFKHQVEEDIKSFRDVLLGLFFITIGMLLDIRLVVEYWWLVLVLLIGPVLVKFALVAILARWFGAPLGVALRTGLALAQAGEFGFVLLNQIGALNLLEPLIVQLILASMVLSMLIAPLILAKSNAIVMKMSANEWMVQSLALTKIASRTMAAQQHVVIAGFGRTGQSLAKLLDEEGIPYQALDLDPDRVRDAQAAGANVSYGDAGRRESLVAAGINRAAALVITYASTPSALKILHHTQQIAPTLPVIVRSYDDSDLDKLRSAGATEVVPEAIEGSLMLASHALLTLGVPLRRVVHRIQTARGERYASLRGFFHGVSDVSEGDEHLQVRLRSVQLSESAYAIGKALAQLGLETLGVEVTALRRDGKRIDWTPETILLAGDIIVLCAAVEELALAENRLLKG

SEQ ID NO: 77565 - protein, 635 aa, Opitutaceae bacterium TAV2
MSAPLISSQTRQAAASVARSSGQWLRDRFPLGAELRKYSWDKLRADGLAAATVSLVSIPQAIGFALIAGLPPLMVIMSVIVGGFVAALFTSSHHLVFGPSNSLSIVLAATIYSFTSTDLTPAQITIVLAALIGIFQLTAGLAQFGKITQFISRSVIIGYGTAIGILLAAGQVSHFFGIIDVGSRGSFIGTLWAALDRIVHLQFNGWALAIGVLTLVIFEVCEHYIRRIPAELIGLVIIALITKYGHLNELIGLRTIADEGVLSVTIPSFIGMPLGPETWGIVPSLLGAALAISILGMLEAVSIAKTMAAKSGQQIDVNQELISMGTANIVTSAYGAMPGSASFARSGANYQSGARTQMSALMSSSIVLAALFFVGPLINYIPVASLAAHLIRIGLRMINREQLRLAWRATRSDAFVLVTTFASAFFLKLDVAIYVGVGLSLVLFLRKAGAPSLVEYTFDDAGQLSQLDEDAARKNSAISIVHVEGELFFGAADLFQEQVRQLASDSKMRVVILRMKNARHLDATSVMSLLQLHDYMKGSGRHLLVSGINPDVERVLRRSGAWAAIGSDNIFPAEANLTMSTKRALLRASRLLQQDGEKARAASGIRIFYDKNKTQETAAPFGDSRERDRPGDFQI

SEQ ID NO: 77566 - protein, 461 aa, Yersinia pseudotuberculosis IP 32953
MIQVAPQQTRDAPSATVVAKFGGTSVASFDAMSRSADVVLSNPDVRLVILSASAGITNLLVALADGSEPEKRADHLEEIRHIQYDIIARLTDSTVIREEIDRMLENIAMLSEAASLATSPALTDELVSHGELMSTLLFVELLRQRQVAVEWFDVRKVMRTNDRFGRAEPDTSALAELAQTLLAPRIEDAIVVTQGFIGSEGKGRTTTLGRGGSDYTAALLGEALNVSRIDIWTDVPGIYTTDPRVVPAAKRIDKIAFEEAAEMATFGAKILHPATLLPAVRSDIPVFVGSSKDPAAGGTLVCNETYNPPLFRALALRRKQTLLTLHSLNMLHARGFLAEVFNILARHSISVDLITTSEVSVALTLDTTGSTSTGDSLLTTSLLTELSSLCRVEVEEDLALVAIIGNNLSQACGVGKEVFGVLDPFNIRMICYGASSHNLCFLVPGNDADKVVQTLHYNLFE

SEQ ID NO: 77567 - protein, 396 aa, Candida albicans SC5314
MNFLRKRRSSEDEDDDDILNNDPTSSIHKSRKPPNTAFRQQRLKAWQPILTPKSVIPLLILIAIILTPLGIAIIYTTYNVQDLIVDYSKCNEASNSYENIPNKYTGYHFRGHSANPNFQWRFENNNTCVIQFNLAQDLKGPVYLYYKLTNFYQNHRKYVESYDLEQLRGEALSSDDVTDNCKPLKHRVYNGEEKLIYPCGLIANSYFNDTISNPVLLNTRNGDNNETYIFSDKGISWPSDRSHKFKKTQYSPDEVVPPPNWDEMYPNGYTKDNMPDLQTWEHLQNWMRTAALPSFYKLYGQNTTQSMSSGIYQISIKMNYPVEIFGGSKSIVITTNTIFGGRNMSLGVIYIIVAVVALVLGIAFLLQYLIKPRKMGDHDYLQDSNGGDITTYRDQL

SEQ ID NO: 77568 - protein, 180 aa, Yersinia pseudotuberculosis IP 32953
MCDSIRPYLHHSPTLGKRVMIDRSSVIIGNVILGDDVSVWPLVAIRGDVNQVIIGARSNIQDGSVLHVTHQSEHNPEGYPLIIGEDVTIGHKAMLHGCTIGNRVLVGMGSILLDGTIIEDDVMIGAGSLIAPGKRLVSGYLYVGSPAKQIRPLTPLELEGLLYSAGNYVRWKDDYLAESK

SEQ ID NO: 77569 - protein, 255 aa, Euglena intermedia
MPRKFFVGGNWKCNGTRESIASLLKDFNGAVGEPDLDVQIVVAPPFVHCDFTKEKLPKGWELSVQNCWIGKGGAFTGEVSAEMIKDAGIPWVILGHSERRHLPQLKESDETVAVKVAYALANGLKVMACIGELLEEREAGQTQAVNERQLKAIAAKLKEEDWKNVVIAYEPVWAIGTGKVATPEQAQEVHEHVRAWVASNVSPSVAAEVRILYGGSVTAKNCVELAGKPDVDGFLVGGASLKPEFLDIIAAHKHK

SEQ ID NO: 77570 - protein, 297 aa, Triticum aestivum
  misc_feature (253)..(253): Xaa can be any naturally occurring amino acid
  misc_feature (260)..(260): Xaa can be any naturally occurring amino acid
  misc_feature (268)..(268): Xaa can be any naturally occurring amino acid
QGLSVEVDAFVGSRALPTLWNSATNFLQGLVGRLASSNKRTINILQNVNGIIKPSRMTLLLGPPSSGKSTFMRALTGKLDKALKVSGSITYCGHTFEEFYPERTSAYVSQYDLHNAEMTVRETLDFSRRCLGVGARYDMLAELAVREREAGIKPDPEIDAYMKATAVQGQESNIVTDLTLKVLGLDICADMPIGDEMIRGVSGGQRKRVTTGEMLTGPAKALFMDEISTGLDSSSTFQIWEYIRQLVHVMNEXTVMISLXLQPPPKDXYTCFDDNYFGLSEGYVTVTMGPRQKNILG

SEQ ID NO: 77571 - protein, 195 aa, Zea mays
  misc_feature (184)..(184): Xaa can be any naturally occurring amino acid
MSRRGDWVYENNGGTCVAIAGADYCVVAADTRLSVGYNILTREHSKICELADKCVIASSGFQGDIKALQKNLAARELLYQHQHNKRMSCPAMAQLLSNTLYYKRFFPYYAFNMLGGLDSEGKGCVYSYDAVGSYERTGYSAQGSGSTLIMPVLDNQLKSPSPLLVPARDAVTPLSESEAVDLSXDVFASATERDI

SEQ ID NO: 77572 - protein, 489 aa, Frankia sp. EAN1pec
MSETGQAQLPPRGGPGLPQVRRLVTAIPGPRSVELAKRRSQAVARGVGETLPVYIAAAGGGVLVDVDGNSLIDFGSGIAVVSVGNAADAVVENVREQAGLFTHTCFMVTPYEGYVTVCEELARLTPGRHEKRSALFNSGAEAVENAVKIARAHTGRSAVVAFAHAYHGRTNLTMALTAKSMPYKHHFGPFAPEIYRMPMAYPYRWPGGPAACGEQAAAQVVETITTEIGAENVAALVIEPIQGEGGFIVPGTGFLTRLAEFCAQTGIVFVADEVQTGFARTGDMFACEHEGIVPDLIVTAKGIAGGLPLAAVTGRAEIMDSPHVGGLGGTYGGNPVACAAALGAIATIERGDLTARARRIERIAMPRLLALRDRYPFIGDVRGRGAMLALELVADPTEGTPPNQPAPAPDRMVTVAAAAEAHRRGLVLLTAGTWGNVLRLLPPLVIPDDLLLEGLDILDEAFADIARHRPRPRPRLQPQPQPDSLPPTH

SEQ ID NO: 77573 - protein, 139 aa, Glycine max
IMDNCQENAMVLKEGLEGTGRFNIVSKDQGVPLVAFSLKDSSRHDEFEISEFLRRFGWIVPAYTMPPDAQHVTVLRVVIREDFSRTFAERLVIDIEKVLHELDALPSRSSGPALQHPNGDTVSEKDLARQREVVSVWKR

SEQ ID NO: 77574 - protein, 252 aa, Prunus fruticosa
VDYKSEADVGNAIAEAIQSGLVKREELFITSKASNHGHVVEACKNSLKKLQLDYLDLYLVHYPLATKHNGVGATASLLDENKVLDIDVTVSLETTWHDMEKTVSLGLVRSIGLSNYELFLTRDCLSYAKIKPQVSQFETHPYFQRESLVRFCKKHGVIPMAHTPLGGATANVKAFGSISPLEDPVLLALAKKYQKSVAQIALRWNLERDTPVIPKSSKVERLKENLEVLNFKLEKEDIELINTIDKKSRTTL

SEQ ID NO: 77575 - protein, 764 aa, Vitis vinifera
MAILSDLGTEILVPACAIVGIVFSVVQWILVSRVKLSPERHSLSNSSKNGTAEYLIEEEEGLNDHSVVQKCAEIQNAISEGATSFLYTEYQYVGIFMVAFAILIFVFLGSVEGFSTKSQPCLYNKGEMCKPALANAIFSTISFLLGGLTSLLSGFLGMKIATYANARTTLEARKGVGKAFITAFRSGAVMGFLLAANGLLVLYIAINLFEIYYGDDWEGLYEAITGYGLGGSSMALFGRVGGGIYTKAADVGADLVGKVERGIPEDDPRNPAVIADNVGDNVGDIAGMGADLFGSYAESSCAALVVASISSFGINHEMTAMFYPLIISSIGILVCLITTLFATDFFEIKAVKEIEPALKKQLIISTILMTAGIAFVSWIALPSSFTIFNFGSQKVVKNWQLFLCVGVGLWAGLIIGFVTEYYTSNTYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNTIPGLMEGTAKPDYATCVKISTDASIKEMIPPGALVMLTPLIVGTLLGVETLAGVLAGSLVSGVQIAISASNTGGAWDNAKKYIEAGASEHAKALGPKGSDPHKAAVIGDTIGDPLKDTSGPSLNILIKLMAVESLVFAPFFAAHGGLLFKIWK

SEQ ID NO: 77576 - protein, 176 aa, Solanum demissum
MDDHEEIIDEYKGEKVWWISSQKPANRQTISFYREDEKRYFKLKFHKKNRDLITNSYLKYVLDEGKAISVKKRQRKLYTNNNGDRGGCRYRGGRMWSGVVFEHLSTFDTLAMDPNKKQDIIYDLETFSKSKDYYAKIGKAWKRGFLLYGPLGTGKSSKIAVMANFLKYDVYDLGKV

SEQ ID NO: 77577 - protein, 209 aa, Neisseria meningitidis Z2491
MNLFQNAKFFTTVNHLKDLPDTPLEIAFVGRSNAGKSSAINTLTNHVRLAYVSKTPGRTQHINFFELQNGNFMVDLPGYGYAQVPEAVRAHWVNLLGDYLQQRKQLIGLVLIMDARHPLKELDIRMLDFFHTTGRPVHILLSKADKLSKNEQIKTLSQVKKLLKPYSDRQNISVQLFSSLKKQGIDEANRTVGSWFDAADAAASSPKEN

SEQ ID NO: 77578 - protein, 584 aa, Physcomitrella patens subsp. patens
MGSISAANLELIATLASHCLQRTTESVKQGQAVLQQAVQPLPSCFPPGPNGDVALDFARDPLECLASLKSRYGSLVGFKLASRPIVLVSSPYGLYPCLILKPAEFMSCKISEVVLHRMIFVFSSRSLRCLENFSREVFVTQSSTFIKAGTAFFPGSSLAGNGLLVSDGDIWKRQRRLSNPAFRRAAIQTYAEAMVNITEKMVDKVWRTGGVRDVYADFNELTMEIVASALFGASEASEEMAQVGPAITQAFQFFTRRATSMFIVPEWVPTFDNIQYNNAVTDLNKVVFRLINERRRQLANSSAPPRKDLLTRLLHVTDEDGSGMDNQSLRDELMTFLVAVPNLNSCAPGLDLVEDITCASRTGFPELYPENTGQETSAILLTWALLMFALHPHTQELVFQEISEVLNGQLPRQTDVSKLRYLEAFIWETLRLMPPAYVVGRCACHPTELGGYKIPQGTTILVSPYLLHQDPAFWPRVSEFDPSRWMPGGDATEHMENDSFWPFGGGPRNCIGMGFAMMEVTLVLAVISSRFRVSLPVGEPIPSPRAMITLRPESEVKLRLTSRRQQRQRKSEAADEMKVIVCLN

SEQ ID NO: 77579 - protein, 370 aa, Physcomitrella patens subsp. patens
MQDLTEDVRYVYLGVGAGNAVKHSPVVKEKVRIGINGFGRFGRLVARVALERDDIELVAVNDPFISTDYMAYMFTYDSVHGTSFKSDIYAQDANTLSFAGKKVAVFGQKDLAKIPWGKYRADYVVECTGNYTDKDSAAAHLKGGAKKVIITGFSKDAPTLVVGVNERDYRPEHNVVAMASCTTNCMAPLVKVLHDRFGMAEALMTTVHSQTATKKSLNGPSLKDWRSGGTAGFNLIPSSTSASKAIGRVIPTLNGKIRSVAFRVPTPDVSLVDLTVSLNSRVSYEEICQAIREEAEGKMKGILGYNDEDHVSNEFIGDTRSSIFDAKAGFSLSDKLVKLVAWYDNEWGYSHRVVDLIMHMSSVQHCRYHF

SEQ ID NO: 77580 - protein, 426 aa, Gluconobacter oxydans 621H
MSAIVDITSREILDSRGNPTVEVEVELSSGARGRAAVPSGASTGAHEAVELRDGDKSRYGGKGVLKACSHVENDILEVLQGAESEDQIAIDNAMIDLDGTPNKSRLGANAILGVSLAVAKATAEELELPLYRYVGGAYAHLLPVPMMNIVNGGEHADNPIDIQEFMIQPVGAPTVADAIRMGSEIFARLKKGLSEAGYNTNVGDEGGFAPNLKSADEALGFIAKSVEAAGYKLGEDVTFALDCAATEFYADGRYNLKGEGKEFDASGMISYLEDLANRYPIVSIEDGLAEDDWEGWAELTTRLGKKLQLVGDDLFVTNPERLRRGIKAGTGNALLVKVNQIGTLTETLEAVETAHKAGYACVMSHRSGETEDSVIADLAVATNCGQIKTGSLSRSDRTAKYNQLIRIEQQLGSAARYAGRSILKNS

SEQ ID NO: 77581 - protein, 740 aa, Chlamydomonas reinhardtii
MARLKPGKVQLPALDTGPIPLVPIREQARKQLLEVIDSRRGKKALILDPAVSGPLGLLDAGLTDLLTEHGVVKLLYLEPGKRLDDVAYNATEPKLADTRSVVYLVRPTVANAQAVAAQIKTRTKADAHDFSVCFVPRRTIACERVLEEEGVLGDVAIGEYCLDMVPYDDDVLSLELDSAFADCVADGDSTPLYYTAAAITRLQALYGVIPRVQGKGPAATAVRDMCFRMRRESSGLTAAPPLAATLGAAGLAGASGLGLGGRIDRMILIDREVDLITPMMTQITFEGLIDEVTGIKHGTVPWLAKDKRGGGAAGESAGEGAGGGGRGPAGRTLLNSTDPFYREFRDLPFHVAIMRLGQYVQDARREYSELGSKDLSELKSFVKGLPKLNMLDRLSDVATPPAERVREQLFHDRLNQEQAIVEGYEPEASVAFIEELMYRGADTVDVLRLLVLLSAVGGGLPRKQLDGLRQELLHTYGHQHLLTLNVLEKAGLLKASPGTKSHFSAVRKALHLIVPEQEPAPGAGGADGAGGGAEPTDVSYLYKGYAPLSIRLVEAALKTGFGPLSEALQHLPGSAFDVVQAVDSNGMPVEKPYKPAPVSAGSAAGVAGASASASGAAPGSGLSSAASSGNVTGLGAGSGMGGLATAASLSAGGGGLGAGGGGAGGAHGQPETVLVVFIGGVTFAEISALRFISSRPDSGFRFVVLTTRIVNGRTLLQSFIDPVTLQYSTAVAAGGSGAQT

SEQ ID NO: 77582 - protein, 425 aa, Zea mays
MESLEALVAHIQGLSGSPEELAHLHSLLKQADGEPLRAHAAALVPFLAHLSPETHSLGYIYLLDACAASASNLSDFGGGDFLVTIAGFLTACSADQIRLAPDKFLHVCKVLKDQVMQLNMPIRGIAPLRAAVRKIQSSPEQLTPVHADYLLLCLLAKQYKAGLSVLEDDIFEVDQPKDLFLYCYYGGMIYIGLKKFPKALELLHNAVTAPMSTLNAIAVEAYKKYILVSLIVNGQVPSFPKYTSISAQRSMKNHAQIYFELSTSYSNGRYTDLETFVESNSAAFQSDNNLGLVKQVLSSMYKRNIQRLTQTYLTLSLEDIARSVQLETPEDAEMHVLRMIEDGEIHATINQKDGMVSFHEDPEQYKSVEMVEHIDSSIQRLTALSKKLASIDENMSCDPSYLLKTGRDRGRFDYDDFDSVPHKYF

SEQ ID NO: 77583 - protein, 78 aa, Magnaporthe grisea 70-15
MIIPIRCFSCGKVTGDLWERFLNLIDSGMSDGDAMDALGCKRYCCRRMIMTHVDLIEKLLKYSTEGRHDKKMNLSHSS

SEQ ID NO: 77584 - protein, 266 aa, Gluconobacter oxydans 621H
MPPSPRLVVGNWKMHGLREQSGRLARAVAEGAQSLPDDVRLVLCPPFTQLASVHGIINAEGPATPLRLGAQDCHTTSSGPHTGDISAEMLADLGVRYVILGHSERRQAHGETDVLIRQKVEAAEAAGLIPIVCIGETTQERLEGRTTTVLATQVEGSLTDGFTGILAYEPVWAIGSGTIPPIDELERTLSLLHGLLQSRLKTDDIRVPILYGGSVTPAQAPTIFSIGSLGGVLVGSASLEAESFLRIAEAASFRLTSQPLSGPYRS

SEQ ID NO: 77585 - protein, 287 aa, Zea mays
TIIILLLKVEVIGLVLVTVKLRSSNIHSDDNLASVSSLLNCSFELKSFLVLLDVRSKTTFVTNIRENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPY

SEQ ID NO: 77586 - protein, 512 aa, Bradyrhizobium sp. BTAi1
MDKATPKADIYKANLDRAAPLLAKLKDEGIGHFIDGKVVPAISGATFETKSPIDNTVLAKVARGNAEDIDRAATSAALAFKSWREMAPAMRRKLLHRVADAIEDHADDIAVLECIDTGQAYRFMAKAAIRAAENFRFFADKCTEARDGLNTPSEEHWNISTRVPIGPVGVITPWNTPFMLSTWKIAPALAAGCTVVHKPAEWSPITAHWLAKLAKDAGIPDGVLNTVHGFGEEAGRALTEHPAIKAIGFVGESTTGSAIMAQGAPTLKRVHFELGGKNPVIVFDDADLDRALDAVVFMIYSLNGERCTSSSRLLVQQNIAETFTAKLAARVRALKVGHPLDPATEVGPLIHERHLAKVCSYVDIARQDGAIIAVGGKPVAGPGGGHYVEPTLVTGASQIMRVAQEEVFGPFLTVIPFGDEADAIAIANDVQYGLTGYVWTGDMGRALRVADALEAGMIWLNSENVRHLPTPFGGMKASGIGRDGGDYSFDFYMETKHVSLARGTHKIQRLGV

SEQ ID NO: 77587 - protein, 513 aa, Stevia rebaudiana
MDAVTGLLTVPATAITIGGTAVALAVALIFWYLKSYTSARRSQSNHLPRVPEVPGVPLLGNLLQLKEKKPYMTFTRWAATYGPIYSIKTGATSMVVVSSNEIAKEALVTRFQSISTRNLSKALKVLTADKTMVAMSDYDDYHKTVKRHILTAVLGPNAQKKHRIHRDIMMDNISTQLHEFVKNNPEQEEVDLRKIFQSELFGLAMRQALGKDVESLYVEDLKITMNRDEIFQVLVVDPMMGAIDVDWRDFFPYLKWVPNKKFENTIQQMYIRREAVMKSLIKENKKRIASGEKLNSYIDYLLSEAQTLTDQQLLMSLWEPIIESSDTTMVTTEWAMYELAKNPKLQDRLYRDIKSVCGSEKITEEHLSQLPYITAIFHETLRRHSPVPIIPLRHVHEDTVLGGYHVPAGTELAVNIYGCNMDKNVWENPEEWNPERFMKENETIDFQKTMAFGGGKRVCAGSLQALLTASIGIGRMVQEFEWKLKDMTQEEVNTIGLTTQMLRPLRAIIKPRI

SEQ ID NO: 77588 - protein, 339 aa, Hordeum vulgare subsp. vulgare
MENILHATPAHVSLPESFVFASDKVPPATKAVVSLPIIDLSCGRDEVRRSILEAGKELGFFQVVNHGVSKQVMRDMEGMCEQFFHLPAADKASLYSEERHKPNRLFSGATYDTGGERYWRDCLRLACPFPVDDSINEWPDTPKGLRDVIEKFTSQTRDVGKELLRLLCEGMGIRADYFEGDLSGGNVILNINHYPSCPNPDKALGQPPHCDRNLITLLLPGAVNGLEVSYKGDWIKVDPAPNAFVVNFGQQLEVVTNGLLRSIEHRAMTNSVLARTSVATFIMPTQECLIGPAKEFLSEENPPCYRTIMFRDFMRIYNVVKLGSSLNLTTNLKNVQKEI

SEQ ID NO: 77589 - protein, 489 aa, Pseudomonas fluorescens Pf-5
MPSITVEPCTFALFGALGDLALRKLFPALYQLDAAGLLHDDTRILALAREPGSEQEHLANIETELHKYVGDKDIDSQVLQRFLVRLSYLHVDFLKAEDYVALAERVGSEQRLIAYFATPAAVYGAICENLSRVGLNQHTRVVLEKPIGSDLDSSRKVNDAVAQFFPETRIYRIDHYLGKETVQNLIALRFANSLFETQWNQNYISHVEITVAEKVGIEGRWGYFDKAGQLRDMIQNHLLQLLCLIAMDPPADLSADSIRDEKVKVLKALAPISPEGLTTQVVRGQYIAGHSEGQSVPGYLEEENSNTQSDTETFVALRADIRNWRWAGVPFYLRTGKRMPQKLSQIVIHFKEPSHYIFAPEQRLQISNKLIIRLQPDEGISLRVMTKEQGLDKGMQLRSGPLQLNFSDTYRSARIPDAYERLLLEVMRGNQNLFVRKDEIEAAWKWCDQLIAGWKKSGDAPKPYAAGSWGPMSSIALITRDGRSWYGDI

SEQ ID NO: 77590 - protein, 349 aa, Mycoplasma pulmonis UAB CTIP
MMICKTNNYYFFKEILVIRIAINGFGRIGRLTFKRLVEKHKNEVEIVAVNDLTQSSTLMHLLKFDTAYGRFNSKVELTEKGFSVDSKEVLVFAERDPRNLPWGKLEIDLVLECTGMFASKEKSQVHLDAGAKRVLISAPSGSDVKTIVYGVNDSSLSSEDKIVSAASCTTNCLAPLVNALEKEYGILTGSMTTTHAYTADQRLQDAPHNDLRRARAAAQNMVPTSTGAAKAIGLVVPSAVGKLDGVAIRVPVITGSLVDLAVQLEKDPKSVEELNAAIKKYASESFEYSEDPLVSSDIIGSSYGSIFDSKLTKIIGSGENKLYKLYAWYDNEASFVSQFVRTALAFGKK

SEQ ID NO: 77591 - protein, 807 aa, Glycine max
MSQQGESSDPKSGKKDFSTAILERKKSPNRLVVDEAVNDDNSVVTMHPQTMEKLQLFRGDTILIKGKKRKDTICIALADENCEEPKIRMNKVVRSNLRVRLGDVVSVHQCPDVKYGKRVHILPIDDTIEGVTGNLFDAFLKPYFLEAYRPVRKGDLFLVRGGMRSVEFKVIETDPGEYCVVAPDTEIFCEGEPLKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSDDVDLERIAKDTHGYVGADLAALCTEAALQCIREKMDVIDLEDETIDAEVLNSMAVTNEHFQTALGTSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVAKNVDLRTLARHTQGFSGADITEICQRACKYAIRENIEKDIERERKSKENPEAMDEDTVDDEVAEIKAAHFEESMKFARRSVSDADIRKYQAFAQTLQQSRGFGSEFRFPESGDRTTTGSDPFATSAGGADEDDLYS

SEQ ID NO: 77592 - protein, 600 aa, Glycine max
MWKVVRFAAARSRRFSTAIPGPCKVHKRGTDILHDPWFNKDTGFPLTERDRLGLRGLLPPRVISFEHQYDRFMNSYRSLEKNTQGQSDRFVSLSKWRILNRLHDRNETLYYRVLIDNIKEFAPIIYTPTVGLVCENYSGLFRRPRGMYFSAKDKGEMMSMIYNWPSDQVDMIVLTDGSRILGLGDLGVQGIGIPIGKLDMYVAAAGINPQKILPVMLDVGTNNQKLLEDPLYLGVRQPRLEGEEYLLIVDEFMEAVHARWPKAIVQFEDFQMKWAFETLKRYRERFCMFNDDIQGTAGVALAGLLGTVRSQGQPLSDFLKQKIVVVGAGSAGLGVLSMAVQAVSRMSGGSGTDANSQFFLIDKDGLVTTERSNLDPAAVPFAKNPRDLEGLSEGASIIEVVKKVKPHVLLGLSGVGGVFNTEVLKAMRESVSTKPAIFAMSNPTMNAECTAIEAFSHAGENIVFASGSPFENVDLGNGEVGHVNQANNMYLFPGIGLGTLLSGARHITDGMLRAAAECLASYMTEDDVRKGILYPSIDCIRDVTAEVGAAVVCAAVAEKQAEGHGDVGFKELENMSKEETVEYVRGNMWYPEYCPLVHEK

SEQ ID NO: 77593 - protein, 344 aa, Zea mays
LEGRASRAAKKKSSRETLLTLTEGDMARKLRELLQKSGNRVCADCGAPDPKWASANIGVFICLKCSGVHRSLGTHVSKVLSVTLDQWTDDEINSMIEVGGNSYANAIYEAFLPEGYQKPHPDSSQEERADFIRSKYELQEFLKPSLRLVSSNKGSLEATSTSSRKHKDNTVSLSASFSSEAGMVEFIGILKVKVIRGTKLAVRDLMSSDPYVVLTLGQQKAKTSVSKRNLNPVWNEELKLSVPQHYGPLKLQVFDHDMLSKDDEMGDAEIDLQPMISAATAFGDPDLLADMQIGKWLRSPDNALARDSAVNVVGGKVKQEVSLRLQNVESGEVELELEWIPLNQ

SEQ ID NO: 77594 - protein, 496 aa, Oryza sativa Japonica Group
MGENGVVASKLCYPAAAMEVVAAELGHTAGSKLYDDDGRLKRTGTMWTASAHIITAVIGSGVLSLGWAIAQLGWVAGPAVMLLFSFVTYYTSALLADCYRSGDESTGKRNYTYMDAVNANLSGIKVQVCGFLQYANIVGVAIGYTIAASISMLAIKRANCFHVEGHGDPCNISSTPYMIIFGVAEIFFSQIPDFDQISWLSILAAVMSFTYSTIGLGLGVVQVVANGGVKGSLTGISIGVVTPMDKVWRSLQAFGDIAFAYSYSLILIEIQDTIRAPPPSESRVMRRATVVSVAVTTLFYMLCGCTGYAAFGDAAPGNLLTGFGFYEPFWLLDVANAAIVVHLVGAYQVYCQPLFAFVEKWAQQRWPKSWYITKDIDVPLSLSGGGGGGGRCYKLNLFRLTWRSAFVVATTVVSMLLPFFNDVVGFLGAVGFWPLTVYFPVEMYIVQKRIPRWSTRWVCLQLLSLACLAITVASAAGSIAGILSDLKVYKPFATTY

SEQ ID NO: 77595 - protein, 297 aa, Listeria seeligeri
AEEIAKEVGIELGKSSVTHFSDGEIQINIEESIRGCHVYVIQSTSNPVNQNLMELLIMIDALKRASAATINIVMPYYGYARQDRKARSREPITAKLVANLIETAGATRMITLDMHAPQIQGFFDIPIDHLNAVRLLSDYFGERHLGDDLVVVSPDHGGVTRARKMADRLKAPIAIIDKRRPRPNVAEVMNIVGNVEGKVCIIIDDIIDTAGTITLAAKALREAGATKVYACCSHPVLSGPAMKRIEESPIEKLVVTNSIALPEDKWIDKMEQLSVAPLLGEAIVRVHENASVSSLFE

SEQ ID NO: 77596 - protein, 841 aa, Microcystis aeruginosa PCC 7806
MRAVLMAGGSGTRLRPLTCDLPKPMVPILNRPIAEHIINLLRKHDITEIITTLHYLPDVMRDYFQDGSDFGVKITYAVEEDQPLGTAGCVKNIAEWLDDTFLVISGDSITDFDLQKAIAFHKSKNSKATLVLTRVPNPIEFGVVITDKEGRIRRFIEKPSTSEIFSDTVNTGTYILEPEVLDYLPYKEESDFSKDLFPLLLQRGEPMYGYVADGYWCDVGHLEAYREAQYDALSGKVNLEFPYRETSPGVWVGTNTYIDPSAHIEAPAMIGNHCRIGANVLIERGSVIGDNVTIGAGSDLKRPILWNGVVIGDEVNLAACTIARGTRIDRRAQVHEGAVIGQLSIVGEEAQINSGVRVWPSKQIESGAILNINLIWGNTAHKNLFGQRGVSGLANIDITPEFAVKLGAAYGSILKPGSTVIVSRDQRSVSRMVSRSLIAGLMSVGVNIQNLQANALPISRTLVSKLNVVGGIHVRIHPDRPDFLLIEFLDEKGINVSKAREKKIEGAYFKEDLRRVGMQEIGSMSYPADILDNYRKTFETQLNVEAIRNSSSKIVIDYAYGVSGAILPELLAKFGCDAVVLNASLRQNALSMQERELLIHQLGHVVEALKANLGVQVSANGEQLVLVDESGLSIRGEQLTALMVNTILTAHPRGTVVVPVHASSAVEQIARRHDGRVVRTKASPSALMEGCQTNPNVVLGGSGQTGFIFPQLHPGFDAMFSVAKLLEMLTIQERSLAQVRAELPRIYNKNTAVRCPWKVKGSLMRYLVETHATDNLELIDGVKVINPLNDDWVLILPDAGEPLVHIYANSEQREWVDRTIKEYRHRVQYFVEHYQGEIVMI

SEQ ID NO: 77597 - protein, 772 aa, Cucumis sativus
MTVTPKITVNDGNLVVHGKTILTGVPDNIVLTPGSGLGLVAGAFIGATASNSKSLHVFPVGVLEGTRFLCCFRFKLWWMTQRMGTSGRDIPFETQFLLMESQGNDGEDPDNSSTIYTVFLPLLEGQFRAALQGNEKNEMEICLESGDNTVETNQGLSLVYMHAGTNPFEVITQAVKAVEKHTQTFLHREKKKLPSFLDWFGWCTWDAFYTDVTAEGVVEGLQSLSDGGAPPKFLIIDDGWQQIEAKPKDADCVVQEGAQFASRLSGIKENHKFQKNGNNYDQVPGLKVVVDDAKKQHKVKFVYAWHALAGYWGGVKPASPGMEHYDSALAYPVQSPGMLGNQPDIVVDSLAVHGIGLVHPKKVFNFYNELHSYLASCGIDGVKVDVQNIIETLGAGHGGRVTLTRSYHQALEASIARNFSDNGCIACMCHNTDSLYSAKQTAVVRASDDYYPRDPASHTIHISSVAYNSLFLGEFMQPDWDMFHSLHPTAEYHGAARAIGGCAIYVSDKPGNHNFDLLKKLVLPDGSVLRAQLPGRPTRDSLFNDPARDGTSLLKIWNMNKCSGVVGVFNCQGAGWCRITKKTRIHDESPGTLTTSVRAADVDAISQVAGADWKGDTIVYAYRSGDLTRLPKGASVPVTLKVLEYDLFHISPLKDITSNISFAPIGLVDMFNIGGAVEQVDIQVVEPIPEFDGEVASELTCSLPDDRPPTATITMKARGCGRFGLYSSQRPLKCSVDKVGTDFVYDDVTGLVTFEIPIPTEEMYRWNIEIEV

SEQ ID NO: 77598 - protein, 671 aa, Zea mays
  misc_feature (263)..(263): Xaa can be any naturally occurring amino acid
ASMVSSHGFLLSLQALTMVSTIMTNTGVIATQGQAFCPSSSCAHASAHASAFRMQGDPQGCGFPEYELVCIDSKAIIHINNGRYFVTSISYSNSTFWVVDANLDNSSCPIPASNQRPYVNGLPSEGRTLLDPDTVTWAAFVSCSEMLSDVSSPFLSCCSGIYQPVNCRSTKNSFAYVFTTTFFPMVGDIKPSCRYLPMIPFGSRHVKRPDNASYDDIVKFMKNGFAVNFPYRNGRSYHLVINTCLKDANGYFNDKISNSSIVXPDIGLAVFGIDLRFLRCVNDYSYRSKLFWAMVAMISTVVIVKFVIVFGILSRFVFAPLTVLTFLAYKYWKTRISIDAVEKFLQMQQALSPARYAYTDITAITGHFREKLGQGGYGSVYRGVLPGDVSVAVKMLSNSLCNGDEFISEVSTIGSIHHVNVVRLVGFCSEETKRALIYEYMPRGSLDKHIFSSEQSFSWDKLNGIALGIARGINYLHQGCEMQILHFDIKPHNILLDNSFTPKVADFGLAKLYPRDNSFVPVSAARGTIGYIAPEMISRNFGVVSCKSDVYSFGMLLLEMAGGRRNLDQHAERRSQTYYPAWVYSHLTRQEVGEICEAFDVHEVERKLCVVGLWCIQMKPHDRPTMAEVVGMLEAGADGLQIPPQPFFCGGELTGSTSYFSSELSAISENG

SEQ ID NO: 77599 - protein, 524 aa, Aspergillus oryzae
MGILAVILDSVCERCSGSSLWMLSTVALLSILVVSVVINVLRQLLFKNYKEPPLVFHWFPFIGSTISYGMDPYRFFFNCREKYGDIFTFVLLGKKTTVYLGTKGNDFILNGKLRDVCAEEVYSPLTTPVFGRHVVYDCPNAKLMEQKKFVKFGLTSDALRSYVRLITEEVEDFVQKSSALQGPNGVFDVCKTIAEITIYTASRSLQGKEVRSRFDSTFAELYHDLDMGFAPINFMLPWAPLPHNRKRDAAQKRMTETYMEIIKERRKAGSKKDSEDMVWNLMSCMYKDGTPVPDEEIAHMMIALLMAGQHSSSSTAAWIVLHLAASPEITEELYQEQLRILGHDMPPLTYENLQKLDLHAKVIKETLRIHAPIHSIIRAVKNPMPVEGTPYVIPTSHNVLSSPGVTARSEEHFPDPLEWKPHRWDEAIAVSSEDEEKVDYGYGLVTKGTNSPYLPFGAGRHRCIGEQFAYVQLGAITAALVRLFKFSNLPGVQTLPDTDYSSLFSKPLGNSKIQFEKREPVTKA

SEQ ID NO: 77600 - protein, 478 aa, Staphylococcus aureus subsp. aureus MSSA476
MNMNESGDNKLSKSSLIGLVIGSMIGGGAFNIMSDMGGKAGGLAIIIGWIITAIGMISLAFVFQNLTNERPELDGGIYSYAQAGFGDFVGFISAWGYWFSAFLGNVAYATLLMSAVGNFFPIFKGGNTLPSIIVASLLLWGVHFLILKGVETAAFINSIVTVAKLIPILLVIICMIIAFNFDTFKTGFFGMTSEGVLPFSWASTMSQVKSTMLVTVWVFIGIEGAVIFSSRAKNKKDVGSATVIGLISVLIIYFLLTVLAQGVILQNHISQLDSPSMAQVLATIVGGWGSTLVNIGLIISVLGAWLGWTLLAGELPFIVAKDGLFPKWFAKENKNGAPVNALLITNILVQLFLISMLFTQSAYQFAFSLASSAILYPYMFSAFYQVKYTLEHRQQATTKQWTIGIIASIYAIWLIYAAGINYLLLTMLLYIPALLVYSIVQKNNQTRLIKSDYILFMIIIVLAVIGLIKLLMGTINVF

SEQ ID NO: 77601 - protein, 421 aa, Frankia sp. EAN1pec
MSVAEETTDQPPWVGRERDVTAGASGPAMRISGRAQTFTESVIRDMTRLALRHGAVNLAQGFPDFACPTELKEAAKAAIDADVNQYAITWGAADFRAAIAAKIGRTYPGWTVDPDTEICVTCGSTEAMIAAMLALVDPGEEVVFFEPFYENYGPDSILSGAVPRLVRLHGPDWSIDPAELRAACSDRTRAIVVNTPHNPTGKVFSADELALIAELCQRHDILVFTDEIYEHIHYLGPGGHIPPATVPGLEDRTVTVNALSKTYAVTGWRVGWTVAPAPYTEAIRKVHDFLTVGAAAPLQAAGVAAMGLPPEYYAGLAQEYRVRRDLLCGALENTGFALRPPDGAYYVMCDTTDLDPAGDDVAFARRLVSELGVAAVPGSSFYADPADGRRIVRFGFPKRLETLRAATDRLRLLERTRAAHP

SEQ ID NO: 77602 - protein, 415 aa, Schizosaccharomyces pombe 972h-
MLRFLKPFPLRFGKRFYSKVPPVTNHERILPKQPSFPTAPAQNEIATLTIRNGPIFHGTSFGANRNVSGEAVFTTSPVGYVESLTDPSYKQQILIFTQPLIGNYGVPDCKKRDENGLLRHFESPHIQCAGVVVNDYATKYSHWTAVESLGEWCAREGVAAITGVDTRAIVTFLREQGSSLAKISIGEEYDANDDEAFINPEEVNLVSQVSTREPFFVSGGDGMLNIAVIDCGVKENILRSLVSRGASVTVFPFDYPIQNVASNYDGIFLTNGPGDPTHLTKTVNNLRELMNTYNGPIMGICMGHQLLALSTGAKTIKLKYGNRGHNIPALDIASGNCHITSQNHGYAVDASTLPAEWKATWTNLNDQSNEGIAHVSRPISSVQFHPEARGGPMDTFYLFDNYIKEAIKYQKSRTA

SEQ ID NO: 77603 - protein, 809 aa, Schizosaccharomyces pombe 972h-
MSVAIKFTVKINDGSLRRQQTRHVFLSPAALNRLKLSPSQVIYLKHKGGEAVGITQSVKGNGIGPFEILISPLLAKWANLKAFQRVNISQYVHPLKEAEGIKIVASLSSNNEPIPESLIRKELLEIRYLHPGMIVMGESPMNMAKSGSKNLSSENMATEIFEINSGLSAQSGTEVGSSQSSPSVNESEPKATEDLDELSPGSYKVKEIHIRSPSNLIEAISDMSLDEPRIYKFTAASSMEIETPDLLKLPHEDRTQSAYNQGSEETQNFDGPPSAVTFSSIGGLQAQIAQIRDIVELPFQNPELFKFFNIMPPRGVLLYGPPGTGKTMVMRAVAAEANAQVFTIDGPSVVGKYLGETESRLRKIFEDARAHQPSIIFIDEIDALAPKRTEDVSEAESRAVATLLTLLDGMANAGKVVVIAATNRPNSIDEALRRPGRLEKEIEIGIPDKSARLDIIKLLLSGVPNEINDAQLEDLASRTHAYVGADLAAVVREAALRAIKRTISLQKDTSGLDIFGAVQMDDLEFALSSVRQSAMREFMMESPNVHWSDIGGQEEVKQKLKESVEWPLTHGETFSRLGVRPPKGVLLYGPPGCSKTITAKAIATETGLNFIAVKGPELFDKFVGESERAVRQVFQKARQASPSVIFFDEIDALTANRGEDNSSDRVVAALLNELDGIEALRNVLVLAATNRPDMIDPALMRPGRLDRLLYVGPPNFEARKQIVKIQAEKMKFAEDVDLDLIAEKTEGCSGAEVVALCQEAGLIAMHEDLEAKEICQAHFKTALLALRKAITRDMLEYYASFSESVTSIS

SEQ ID NO: 77604 - protein, 403 aa, Gluconobacter oxydans 621H
MPALSPTMTEGKLARWLKAEGDTVSAGDVIAEIETDKATMEVEAVDEGILSRILIQEGVEGIPVNTPIAVLVEDGEAVPEASSTQAPAAPKAEAAPAVLTGTAPAKAAPEEKGERIFVSPLARRMARERGIALDALTGSGPNGRILKRDVEKGVTAPKTSPKAAPSAAPLAASEETVRHVPNSTMRKVIARRLTESKTQVPHFYVSVDIELDALLDLRAKLNATAQENSFKISVNDMMIKAVALALKKVPGVNVQFTDAETLHFENVDISMAVSVPDGLITPIIRNADRKSLRQISVEAKDLAKRARAGKLKPEEFQGGTFSISNMGMFGVREFAAIINPPQAGILAIASGEKRAVVRGSEIAVATVMTATLSVDHRAVDGALGAEWLNALRDIVQNPYTLVV

SEQ ID NO: 77605 - protein, 389 aa, Thermotoga maritima
MGSDKIHHHHHHMVSRRISEIPISKTMELDAKAKALIKKGEDVINLTAGEPDFPTPEPVVEEAVRFLQKGEVKYTDPRGIYELREGIAKRIGERYKKDISPDQVVVTNGAKQALFNAFMALLDPGDEVIVFSPVWVSYIPQIILAGGTVNVVETFMSKNFQPSLEEVEGLLVGKTKAVLINSPNNPTGVVYRREFLEGLVRLAKKRNFYIISDEVYDSLVYTDEFTSILDVSEGFDRIVYINGFSKSHSMTGWRVGYLISSEKVATAVSKIQSHTTSCINTVAQYAALKALEVDNSYMVQTFKERKNFVVERLKKMGVKFVEPEGAFYLFFKVRGDDVKFCERLLEEKKVALVPGSAFLKPGFVRLSFATSIERLTEALDRIEDFLNSR

SEQ ID NO: 77606 - protein, 521 aa, Gibberella zeae PH-1
MSIDPVMQVEDKIAPGPSANNDKPAVEETIIRQTIITTTEDEAHEHIAASNGSASAATSPTTGAASRPRLKKDNSTPNMNGPLYMQTAGNKTVLVRRLKRKEESTWKHLSRWFVENQIGLSFNLLALIFLAQTFIPKARDYTQKFFHLSYHNSQSGQYRIGYDDAYFITFCIILFTGLRAATMEYVLAPIGRWQGVDNRKNLTRFSEQAWLMVYYTVFWPWGVYIYCTSPHYMSMENLWTDWPNRELDGIMKAYLLCQWAFWLQQMIVINIEERRKDHWQMFTHHIVTTALIFACYAYHHTRVGNFILVIMDVVDLFLPLAKCLKYCGYKKICDVMFGLFVVSWFFARHVLYIAVCWSIYSDTPRIMPTGCFKGNNENMIGPLNPPAGWGYLVEPFINPQGLVCYNETVKWGFLGPLLFLQAITIGWFTMIVRVIVKVLKGGDAEDVRSDDEGGEEEEEEEFVYEEAQPLEEEVGVEALDLRNWERRSGVKKQASSSGVSLPGHSDRKELLGRIGCEKQVD

SEQ ID NO: 77607 - protein, 468 aa, Gluconobacter oxydans 621H
MCDTFDLIVVGGGPGGYVAALRASQLGMSVALVESTHFGGVCLNWGCIPTKALLRSSEIHHLLHELGTFGLSADNISFDLSKIVGRSRSIARRMGGGIAHLLKKTKVTTFDGRAKLAGRSGEAHQVAITKDGAAVATIKAPHVILATGARGRQLPGLETDGTLIWGAREAMTPKELPKRLLVIGSGAIGIEFASFYRNMGSEVTIAEVADRILIAEDPEISAAARKAFEKQGMKIITSAKVGPLNKGENEVSTTIESPTGKVDLTVDRVICAVGIVGNVEDLGLEGTKVQVERTHIVTDGFCRTGEPGIYAIGDVAGAPWLAHKASHEGILCVEKIAGRSPQPLHPLNIPGCTYSRPQIASVGLSEEKAIAAGHKVKVGRFPFIANGKAVAMGETDGMVKTVFDATSGELLGAHMIGAEVTEMIQGYVITRTGELTEAELVETVFPHPTISETMHEATLAAFDGPLHI

SEQ ID NO: 77608 - protein, 249 aa, Xylella fastidiosa Temecula1
MTRKLVLLRHGQSQWNSMNRFTGWVDIGLTEQGHQEATMAGHLMKKEGLEFDVAHTSLLKRAIHTLQDALKALDQDWLPIYKSWRLNERHYGALQGLDKIDTAAKHGEEQVNIWRRSYDIQPPPIDLDDPSHPMRDRRYAALDRKVLPVRESLKNTLERVLPYWNDAIAPQLNDNKTVLISAHGNSLRALYKYLNKESDEKILNVNIPTGIPLLFELSDTLQVVSYRYLGDPDAAQRAAEMVANQGKAK

SEQ ID NO: 77609 - protein, 297 aa, Oryza sativa Japonica Group
MAQNVPSKGVKMPMDSADWNDYNTRVVCEIFVEQVAAGNRPNTHLSNPGYNEVIEKFAVRTGLRYTRLQIKNKWDKHRVEYNCWKKLTSQTGLGWDNTKETVTATVEHWKQLKGDIPGCTKFMKAGLQNEELLQKMFEDIRNTGADHWSLGQSTIPTPTNEAIHIADDNEIDEETEDDEPSAKRKRGGGSKVDKSKKSKSGSQKMVEEMSKSNELSAQTLSSIQSFTKTREDPPGCSIKDVMALVEECCAVEGTNEHFIATEIFIKKDQREMFVNSLCTPAGCFAWLKKKYEVKYGN

SEQ ID NO: 77610 - protein, 335 aa, Achromobacter xylosoxidans
  misc_feature (154)..(154): Xaa can be any naturally occurring amino acid
TIRVAINGYGRIGRNILRAHYEGGKSHDIEIVAINDLGDPKTNAHLTRYDTAHGKFPGTVSVNGSYMVVNGDKIRVDANRNPAQLPWGALKVDVVLECTGFFTTKEKAGAHIKGGAKKVIISAPGGADVDATVVYGVNHGTLKSTDTVISNASXTTNCLAPLVKPLNDKLGLQDGLMTTVHAYTNNQVLTDVYHEDLRRARSATMSMIPTKTGAAAAVGDVLPELDGKLNGYAIRVPTINVSIVDLSFVAKRNTTVEEVNGILKAASEGELKGILDYNTEPLVSVDYNHDPASSTVDASLTKVSGRLVKVSSWYDNEWGFSNRMLDTTVALMSAA

SEQ ID NO: 77611 - protein, 429 aa, Flavobacteria bacterium BBFL7
MTLKELQKLDAQHIWHPLTQHKTANSPLAIKKGQGNYLYDMSNKPYFDAISSWYTCSYGHANPVLTESIKKQVDQLHHVVFAGMTHEPAAHLSKKLIGILPDNQQKLFFSENGSTSVEIALKMAFQYHFNRGEKRNVVIALENGFHGDTFGAMSASSLSVYNGPFEDFFIDVQRIPVPTDENINEVLNLIEELTTQYQVASFIYEPLVQGAAAMQMHEPAHLDCLLKLFKEKAVLTIADEVMTGFGKTGYNFASEAMINKPDMMCLSKALTGGIMPMAITTCTQEVYDAFYDNELTRGFFHGHTYSGNPLGCAVAAAGIDLLTSSAIQKNIEFITQSHQEHIQVYDTHKAVAAVRSCGVILAIDLAIEMERYGSKRNEIFQWFMDHGIFLRPLGKTIYIVPPFTTTPQELELLYKALLVFLDEMTANKA

SEQ ID NO: 77612 - protein, 836 aa, Mycoplasma pulmonis UAB CTIP
MLLLSLKFYIIINDITSGVLKMNYKALYRVYRPTTFDEVNGQDHIVATLKNIILTNKISHGYLFNGPRGTGKTSVAKIFATALNCIHKNDDFNPCQICIENSNKNIDIIEMDAASNNSVDDVRRLNEELKSLPLKGEYRIYIIDEVHMFTKSAFNALLKSLEEPPKHVIFIFATTESHKIPNTILSRVQRFNFRRISNDVIIGHLANILEKEKINYEPKSLVYIASLASGSFRDALSIADQASIYGQGKITLKNLITSFGISSNESVINLINNTVFNLYEAINNLDEFKKNGADPEYLLISLINIIKDFIVFKKTNNLSFLALLSFDEIDLIKIDLQKSYFIIEEAMKTLEFLRISEMPFDAIEILIIKVHKKIGQEEEKENENEKLKIIQNSIDNEKIKDELLNYASASKGSIGTNTIETSILETSEDEEAQSLTQILNSGEMDLKLKEKTNNSWDKTQNHKQQSNTDLISKTNEIITNLNENEASISELDQNIITSEIDNNFEDDNLISTGEFSLENYLKNQDSSAQSNQRKIEDFLFSAKNEIPHETNLTKTINATLKNQEKANENFTKEQDSSVKEILETLKIELSKKSQEIEVDQGDFYTDNSSKENEIIDTNQFDYTTKEKLKTSDLFFTEEKPILERVKVDNLYKKTTEEIKVDKTKTTTTTTESQDVVIEKVNEDKYSVDEVINMFLQHDNANYREESKMAIQNANNFLANPRFRKYAHFFSAVHCVAANKNFVVVSSEINLDIFNLLESIEKVEFKNFINDLYGYPKYVFPITESLWKLAKIKWQDIKNKKIPVPEIKKIEIENVDKKATQFFSKIFGNITTKKRGE

SEQ ID NO: 77613 - protein, 222 aa, Nitrosomonas europaea ATCC 19718
MTHPLFRHAEFYTTVNRLQDLPQTAGVEVAFAGRSNAGKSSAINTLVGRERFAFVSKTPGRTQHINFFQLGEERFMVDLPGYGYAQVPLAIRQHWGHLLSSYLQTRQSLYGMILIMDIRHPLTKLDLQMLDWFRQTKKPVHVLLTKADKLSKSRALVALNEVRQFLTVNYPHCTVQTFSSLKVAGVEEASQLLQNWFDTGHASVQQENGEISEQKKTPAKGD

SEQ ID NO: 77614 - protein, 332 aa, Desulfotalea psychrophila LSv54
MNLTQFPRRNYLQGPTPIEAAPRFSKALGGKVNVFIKRDDLLPGCAGGNKTRKLDFCIADAIEKGADTIITCGPVQSNHCRLTLSWAVKEEMDCHLILEERVPGSYKEDGSGNNFLFNLMGVKSTQVVPGGSDMMGEMEKLAKELEAQGKKPYIIPGGASNVLGATGYVACAQEIQQQLFQQNINITDIVVPSGSAGTHAGVAVGMYGINSGIRVSGINVSKPKDVQEENVYKLAYETAKAVGVCGELPRGEITCFDGYVGAGYSLPTDSMVEAVKLLARTEAILLDPVYSGKVMAGMIDLIRNDYFAPGTNVLFLHTGGSPALYAYTDTFK

SEQ ID NO: 77615 - protein, 285 aa, Zea mays
MAKDIEAAAAHEGKDYSDPPPAPLVDAEELTKWSLYRAVIAEFVATLLFLYITVATVIGYKHQTDAAASGPDAACGGVGVLGIAWAFGGMIFILVYCTAGVSGGHINPAVTFGLFLARKVSLVRALLYIVAQCLGAICGVGLVKGFQSAFYVRYGGGANELSAGYSKGTGLAAEIIGTFVLVYTVFSATDPKRNARDSHVPVLAPLPIGFAVFMVHLATIPITGTGINPARSLGAAVIYNNDKAWDDHWIFWVGPFIGAAIAAAYHQYVLRASAAKLGSSASFSR

SEQ ID NO: 77616 - protein, 318 aa, Listeria ivanovii
MSNEYFDPKLKIFSLNSNRELTEEIAKEVGIELGKSSVTHFSDGEIQINIEESIRGCHVYVIQSTSNPVNQNLMELLIMIDALKRASAATINIVMPYYGYARQDRKARSREPITAKLVANLIETAGATRMITLDMHAPQIQGFFDIPIDHLNAVRLLSNYFGERHLGDDLVVVSPDHGGVTRARKMADRLKAPIAIIDKRRPRPNVAEVMNIVGNVEGKVCIIIDDIIDTAGTITLAAKALREAGATKVYACCSHPVLSGPAMKRIEESPIEKLVVTNSIALPEDKWIDKMEQLSVAPLLGEAIVRVHENASVSSLFE

SEQ ID NO: 77617 - protein, 334 aa, Pseudomonas fluorescens Pf-5
MTLRIAINGFGRIGRNVLRALYTQGYRQDLQIVAINDLGDSAINAHLLKYDTVHGTFDAQVEHDQESLTVNGDRIAVSAIRNPAELPWAAEKIDVVFECTGLFTDRAKAAAHLTAGARKVIISAPAKGADATVVYGVNHDILRQSHQIISNASCTTNCLAPVAQVLHRELGIDNGLMTTIHAYTNDQNLTDVYHSDPYRARSATQNMIPSKTGAAEAVGLVLPELAGKLTGMAVRVPVINVSLVDLTVTLKRDTTAEEVNALLKSASQHSTILGYNTLPLVSSDFNHNPLSSIFDANHTKVSGGRLLKVLAWYDNEWGFSNRMLDNCLALCNAE

SEQ ID NO: 77618 - protein, 177 aa, Triticum aestivum
  misc_feature (36)..(36): Xaa can be any naturally occurring amino acid
  misc_feature (55)..(55): Xaa can be any naturally occurring amino acid
  misc_feature (117)..(117): Xaa can be any naturally occurring amino acid
  misc_feature (127)..(127): Xaa can be any naturally occurring amino acid
  misc_feature (134)..(134): Xaa can be any naturally occurring amino acid
  misc_feature (143)..(143): Xaa can be any naturally occurring amino acid
MAPTVMASSDTSVALFQGLKSTAGLPVSRRSNGASXSASVSNGGRIRCMQVWPIXGIKKLESLFYLPPLTTEALLKQVDYLIRSKWVPCLEFSKVGFIFRDHNASPGYYEGRYWTKXKLPMFGCTDXTHVINEXEEVKKEYPXDPYVRIMGFDNMSEVPRGHFIAYKPPGCHESAKA

SEQ ID NO: 77619 - protein, 152 aa, Zea mays
MTTEQTFIAVKPDGVQRGLIGPIITRFENRGFKLAGIKMVTPSKEHLEKHYADLSDKPFFPGLIAYMGSGPVCAMVWEGRDAVKTGRSILGATNPLASAPGTIRGDYALDVGRNVCHGSDSVENGKKEIALWFKDGEVQSWKSAQHDWVYEK

SEQ ID NO: 77620 - protein, 292 aa, Thiomicrospira crunogena XCL-2
MSYKKLTKAVIPVAGLGTRFLPATKAIPKEMLTVVDKPLIQYIIHEAAEAGITDIILVTHSSKGAIENHFDKHYELEAELEIRGKKDRLESLKEITPKGVRIVSVRQPEALGLGHAILCASPIIADNEPFAVLLPDVLMHHSVKGCLAQMTEQYRKMHTSVVALEAVPDDQVEKYGIAAVKGPDLRIVELVEKPKPADAPSNLSVVGRYIFTPRLMEILKTTKPGAGGEIQLTDAMDELLNEEVMFGFEFKNGHTYDCGDKLGYLQANVEYALRDKTLGKGFKAYLKSLKLS

SEQ ID NO: 77621 - protein, 543 aa, Thiomicrospira crunogena XCL-2
MGVETSSAWQALQLHSDSGMGSIHLSKLFQDTNRQDDYSLELSDVYVDFSKNRITQETVQLLIELAEQQKLPKEIHRLMTGEHVNDTEDRPALHTALRALGKDVSGGAETVQPEIEQVLQKMELMTKKIRSGHWRGYSGKPITDVVNIGVGGSDLGPLMITHSLQTISSPINLHFISSIDGTQTSNLLRGLKQETTLFILASKSFTTIDTLSNAETAKDWLKECISDERVIFSQHFIGVSTKPDKMQEWGIPPENQLMFWDWVGGRYSLWSAIGFPIALKIGMDGFRELLQGAHEMDQHFATADLKKNIPVILALIDIWNINFLNIHDKAILPYDARLRYLPAYLEQLVMESNGKSVARSGESVPYKTCPVLWGEVGPNAQHAFYQLLHQGTQAVMCDFIAPVERDDFDANSHTERDESLRHQHELALANCFAQSRVLMLGDNAIPSDLKASFDSPFKHYPGNQPSNTILIKTISAKTLGMLVAMYEHKTYVESVIWEINPFDQWGVELGKLIAKETYNAIKDKPLADSFDSSTKGLIDRVVK

SEQ ID NO: 77622 - protein, 449 aa, Synechococcus sp. RS9916
MTITASASSALTAKATFDDLGLSAPLLQALREKGYSTPSPIQEQAIPAVLSGRDLMAAAQTGTGKTAGFTLPMLETLSHGARPGRGQIRALVLTPTRELAAQVLDNARDYSRHLRLRSEVVFGGVKINPQIQRLQQGVDLLVATPGRLLDLHQQGAVRFERVEFLVLDEADRMLDMGFIHDIRRVLSRLPERRQNLLFSATFSPSIRKLATGLLNDPLQIQITPPNQTARTVQQVVHPCDMKRKPDLLSHLIRSNDWQQVLVFSRTKHGANRVAEKLTNEGLVAAAIHGNKSQGARTRALQGFKDGSVRVLVATDIAARGIDIQQLPHVVNLDLPNVAEDYVHRIGRTGRAGECGHAISLVAAEEALLLKAIERTTRESLEKVLVPGFEPTVLDAPPLDLSGGRGRRSPRGGGPTRNHHERNRGGGGSRGGSSRSASGRPKRSGRPPQR

SEQ ID NO: 77623 - protein, 436 aa, Thiomicrospira crunogena XCL-2
MKITVFGCELSGLVTAGSLAHTGNEVLAIPVGKAKAEELKQGLLPRDEPGLDQLIASQLKEGRLDFSHDWSEGIQHGEVYFLSMPSWRADKAELVIDAIGQSASKDVLIVNQSTFPIGTADRFEATIKLAFAQRGLVANVAVASMPEFISEGSAISDFSKPSRVVLGCHNENAIALIKDLMRPFNHVTDQVKIMSTRAAEYTKYAVNALLATRISLVNELANNAEHFNIDIEEVRQGLGSDSRIGFNYLFPGCGFGGPSFAADVQALVGTFQSKGYDADLLKAVLQNNETQKEVMFRKAWRFFKNDLRGLKVAIWGLSFKPNTATVDNAPSVKTIEALVAQGAEVVAYDPKANSAFKEYWGDQVGVTLVSDMYDALEQADALMVLTEWRRFWSPDYVRMFELMKRPIIFDGRNIYEHEVLTNYGFRHFGVGRGEVV

SEQ ID NO: 77624 - protein, 344 aa, Synechococcus sp. CC9605
MGRRVLITGGAGFIGSHTCLVLLEQGHELVVLDNFDNSSPEALRRVQELAGSTQLTLVEGDVRDPSAVDQAFSSGGAVDGVIHFAGLKAVGESVANPLRYWDVNVNGSRVLAAAMERHGCRTLVFSSTSTAYGEPETFPLREDMPTAPVHPYAQTKVAVEQMLAALCRSGSWQVACLRYFNPVGAHPSGRIGEDPLGIPNNLFPFITQVAAERRERLRIFGNDYPTPDGTGIRDYLHVMDLAEAHGSALDHLFKRQASDPLTLNIGTGCGLSVLDVVHGFEQATGLAIPYEIVERRPGDVPRLEACPQTAQTVLGWRARRSLEEMCRDGWAWQQANPSGYRGPT

SEQ ID NO: 77625 - protein, 283 aa, Acidobacteria bacterium Ellin345
MLQRGCVVLYPCTQMKIAIQGELGAFSHEACRRNFPRAKVVPCAVSSEVFEALESGRVDAALIPIENTLAGPVVVHYDLLLEHDFYVNAEFRLRIEHQLLAVPGTKFGEIREVLSHPVALDQCRKFFAKNKKVRSVSFYDTAGAARHVMEEGKHEQAAIASRVAGEVYGAEVLQSNLEDDAQNFTRFVLVERRARANKDANKVSVAVGLPNKPGMLFKALSVFALREIDLTKIESRPVRGRPWEYAFFLDFMQTDKKAAENALRHLEEIAQFVKVLGRYRSAE

SEQ ID NO: 77626 - protein, 162 aa, Oryza sativa
MQHQQRMKQAAAAAQQQQMMQQALLMQQQQAAAVAAAAQQQQAPLFPPHHPHPGLLAAPQIEPIVSGNLPPGFDSSTCRSVYVGNIHLQVTDSLLHEVFQSIGPVQGCKLIRKEKSSFGLVDYSDRRSAAVALVSLTGRQRMANQYSHRDLQDSRKDPQAHT

SEQ ID NO: 77627 - protein, 69 aa, Zea mays
MADWGPVVIATVLFVLLTPGLLFQLPAHGRIVGFGTMHTSGLAILVHAVLYFALITIFLIAIGVHIYAG

SEQ ID NO: 77628 - protein, 625 aa, Oryza sativa Japonica Group
MASISGAAAPPSSSAACRLRLRRQLLLRPSHLRLRAPHSIADLSRSSSSSSEQQPSSTPAAPLASRPGQNGSTRGAVEKDPIKLWERYVEWLYQHKELGLFVDVSRMGFTEEFLRRMEPRMQRAFAAMRELEKGAIANPDEGRMVGHYWLRDPGLAPNSFLRTKIETTLDRILAFSQDVVSGKIKPPSSPAGRFTQILSIGIGGSALGPQFVSEALAPDNPPLKIRFIDNTDPAGIDHQIAQLGPELASTLVIVISKSGGTPETRNGLLEVQKAFRDAGLDFSKQGVAVTQENSLLDNTARIEGWLARFPMFDWVGGRTSEMSAVGLLPAALQGIDIKEMLVGAALMDEETRNTVVKENPAALLALCWYWASEGIGNKDMVVLPYKDSLLLLSRYLQQLVMESLGKEFDLDGNRVNQGLTVYGNKGSTDQHAYIQQLREGVHNFFVTFIEVLRDRPPGHDWELEPGVTCGDYLFGMLQGTRSALYSNDRESISVTVQEVTPRAVGALVALYERAVGIYASLVNINAYHQPGVEAGKKAAGEVLALQKRVLTVLNEASCKDPAEPLTLDQIAERCHCPEDIEMIYKIIQHMAANDRALIAEGSCGSPRSIKVYLGECNVDEDMLAA

SEQ ID NO: 77629 - protein, 308 aa, Silicibacter sp. TM1040
MILCCGEALIDMIPGTTETGQAAFVPHTGGAVFNTAIALGRLGRRVSLLSGVSRDLMGRKLEAALRESGVSEGHLIRSDRPTTLAFVELQNGHAKYAFYDENTAGRLITVADLPKLGAEVEALFFGGISLACEPCADTYASMLKRYGAERAVVLDPNIRPGFVPDEARYRARLKEMLAQADMVKVSDEDLAWLMPEQSDPQAQAAALQAWGPAVVLVTRGGDGAMGLLPNGESVTVAAERAEVVDTVGAGDTFNAGVMARLDESGALNKEALRKLDASTLAEALRWGAKVAAVTVSRAGANPPWRSEL

SEQ ID NO: 77630 - protein, 201 aa, Magnaporthe grisea 70-15
MGVAKKTRKFGAVKRMIGKRDERLKKPKVPEGGSGKAKAGPSTSAPGAGEPVRQVTAAPKGLFFSHNENIVPPYNVLVDTSFITHTVGAKIELLEGLMDSMYATCRPIITDCVMAELEKLGPKYRIALRIARDERWERLKCDHKVYADDCLVDRAVKNRIYIVATNDRDLKRRIRKIPGVPIVTCGRKKYLVEGLPGAPTK

SEQ ID NO: 77631 - protein, 395 aa, Fulvimarina pelagi HTCC2506
MSQGWTKRATTGLLVLADGTVIEGFGLGAEGAVEGEVCFNTALTGYQEILTDPSYAQQIVTFTFPHIGNVGANAEDHEDFSPLGNAGAVGAILRAEVSEPSNYRSAGHLDAWLKERGIVALSGIDTRALTALVREKGMPNAVIAHDPNGSFDIEKLKSRAREWPGIDGVDIAKLVATTDRSVWTERPWVWGGETAAETPVRYKIVAVDYGAKRNIFRLLASHGGEVTVVPPTTSAEDILAMEPDGVFLSNGPGDPAATGIYAVKEIGKLVASGVPLFGICLGHQLLALALGARTKKMHQGHHGANHPVMDYTTGKVEIVSMNHGFAVAADTLPSGVTETHRSLFDGSNCGLQLTEKPVFSVQHHPEASPGPQDSHYLFKRFFDMIDGYRGARSAA

SEQ ID NO: 77632 - protein, 288 aa, Rhodospirillum rubrum ATCC 11170
MSDPNQTVAFQGLPGAYSHMAATRLFPAMDVLPCAAFDDAFAAVREGKALYAVLPIENSVAGRVADIHHLMPDSGLHIIGEYFLKVNHHLLAPEGAKIEDIRIVRSHVHALGQCRRFIKAHGLKAIVHADTAGAAAELAERKAPGEAAIASELAGRIYGLSSLHANIEDENHNTTRFLIMAREAVQPREDVAAVTTFVFRVRNVPAALYKALGGFATNGINMTKLESYQVAGTFVAARFYADVEGRPDQPALARALDELRHFTHELLILGVYPAHPYRFAARQSLTPE

SEQ ID NO: 77633 - protein, 229 aa, Chlamydomonas reinhardtii
MNPINGLKTILHRVGFAMRESGQALERVGCRLQGVYSFEEKLNRHATVLPMRHNVPSLDKTSWVAPSGMVSGSVTLGENSSVWYGAIVRGDFQPVVVGSNSNIQDAAYVGATSEFSGPVTIGDNVSVGHGAVLKGCTVGDNVLIGMNSIISEHAEIQSGAVIAAGSYVEEGTTVPSGEVWAGSPAKKLRDVRAGEAEYLKSLPGRYTELAGEHKGIMKVLKMKQAEYFA

SEQ ID NO: 77634 - protein, 526 aa, Schizosaccharomyces pombe 972h-
MARETEFNDKSPSSTDDGMSQSHFSDKLKNLFHFRRNRAATVSTSVRNDQRDNDSDDSTFDINVNQLNELDLNDSSDQLDSRPSLRRVSSAPDSHKGVEAPPPRPLINMSNIRKAQVKILKNPGNYIFGRTEYGKRTYSGNSTKISRVEVTPHSFEKIRLLGQGDVGKVYLVRQKSNHRLFAMKILNKREMIKRHKVNRVLAEQEILTKSKHPFIVTLYHSFQSRDYLYLCMEYCAGGEFFRALHSLPKHILPEKDACFYAAEVTAALEYLHLMGFIYRDLKPENILLHQSGHIMLSDFDLSKPISIVTHPTVVLPKHSTFSQEKPALDTNSYFSNFRTNSFVGTEEYIAPEVIRSCGHTVAVDWWTLGIFIYEILYGTTPFKGKNRHATFSNILYSDVSFPEYHGAPNVSSTCKSLIRRLLVKDESKRCGSVAGASDIKQHPFFRHIQWALLRSMKPPIIPKIEDGMEAVEPSDNDNEEEDFLNSQYLISANLPAVDMHSSTPVNEQSNPFDSFSSVTLHHAGDE

SEQ ID NO: 77635 - protein, 344 aa, Desulfotalea psychrophila LSv54
MLNKFFIKDKKIMNLTQFPRRNYLQGPTPIEAAPRFSKALGGKVNVFIKRDDLLPGCAGGNKTRKLDFCIADAIEKGADTIITCGAVQSNHCRLTLSWAVKEEMDCHLILEERVPGSYKKDGSGNNFLFNLMGVKSTQVVSGGSDMMGEMEKLAKELEAQGKKPYIIPGGASNAIGATGYVACAQEIQQQLFEQNINITDIVVPSGSAGTHAGVAVGMYGINSGITVSGINVSKPKAVQEENVYKLAKETAKRVGVRGEFPRDEITCFDGYVGAGYSLPTDSMVEAVKLLARTEAILLDPVYSGKVMAGMIDLIRNDYFAPGANVLFLHTGGSPALYAYTDTFK

SEQ ID NO: 77636 - protein, 172 aa, Synechococcus sp. WH 5701
MPEPSLLRPVPLQELRLLQEPRLWAVEQQLDDLESLTPVRGWLSVRHAEPVLEVEGEAETIVTLCCDCCLSDYNHALHFRGEERLWLGEADQLGDDLADCELIESLDPRGDFDPARWLFEQLSLQLPLQNRCGPDCPGPALLEHPEASLESSSTTDGGDPIDPRWSALRQWR

SEQ ID NO: 77637 - protein, 187 aa, Nitrosomonas europaea ATCC 19718
MSLINTTVKPFKATAYHNGDFVEITDKTLKGKWSVIVFYPADFTFVCPTELEDLADNYDEFQKIGVEVYGVSTDTHFTHKAWHDTSSVVRKVRYPLVGDPTRELSRNFDVLIEDAGLALRGSFIINPEGEIKAFEVQDNNIGRNAAELLRKVKAAQYVSMHEGEVCPAKWTEGAATLKPSIDLVGKI

SEQ ID NO: 77638 - protein, 176 aa, Zea mays
SCLASRPRPRRPTPPFRPRVSVAAPLSVRVTGGRQGQAVVAMASADARLAGIASSIRVIPDFPKPGIMFQDITVVAGVEARGFIFGPPIALAIGAKFVPLRKPKKLPGEVISEEYSLEYGTDKIEMHVGAVQANDRALVVDDLIATGGTLCAAVKLIERVGAKVGECACVIELPEL

SEQ ID NO: 77639 - protein, 309 aa, Mycoplasma pulmonis UAB CTIP
MPWYIILLIVLGVIFLFCLVLVLPFSLKIVSQTEFIIVERLGTYRKTLTNGIHFIIPIIDIPRSRGNFKEQVLDFKPQDVITKDNAIVKVDSVIFFQITDAKLYTYGAEYPIKALENLSYTTLRNLLGEFELDELLTSRDIVNAKLTTTIDLASDSWGIKVHRVELKTIDPPADIKNAMEKQLRAEREKRANILEAQGQREAAILEAQGQREAAILAAQGEKEAAILKAQGQREAAILEAEGQKQSIHLLNSSDISKEVLTWKSIEQLGKIADGNATKIIIPPTLQNLAGSMASVAEFLDLKDKKLISN

SEQ ID NO: 77640 - protein, 467 aa, Synechococcus sp. CC9605
MTIQRICCIGAGYVGGPTMAVIADHCPQIQVQVVDINQARIDAWNDADLSKLPVYEPGLDRVVERARGRNLHFSTDVAESIAAADMVFISVNTPTKTKGLGAGQASDLRWVEACAREVAQAATEHTIVVEKSTLPVRTAAAIKTILQAASNGEGQRTFSVLSNPEFLAEGTAIRDLEAPDRVLIGGDDPASIDALAAIYAHWVPQEQILRTNLWSSELSKLTANAFLAQRISSINSIAAFCEASGADVREVARAIGTDSRIGPKFLNAGPGFGGSCFQKDILNLVYLCRHFGLPEVADYWESVVALNTWQQHRIARLVVEKLFGTVTGKRLAILGFAFKANTNDTREAPAIRICRDLLEEGAQLAIHDPKVVARQMTRDLQQEAAPQADALSATGSWAEACSVEEAVTGADAVLVLTEWQDYRNLNWMSLAGRMRKPAWVFDARAITDHGQVRASGLNLWCVGDGEG

SEQ ID NO: 77641 - protein, 339 aa, Synechococcus sp. CC9605
MSRTVLVTGAAGFIGAALSKRLLQRGDRVVGLDNLNDYYDPGLKQSRLRQVEAIAPAGAWRFERLALEDDQGLMALFVEERPQVVVNLAAQAGVRYSLENPAAYIQSNLVGFGNLLEGCRYHGTQNLVYASSSSVYGGNRNLPFHERQPVNHPVSLYAASKKANELMAHTYSHLYGLPATGLRFFTVYGPWGRPDMAPMLFARAILAGEPIKVFNHGKMQRDFTYIDDIVEGVLRCCDKPATSNPEFDPLQPDPATAAAPHRVFNIGNSQPTELLRFIEVMEQALGREAIKDFQPIQPGDVIATAADTSALEKWINFTPSTSIEDGIQRFANWYFEYFN

SEQ ID NO: 77642 - protein, 336 aa, Pseudomonas fluorescens Pf-5
MAFNIHNRNLLSLEHHTPRELRYLLDLSRDLKRAKYTGTEQQHLKGNNIALIFEKTSTRTRCAFEVAAYDQGANVTYIDPNSSQIGHKESMKDTARVLGRMYDAIEYRGFKQEIVEELAKFAGVPVFNGLTDEYHPTQMIADVLTMREHADKPIHEISYAYLGDARNNMGNSLLLVGAKLGMDVRICAPKALWPHDDLVQRCKHYAEESGARITLTEDPKAAVKGVDFIHTDVWVSMGEPVEAWAERIEQLLPYQVNAQLMKATGNPRTKFMHCLPAFHNSDTKVGKQIAEQYPHLANGIEVTDDVFESPACIAFEQAENRMHTIKAILVSTLADL

SEQ ID NO: 77643 - protein, 186 aa, Brassica napus
LLVSEYMSRGSLSALLHGNKGNGRAPLNWETRAGIALGAARAISYLHSRDSTTSHGNIKSSNILLSNSYEAKVSDYGLAPIISSTSAPNRIDGYRAPEVTDARKISQKADVYSFGVLILELLTGKSPTHQQLTEEGVDLPRWVQSITDQQSPSQVFDPELAGHQSEGNENMIRLLKIAISCTAQYP

SEQ ID NO: 77644 - protein, 366 aa, Chlorobium tepidum TLS
MQEIPAILVLENGSVYRGTAFGHAGEATGEVVFNTSLTGYQEILTDPSYTGQMVVMTYPLIGNYGITPNDNESKKIWASALIVREASNVYSNYESTRSLDATLKEAGVMGLAGIDTRKLVREIRQKGAMRAVISTLCDDVAALKAQAAAIPEMTGLDLVQRVTTGERYTVDNPDAKYHVVAFDYGIKTNIIRQLNAEGCKVTVVNAKTTADEVLAMNPDGIFLSNGPGDPFAVTYAIDTIRELAARNSTLPIFGICLGHQLLSLAFGAKTYKLKFGHHGANHPVKNLLSNTIEITSQNHGFAVEMESLPGELELTHKNLYDMTVEGIRHRELPCFSVQYHPEAAPGPHDSHYLFKEFTELMERLKN

SEQ ID NO: 77645 - protein, 260 aa, Thiomicrospira crunogena XCL-2
MFKRIKEDIHSVFDRDPAARNSFEVLTTYPGVHAILWYRLSHWLWGKGLKWLARFISGLARWFTGIEIHPAAKIGHRFFIDHGMGVVIGETAEIGDDCTLYHGVTLGGTSWNEGKRHPTLGDRVVVGAGAKVLGPIEIGDDARIGSNAVVIKSVPNNRTVVGIPGRIVETNLTEQEKRRQKMAQKIGFDAYGVGQNVEDPVEKAIYSLLDHVQSQDEQLEKLNEQIKKLGGADTHMELPSLEDAVLEPDDPEQRAHFKTE

SEQ ID NO: 77646 - protein, 141 aa, Thiomicrospira crunogena XCL-2
MLERTFSIIKPDAVKRNLIGQIVSKLEQNGLKVIASKMVFLTVQEAKGFYAEHDGKPFFDTLIKNMTAGPIVVQVLEGDDAIAKNREIMGPTDPENAPAGSIRKEYAISMQQNSVHGSDSPESAQREISYFFSEIEVFSAS

SEQ ID NO: 77647 - protein, 316 aa, Yarrowia lipolytica CLIB122
MVDLNHYQKLEKVGEGTYGVVYKARDTLNNNRLVALKKIRLEAEDEGVPSTAIREISLLKEMRNDNIVSLYNIVHSDSHKLYLVFEFLDLDLKKYMESISPGVGLGADMVKKFMNQLILGTRYCHAHRILHRDLKPQNLLIDREGNLKLADFGLARAFGVPLRTYTHEVVTLWYRAPEILLGGRQYSTGVDMWSIGCIFAEMVTRKPLFPGDSEIDEIFKIFRLLGTPTEETWPGVTALPDYKPTFPQWSRKDIGRTVTPLDHEGLDLLEHLLAYDPACRISAKRAADHAYFDVGTNMKSGYNAAAGPGLMMSTRA

SEQ ID NO: 77648 - protein, 1422 aa, Vibrio parahaemolyticus RIMD 2210633
MIEIVIDGKYRIVEEGLTLLEAAKVCGVEIPSLCGMNKSNEKIPCDLCVVEVESGGTKRACDLKVYRGLNVVTQSEQLSEHRRKALNRIMTDHYADCEAPCKTACPAGVDIQSYLYHISQNDHQKAIEVIKRTLPMPLSIGRVCPAFCESECRRSLVDEPIAIRQLKRHAADADLAAHEAYVPEKKPAKHRKIAVVGSGPGGLTAGYYLSNEGYDVTIFESMPKAGGWLRYGIPEYRLPKDILDKEIELMCRNGMQVETNKKLGVDFTLSQLSEDYDAVCLAVGASQAVEMNYPGSDLDGCYLGVDYLKDYVTEQNYVTGKKVAVIGGGNTAIDCARTARRAGADTTLIYRRTRDEMPAEDYEIVEAEHEGVTFHFLTNPAENIADENGRVKAIRLERMALGEPDASGRRSPKPTGEFFTEAFDTVIAAVSQKPDLSFLENDDLSIPLTRWNTSESDSQTMHTGTGNIFSIGDFRRGPATAVEAVGDGRVAAKAIDLFLNGDMADMPKPAFNSRKEKKLAQVDPLHFENIQKVARSIMPELTPAQREQSFAEVELGFDNEEAMKEAARCLECGCQANTDCALRDYSTEYHAEQHFDVSVDVSSASVIGHQDWLDLRAKDLRHKYEVDRSSEFIEFDANRCISCGQCIQACREQAVHGVLSFVSDKNGRPALRPDDRPRFRSDEKGVGCSGLTLMGDSKCVQCGVCVQACPTGAMVDSRDRSQGRTEQLKAVDTICTYCGVGCKLTMFVDERQNKIRYVKGADSPVNQGMLCVKGRFGFDFISSEERLTTPLIRKDGWLQPATWDEAIQLVASKLSTIKQDFGSNALAGFSSAKTTNEDNYAFQKFIRRELGTNNVDHCARLCHASSVTGLEASLGSGAMTNDIPSIKHSDVIFIIGSDTTSAHPIIASHIKQAIRHHGARLIVADPKRVDMAEHAELYLAHRPGTDVMLLNGVMQQIIKNGWYDQEYIEERVDGFDTLLQEVMSPAYNLDKVELVTGVKADDIFAMARMIGTAKRTAVYYSMGITQHTTGHDNVRSIANLQLLCGNIGIEGGGINPLRGQSNVQGACDMGALPNCYPGYQKVYNPIVRQKFAIEWDAPNLPSEQGLTLTEIIDAACKREVRGMYIMGENPVLSDPNQAHVIEGLEALDFLVVQDIFLTETAQYADVVLPSCSFAEKSGHFTNTERRVQRVNAAVKAPGEAKEDWWIIQAIANAMGSDWHYQCVSEITSEIARVTPQYAGLRWDAITPNGVQWPSNKNNPNGTRIMHQTQFTRGKGQMVGVPFRYAAELPDEEYPLVLTTGRVLEQFHTGTMTRKTKGLDNLAGPRAMISVEDAEAIGIHNGQRLKVSTRRGNIEIDAFVTKRMQKGVVFIPFHFVESPVNRLTTTATDPHAKIPEFKVAAVKIEISETAAQPEPVEEAVHHV

SEQ ID NO: 77649 - protein, 237 aa, Zea mays
MSGSASRKLFQTARSIVLSASQRSSFSVLAAEGRTAALANFGRKILPSACSYHRQGSHAASGWGAIAAAVPAAVYMLQDQEAHAAEMERTFIAIKPDGVQRGLISEIVNRFERKGYKLVAIKLIVPSKGFAEKHYHDLKERPFFNGLCDFLSSGPVLAMVWEGEGVIKYGRKLIGATDPQKSEPGTIRGDLGVVVGRNIIHGSDGPETAKDEIALWFEPKELVSYTSNAEKWVYGVN

SEQ ID NO: 77650 - protein, 743 aa, Physcomitrella patens subsp. patens
MINERRVIELEQGWNFMQKGITKLKNLLEGVPEQQFSSEEYMLLYTTIYNMCTQKPPQDYSQQLYDRYRESFEGYINSKVLPALREKHEEFMLKELVKRWDNHKIMVRWLSRFFNYLDRYFIARRSLPALSEVGLMRFRDLVYEEMKVNVKDAVIALIDREREGEQIDRALLKNVLGIFVEIGMGNMDAYETDFEAFMLEDTASYYKRKASSWIQEDSCPDYMLKAEECLKRERERVGHYLHASSEQKLLEKVQHELLTQYETQLLEKEHSGCHTLLRDDKVDDLSRMYRLFCRILKGLDPVAAIFREHVTGEGTALVKQAEDAASNKKAERKDIVGVQEQAFVRKVIELHDKYLQYVSDCFLNHSLFHKALKEAFEVFCNKGVAGSTSAELLATFCDNLLKKGGSEKLSDEAIEDTLEKVVKLLAYISDKDLFAEFYRKKLARRLLFDKSANDDHERSILTKLKQQCGGQFTSKMEGMVTDLTLARENQINFEEYLSDNTQSNPGIDLTVTVLTTGFWPSYKSSDLALPAEMVKCVEVFKEFYQTKTKHRKLTWIYSLGTCNITGKFDAKPIELIVTTYQAAVLLLFNAADRLSYNDIKSQLNLTDEDIVRLLHSLSCAKYKILNKDPITKTVGQSDIFEFNTKFTDKMRRIKIPLPPMDEKKKVIEDVDKDRRYAIDASIVRIMKSRKMLPHQQLVLECVEQLGRMFKPDFKVIKKRVEDLIAREYLERDKDNPNVFKYVA

SEQ ID NO: 77651 - protein, 320 aa, Physcomitrella patens subsp. patens
MTIGSPLVVVGSVNADIYVEVERLPAEGETIAARSGQTLPGGKGANQAACAARLSYPTFFCGQVGQDAHANLVRNALVSAGVHLDHVNTVDAPTGHAVVILQPGGKNSIIIVGGANVAWPKLEDGISSLTTNAQELIKRAGAVLLQREIPDAVNLEAAKIAKSAGVPVIMDAGGAEGPIPEELLKCLTVLSPNETELARLTDMPTNSGEEILTAAKKVLEMGVKQVLVKMGENGSMLVSEKESPIHQPAILAPVVVDTTGAGDTFTAAYAVALIERQTLVEALRFAAASASICVRFKGAMPSMPERKAVLQLLKEHPVSK

SEQ ID NO: 77652 - protein, 480 aa, Gluconobacter oxydans 621H
MTTPLWRTKPVSSAADSQTGLKRVLGPWQLVALGVGVTIGAGLFSLTGVAAGQNAGPAVTLSFVIAAVACGFAGLCYGELASMIPSGGSAYSYAYASMGELIAWIIGWDLVLEYTVGAAAVASSWSGYLASLLGGWGIHIDPRLLATPMTPVTMPDGSMASAWLNLPAVCALWGVTALLMRGVSESTTINTIVVCIKLAVIVAVIAACAPHISFEHYHPFIPQNTGTFGQFGMSGVMRAAGMAFFAYLGFDIVSTTAQDSRNPARDIPIGILGSLLVCSVVYAVFSMVLTGVVDYRAMANDPSPVATAIDVAGMPWLASLVKLGITAGYISVLFGLLMGQARVFLIMSHDGLLPPVFSKLNARTHTPWTSHLMFAALTSVFAAVLPIGQLGNMTSIGTLLAFIIVCIGVPVLRHRYPEAPRQFRVPGGLLVPVLGILSCGAVMVSLDRLTWIRLVVWLAIGLAVYFAYGIRNSRLCRSES

SEQ ID NO: 77653 - protein, 414 aa, Schizosaccharomyces pombe 972h-
MSLSTKLAITDVDLKGKNVLIRVDFNVPLDGDRITNNARIVGALPTIKYALEQQPKAVILMSHLGRPNGARVAKYSLKPVAAELSKLLGKPVKFLDDCVGPEVEKACKEAKGGEVILLENLRFHIEEEGSAKVDGKKVKADASAVEAFRKSLTSLGDIFVNDAFGTAHRAHSSMVGVDLPRVSGFLMKKELDYFSKALENPARPFLAILGGAKVADKIQLIDNLLDKVNRLIICGGMAFTFLKVLNGMKIGDSLFDEAGSKNVESMMAKAKKNNVEVFLPVDFVTADKFDKDAKVGSATAEEGIPDGWMGLDCGPKSSAKFAEVITTSKTIVWNGPAGVFEFDNFAKGTKSMLDACVKTCEAGNVVIVGGGDTATVAKKYGKEDALSHVSTGGGASLELLEGKALPGVVALSSK

SEQ ID NO: 77654 - protein, 262 aa, Neisseria cinerea
KTSTRTRCAFEVAARDQGAGVTYLEPSASQIGHKESIKDTARVLGRMYDGIEYRGFAQETVEELAKYAGVPVFNGLTNEFHPTQMLADALTMREHSGKPLNQTAFAYIGDARYNMANSLLVLGAKLGMDVRIGAPKTLWPSENIVARARAVAEETGGKILLTENTKEAVKGADFIHTDVWVSMGEPKEVWQERIDLLKDYRVTPELMAVSGNSKVKFMHCLPAFHNRETKVGEWIYETFGLNGVEVTEEVFESPASIVFDQA

SEQ ID NO: 77655 - protein, 401 aa, Synechococcus sp. RS9916
MGTRWRGAALMLRPSLLSNRAIALQPSLTLAISARAAAMKQAGRDICSMSAGEPDFGTPEFIVEAAIKALRDGVTRYGPAAGDPQLREAIANKLTRDNGIPSTAANVLVTNGGKQAIFNLFQVVLNPGDEVLIPSPFWLSYPEMARLAGAEPVTVPASAETGFRLDLEALEAAITPRTRLLVINTPGNPTGRVSDRDELLALADMVRRHPQLLVMSDEIYEYLLDEGVEHHSFAAVAPDLAERTFVVNGFAKGWAMTGWRLGYLAGDSAVIKAASALQSQSTSNVCSFAQRGALAALMESKDCVRSMATSYNSRRSQLVTGLQAIDGLTLVKPKGAFYAFPKLPEHVEGSMQFCEVALEQEGLALVPGLAFGDDRCIRLSCAVSRETIDDALSRLGRLLSA

SEQ ID NO: 77656 - protein, 262 aa, Neisseria flavescens
KTSTRTRCAFEVAARDQGAGVTYLEPSASQIGHKESIKDTARVLGRMFDGIEYRGFGQDVVEELAKYAGVPVFNGLTNEFHPTQMLADGLTMREHSDKPLNQIAFAYVGDARYNMANSLLVLAAKLGMDVRISAPKSLWPSENIIEMVQAVAKETGGRILLTENVQEAVKGVDFIHTDVWVSMGEPKEAWQERIDLLKDYRVTPELMAAAENPQVKFMHCLPAFHNRETKVGEWIYETFGLNGVEVTEEVFESEASIVFDQA

SEQ ID NO: 77657 - protein, 775 aa, Xanthomonas campestris pv. campestris str. ATCC 33913
MRPTQPMSNDDFKQAALDYHRQQPAGKIKVTATKPMLTQRDLSLAYSPGVAFACEAIVEDATQASELTARGNLVAVITNGTAVLGLGNIGPLASKPVMEGKGVLFQKFAGIDVFDIEINENDPDKLVDIIASLEPTFGGINLEDIKAPECFIVERKLRERMNIPVFHDDQHGTAIIVGAAVLNALVVTGKKIEDVKLATTGMGAAGISCVNMLVSLGLKSENILALDRDGVIHTGRTDLDPDKQRYARDTDKRTLAEIVEGADIFLGLSAAGILKPEMVATMARQPVIFALANPNPEITPEAAKAVRPDCIIGTGRSDYPNQINNVLCFPYLFRGALDVGATGINEDMKIACVKAIAAMARREASDLGAAYGGETPSFGPEYLIPRPLDPRLLVELSSAVAQAAMDSGVATRPIADMAAYRDRLSQFVYRTSLMMKPVYDRARADKQRVVYAEGEEEVVLRAVQNVIDEGLALPILIGRPDVIEARIQRMGLRIRAGEDFEITNIHDDPRFNDYWQYYYALTERRGVTVTAAKELMRSRPTLIAAVMVARGEADAMLSGVVGRFHKKLGYARSVIPLEPRVSSTSAMTGVINQQGMFFFLDTHVQEDPTVEQVVEATLQAAYRLKLFGIEPNIALLSHSNFGSHDSRDALKMREVREALLKRKPELNIDGEMQGDTAWDEALRKQIMPNSTLKGRANLFVLPNLEAANIAYNLVRVFTDGVAIGPILMGISKPVHILTTSATSRRVMNMTAIAAVDAQIRKQRDAEKHNAEKNGG

SEQ ID NO: 77658 - protein, 239 aa, Herminiimonas arsenicoxydans
MSLLWQARFFTTVNHLRDLPNTQVPEIAFAGRSNAGKSTAINILSNQKKLCFASKTPGRTQHINYFSIGGAHVGQHRKDETKVEEIRAMLVDLPGYGYAEVSGSAKHHWQALLGDYVQRREQLAALVLIVDSRRPFTDLDIQMLEWFAPTGKPIHCILTKSDKLNRNESTNALRTANTLLASYVDEYGQPFPFTAQLFSALKRTGIDEANDKILELLGLNDEVSEESDSKTAGDAEKAE

SEQ ID NO: 77659 - protein, 306 aa, Chaetomium globosum
MASAVLNSTISGLTSSASITTVFEEVSKYNVQLNVFERLWAAWYLWMQNDTIATGIMSFVMHEFVYFGRSLPWIIIDAIPFFNKYKLQNTKVPTWKEQWECAGLVLLSHCTVELPQIWLFHPVATYFGLDYGVPFPPAWKMAMQIAIFFAVEDAWHYWMHRALHYGPLYKSIHKLHHTYSAPFGLAAEYASPIEVMLLGFGIVGTPIIWVSITGELHLITMYLWIVLRLFQAIDAHSGYDFPWSLRRILPFWAGADHHDLHHERFIGNYASSFRWWDYCLDTEAGEAASKQRRERKLAEIRAKKAQ

SEQ ID NO: 77660 - protein, 263 aa, Vibrio parahaemolyticus RIMD 2210633
MELDIYVVDAFTDTQFKGNSAAVVPLQEWLEPELMQNIATENNLSETAFVKTIGTNQYEIRWFSPLTEIDFCGHATLAASMVLFDKLGVTGSIEFHTLKVGTLTVIKNALGKIEMTFPTRAPHPVNAIPTQLIEGLNCEITHVLLSPQAYFVIVEDEQTVFDVQYRSDQLKQLAPYDVVVTSKGSQYDFVSRYFWPANGGDEDPVTGSIHAGLAPYWAQELGKASLVAYQASARGGVLYCEVKEDCVKVSGDGVLYMKGKIYV

SEQ ID NO: 77661 - protein, 184 aa, Lactococcus lactis subsp. lactis
PHMSKEDIENKLKEHLSAEKILWLGDGIDPEETNGHVDDVACFVAPGEVACIYTEDEKSPFYEAAQDAYKRLSQMTDAKGRQLKVHKLTCPAKNVTIKKQFRIDTVEGTMPREDGDICIASYMNFLITNKGVIVPQYGDENDALALKQVQEMFPDREIVGVNTVEVVYGGGNIHCITQQQPKAK

SEQ ID NO: 77662 - protein, 182 aa, Lactococcus lactis subsp. lactis
PFFTYKDERVKASKVLSGPAVNFSGDKKEVIEKIRKALYFSKIMSYAQGFAQLRKASEEFDWDLPYGTIAQIWRAGCIIRAEFLQNITDAFDKDSELENLLLDDYFVDITKRYQEAVRDVVSLAVQAGIPIPTFTSAISYYDSYRSENLPANLIQAQRDYFGAHTYERTDKAGIFHYDWYKD

SEQ ID NO: 77663 - protein, 461 aa, Arabidopsis thaliana
MEEGHKEPLVLRVEGSHCSLSEMDDFDLTRALEKPRQLKIERKRSFDERSMSELSTGYVRQDSILEMAHSPGSRSMVDTPLSVRNSFEPHPMVAEAWEALRRSMVFFRGQPVGTIAAYDHASEEVLNYDQVFVRDFVPSALAFLMNGEPDIVKNFLLKTLQLQGWEKRVDRFKLGEGVMPASFKVLHDPVRKTDTIIADFGESAIGRVAPVDSGFWWIILLRAYTKSTGDLTLSETPECQRGMRLILSLCLSEGFDTFPTLLCADGCSMVDRRMGVYGYPIEIQALFFMALRCALSMLKPDEEGRDFIERIVKRLHALSFHMRSYFWLDFQQLNDIYRYKTEEYSHTAVNKFNVMPDSIPDWVFDFMPLRGGYFVGNVSPARMDFRWFSLGNCVSILSSLATPDQSMAIMDLLEHRWEELVGEMPLKICYPCIESHEWRIVTGCDPKNTRWSYHNGGSWPG

SEQ ID NO: 77664 - protein, 197 aa, Cryptococcus neoformans var. neoformans JEC21
MATYTLPQIQKPAPNFAGTAVKEGSFEEIKLNDFKGKWTILVFYPMDFTFVCPTEILAFNKALDQFAAVGAEVICVSTDSEFTHLAWSQTKRSEGGLGPDLKLTLLADRNHAAAKAYGVLLPEEGVALRGTFFIDPKGTLRAMHVHDLPVGRSVEETIRVIKAFQFTDEHGEVCPAGWEEGKDTIDTSAPSAYFSKQ

SEQ ID NO: 77665 - protein, 393 aa, Opitutaceae bacterium TAV2
MSIKRSFKAIHSHAPPCYALAAPATLLPIMFTTTPTIPDQMQAASLPGNSTTRLHVRRIPQPGHGEVLLRMKCSTICGSDIRCIYHEHLGKGPEGYQPGMIAGHEPCGQIVKAGPGCRRFGEGDRVIVYHISGCGVCNDCRRGYMISCTSEKYRRAYGWQRDGGMAEYLLAEEKDLVHLPDELSYADGAQVACGFGTVYEGIEKIGVSGNDTVLVTGLGPVGLAAAALSRKLGARKIIGIDVIDERLKIARDLGLCDEVLKSSADNESQVRALTGGHGVERAIECSANATARATALRATRKWGRMVMIGEGGGMSLNPSPDMIHDQKTLYGSWVTSIWRMEELVERLVRWNLHPADLITHRFSLEKVSDAYALMASGRCGKVAVCFDEELKQN

SEQ ID NO: 77666 - protein, 369 aa, marine gamma proteobacterium HTCC2143
MKSRAAVAWEAGKPLTIEEVDVEGPKQGEVLVRIVATGVCHTDAFTLSGADPEGVFPAILGHEGGGVVEEIGRGVTSVAVGDHVIPLYTAECGVCKFCLSGKTNLCQAIRVTQGQGVMPDFTSRFSLNGKPIYHFSGTSTFSEYTVMPEIAVAKINKAAPLDKVCLLGCGITTGIGAVLNTAKVEPGSTVAIFGLGGVGLSVIQGAVLAKASRIIVVDINEDKFEMAKMLGATDFINPKNYDDPVQDVIVDLTDGGVDYSFEAIGRTETMRSALECCHKGWGESTIIGVAGSGQEICTRPFQLVTGRVWRGSAFGGVKGRTQLPGYVDRYLKGEIKVDEMITHTMGLEDINRAFDLMHSGESIRSVILY

SEQ ID NO: 77667 - protein, 200 aa, Triticum aestivum
HSRTSLYKKAGWYRSGIPGISSTHASEEIDKEIEDKKTELEPKVVETIEASPPEIKGLIKDKKTSKIRKNSVAVTKFLDDLAKIDFPGAKLVSDAVAKSGTTPLSPAIVFILDKVAPFVPAPKEEPKVEPEVAAAAPAEETTTREVAVEEEKKEEAEPSAAPAEAAAPAEAAAPAEVVEEKKEEKPVEAAAPAAEEPEKK

SEQ ID NO: 77668 - protein, 347 aa, Opitutaceae bacterium TAV2
MTTETATLAPIDPAKIPQRTLASGARMPAIGMGTFGSDHAAPGEVAASVYAAAELGYRHFDCAAVYSNEREIGATFRRILTSNTGIRREDLWITSKLWNDKHAEADVIPAFEKSLRDLGLDYLDLYLIHWPFPNFHPPGCDVSSRSPDARPYIHAEFMKTWRQLETLHDRGLVRHIGTSNMTIAKLQLLLRDARVRPAVNEMELHPHFQQPALFDYVRVRNIVPVGYCPLGSPGRPERDRTAEDTSPLEDPVIQRIAAAHGMHPAAVCLKWAVQRGQTPIPFSTKRRNIHANLAAAASVTTAPLSEQEMADIAATDRHCRLIKGQVFLWKENQDWRDLWDEDGQIPA

SEQ ID NO: 77669 - protein, 379 aa, Chlorobium tepidum TLS
MKKRLFTPGPTPVPENVMLRMAAPIIHHRNPEFMEILERVHENLKYLFRTTQPVVVMTCSGTGGMEAAISSLFRQGDKLITINGGKFGERWSELARIYTGNCVEEKIEWGTAISPERIAELLDEHPDAMGVCITHSETSTGTASDVRALCAAIRERSEALILVDGITAIGAHEFHFDDWGADICITGSQKGLMMPPGLALVAVSERAQEIIHNRKHQPQYYLSLRKALKSHAGNDTPFTPAVSLIIGLDEALQMLRAEGIENVWARHEALAGACRLGCQALGMELFSESPSYAVTAVWLPEGADWKEFNTTLKIKNGITVAAGQDDFKGRIFRISHLGYYDELDMLTLMGGLERSLKMMEIPFRVGAGVSAVQRAFLGE

SEQ ID NO: 77670 - protein, 357 aa, Aspergillus oryzae
MSAFNASNVDLNTASKEDVLCFLALSDNDYNGHLGARISSIFVILFVSSAFTFFPVVAKSLPSWKIPFGVYLFARYFGTGVIVATAFIHLLDPAYKRIGPKTCVGESGYWGEYSWCAAIVLGSVMVIFLMDLAAEVYVERKYGVHRDEDATGAFIQGGHQSAAVAHNAYDQEKSMPSEQATPAYRSDSESATAERSFKQQIAAFLILEFGIIFHSVIIGLNLGVTGSEFATLYPVLVFHQSFEGLGIGARMSAIPFGKHTWLPWILCAMYGLTTPISIAIGLGVRTTYNPGSKVALIVQGVLNAISAGVLIYSGLVELLARDFLFDPDRTKRRSQLSFMVFCTLLGAGIMALIGKWA

SEQ ID NO: 77671 - protein, 394 aa, Cryptococcus neoformans var. neoformans JEC21
MTCRSVLVYCVALAVVGLVRGQTATEEEHDHDHDHESEEAVETDDAATGLHAGHTHAHSSSDCGVTELQDYNLSLHIAAVFVMLVASAIGVFLPVILGKLGSRNKLFGSVFFVLKYFGSGIIISLAFVHLLIHAFFNLTSPCVGNLEYESAAPAIAMATVIVVWLVDFFGSRYIARQNSKLRECDRNISAAPGFSPDPTEERKKDDISTPMTELACCGPNNLEITNFDGAAKIAHWNVQLLEYGVIFHSVMIGVSLGAMGTGFSTTFAALVFHQLFEGLGLGARIAMLVWPSGISSTIKKWSMCLAYALTTSVGIAIGIGVHASVNMNGRAILLSTGILDSISAGILLYSGLCQLLYREWVVGEMRDASTSKIIVALVSLFLGLFAMSFIGKWI

SEQ ID NO: 77672 - protein, 113 aa, Brassica napus
  misc_feature (9)..(10): Xaa can be any naturally occurring amino acid
  misc_feature (15)..(15): Xaa can be any naturally occurring amino acid
  misc_feature (101)..(101): Xaa can be any naturally occurring amino acid
MATVSAAVXXTIVAXAAIARPNALGLPALRARSERVRCSYAKDAKNAAPVSTKGAGASLLAAAGAVTASAGPALALVDERMSTEGTGLSLGLSNNLLGWIXLLGVFGLIWSLY

SEQ ID NO: 77673 - protein, 626 aa, Aspergillus oryzae
MSQPRLISNRDVENQSSLNLISSNSKTSIAHQHTSQKYRPRVTAIIPTLIKLCFLAILSLLLIVSHPPNSNTWPFNSFKPNFDSDSASRSKSAPGKLGAVASENSICSQHGVDILRKGGNAADASRNGQQRIAMYHSGIGGGGIMLVRTPNSSYEVIDFRETAPAAAFKDMYEHNKNASVYGGLASGVPGEIRGLEYLHSKYGVLPWSTVVQPAVQTARRGFPVGEDLIRYMNHAAGYEDFFTKNPTWAIDFAPGGARLNLGDTMTRHRYADTLEAIAKYGPSAFYSGRIAETMINALQNENGTMTLGDLQNYTVAIRNISQIDYRGYKITSTSAPSSGVIALYILKVLETYKDLFRTEQSVNLSTHRINEAIRFGYGRRTYLGDPLFTDDMATYESQTLVQSMIDATRSKISDHRTQNISAYDPAGLECLETPGTSHIVAVDNTGLAISSTSTINHVFGSYVMVPETGIIMNNEMNDFSIPGSSDLFGYIPSETNYVYPGKRPLSSITPVIVERSDGTLVLITGSAGGSRIITATVQNVIHSIDEGLSAADALAKPRLHDQLVPNQVTFEYNYDNDTVAFMKSLGHNVSWVAPGQSNAQLVRVLPNGTFDAAGEPRQVNSAGYSI

SEQ ID NO: 77674 - protein, 420 aa, Cryptococcus neoformans var. neoformans JEC21
MASYTPSSSRPHTPLGLSPRGSYTNLASAAYDASSPGGHGAKDEKERLRAEREVQEALLKAQDGVEKAKKEEVCMPASTTVLPILSYCVASIMMTVVNKFVVSGRQFTMTFLLLAIQSFVCVACVWLAKRIGVINFRDWDMNDAKAWFPVSSLLVAVIYTGSKSLQFLSIPVYTIFKNLTIILIAYGEVIWFGGHVTPLTLCSFFLMVGSSVIAAWADISTTLSKLSAGVAVVDPISGADVPLSSISVMDTMNVGYLWMFINCLASAGYVLFMRKRIKVTGFKDWDSMFYNNLLSIPVLFVFSLIIEDWGAASFSRNFPEEGRAFLLSAIAFSGAAAVFISYSTAWCVRICGATTYSLVGALNKLPVAASGILFFGDPVNFGNVSAILVGGVSGIVYAVAKTNQAKVEKSKQARGGESKA

SEQ ID NO: 77675 - protein, 287 aa, Arabidopsis thaliana
MEGKEEDVNVGANKFPERQPIGTAAQTESKDYKEPPPAPFFEPGELKSWSFYRAGIAEFIATFLFLYVTVLTVMGVKRAPNMCASVGIQGIAWAFGGMIFALVYCTAGISGGHINPAVTFGLFLARKLSLTRALFYIVMQSLGAICGAGVVKGFQPGLYQTNGGGANVVAHGYTKGSGLGAEIVGTFVLVYTVFSATDAKRSARDSHVRILAPLPIGFAVFLVHLATIPITGTGINPARSLGAAIIYNKDHAWDDHWIFWVGPFIGAALAALYHQIVIRAIPFKSKT

SEQ ID NO: 77676 - protein, 509 aa, Microcystis aeruginosa PCC 7806
MSLTLSEQLKREQLSYPQTLLHHLQRLRHFVTVEGEEKLQQWKNLIEKDNFQPSTRNLAYYLALRQEDIRDLQLALMPWGLSSLGRIESKVLPTLDAVIATLGAVCHQEASLLPKHPPLEAFFQGDQLLASHSAEVFGLPSPRRRVRIMVTMPTEAATDPDFIAQLLRCGMDCIRINCAHDGPKEWRGMIENLREAVKNPENLVNGHTCKVYMDLAGPKIRLEQILAPQSQTRLYQGDFLLLTNQPPHTAHPQYFQANCSQPEIIPQIPVGAKVWIDDGHIGAEVIAIMPEGLLLKITHAREKGEKLKADKGLNFPDTVLNIDPLTAKDRQDLDFIAENADIIGYSFVQKASDIETLQLELQSRLGDAWRQKAIVAKIETPLAVKNLPELIIHAAGKQPFGVMIARGDLAVEIGYQRLAEIQEEILWLCEAAHIPVIWATQVLENLVKKSIPSRAEITDAAMAERAECVMLNKGEYIREAVTILDDVLQRMQTHQAKKTPQLRALHSWV

SEQ ID NO: 77677 - protein, 266 aa, Chlorobium tepidum TLS
MARLSIGFIGTGRIAQALISGLSHDPNIVICGYDKMPDALHSVSLQYGVNTEESIESLARDAEIIVIAVKPYQMAEVLAELKPALHGQHLIVSVAAGISTGFIESNCPEGTRVVRVMPNTPAFVGEGMTALCKGMHATADDLLVAERIFNAIGKTAIIEESGMDAATAVSGSGPAYMFRIIDSLAEGGEACGLDRETAQLLAAQTMLGAAKMVLSGHKSPEELVREVTTPGGTTEAGLKAMDERDLRGALIDTVRAAAARSKELMK

SEQ ID NO: 77678 - protein, 63 aa, Brassica napus
MVKVLTYFGMTLAAFAFWQSMDKVHVWIALHQDEKQERMEKEAEVKRVRAELLRKAREEDPLA

SEQ ID NO: 77679 - protein, 313 aa, Silicibacter pomeroyi DSS-3
MPPRKIIIDTDPGQDDAVAILLALASPDELEVLGITAVAGNVPLPLTAKNARIVCELAGRADVAVYAGCDAPIARKLVTAEHVHGKTGLDGPDLPDPVMPLQEAHAVDFIIDTLRAHAPGTVTLCPLGPLTNIATAFTRAPDIVSRVQEIVLMGGAYFEVGNITPAAEFNIYVDPEAADIVFKSGAPIVVMPLDVTHKALVTKARNDAFRALGTPAGIAVAQMTDFFERFDKEKYGSEGAPLHDPCVTAYLLNPDLFSGRHINVAVETTSELTLGMTVADWWRVTERAPNALFIGDLDAEGFFTLLTDRLARL

SEQ ID NO: 77680 - protein, 262 aa, Neisseria lactamica
KTSTRTRCAFEVAARDQGAGVTYLESSASQIGHKESIKDTARVLGRMYDAIEYRGFGQETVEELAKYAGVPVFNGLTNEFHPTQMLADALTMREHGGKPLNQTSFAYVGDARYNMGNSLLILGAKLGMDVRIGAPEGLWPSEGIIAAANAVAEETGAKITLTANPQEAVKGVGFIHTDVWVSMGEPKEIWQERIDLLKDYRVTSELMAASGNPQVKFMHCLPAFHNRETKIGEWIYETFGLNGVEVTEEVFESPAGIVFDQA

SEQ ID NO: 77681 - protein, 275 aa, Triticum aestivum
  misc_feature (99)..(99): Xaa can be any naturally occurring amino acid
DAFFQGLVSFPLYFPGTTFYACIQGRKNVQKVLKDLLKERLSAPEKRHGDFLDEVVNELQSGRGVIDEKFAVDLMAALLFASFATVSSSLTVAMKFLRXATPNVVESLKEEHEAILKKREDGRSGITWEEYKSMTFTAQVTNEIARVSNVAPGIFRKTLTDVQVKGYTIPAGWLVMISPMAVHMNPELFKDPLTFNPWRWQDESKKSALLKNFMPFGGGIRLCVGAEFSRIQIALFLHTLVTKYRWKEIKGGEVQRVSEIVFPKGYHIQIIPREG

SEQ ID NO: 77682 - protein, 382 aa, Pseudomonas syringae pv. syringae B728a
MIDSKLPNVGTTIFTVMSQLAAETGAINLSQGFPDFDGPQALRDAVCRHVTQGHNQYSPMTGLPALRQQVAAKIARSYGRTVNPDSEITITPGATQAIFCAIHSVIRAGDEVIIFDPCYDSYEPAVELAGGRCVHVQLGLDDFSIDWQKLSDALSPRTRMIVINSPHNPSGALISRAELDRLAALIADRDIYLLSDEVYEHLVFDGARHVSVLDHEALYQRAFVVSSFGKTYHVTGWKTGYVVAPPALSAELRKVHQYVSFCGVTPLQYALADFMAEHPEHVDELPGFYQAKRDFFCGHLAESRFSFRPVGGTYFQLVDYSQIRPDLNDVDMALWMTREHGVASIPISVFYQSPPAGQRLIRLCFAKQEETLRQAAEKLCAI

SEQ ID NO: 77683 - protein, 262 aa, Neisseria mucosa
KTSTRTRCAFEVAARDQGAGVTYLEPSASQIRHKESIKDTARVLGRMYDGIEYRGFGQDVVEELAKYAGVPVFNGLTNEFHPTQMLADALTMREHSGKPLNQTAFAYVGDARYNMANSLLVLGAKLGMDVRIGAPKTLWPSENIVARARAVAEETGGKILLTENAEEAVKGVDFIHTDVWVSMGEPKEAWQERIDLLKDYRVTPELMAVSGNPQVKFMHCLPAFHNRETKVGEWIYETFGLNGVEVTEEVFESSASIVFDQA

SEQ ID NO: 77684 - protein, 262 aa, Neisseria polysaccharea
KTSTRTRCAFEVAARDQGAGATYLEPSASQIGHKESIKDTARVLGRMYDAIEYRGFGQEIVEELAKYAGVPVFNGLTNEFHPTQMLADALTMREHSSKPLNQTAFAYVGDARYNMGNSLLILGAKLGMDVRIGAPESLWPSEGIIAAAHAAAKETGAKITLTENAHEAVKGVGFIHTDVWVSMGEPKEVWQERIDLLKDYRVTPELMAASGNPQVKFMHCLPAFHNRETKVGEWIYETFGLNGVEVTEEVFESPASIVFDQA

SEQ ID NO: 77685 - protein, 714 aa, Arabidopsis thaliana
MRKGVLNPDRDRQIVEHELQETGFSPETEKVKNKNFEEDEEEEDESVEKIFESREVPSWKKQLTVRAFVVSFMLSILFSFIVMKLNLTTGIIPSLNVSAGLLGFFFVKTWTKMLHRSGLLKQPFTRQENTVIQTCVVASSGIAFSGGFGTYLFGMSERIATQSGDVSRGVKDPSLGWIIGFLFVVSFLGLFSVVPLRKIMVIDFKLTYPSGTATAHLINSFHTTQGAKLAKKQVRVLGKFFSLSFFWSFFQWFFTGGENCGFSNFPTFGLKAYQYKFYFDFSATYVGVGMICPYIINISVLLGGILSWGIMWPLIETKKGDWFPDNVPSSSMHGLQAYKVFIAVAIILGDGLYNFCKVLSRTLSGLFVQLRGPTTSISRTSFTLEEDPHASPLSPKQSYDDQRRTRFFLKDQIPTWFAVGGYITIAATSTAILPHMFHQLRWYYILVIYICAPVLAFCNAYGAGLTDWSLASTYGKLAIFTIGAWAGSEHGGMLAGLAACGVMMNIVSTASDLTQDFKTGYLTLSSPKSMFVSQVIGTAMGCVVSPCVFWLFYKAFDDLGLPNTEYPAPFATVYRSMAKLGVEGVASLPRECLVLCYAFFGVAILVNIVKDSLHSNWGRFIPLPMAMAIPFFLGPYFAIDMCVGSLILFIWERVDAAKAEAFGTAVASGLICGDGIWSLPSSVLAIAGVNPPVCMKFLSSATNSKVDNFLKGSI

SEQ ID NO: 77686 - protein, 425 aa, Silicibacter pomeroyi DSS-3
MSTIIDIHAREILDSRGNPTVEVDVVLEDGTMGRAAVPSGASTGAYEAVERRDGDKSRYMGKGVLEAVAAVNGEIAEELVGFDATEQVAIDAAMIELDGTENKGRLGANAILGVSLAVAKAAADFTAQPLYRYVGGTSARVLPVPMMNIINGGEHADNPIDIQEFMIMPVAAEDIRDAVRMGAEVFHTLKKELSAAGLSTGIGDEGGFAPNIASTREALDFVLKSIEKAGYKPGEDIYLALDCAATEYFKDGKYVLSGEGKTLSSDENVDYLAALVADYPIISIEDGMAEDDWAGWKALTDRLGGKVQLVGDDLFVTNPARLAEGITRGCANSMLVKVNQIGSLTETLKAVDMAHRARYTNVMSHRSGETEDATIADLAVATNCGQIKTGSLARSDRLAKYNQLIRIEEALGEVAEYAGRSILRG

SEQ ID NO: 77687 - protein, 240 aa, Prochlorococcus marinus str. MIT 9515
MIYSKYQFSNYCYWPSNPKKIIEFIGGSYLASKPDLTYKRFIKSLINKNYAVHAYRYTPQFDHQELAIKAWKDFKNCQRSLSKRIGISIPSIRIGHSLGCKLHLISPDGGRNCEKFISISFNNFSANRSIPFLKQFSQKLEFKSEFSPSPNRTYGIIEKTYTQKNNFLIKFNSDKLDQTDKLLSCLRARKEDNSKGIKLKGTHTIIASAGLRENLLGDWADDDLKRYTIKQISNLIENSI

SEQ ID NO: 77688 - protein, 297 aa, Glycine max
VLFSVRSDSHPIFGAPKFQLCDFQVLYCLSFRLLGKVALVTGGASGIGESIVRLFHIHGAKICIADVQDNLGKQVCQSLGDEANVVFVHCDVTVEDDVSHAVDFTVGKFGTLHIIVNNAGISGSPCSDIRNADLSEFDKVFSVNTKGVFHGMKHAARIMIPKKKGSIISLCSVASAIGGLGPHAYTGSKYAVLGLTKNVAAELGKHAIRVNCVSPYGVATGLALAHLPEDERTDDALVSFRDFTGRMANLQGVELTTHDVANAVLFLASDDAKYISGENLMVDGGFTSANHSLQVFR

SEQ ID NO: 77689 - protein, 444 aa, delta proteobacterium MLMS-1
MEKVTEFMKVVTDKNPGESEFHQAVLEVVETLMPFIEDNPKYQETKILERMVEPERVIIFRVPWVDDKGEVQINRGYRIQMNSAIGPYKGGLRFHPSVNLSILKFLAFEQVFKNSLTTLPMGGGKGGSDFDPKGKSDNEVMRFCQSFMTELYRHIGAETDVPAGDIGVGGREIGFMFGQYRKITNEFTGVLTGKSRNWGGSLIRPEATGYGAVFFAEEMFKVRGDSLAGKTCIVSGSGNVAQYTIEKVNQLGGKCVTLSDSAGFIHDPEGIDDEKLAYVMELKNVKRGRISEYAEKYGCKYYPGERPWKIPGDVAFPSATQNEIDAQDAETLVAGGCTCVSEGANMPSTSEAVRIFLKAKIMYGPGKAANAGGVATSGLEMSQNSLKLSWPREEVEERLRQIMEGIHEACYKYGKEGDFVNYVKGANIAGFVKVADAMIEQGVI

SEQ ID NO: 77690 - protein, 328 aa, Capsicum annuum
MASQSFVPPIFENPFLNIEELAGDTIVRKPEPLTQANSDPNGTSLVVSKDVDLDINKKTWLRIYVPQRIITNHNDDEKLPVIFYYHGGGFVFFHANSFAWDLFCQGLAGNLGAMVISLEFRLAPENRLPAAYDDAMDGLYWIKSTQDEWVRKYSDLSNVYLFGSSCGGNIAYHAGLRVAAGAYKELEPVKIKGLILHQPYFSGKNRTESEEKLKDDQLLPLHAIDKMFDLSLPKGTLDHDHEYSNPFLNGGSKHLDDVIAQGWKILVTGVSGDPLVDNARNFANFMEEKGIKTFKLFGDGYHAIEGFEPSKAAALIGATKDFICATTN

SEQ ID NO: 77691 - protein, 409 aa, Synechococcus sp. WH 5701
MPISERVTRLGQGVFARNDRRKIAYGEGLLNPELPAGRPPLLDLSLGSTDLAPPPVALEAMASALQQPSSASYCLHGATLPFREAVAAWAQRRFGVTVDPEREVLLLVGSQEGTAHLPLAVLNPGEPALLLDPYYPSHRGGLLLASACTELLPLRADQGWRPPFEAISLVAWDQLRLMVLGFPHNPTATVGEQAWLDQAVARAQRHGFVLAHDNPYVDLALEGEAPALLRNPHWRSCGIEFFSFSKSWCLGGFRLAFAIGAEPLITALRQLKGVVDFNQSLALQAGAIAALEQAPEWPAQLRKVYRLRRDRMASALEAQGWALQRPSMALYLWLGLPEVALARGLDSESFCAALLEATGVALTPGNGFGPSGEGWMRLALVHPVEELEAGAERIGEWLRSLNGPLSPSH

SEQ ID NO: 77692 - protein, 582 aa, Oryza sativa Japonica Group
MELVYLERRNGFDEDSTSPEFSGRSAIDHQQLSIATPEVESDLGQTIYKQPLPSDEKKSRSCQSCHKSPCSCRSEVFHSDLYPTLPAKMMILEFLIRSLRHPRRTHNVSDLDDMISNGASTGSVVLGPSEKMMLDSLHSLVDAKTRPKSPSFFHSGTKMRKARSKSHIITQSEILKLISPETWEISSPGVSPLKKSTAELSMHEKMVSSDTPSMSSNQPVLSSCPSSLSAGLLQCIWKDGLPHFELSLDNPMAVYTANPTKAHDNDKPLDYVYLFHSGEQGRKDWLGNSSSVSRLVGKMKVSSSLVLNPDKSTSMETEFVLYGSPDDYLRQMQSSYGVTKGKGLAKRVADIMKPSNLNSSPKHVWKFGKSSSQQIDEMTEIPEGEQCSAKESVLKNLVADDLPTNQEIAAIVVRKQRRERRKSPVLGGWGLKFLEKAGATHPGSTEDGDVQNKKNNAGSVSAIFPRGYHGGAASKNGSPASLIGRWRSGGRCDCGGWDIGCPIRVLQNDGCGTSPQAESQSQDRKSVELSVKGAKKGPMFRLVNITDDLHIIYFDSSLSPLQCFSAGIAIIHSQAPHLYPKL

SEQ ID NO: 77693 - protein, 151 aa, Methanococcus maripaludis S2
MAKIAKNAVVIGDVELGENVNIWYGAVLRADINKIKIDDDSNVQDNCTVHCSKDYPVFIGKGVSVGHGAVIHGCTIEDNVLIGMNSTVLNGAKIGKNSIIGANALVSQNKEIPPNSMVLGVPGKVVRTLTDDEVNSIKENAKNYLELSKNL

SEQ ID NO: 77694 - protein, 509 aa, Bacillus subtilis
MDYEKERTERAERIQKGGAEKYHRSNQEKGKLFVRERLALLFDDDIELEDAFFAECMSDGLPADGVVTAIGKIGGQTVCAMANDSTVKAGSWGAKTVEKIIRIQETAEKLNCPLIYLVDSAGARITDQVNVFPGRRGAGRIFYNQVKLSGRIPQICLLFGPSAAGGAYIPAFCDIVVMVDGNASMYLGSPRMAEMVIGEKVSLEEMGGARMHCSVSGCGDILAETEQEAIHLARSYLSYFPANYKERAPVQEKRPPKPFEIPLSDVIPQNQNAPFNMFELIDRVIDEGSFFEIKALFAPEIITGLARIHGQPVGIIANQPKVKGGVLFHDSADKAAKFITLCDAFHIPLLFLADIPGFMIGTKVEQAGIIRHGAKMISAMSEATVPKLSVIVRKAYGAGLYAMAGPAFEPDCCIALPTAQIAVMGPEAAVNAVYAKKISELPKEERAQFISSKREEYKEDINIYRLASEMIIDAVIPANSLRGELHKRLMAYMTKEITFTNRKHPVYPV

SEQ ID NO: 77695 - protein, 403 aa, marine gamma proteobacterium HTCC2143
MKPIKQSEKLANVCYDIRGPVLAEANRLEEEGHRILKLNIGNPAAFGFDAPDEIIQDVIRLLPTSQGYCESKGLYSARKAVMQHYQQRGVLDVDIDDIYLGNGVSELITMSMQALLNNDDEVLIPAPDYPLWTASVSLSGGTPVHYICDEEADWFPDIADIRSKISSKTRAIVVINPNNPTGAVYSKELLQEIVKLAEEHSLVIFADEIYDKILYDEAQHIPLATLADNVLCVTFNGLSKAYRLAGFRSGWMMLTGAKSHAQGYIEGLTILASMRLCANVPAQHAIQTCLGGYQSINDLVLPGGRLLKQRNAAIELLNQIPGVSCVKPKGAIYMFPKLDVKKFAIQNDEKLVLDFLRHEKILLVQGTAFNWKQPDHLRVVFLPQVDDLTRAMERFAAYLSRIG

SEQ ID NO: 77696 - protein, 441 aa, Aspergillus oryzae
MVSNEHACDSMTPSNRAMTTEAALAAEKNFSAKNYESLPIVFARAQGASVWDPEGNHYLDFHSASTALNHGHCHPKLVAALVEQASRLTLTSRAFHNDVYPKFAEMVTKLFGYDRALPSSTGAEASETAIKVARKWAYKVKGVPRDQAIVLGAAGNHHGRTLASISLASDNMSRENYGPLVPNISCTIPGTDKLITYNDKAALREAFAAAGFNLAAFVIEPIQGDAGVIVADDDYLREARALCDKHQVLLICDEIQTGIARTGKLLGHYWSGIWPDMVILGKTMTGGMYPVSCALANDDVMLTVEPGTHGSTYGGNPLGAAVAMRALQVVEEENLVERAEHLGNLLRAGLRAIQAQTPVIETVRGRGLLNAFVIDQNKTNGHTGIELCEVMKAKGLLLKSSRTGVIRIAPPLVITESEIERALGVIKDSINQLVNGSCKTI

SEQ ID NO: 77697 - protein, 525 aa, Mycobacterium tuberculosis CDC1551
MVQPADIDVPETPARPVLVVDFGAQYAQLIARRVREARVFSEVIPHTASIEEIRARQPVALVLSGGPASVYADGAPKLDPALLDLGVPVLGICYGFQAMAQALGGIVAHTGTREYGRTELKVLGGKLHSDLPEVQPVWMSHGDAVTAAPDGFDVVASSAGAPVAAFEAFDRRLAGVQYHPEVMHTPHGQQVLSRFLHDFAGLGAQWTPANIANALIEQVRTQIGDGHAICGLSGGVDSAVAAALVQRAIGDRLTCVFVDHGLLRAGERAQVQRDFVAATGANLVTVDAAETFLEALSGVSAPEGKRKIIGRQFIRAFEGAVRDVLDGKTAEFLVQGTLYPDVVESGGGSGTANIKSHHNVGGLPDDLKFTLVEPLRLLFKDEVRAVGRELGLPEEIVARQPFPGPGLGIRIVGEVTAKRVDTLRHADSIVREELTAAGLDNQIWQCPVVLLADVRSVGVQGDGRTYGHPIVLRPVSSEDAMTADWTRVPYEVLERISTRITNEVAEVNRVVLDITSKPPATIEWE

SEQ ID NO: 77698 - protein, 142 aa, marine gamma proteobacterium HTCC2143
MLLIFGKEALIVSQIKKSDEEWRQQLTEEEYHICRNKGTDRAFSGEFCDTKTTGHYLCTCCGEELFESTTKYDSGCGWPSFYQPLTAEVIAEERDASLGMVRTEVMCSRCGSHLGHVFNDGPNPTGLRYCVNSTSLKFKGLE

SEQ ID NO: 77699 - protein, 359 aa, Mycobacterium tuberculosis CDC1551
MRGTDEKYGLPPQPDSDRMTRRTLPVLGLAHELITPTLRQMADRLDPHMRPVVSYHLGWSDERGRPVNNNCGKAIRPALVFVAAEAAGADPHSAIPGAVSVELVHNFSLVHDDLMDRDEHRRHRPTVWALWGDAMALLAGDAMLSLAHEVLLDCDSPHVGAALRAISEATRELIRGQAADTAFESRTDVALDECLKMAEGKTAALMAASAEVGALLAGAPRSVREALVAYGRHIGLAFQLVDDLLGIWGRPEITGKPVYSDLRSRKKTLPVTWTVAHGGSAGRRLAAWLVDETGSQTASDDELAAVAELIECGGGRRWASAEARRHVTQGIDMVARIGIPDRPAAELQDLAHYIVDRQA

SEQ ID NO: 77700 - protein, 309 aa, Cryptococcus neoformans var. neoformans JEC21
MSLATPAIIRRLAVSSRTAAPLLRAVSSNVTRTFASSSRQQLVASAPHSVGFRSTAVSGLRRKTSLLHMSPIIRQQRRTMFIQTETTPNEASLKFIPGVQVTNGAAHEFLDLRSALQSPLATRLLTIDGITGVFFGPDFVTCSKDDSYSWSILKPEVFAVLMEHFSSGASLFKEGSGESQAEDTRILDTDSEIVGMIKELLETRVRPAIMEDGGDIEYRGFDEDTGLVKLKLKGSCRGCSSSSVTLKNGIERMLTHYVPEVQSVEQVLDEEELIALDEFAKLEARLEKEQGGDKAGKSGKGDMSSYLSV

SEQ ID NO: 77701 - protein, 354 aa, Nicotiana tabacum
MASITLSSFAASLLLILSVNFYQTEAQGTQPIVKGLSWTFYDSICPNAESIIRSRLQQVFRQDIGQAAGLLRLHFHDCFVQGCDGSVLLDGSASGPSEKDAPPNLTLRQQAFRIIEDLRRRVHRDCGRVVSCADITAIAARDSVFLSGGPDYDLPLGRRDGLNFATRNETLANLPPPSFNASAILTSLATKNFTPTDVVALSGGHTIGIGHCTSFTERLYPNQDPSMDKTFANNLKNTCPTSNSTNTTVLDIRSPNKFDNKYYVDLMNRQGLFTSDQDLYTDRRTRGIVTSFAINESLFFEEFVNSMIKMGQLNVLTGTQGEIRANCSVRNSANYNLLLSTSVAEEQQRTWSEI

SEQ ID NO: 77702 - protein, 381 aa, Oryza sativa Japonica Group
MASSTQGQVITCKAAVAWEANRPMTIEDVQVAPPQAGEVRVKILFTALCHTDHYTWSGKDPEGLFPCILGHEAAGIVESVGEGVTEVQPGDHVIPCYQAECRECKFCKSGKTNLCGKVRAATGVGVMMNDRKSRFSINGKPIYHFMGTSTFSQYTVVHDVSVAKINPQAPLDKVCLLGCGVSTGLGAVWNTAKVEAGSIVAIFGLGTVGLAVAEGAKSAGASRIIGIDIDSKKFDVAKNFGVTEFVNPKDHDKPIQQVIVDLTDGGVDYSFECIGNVSVMRSALECCHKGWGTSVIVGVAASGQEISTRPFQLVTGRVWKGTAFGGFKSRSQVPWLVEKYLNKEIKVDEYVTHSMNLTDINKAFDLLHEGGCLRCVLATDK

SEQ ID NO: 77703 - protein, 163 aa, Thiomicrospira crunogena XCL-2
MKHIISMLIENESGALSRVSGLFSARGYNIHALTVAPTDDETISRLTLVTSGTEQQVEQIVKHLNRLIDVIKVVDITEGSHIERELMLVKLKASGTMREEIKRLSDIFRGTIVDVTANIYTVQLVGESQKLDAFVDAIDEGLIVEVVRSGAVGLMRGEKSLHL

SEQ ID NO: 77704 - protein, 467 aa, Zea mays
  misc_feature (170)..(170): Xaa can be any naturally occurring amino acid
MPSIAPPSSSVAALTRQPVQFFKGCSVSKETKGPVRSFFTANSKSTKVKSAGLKVASSFKNDGGYPAGGVSWKDDTLLPKSTTIRGQDHPVADPVLPMDSMITPEILSANVERVIDMFADDDTDTELDLDSPTEGFTSIAEAIEDIQQGKLVIVVDDESRPRVRPLILAXASADAWIFPLKYRGRGVLKRAGQCEASVDLAMLAGLPPVAVLCEIVDDADGSMARLPKLRVFAEKENLKIIFICCRYRRKRDRLIERASVARLPLKWGNVHAYCYKSVIDGIEHIAMVKGDIGDGQDILVRVHSECLTGDIFGSARCDCGDQLAMAMEMIEKAGRGVLVYLRGHEGRGIGLGHKLRAYNLQDDGRDTVEANEELGLPVDSREYGIGAQILRDLGVRSMKLMTNNPAKYSGLKGYGLSIAGRVPLITPITSENRRYLETKRTKMGHVYGLANAQANQANGSQSTEENH

SEQ ID NO: 77705 - protein, 481 aa, Silicibacter pomeroyi DSS-3
MVRPAYLGPMTIAIPFDNSYARLPGGFYTAQAPQPVRAPRLVAFNADLARLLGIAPGEVEEMAQVFAGNAVPQGAEPLAQLYSGHQFGNYNPQLGDGRAILLGEVLGSDGIRRDIQLKGAGRTPYSRGGDGRAWLGPVLREYVVSEAMAALGIPTTRALAAVETGETVRRESALPGAVLTRVAQSHLRVGTFQVFAARGEIAHLKRLTDYAIARHYPDAQGPMGLLAAVRDAQARLIARWMGVGFIHGVMNTDNSSIAGETIDYGPCAFMDTYHPDTVYSSIDRYGRYAYSNQPDIAVWNLAQLATALIQQAEDKEAVVEEATEIVHAMPELLERAWLEVFAAKIGIARPGEGDKALVSELLTRMAREQADFTNTFRALGAPRARDQFTDPTAYDSWAEDWRQRLTQEATPEAVIRAANPAFIPRNHRIEQMITAAVEGDYTLFERLNTVLARPYADQPDHIDLTRPPSASEIVPATFCGT

SEQ ID NO: 77706 - protein, 525 aa, Pseudomonas syringae pv. syringae B728a
MALDIHAHRILILDFGSQYTQLIARRVREIGVYCELHPFDMDDEAIREFAPKGVVLAGGPESVHEADSPRCPQAVFDLGVPVFGICYGMQTMAEQLGGKVAGSELREFGYARVDVVGKSRLLDGIEDHIDADGLFGLDVWMSHGDKVTKLPENFHILASTPSCPIAGMADDARGYYGVQFHPEVTHTKQGGRILSRFILDICGCEALWTPSKIAEDAIAQVRAQVGTDNVLLGLSGGVDSSVVAALLHKAIGDQLTCVFVDNGLLRLHEGEQVMAMFAENMGVKVIRANAEEQFLNNLAGESDPEKKRKIIGRTFIDVFDAESCKLDNIKYLAQGTIYPDVIESAGAKSGKAHVIKSHHNVGGLPEEMNLKLVEPLRELFKDEVRRLGLELGLPYDMVYRHPFPGPGLGVRILGEVKKEYADLLRRADHIFIEELRKADWYHKVSQAFVVFQPVKSVGVVGDGRRYAWVVALRAVETIDFMTARWAHLPYELLETVSGRIINEIEGISRVTYDVSSKPPATIEWE

SEQ ID NO: 77707 - protein, 221 aa, Zea mays
MKMSASVAAASPTLRFSSATHPLHRPLRRRLPSVRCSLAAAAGPGVRAPPELVDSILSKVKGTDRGVLLPKDGHQEVAEVALQLGKYCIDDPVKSPLIFGEWEVVYCSVPTSPGGLYRTPLGRLVFKTDEMVQAVEAPDVVRNKVSFSVFGLEGAVSLKGKLNVLDSKWIQVVFEAPELKVGSLGFQYGGESEVKLEITYVDEKIRLGRGSRGSLFVFLRR

SEQ ID NO: 77708 - protein, 440 aa, Glycine max
MQENYSYQSYPDSGESSPRSREIDFDNPPPWDDQNYKAKFMCSYGGKILPRSHDNQLSYVAGETKILAVDRSIKFSAMLAKLSALCDAPDNNNLTFKYQLPGEDLDALISVTNDDDLDHMMHEYDRLYRASARPSRMRLFLFPSDTLPSPPPAASAPHDSVIKPNNVDFLFGLQPQPPPIDVKFNDPLPEPVAPPPEHPLRFNFNPAVSDPSAIQRQLQQLQIAENEQAAHRRKGEDNYPAGDYYVQKVPEKFPPPNFLASSPGYWPEKHVSGDVYPPAVTATSGGGEPSVYMVPAPGTFYHAPVMRPPPPATQGYYTVQRMGSDNYREAPVYGGVPPPKAAVPASMAPAQQPIKAPAYTEGFGMVRPGGIVDNTGVPYAQVAYDSGSGRQVYYTAPGGGVTHAPPYHGVFPPVTADMRLGGVSFGQDVKVISKLTQGSV

SEQ ID NO: 77709 - protein, 335 aa, Glycine max
TPFSLLLCLIWRLRSLSIAKDVTELIGKTPLVYLNRIVDGCVAKVAAKLEMMEPCSSVKDRIGYSMIVDAEEKGLITPGESVLIEPTSGNTGIGLAFMAAAKGYKLIITMPSSMSLERRTILRAFGAELVLTDPAKGMKGAVQKAEEIRDKTPNSYILQQFENPANPKIHYETTGPEIWKGSSGKVDALVSGIGTGGTITGAGKYLKDQNPDIKLYGIEPVESPILSGGKPGPHKIQGIGAGFIPGVLDVDLLDEVVQISSEEAIETAKLLALKEGLLVGISSGAAAAAAIKIAKRPENAGKLIIAVFPSFGERYLSSVLFESVKREAESMVFEP

SEQ ID NO: 77710 - protein, 223 aa, Botryotinia fuckeliana
MLFVPRTASALKSTSLPLLRNTFINNSFTSISSRQFHASKSNMAIKTYFDVTWEGPVLDASGKPTSTVQEQAGRITFNLYDDVVPKTAENFRALCTGEKGFGYAGSSFHRIIPQFMLQGGDFTRGNGTGGKSIYGEKFADENFERKHTRPGLLSMANAGPNTNGSQFFVTTVVTSWLDGKHVVFGEVADDESLMIVKALEATGSGSGKVQYNKKPTIVKSGEL

SEQ ID NO: 77711 - protein, 397 aa, Neisseria meningitidis Z2491
MFFKHIEAAPADPILGLGEAFKAETRPEKVNLGIGVYKDASGATPIVKAVKEAEKRLLESETTKNYLTIDGVADYNEQTQILLFGKDHEIIASRRAKTAQSLGGTGALRIAAEFAKRQLNAQTIWISNPTWPNHNAIAKAVGIQDQPYRYYDAAKHGLDWDGMIEDLSQAQKGDIVLLHGCCHNPTGIDPTPEQWETLAKLSAEKGWLPLFDFAYQGFGNGLEEDAYGLRVFLKHNTELLIASSYSKNFGMYNERVGAFTLVAEDEATAARAHSQVKTIIRTLYSNPASHGANTIALVLKNDDLKAQWIAELDEMRGRIKAMRQKFVELLKAKGATQDFDFIIEQNGMFSFSGLTPEQVDRLKNEFAIYAVRSGRINVAGITDDNIDYLCESIVKVL

SEQ ID NO: 77712 - protein, 635 aa, Anabaena variabilis ATCC 29413
MHLSEITHPNQLHGLSIRQLQQIARQIRDKHLQTVAEFGGHLGPGLGVVELTLGLYQTLDLDRDKVIWDVGHQAYPHKLITGRYSDFHTLRQKDGIAGYLKRGENKFDHFGAGHASTSISAALGMALARDMNGEKFKAVAVIGDGALTGGMALEAINHAGHLPKTNLLVVLNDNEMSISPNVGAIPRYLNKMRLSPPVQFIKDNFEEQFKHIPFVGESLSPELGRIKEGMKRLAVPKVGAVFEELGFTYMGPVDGHNLEELIATFQQAHQIAGPVLVHVATIKGKGYELAEKDQVGYHAQTPFNLTTGKAIPSNKPKPPAYAKVFSHTLVKLAEQNPKIIGITAAMATGTGLDKLQAKLPNQYIDVGIAEQHAVTLAAGLACEGMRPVAAIYSTFLQRAYDQIIHDVCIQNLPVFFCLDRAGIVGSDGPTHQGMYDIAYLRCIPNIVMMAPKDEAEMQRMVVTGIEYTTGPIAMRFPRGNGYGVPLMEEGWEPLEIGKGEILRNGDDVLIIGYGTMVYPSMQAAEILSEHGIEATVINARFVKPLDTELIVPLAQKIGRVVTLEEGCVMGGFGSAVAEALLDADVVVPVKRIGIPDVLVEHATPDESKAELGLTSRQIAERVLQAYFQKQVSAVI

SEQ ID NO: 77713 - protein, 318 aa, Schizosaccharomyces pombe 972h-
MINIVVLGSMNTDLVMRTKICPSGGETIHGEPDGFSTGNGGKGANQAVAVARLSNPADTKVSMLGCVGDDAFGVEMLSGLKKDGVNVDNVKKIENKSTGVAMIIVEETGENRILLSEGANGNVDTAFVKAMEQRISTCNLLIMQLEIPLEAVEIALQIAHKHGVDVLMNPAPAIPLSHDMISYCAYLVPNEHEAAILLNQADSPATLENVDAYASKLLSFGVRKAVIITLGSQGAYYKSANGESALVSACKVKAVDTTAAGDTFIGAFSNSIAHGQPLKDSLEFAAKCSAITVQRKGAASSIPSLLEVDGSFNLKKNT

SEQ ID NO: 77714 - protein, 892 aa, Arabidopsis thaliana
MYYHSLSSYSILFFLFSLFHHLPCASSNQGLGWCESLFQCGNITADFPFWGGNRHKPCGHPLLELHCNNNNITSLYISNQEFYVRQINQTSNTLTLARSDLLGSFCSSYAYNTTTLPPEIFELSPTYKSLTVLYHCDPKLSYRSSYTCPALGTFSMSQSVDYQYSCQNSFTVNVPTSFHPEERGLNLTNLESALRKGFEVKLVIDEIPCQQCSSTRGICSFNGTTQSCCNATSPSGGVSCVPYQHSADEVYRRCSESFSCGSQRDLNYPLWKPGREECGHPNFKLNCSGGFAEINIASVKFRILDSYRSLIRLARSDYIGDLCPANPLTAPFIEKFLPVLELTGETELLTLYYGCRFNSSDIPANIYVGELGCDEGRSYYVTRNLSSPLLDSSRGVLNNLREMCKRNVSVPASGPALFDLQTRPNQDNLKMALDQGFRMLITSDCERCRGSGGACGYNQTSSGFGCYCKDGKCGYEYDDGFFRRHRRFIATLVRYTFIALGALTGVVIVFLVLLCPCFRVQIFRKRKTSDEVRLQKLKALIPLKHYTYAEVKKMTKSFTEVVGRGGFGIVYSGTLSDSSMVAVKVLKDSKGTDGEDFINEVASMSQTSHVNIVSLLGFCCEGSRRAIIYEFLGNGSLDKFISDKSSVNLDLKTLYGIALGVARGLEYLHYGCKTRIVHFDIKPQNVLLDDNLCPKVSDFGLAKLCEKKESILSLLDTRGTIGYIAPEMISRLYGSVSHKSDVYSYGMLVLEMIGARKKERFDQNSRSDGSSIYFPEWIYKDLEKANIKDIEKTENGGLIENGISSEEEEIARKMTLVGLWCIQSSPSDRPPMNKVVEMMEGSLDALEVPPRPVLQQISASSVSDSFWNSEESSSASDILVFSTNSKLESSSL

SEQ ID NO: 77715 - protein, 212 aa, Aspergillus niger
MNFKNIFLSFFFVLAVGLALVHAEDAQPRGPKITSKVFFDIEHGDKPLGRVVLGLYGKTVPKTAENFRALATGEKGFGYEGSTFHRVIKDFMIQGGDFTRGDGTGGKSIYGEKFADENFKLRHTRKGLLSMANAGKDTNGSQFFITTVPTPWLDGRHVVFGEVLEGYEIVAQIENVPKGRSDRPVETVKIVKSGELESEDKAGEKGSSHEEL

SEQ ID NO: 77716 - protein, 455 aa, Lactococcus lactis subsp. lactis
MSQEQFKFDKEATIAKLDEVIGYIKKDKFDSETIKKITDDTLEGFDNYVSPGWLKYRKSVSTDAAVLEWHDEGSIDYGLNDEEFIDFLGGFGIYTFGHRNQEILETVEAQLKHQALHSQELLDPLRSYLAKAVAEITPGDLQYSFFTNGGAEAVEMSLKLARIAIGGRWYISTVGAFHGKSMGAISVGGKGSYREPYLPMIQQVQHVEYGNAEDMRKAIANLQAVGEKVAGIILEPVQGEAGIKLPPEGYLQEVRKIADEFGVALIFDEIQTGMGRTGKIWASEWSGVTPDIMTFGKSFGGGIMPITGIVFTKKMWVQQLIDNPWLLGSPTFGGNPLACSAALAAIRYMIKYDIPKQAFEKGEYLIPKLKEYAKKYPQLIQEVRGIGLMIGIEFNTTDIGYAVSKGLFSRGVMTAGTLVNAKTVRMEPPAIVTYEQIDTVLERFGETLEEISKNL

SEQ ID NO: 77717 - protein, 162 aa, Aspergillus niger
MATDVAFDTSMGSFTVELYNAHAPKTCKNFATLAQRGYYNNVIFHRIIPNFMVQTGDPTGTGRGGSSIYGEKFEDEINPNLKHTGAGILSMANSGPNNNGSQFFITLAPQPWLDGKHTIFGRVKSGMRVIQRMGLVKTNSEDRPVDGVKILRARIVEETGDE

SEQ ID NO: 77718 - protein, 256 aa, Agrobacterium tumefaciens str. C58
MSNQIIFDLGGRTALVTGSSRGLGRAMAEGLAVAGARILINGTDPSRVAQTVQEFRNVGHDAEAVAFDVTSESEIIEAFARLDEQGIDVDILVNNAGIQFRKPMIELETADWQRVIDTNLTSAFMIGREAAKRMIPRGYGKIVNIGSLTSELARATVAPYTVAKGGIKMLTRAMAAEWAQYGIQANAIGPGYMLTDMNQALIDNPEFDAWVKARTPAKRWGKPQELVGTAVFLSASASDYVNGQIIYVDGGMLSVL

SEQ ID NO: 77719 - protein, 516 aa, Bacillus halodurans C-125
MDMFDRIHEMEVRRDKVKLGGGSKRIDAQHDRGKLTARERIDLLLDEGTFVELNPFIEHRGLDFGTAEAPGEGVVTGYGKVDGRLVFLFAQDFTVFGGALGEMHARKITKVMDLAAENGAPIVGLNDSGGARIQEGVRSLDGYGEIFYRNSIYSGVIPQISVILGPCAGGAVYSPAITDFVFMVEKTSQMFITGPKVIESVTGAKINSEDLGGAKVHSTISGNAHFTAASEEGVLQQVRNLLSYLPSSFEEKPPHQRAKHPVPLDERVQELLDIVPVDGTKVYDVRHVIEKVVDDEQFLEVQPQFARNIVVGFARINGDTVGIIANNPKMMAGGLDINSSDKCARFIRFCDCFNIPLITFEDVSGFIPGVQQEHGGIIRHGAKILYAYSEATVPKITVILRKAYGGAYVALNSKAIGADLVFAWPNAELAVMGPEGAANIIFAKEIKESANPDATRQAKISEYRERFANPYVAAANGMIDDVIDPRDTRKSLVSALAMLKNKKKTLPKKKHGNIPL

SEQ ID NO: 77720 - protein, 340 aa, Paulownia kawakamii
MNDGPEVCRKVRTRRPIQTGQSSLGPDARHTDPPGPPPPGPLGDLLPFPYARRHPPRRRPSWPQPRPPPNPSFPPSQWAAAVGPAQQDQRDQACVPFKDPAGRRGLFRWAWIGRPAAGFDGGGSSPGPRHGHSNSVDEYSSAMSSELDSIAKRAMAADRLAELSLIDPKRAKRILANRQSAARSKERKTRYTSELERKVQTLQTEATTLSAQITLLQRDTTGLTTENKELKMKLQAMEQQAHLRDALNEALKDELQWLKIAAGQVPGVNGNNRGSFSQFSSQPPTIRYFGNHLAQQQQQQQQQQQQQQQQQPLHMPHSSANNPRLGGQSQLSFQDFNHRV

SEQ ID NO: 77721 - protein, 320 aa, marine gamma proteobacterium HTCC2143
MSISEPPARFADLQSIDDPVFRRAGIRCSILRLDTFSSYANGNKFFKLKQNILQAKAQGFTRMLSFGGAFSNHIHALALAGRHFGISTVGIVRGDNLSVLNPTLTDAVAAGMELQFISRQDYKRRNDADFLNYVRGQYPDCFVVPEGGSNVLGVQGCMEIIDHIHSHEVGRGGLIVVPCGTAATLAGIAAACDNGEKVLGFSVLKNSHYLDAEVEKFIADLSIESRDNWTISHDYHCGGYAKLSTELVSFIDKFEQQHNIPIEPVYTGKMLFGLHQMLQLPHQSIAAGTHVIAVHTGGLQGGRGMVEKMQRKRMSIASPK

SEQ ID NO: 77722 - protein, 294 aa, Methanococcus maripaludis S2
MEDYTKAEILIEALPYICKFHDQKILIKYGGHAMVNEQAKNWIAKDLVLLKYVGINPIVVHGGGPEINRAMEKMGKTPEFIHGLRVTDEETLDIVKMVLIGKINGDIVSKLERYGGKSVGLSGKSGQLIKAKKKIQYLMKDSQKIEVDLGMVGEVEHVDTKLIDILVEKRYIPVISPIGVDHQGNDLNLNADIAAGDIAGAMNAQKLIMVTDVDGIMDDVNDPSTLHRRLTIPQIEDMIEKGLITGGMIPKIEACVNALDKGVQSVHIVNGKTPHAVLLEIFTEDGVGTMVVRE

SEQ ID NO: 77723 - protein, 275 aa, Zea mays
MLRSTHPPSPSSGSSDATMVGGGAPSGAKLLQILNVRVVGSGDRVVVLSHGFGTDQSAWSRVLPYLTRDHRVVLYDLVCAGSVNPEHFDFRRYDTLDSYVDDLLAILDALRVSRCAFVGHSVSAMIGILASIRRPELFAKLVLIGASPRFLNDHDYHGGFELPEIQQVFDAMAANYSAWATGYAPLAVGADVPAAVQEFSRTLFNMRPDISLHVCRTVFNTDLRGVLGMVRAPCVVVQTTRDVSVPASVAAYLKAHLGGRSRVSLEGPKLTRTQL

SEQ ID NO: 77724 - protein, 466 aa, Magnetospirillum magnetotacticum MS-1
MSMSDELRDAALEYHRLPTPGKISVTPTKPLATQRDLALAYSPGVAAACELIVADEDSAADVTARGNLVAVVTNGTAVLGLGPIGPLAAKPVMEGKGVLFKKFAGIDVFDMELAELDPDKLVDIIAAMEPTFGAINLEDIKAPECFEVERKLQERVKIPVMHDDQHGTAIVVGAAMVNALRVVGKDIGEVKLVASGAGAAALACLNLLCKLGVKRENVWVTDIKGVVYEGRTELMDQYKSIYSKKTDMRTLAEVIEGADIFLGLSAPRVLTGEMVDKMAQKPIVFALANPTPEILPDEVKAVRPDAIIATGRSDYPNQVNNVLVFPYIFRGALDVGATQINDEMKLACVYALANLAMAESDERVRAAYGTAPLTFGPEYLIPKPFDSRLIIKIAPAVAKAAMESGVARRPIIDFDVYMDRLNQFVFRSGLVMKPVFDRARQDMRRIVYTEGEGRRVLHAVQTVVDE

SEQ ID NO: 77725 - protein, 155 aa, Citrus reticulata
AANSLVISEWMNWLKTEIGFDGWRFDFVKGYAPSITKVYMENTSPDFAVGEKWDSLSYGPDGKPDANQDGHRGALKDWVQAAGGAVAAFDFTTKGILQAAVQGELWRLKDSNGKPPGFIGILPQNAVTFIDNHDTGSTQRLWPFPSDKVMQGYES

SEQ ID NO: 77726 - protein, 442 aa, Rhodobacter sphaeroides 2.4.1
MNALIEGLGHHLAQLPHRQAPQVTGRVVRYDGLLLECAGFPVSPGALCRVATEDGREVQGEVIGFAQGRNLLFLDQMRAPVIAGARVRLVPGGQMAAVGPALLGRVIDAEGAPLDGLPAPDCMGEWPLAGRVMNPLARTAVSRPLDVGVRAINAALTVGQGQRIGIVAGSGVGKSVLIEMMTRYTAADVIVVGLIGERAREVGAFAASVMQGEAARKLCMVAVPADRSPLLRLRAARRATAIAEHFRSEGKQVLLIMDSLTRVAHAQREVGLALGEQPTAKGYPPSVVSMIPGLIERTGPGLPGEGAITAIYTVLADGDDTTNDPVVDTARAILDGHFVLSRRQTQMGLYPAIDIPHSVSRTMNDVVDDRHRRAAARLRQLIALYSDNRDLMLMGGYAAGQDADLDQAVQLWPRIRALIGQGPHEPADFEASRAALLELTGL

SEQ ID NO: 77727 - protein, 333 aa, Chlorobium tepidum TLS
MKITVLGAGSWGTTLAMLLANKGHEVRLWAHRPEFARALEADRENKRYLKGVLFPDNLRVVENLHDAVETAEMIVTAVPSHALRETAAAFAHLPLDGKIIVNVAKGIEQHTGKRMSEVLLEALPRIAPEQIAVLYGPSHAEEVARQQPTTVVACSVSEATARRVQEAFHTSSFRVYVNTDLIGVEIAGSVKNVIAIAAGISDGLGFGDNAKAAIITRGLAEISRLSSKLGADPLTLSGLSGIGDLVVTCLSQHSRNRYVGEQIGKGRKLDEVIGEMSMVAEGVLTSKAVVKLAERLGVEMPISQAVYEMLYENKPAPQAILELMERDPKPEHY

SEQ ID NO: 77728 - protein, 280 aa, Chlamydomonas reinhardtii
MIVCVCVQQVRLNNGVLMPTVGYGCAGLGESAGDTVQWALEAGYRHLDSAQSAASASAEGGGGGGGGRPVRREDVFVTSKLHPRHLGYEVTLRQFNETLKDLRSGYVDLFLLHYPECWGDLCGGVAPAGTFPDSWRALEDLYEAGLARAIGISNFAPHQVTQLLAKATVRPAVLQVHVDPLDHADALQALCRSQSITLTAYSTLGTQGEGAGGGAGGGAGGGAGGGGGGGRGVAQVALRWALQQGLVVLPRSSNRGRIAQNLQLYDWSLTPAQMRRIESL

SEQ ID NO: 77729 - protein, 470 aa, Chlorobium tepidum TLS
MVVMKFGGTSVGSAAAMRQVIANVAEKKKSSAPLVVLSACSGITNKLIQIADAAGSGCLEEAQQLVGEVRQFHLDLIGELIESEELQQEVIAKIEVYLTRLERLTEGIEIVGELTERSKDRFCSFGELLSTSVFAAALNEAGVSCKWIDVRTVMITDDRFGFARPLAEICQKNTSEIIKPLLDAGTVVVTQGYIGATESGRTTTLGRGGSDLSAALFGAWLHSESIEIWTDVDGVMTTDPRIVPEAKSIRVMTFSEAAELAYLGAKVLHPDTIAPAVQKNIPVYVLNTWHPDSKGTLITNDPELLAGKSHGGLVKSIAVKKAQAILNIRSNRMFGRHGFMSELFDVFERFGISVEMISTSEVSVSLTVDDAVVSEPLIKALGALGEVEIEHKVATVSVVGDNLRMSKGVAGRIFNSLRNVNLRMISQGASEINVGVVVDESDVQAAVASLHCEFFAESQCDAIFEKPAGS

SEQ ID NO: 77730 - protein, 539 aa, Glycine max
MASSLRISRLLSRSFLSASTTTPLFSRGGSGALGAGLSKFSTAAAIEEPIKPPLKVEHTQLLIDGKFVDAATGKTFPTLDPRTGDVISHVAEGDHEDVDRAVAAARKAFDRGPWPKMTAYERQRILLRAADLFEKHNDDLAALETWDNGKPYEQSAQIEIPMLVRLFRYYAGWADKIHGLTVPADGPYHVQTLHEPIGVAGQIIPWNFPLVMFAWKVGPALACGNTIVLKTAEQTPLSALYASKLLHEAGLPPGVLNVISGFGPTAGAAIASHMDIDKLAFTGSTETGKIVLELAARSNLKPVTLELGGKSPFIVCEDADVDEAVELAHFALFFNQGQCCCAGSRTFVHERVYDEFIEKAKARALKRAVGDPFKGGIEQGPQIDSEQFQKILKYIRSGVESGATLETGGDRFGNSGFYIQPTVFSNVKDDMLIAKEEIFGPVQSILKFKDLDDVIQRANNTHYGLAAGVFTKNINTANTLTRALRAGTVWVNCFDTFDAAIPFGGYKMSGQGREKGEYSLKNYLQVKAVVTSLKNPAWL

SEQ ID NO: 77731 - protein, 281 aa, Leccinum brunneogriseolum
  misc_feature (69)..(71): Xaa can be any naturally occurring amino acid
  misc_feature (133)..(141): Xaa can be any naturally occurring amino acid
AVNDPFIDLEYMVYMFKYDSVHGRFKGDVHAKDGKLYINGKAITVYAERDPANIKWGAVGAEYVVESTXXXTTIEKAGAHLKGGAKKVIISAPSADAPMFVCGVNLDKYDPKYTVISNASCTTNCLAPLAKVXXXXXXXXXGLMSTIHGTTATQKTVDGPSAKDWRGGRAVNGNIIPSSTGAAKAVGKVIPTLNGKLTGLAFRVPTNDVSVVDLVVRLEKSASYDEIKAAVKAASESPDLKGIIEYTDEALVSTDFTGHPASSIFDASGSIMLNPNFVKLI

SEQ ID NO: 77732 - protein, 515 aa, Zea mays
  misc_feature (237)..(237): Xaa can be any naturally occurring amino acid
  misc_feature (252)..(252): Xaa can be any naturally occurring amino acid
  misc_feature (338)..(338): Xaa can be any naturally occurring amino acid
MANIDMAAVLADMERDAAADARTPRTKLVCTLGPASRSVPMLEKLLRAGMNVARFNFSHGTHEYHKETLDALRQAMHNTGILCAVMLDTKGPEIRTGFLKDGKPIKLTKGQEITVSTDYDIKGDTNTISMSYKKLPQDVKPGHVILCADGTISLAVLSCDPAAGTVRCRCENTAMLGERKNCNLPGIVVDLPTLTEKDKEDILEWGVPNDIDMIALSFVRKGSDLVTVRQLLGQHAXKRIKLMSKVENQEGXVNFDDILRETDAFMVARGDLGMEIPVEKIFLAQKMMIYKCNIAGKPVVTATQMLESMIHSPRPTRAEATDVPNAVLDGTDCDMLTXESATEDYPKVAVKIMARICIEAESSLDHEAVFKAMIRSAPLPMSPLESLASSAVRTANKAKAALIVVLTRGGTTAKLVAKYRPRVPILSVVVPVLTTDSFDWTISSEGPARHSLIYRGLIPLLAEGSAKATDSESTEVILEAALKSAVQKQLCKPGDAIVALHRIGVASVIKICIVK

SEQ ID NO: 77733 - protein, 174 aa, Pseudomonas syringae pv. syringae B728a
MKFRLGESRVQTDPQSWVAPNATLIGNVRLEAGASVWFNAVLRGDNELIHIGENSNVQDGTVMHTDMGSPLSIGKGVTIGHNAMLHGCSVDDYSLIGINAVILNGAKIGKYCIIGANSLIGENKVIPDGSLVMGTPGKVVRELTDMQKKMLEASAAHYVHNAQRYARDLVVQED

SEQ ID NO: 77734 - protein, 451 aa, Pseudomonas aeruginosa PAO1
MRLERTSFARRLEGYTEAVSLPAQPVVEGRLLRMVGLTLEAEGLQAAVGSRCNVINESGYHPVQVEAEVMGFSGSKVYLMPVGSLAGIAPGARVVPLPDTGRLPMGMSMLGRVLDGAGRALDGKGGMRAEDWVPMDGPTINPLKRHPISEPLDVGIRSINGLLTVGRGQRLGLFAGTGVGKSVLLGMMTRFTRADIIVVGLIGERGREVKEFIDEILGEEGLKRSVVVASPADDAPLMRLRAAQYCTRIAEYFRDKGKNVLLLMDSLTRYAQAQREIALAIGEPPATKGYPPSVFAKLPKLVERAGNAEAGGGSITAFYTVLSEGDDQQDPIADAARGVLDGHFVLSRRLAEEGHYPAIDIEASISRVMPQVVEAEHLRDAQRFKQLWSRYQQSRDLISVGAYVAGGDPETDLAIARFPVMRQFLRQGLDESESLAESRARLASLLAGGQA

SEQ ID NO: 77735 - protein, 283 aa, Leccinum holopus
  misc_feature (133)..(150): Xaa can be any naturally occurring amino acid
VAVNDPFIDLEYMVYMFKYDSVHGRFKGDVHSKDGKLYINGKAITVYAERDPANIKWGAVGAEYVVESTGVFTTIEKAGAHLKGGAKKVIISAPSADAPMFVCGVNLDKYDPKYTVISNASCTTNCLAPLAKXXXXXXXXXXXXXXXXXXTTATQKTVDGPSAKDWRGGRAVNGNIIPSSTGAAKAVGKVIPSLNGKLTGLAFRVPTNDVSVVDLVVRLEKSASYDEIKAAVKAASESPDLKGIIEYTDEALVSTDFTGHPASSIFDASGSIMLNPNFVKLIS

SEQ ID NO: 77736 - protein, 543 aa, Arabidopsis thaliana
MSSINLSSSSPSTISLSRSRLSQSSTTLLHGLHRVTLPSNHPLSTFSIKTNTGKVKAAVISREDDLLSFTNGNTPLSNGSLIDDRTEEPLEADSVSLGTLAADSAPAPANGFVAEDDDFELDLPTPGFSSIPEAIEDIRQGKLVVVVDDEDRENEGDLVMAAQLATPEAMAFIVRHGTGIVCVSMKEDDLERLHLPLMVNQKENEEKLSTAFTVTVDAKHGTTTGVSARDRATTILSLASRDSKPEDFNRPGHIFPLKYREGGVLKRAGHTEASVDLTVLAGLDPVGVLCEIVDDDGSMARLPKLREFAAENNLKVVSIADLIRYRRKRDKLVERASAARIPTMWGPFTAYCYRSILDGIEHIAMVKGEIGDGQDILVRVHSECLTGDIFGSARCDCGNQLALSMQQIEATGRGVLVYLRGHEGRGIGLGHKLRAYNLQDAGRDTVEANEELGLPVDSREYGIGAQIIRDLGVRTMKLMTNNPAKYVGLKGYGLAIVGRVPLLSLITKENKRYLETKRTKMGHMYGLKFKGDVVEKIESESES

SEQ ID NO: 77737 - protein, 138 aa, Hordeum vulgare subsp. vulgare
MDHQELQEADVLWPHYNSEHRRDGDDGSNVDGDIAKVSPPELSAPVLVPLRKRRSRSWTASSDGSGSGNDDCSDGDVRCTNDAKRNVPPHVLAERRRRLAGRSTAAYSMCTGKGRTLKGRDLRNIRNLVLRMTGFIEK

SEQ ID NO: 77738 - protein, 989 aa, Gibberella zeae PH-1
MSGPISIGSESEWSSLLAGTNVVIADFYADWCGPCKMIAPTFEALAKEHSSPKKVAFAKINVDSQSGIARAQGVSAMPTFKIFQNGACIETIKGANPPALTAAIKNAVKLGGPVTGDVFKTPGRTLGGDARSAPLSKRWNLKGIFDALIAFFGLYFVSLLSFDPYKSAEKSPFNVHRKPTSGSSGSFGQGPGVSSRFYSSSTPFLRTRRISPFLKTQSNRNAAITQAFSTSRCLRQDSQSEPPASPEEIEQIVRDAKQRFRDTLPKGYLNDEEYAVYERLYGAPLRETRPEDVGIPEHADMEQTLRPDNEGTLLRELEDGEFEEITYEIPLSENVEETGETEPEADLEDPGMDQLAYQAPGYVDLVARSQREYDALKKLSDDFKISQKEQQEAENKAAAEEELAMEQLEEEQPQWPEEYDQRERPTGEAGRFHPLSIEGRFYDSPVEISLPMEELITPIRDLLQRTHIDHVKSAAETAFGGPGLPLSPATPAAKRNGNMHGVGLPADQRHMTEIEGDAFLAGFLPPAYASVMATLREVRKRAGSDWLQSKLKSGSGISVLDAGSGGAGLIAWDEIVKAEWDLLKEKGEVKGNKIPGKRSVIVGSDRLRHRTKTFLENTTFLPRLPDYEHSGEMKGERLDAGDKPQARKSYDVIVASHLFLKEEQDHYRQAVLNNLWNLLNKDGGVLIVLEKAHPRGFEAVAHVRDTVLKQFLLPQSGEPELLPEDFNPAYDREKEPGYVVAPCTNQGLCPMYQTPGKSAGRKDYCHFSQRFVRPMFYTKMLGNSSNNQGEVEFSYVAIRRGVSKEKPVTGKEAANQAFEGYENSDVKPDMQSLPRMIMPPLKRKGHVTLDLCTPEGRVERWTVSKSFSKLAYHDARKSKWGDLWALGAKTRVQRTVRAGKGPDDGGKRAGQGKKPRKVEIVMGPGGISASEKNAPRERRGRNKLDKKGRLLQEIMEAEEEEERMISKQMDEEVEAELEDESEVERRSRR

SEQ ID NO: 77739 - protein, 477 aa, Zea mays
MQRLASSRRLLQAALAPARANSSLSAAAVAAPAPANGAFPKMPAFDYTPPPYDGPRAEEIFRKRAQFLSPSLFHFYDRPLNIVEGKMQYLFDEDGRRYLDAFGGIATVCCGHCHPDVVEAIVNQAKRIQHSTVLYLNHAIADFAEALASKMPGDLKVVFFTNSGTEANELALMIARLYTGCNDIISLRNGYHGNAAGTMGATAQSNWKFNVVQTGVHHALNPDPFRGAFGSDGEKYARDVQEIIEFGTTGRVGGFISEAIQGVGGIVELAPGYLPVAYSMVRKAGGLCIADEVQAGVARTGSHFWGFEGHGVIPDIVTMAKGIGNGIPIGAVVTTPEIAQVLTRRSYFNTFGGNPVSTAGGHAVLKVLEKEKLQENAFVVGSYLKEQLNNLKDKHEIIGDVRGKGFLLGVELVTDHEKKTPAKAEISRVMNHMKDMGVLVGKGGFYGNVFRITPPLCFTKEDSDFFIEVMDIALSKL

SEQ ID NO: 77740 - protein, 401 aa, Synechocystis sp. PCC 6803
MLSKQSIANLTEADLAGKRVFVRVDFNVPLDNGSITDDTRIRAALPTIKDLLSKGAKVILGSHFGRPKGKVVDSMRLTPVGDRLGELLGQPVVKCDDCIGAEVTAKIASLPNGGVALLENLRFHAGEEGNDAEFAKALAANADLYVNDAFGTAHRAHASTEGVTHFLSPNVAGYLIEKELQFLQGAIEAPKRPLVAIVGGSKVSSKIGVIETLLDKCDKLIIGGGMIFTFYKAQGLNTGKSLVEEDKLDLAKSLMAKAKEKGVEFLLPTDVVVADNFAPDANAQTVGVDAIPDGWMGLDIGPDSVKTFQDALAGCGTVIWNGPMGVFEFDKFAVGTEAIACSLAELTASGTVTIIGGGDSVAAVEKVGVAEKMSHISTGGGASLELLEGKVLPGIAALDDR

SEQ ID NO: 77741 - protein, 130 aa, Oryza sativa Japonica Group
MEEFQEADVLWPDHHQHLRRDDDARRRRHQEQQHGGVDDADDSRGGTGTPSAPVGIPVTRAPTTRRISHGSTAPAAAFVPPHELVAARARRCSEERAAFSVCVGNGRTLKGRDLRDVRTAVLRMTGFLET

SEQ ID NO: 77742 - protein, 524 aa, Prochlorococcus marinus str. MIT 9515
MSNFTKYLSKNWLDDPKSNILSGLVVAFAMIPEAIAFSGIAGVDPKVGLYGAFCLSITIAILGGRRGMITSATGSTALLMTGVVSIGEAQAPGTNLGLSYLIAAGLLTGVFQILWGYLRLAYQMRFVPTGVLSGFVNALALLIFQAQFLQLGIGINEGKLLENELTKYPTISQVPTVWILVIFGLIIIYGFPKITKVIPSQLVAIVLLTFTSLFFQLDIPTVSDLGTLPNGFPSFSLPFGELENGKVPFNLSTLGVILPTSLAISLVGLMETFLTQDILDDATDTSSNKNKEARGQGIANLISSLFGGMAGCALVGQSVMNNENGGKSRLSTLTSGLSLLLMIILLKPWIGAIPMAALVAIMITIAISTADLNGLKNIRKIPKSDTAVMLMTFAVTMLTKPHNLALGVIAGVGLAAILFSRKVAKVITVSKVKDKDKNQITYKVEGQLFFVSKIYFLQGFDIHEHPKNILIDMSLAHIWDQSGVVALDQIIRKFKNSGSKVDIIGLNKESLNLFERLGGLETSH

SEQ ID NO: 77743 - protein, 187 aa, Silicibacter sp. TM1040
MFIQTESTPNPATLKFLPGQTVLDAGTADFPSAEAASKSPLAQRIFAVSGVTGVFFGNDFVTVTKDDSVEWDHIKPAVLGAVMEHYQSGQPVINEGQQQASGHAEHTGEDGEIVNQIKELLDSRVRPAVAQDGGDITFHGFDRGVVYLHMQGACAGCPSSTLTLKMGIENLLRHYIPEVTEVRPVAV

SEQ ID NO: 77744 - protein, 417 aa, Kluyveromyces lactis NRRL Y-1140
MRKCKVFVGNSHPELGHLVCERLGIEAAPCTLKKFANGETSVQIGVSVRDEDVYVIQSGSPEINDHIMELLILVSACRGGSAKKITAVIPQFPYSKQCKMKKHRGAITARMLANLLIMAGADHVVSMDLHASQMQGFFTKPVDNLYGGPSLGKWIREHVEDYREAVVVSKNPGGTKRVTALADSLKINFAMIHTDRRRSKDLYSQNKDKLQLKQRKQSMLRKNKPIIRPGDFENEEENIILTNGIQTARVIKGHVVDDEYVDDADAIQSDGEGSIGTIGSFDAVDSEDDEEDDEQPEKLITLVGNVQGRTAIILDDMIDRPGSFISAAEHMVKNCGAKEVYVIATHGIFTGDCLEQLEMSDDIHKVVVTNTYPISEERIRKSKKLVIIDVSSIFAECIRRDHYGESISVLFDSLASL

SEQ ID NO: 77745 - protein, 288 aa, Gibberella zeae PH-1
MNYSGANGFEFGAGNTNIDPAVLRELPEGCKVTSIENHGVSFWAKTGRIDVLLNDGTPKSFFIKAISKELGMNMTRGEFHSMSAIHNVLPEIVPRPIACGTYQTITDTHFFLCEFREMTEDMPDPHKFAALLSTLHQKSVSPTGKFGFHITTYAGNLPQFVTWEDRWETFFAKSMRQALDLEIERKGPSEELETLSRALFEKVIPRLLRPLESDGRTVKPSLVHGDLWYANAGIDVDNDQPLVFDACCFFAHNESDIKLGGLTHMYQPFLSITRHFAHSEAILSLPTV

SEQ ID NO: 77746 - protein, 238 aa, Rubrobacter xylanophilus DSM 9941
MTNSSSANGLRYDTVFLDVDGTLLWVDLDIEGYVRDLAPYAPDGGLTVERAAGPLRESVRTHIAENIKYRTAGALNEFRRRNALATARRLGVEAPPEVITGAAERRISFRPYPESEEVLRELRGLGARLYVVSNWDVLLEEVLRDLGWRGYFQGVVASAAVGREKPDPGIFEEALRRSGASRGRTVHVGNDPVADVEGARAAGIDAVLVDRRGGGGHPEAAFVVSDLREVPGIVRGES

SEQ ID NO: 77747 - protein, 435 aa, Oryza sativa
  misc_feature (31)..(31): Xaa can be any naturally occurring amino acid
  misc_feature (43)..(43): Xaa can be any naturally occurring amino acid
  misc_feature (119)..(119): Xaa can be any naturally occurring amino acid
  misc_feature (134)..(134): Xaa can be any naturally occurring amino acid
MERYKVIREIGDGTCGNVFRAYNTETNEIVXAVKKMKRKFFQXEECISLREVKALQKLNHPNIVKLKEVTMENHELFFIFENMECNLYDVIRERQAAFSEEEIRNFMVQILQGLALYAXNNGYFHRDLKPENLXVTDGTVKIADFGLAREVSSSPPYTDYVSTRWYRAPEVLLQSSAYTPAIDMWAVGAILAELFTLSPLFPGGSETDQLYKICAVLGTPDHTVWPEGMNLPRSSSFNFFQIPPRNLWELIPNATLEAIDLIQQLCSWDPRRRPTAEQSLQHPFFNVGNWVPRPLHASHTKTIETRPNPRLELNLWDFGTEPEDNYLDLTLSLKPSFPGTDFSNNVPEHTKEEILLYPGFENPPVQSGFWPLVASDRPMGDVPAMSSWPQAYVVDGQATLPAVGFSGSPFGLSPLQPNLFENRSFATPIRQVNFF

SEQ ID NO: 77748 - protein, 264 aa, Triticum aestivum
  misc_feature (77)..(77): Xaa can be any naturally occurring amino acid
MHPTRWELSHMVDLQAAALVISVVAAEVAVVSTQSPTYTCQISEYALAADIANSQKRPRCPAEIFKNSPLVVLSGFXGLGEPFKSFVTFFRHLVPAIDTDTVKLSTCQRILLLQYDKEMEAIDFRHYSIKLQPVGVSRKIRKLMQNNQVPDLRDLKDVSDYVTKAGYGSESEPDDEAATVSLASDIDKLNRASRKSAVRLQEIGPRMTMRLVKVESGLCSGDILYPQSVGKDVKEGQEEEEIEDAEDMMELEDGTEEDDSGDEE

SEQ ID NO: 77749 - protein, 668 aa, Staphylococcus aureus subsp. aureus COL
MVINLNDKQTKTSKEGLISVSHPLAAKIGKDVLDQGGNAMDAVIAIQLALNVVEPFASGIGGGGYLLYYEQSTGSITAFDARETAPEHVDKQFYLDDSGEYKSFFDMTTHGKTVAVPAIPKLFDYIHKRYAKLSLEDLINPAIELAIEGHAANWATEKYSRQQHARLTKYHETAQVFTHENQYWREGDWIVQPELGKTFQILREQGFNAFYKGDIAKQLVNVVKACGGTITLEDLAKYDIQIKAPISATFKDYDIYSMGPSSSGGITVIQILKLLEHVDLPSMGPRSVDYLHHLIQAMHLAYSDRAQYLADDNFHEVPVQSLIDDDYLKARSTLIDSNKANIDIEHGVVSDCISHTDVEENHTETTHFCVIDKEGNIASFTTSIGMIYGSGITIPGYGVLLNTTMDGFDVVDGGINEIAPYKRPLSNMAPTIVMYHGKPILTVGAPGAISIIASVAQTLINVLVFGMDIQQAIDEPRIYSSHPNRIEWEPQFSQSTILALIAHGHAMEHKPDAYIGDVHGLQVDPTTYEASGGSDDTREGTVMGGEVLVIRKQPLPYRQMYDSDGFRLYFNDVQLPLLADQVRWMHDKYWVDESVVRIIFPEVSAHIEDLRSYENAGENYIDIAWLARKYAYQVTLKDDGLYLTDDTYTSVKRNTNAYYRYDRDSITR

SEQ ID NO: 77750 - protein, 189 aa, Oryza sativa
LFNSILGNTEHVVKEHGWYPYEFQSGTTVAVAGEDYVVVASDTRLTENYTILSRTHSCVYQMHPNSLLLSTGFLADVLTLKKSLAARIKSYEYTHNTPISTPALAHLISIVMYGRRFFPYYTNSVLTGLDTAGQGCVFAFDPVGSMTPQLSACGGSAMPLILPILDAYILGTNTSYPGLVQRTKADPVY

SEQ ID NO: 77751 - protein, 514 aa, Solanum lycopersicum
MSSTLEIEARDVIKIVLQFCKENSLHQSFQTLQNECQVSLNTVDSLETFIADINSGRWDAVLPQVAQLKLPRKILEDLYEQIVLEMIELREMDTARAILRQTNVMGVMKQEQPERYLRLEHLLVRTYFDPHEAYNDSTKEKRRAQISQALSAEVSVVPPSRLMALIGQALKWQQHQGLLPPGTQFDLFRGTAAMKQDEEDMYPTTLGHTIKFPKKSHPECSRFSPDGQFLVSCSVDGFIEVWDHISGKLKKDLQYQADETFMMHDDAVLCVDFSRDSEMLASGSQDGKIKVWRIRTGQCLRRLERAHSQGVTSLVFSRDGTQILSTSFDSTARIHGLKSGKLLKEFRGHSSYVNDAIFTFDGSRVITASSDGSVKVWDAKTTECLQTFRPPPPLRGGDASVNSVHLFPKNNEHIIVCNKTSSIYLMTLQGQVVKSFSSGKREGGDFVAACLSPKGEWIYCVGEDRNLYCFSYQSNKLEHLMKVHEKDVIGITHHPHINLVATYGEDCTMKLWKP

SEQ ID NO: 77752 - protein, 408 aa, Thermoplasma acidophilum DSM 1728
MDEFFLMNSFDLAGKTVYLRVDINAPVNPLTGEIMGIDRFRAHIDTIRNLRNSKVVIVAHQSRPGKDDFISLRQHAQILSHLLNKRVQFVDQLFGSQVNRAVSEMSDGDIVMLENSRFYSEEVDLTTIESMESSNIVRSLSPLFDYFIIDAFAAIHRAQTTLVGFHRIKPNIAGTLIEREVSMIERFRKIREKPKIAILGGAKIEDSIAVSENFLSRGFVDKILTGGVVANAFLWASGFDIGKKNREFIMKNNGDYEKLLDKCRAILSKYGDKLVMPTDFVMNPSGQRISINEKIPDDQILADIGLDTIVEYSEIIDGARAIFMNGPMGMYEIEDYSSGTREVFTAVAHSKAFKLAGGGHTLSALDKLGLTKMIDHASTGGGALISYLSGETMPVLEALKESKKLFEG

SEQ ID NO: 77753 - protein, 183 aa, Crocosphaera watsonii WH 8501
MTIFEGTFAQDSSALRFAIVIGRFNDLVTDKLLSGCQDCLKRHGIDVNPHGTQVDYVWVPGSFEVPLVSRQLALSGNYDAIICLGAIIRGNTPHFDYVAAEVAKGVAAAAFQTGTPVVFGILTTDTMQQALERAGIKSNLGWNYALNALEMASLIGQLRGELPANNAQAALPVSQLKNPMLSE

SEQ ID NO: 77754 - protein, 149 aa, Zea mays
SDFVLVCVHSILLGFFQIGEIISRFEKKGFYLKALKLVNVERSFAEKHYADLASKPFFRGLVDYIISGPVVAMVWEGKRVVTTGRKIIGATNPLAFEPGPIRGDFAVDIGRNVIHGSDSIESANKEIALWFPEGPADWQSSQHPWIYEK

SEQ ID NO: 77755 - protein, 453 aa, Arabidopsis thaliana
  misc_feature (327)..(327): Xaa can be any naturally occurring amino acid
MAKVYWPYFDPEYENLSSRINPPSVSIDNTSCKECTLVKVDSMNKPGILLEVVQVLTDLDLTITKAYISSDGGWFMDVFHVTDQQGNKVTDSKTIDYIEKVLGPKGHASASQNTWPGKRVGVHSLGDHTSIEIIARDRPGLLSEVSAVLADLNINVVAAEAWTHNRRIACVLYVNDNATSRAVDDPERLSSMEEQLNNVLRGCEEQDEKFARTSLSIGSTHVDRRLHQMFFADRDYEAVTKLDDSASCGFEPKITVEHCEEKGYSVINVSCEDRPKLMFDIVCTLTDMQYIVFHATISSSGSHASQEYFIRHKDGCTLDTEGEKERXVKCLEAAIHRRVSEGWSLELCAKDRVGLLSEVTRILREHGLSVSRAGVTTVGEQAVNVFYVKDASGNPVDVKTIEALRGEIGHSMMIDFKNKVPSRKWKEEGQAGTGGGWAKTSFFFGNLLEKLLP

SEQ ID NO: 77756 - protein, 359 aa, marine gamma proteobacterium HTCC2143
MSRKVLVISGDGIGPEITAETVKVLDVVNQRFELGIEFDEALLGGAALDETGVPMPDETLNKAKDSDAILFAALGGPKWDANDRDLRPEKGLLQFRSGLGLFGNLRPAILYSQLADASSLKPEIVAGLDILIVRELTGGIYFGEPRGIRTLENGEREGYNTYKYNETEIRRIAKMAFEAAQKRSGKLCSVDKSNVLEATVLWREIVEGMAADYPDVELSHMYVDNAAMQLVRDPKQFDVIVTGNMFGDILSDAAAMLTGSIGMLPSASLDKNGRGMYEPCHGSAPDIAGQGKANPLAMILSAAMMLRYSLDAVEAADAIEIAVGVVLDQGIRTSDIFSAGTELVSTRVMGDAVAAALQL

SEQ ID NO: 77757 - protein, 610 aa, Zea mays
METLLAGNPANGVAKPTCNGVGALPVANSHAIIATPAAAAATLAPAGATLGRHLARRLVQIGASDVFAVPGDFNLTLLDYLIAEPGLTLVGCCNELNAGYAADGYARSRGVGACAVTFTVGGLSVLNAIAGAYSENLPVVCIVGGPNSNDYGTNRILHHTIGLPDFSQELRCFQTITCYQAIINNLDDAHEQIDTAIATALRESKPVYISVSCNLAGLSHPTFSRDPVPMFISPRLSNKANLEYAVEAAADFLNKAVKPVMVGGPKIRVAKAREAFAAVADASGYPFAVMPAAKGLVPEHHPRFIGTYWGAVSTTFCAEIVESADAYLFAGPIFNDYSSVGYSLLLKREKAVIVQPDRMVVGDGPAFGCILMPEFLRALAKRLRRNTTAYDNYRRIFVPDREPPNGKPNEPLRVNVLFKHIKGMLSGDSAVVAETGDSWFNCQKLRLPEGCGYEFQMQYGSIGWSVGATLGYAQAAKDKRVIACIGDGSFQVTAQDVSTMLRCGQKSIIFLINNGGYTIEVEIHDGPYNVIKNWDYTGLVNAIHNSEGNCWTMKVRTEEQLKEAIATVTGAKKDCLCFIEVIVHKDDTSKELLEWGSRVSAANSRPPNPQ

SEQ ID NO: 77758 - protein, 56 aa, Vitis riparia
DTCCPVLQGLVDLDAAVCLCTGIKVKLLNVNIIIPIALQVLVGCGKTPPSGFQCPA

SEQ ID NO: 77759 - protein, 163 aa, Zea mays
  misc_feature (82)..(82): Xaa can be any naturally occurring amino acid
MADSNNIDARCILVGYWRDDGQRSKVSKYWYSASAIHNGEITCTYPLLSSTFLGAFYIVLIVYVMFVGHQMLSLVINKGLRXRIYMLIFATRILLSRAILLGLSVLPWPGEVEHEALVFVSFLVLMLATMVGIVILVYFPVADTFSIGDQEHIEMQTSCDMIL

SEQ ID NO: 77760 - protein, 467 aa, Salmonella enterica subsp. enterica serovar Typhi str. CT18
MVDQVKVAADEQAPAEQSLRRNLTNRHIQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPGLSDWVASLAVVVLLLSLNLATVKMFGEMEFWFAMVKIVAIVALIVVGLVMIAMHFKSPTGVEASFAHLWNDGGWFPKGISGFFAGFQIAVFAFVGIELVGTTAAETKDPEKSLPRAINSIPIRIIMFYVFALIVIMSVTPWSSVVPDKSPFVELFVLVGLPAAASVINFVVLTSAASSANSGVFSTSRMLFGLAQEGVAPKAFAKLSKRAVPAKGLTFSCICLLGGVVMLMVNPSVIGAFTMITTVSAILFMFVWTIILCSYLVYRKKRPHLHEKSIYKMPLGKLMCWVCMAFFAFVLVLLTLEDDTRQALIVTPLWFIALGLGWLFLRKNKLAK

SEQ ID NO: 77761 - protein, 460 aa, Synechococcus sp. WH 7805
MLAAAMPPLLAEISAHDLEMAETLIGVARFALIFVAARLLAEVLVRLQLPTILGELLAGVLIGASGLHLLVPPETQVELSNGVISLVSGLVNVPPEAVPDIYNESFPSLESVAELGLYALLFLTGLESELEELIAVGAQAFTVAVAGVVLPFALGTWGLMAIFHVDAIPAIFAGASMTATSIGITASVFGELGFLKTREGQIVIGAAVLDDILGIVILAVVVALASGGSLEIGPIVKLVVAAAVFVVAAIGLSRTAAPAFDWMIDKLKAPGEVLVGSFVILALSCFTATAIGLEAALGAFAAGLILSSSKHNHAIQQAVLPIVTLFATIFFVLVGAGMDLSVINPSDPSSRTALVVAGFLLVVAIIGKIAAGWAFVSKQPTRRLVVGLGMMPRGEVGLIFLGLGTSAKLLSPSLEAAILLMVIGTTFLAPVLLRLVLGGNKPDDGDSVSDDVAAEPVGLL

SEQ ID NO: 77762 - protein, 282 aa, Leccinum holopus
  misc_feature (130)..(153): Xaa can be any naturally occurring amino acid
AVNDPFIDLEYMVYMFKYDSVHGRFKGDVHSKDGKLYINGKAITVYAERDPANIKWGAVGAEYVVESTGVFTTIEKAGAHLKGGAKKVIISAPSADAPMFVCGVNLDKYDPKYTVISNASCTTNCLAPLXXXXXXXXXXXXXXXXXXXXXXXXQKTVDGPSAKDWRGGRAVNGNIIPSSTGAAKAVGKVIPSLNGKLTGLAFRVPTNDVSVVDLVVRLEKSASYDEIKAAVKAASESPDLKGIIEYTDEALVSTDFTGHPASSIFDASGSIMLNPNFVKLIS

SEQ ID NO: 77763 - protein, 463 aa, Chlamydomonas reinhardtii
MKQFLRGLRGAADAREAGGGQDGAQEVVGGPSEPSRAAPTPSTSSAPAAAEDPGKPQAPSSFYCPISMELMHDPVMVATGHTYDRQCIEKWLNQGNRTCPVTGMRLRHLELTPNYALRTAIQEWATTHGVSMNAGGGKLNAPYRYEDEPRNILQGHEEIVWAVEVCGRRLFSASADKTIRVWDIESRRCEQVMEDHTRPVLSLSIANGKLFSGSYDYTIKVWDLATLQKIQTLSGHTDAVRALAVAGGRLFSGSYDSTVRVWDENTLQCLDVLKGHNGPVRTLVHCRNQMFSGSYDRTVKVWDCNTLECKATLTGHGGAVRALVASSDKVFSGSDDTTIKVWDAKTLKCMKTLLGHDDNVRVLAVGDRHMYSGSWDRTIRVWDLATLECVKVLEGHTEAVLALAVGNGVLVSGSYDTTVRFWDINNNYRCVRKCDGHDDAVRVLAAAEGRVFSGSYDGTIGLW

SEQ ID NO: 77764 - protein, 1077 aa, Zea mays
MEGDADGVKSGRRGGGQVCQICGDGVGTTAEGDVFAACDVCGFPVCRPCYEYERKDGTQACPQCKTKYKRHKGSPAIRGEEGDDTDADSDFNYLASGNEDQKQKIADRMRSWRMNVGGSGDVGRPKYDSGEIGLTKYDSGEIPRGYIPSVTNSQISGEIPGASPDHHMMSPTGNIGKRAPFPYVNHSPNPSREFSGSIGNVAWKERVDGWKMKQDKGTIPMTNGTSIAPSEGRGVGDIDASTDYNMEDALLNDETRQPLSRKVPLPSSRINPYRMVIVLRLIVLSIFLHYRITNPVRNAYPLWLLSVICEIWFALSWILDQFPKWFPINRETYLDRLALRYDREGEPSQLAAVDIFVSTVDPMKEPPLVTANTVLSILAVDYPVDKVSCYVSDDGAAMLTFDALAETSEFARKWVPFVKKYNIEPRAPEWYFSQKIDYLKDKVHPSFVKDRRAMKREYEEFKVRVNGLVAKAQKVPEEGWIMQDGTPWPGNNTRDHPGMIQVFLGHSGGLDTEGNELPRLVYVSREKRPGFQHHKKAGAMNALVRVSAVLTNGQYMLNLDCDHYINNSKALREAMCFLMDPNLGRSVCYVQFPQRFDGIDRNDRYANRNTVFFDINLRGLDGIQGPVYVGTGCVFNRTALYGYEPPIKQKKGGFLSSLCGGRKKASKSKKGSDKKKSQKHVDSSVPVFNLEDIEEGVEGAGFDDEKSLLMSQMSLEKRFGQSAAFVASTLMEYGGVPQSATPESLLKEAIHVISCGYEDKTEWGTEIGWIYGSVTEDILTGFKMHARGWRSIYCMPKRPAFKGSAPINLSDRLNQVLRWALGSVEILFSRHCPLWYGYGGRLKFLERFAYINTTIYPLTSIPLLIYCILPAICLLTGKFIIPEISNFASIWFISLFISIFATGILEMRWSGVGIDEWWRNEQFWVIGGISAHLFAVFQGLLKVLAGIDTNFTVTSKASDEDGDFAELYMFKWTTLLIPPTTILIINLVGVVAGISYAINSGYQSWGPLFGKLFFAFWVIVHLYPFLKGLMGRQNRTPTIVVVWAILLASIFSLLWVRIDPFTTRVTGPDTQTCGINC

SEQ ID NO: 77765 - protein, 249 aa, Vitis berlandieri x Vitis rupestris
MPKIAFGRFDDSFSLASFKAYLAEFHSTILFVFAGVGSVMAYNKLTSDAALDPAGLVAVAVAHGFALFVAVAVSANISGGHVNPAVTFGLVVGGQITILTGILYWIAQLVGSILACFLLKLVTGGLTTPVHSLGAGVGVIDAIVFEIVITFALVYTVYATAVDPKKGSLGIIAPIAIGLVVGANILAAGPFSGGSMNPARSFGPAVVSGDFKDNWIYWVGPLIGGGMGGSVYAFMYLGSDHQPLASSEF

SEQ ID NO: 77766 - protein, 237 aa, Leccinum rotundifoliae
  misc_feature (133)..(133): Xaa can be any naturally occurring amino acid
  misc_feature (140)..(140): Xaa can be any naturally occurring amino acid
AVNDPFIDLEYMVYMFKYDSVHGRFKGDVHAKDGKLYINGKSITVYAERDPANIKWGSVGAEYVVESTGVFTTIEKAGAHLKGGAKKVIISAPSADAPMFVCGVNLDKYDPKYTVISNASCTTNCLAPLAKVXNDKFGIXEGLMSTIHATTATQKTVDGPSAKDWRGGRAVNGNIIPSSTGAAKAVGKVIPSLNGKLTGLAFRVPTNDVSVVDLVVRLEKSASFDEIKAAVKAASES

SEQ ID NO: 77767 - protein, 1966 aa, Gibberella zeae PH-1
MFFRKQRRAKPDLHPDNSSSSRDSTKGLRNLFPLSKPQSNTSTNLDDRAKGDRGPLGLSLLYSPSAPEIDLIFVHGLGGNSRKTWSKSSTERSQFWPEEWLSKDPAFRNVRLHSYGYDSYYLKGKEDCLNVHHIGKSFLGAISTSPCIVNSRTYIVVVGHSMGGLVMKKAYILAKQDTGHEALAGRFAAFYFLATPHRGANSAKMLKNLLRVAYDRAYVGDLEPNSEAVQVTNDEFRHFSADLELWSFYETQNMKLFSSLIVDPESAVLGYRGEKQIPMTADHRSICKFDTPQDPNYILLRDALASTVSKIATAIPEKKRERTKNLKKYLEVSDLLDDDLANVCESRMRGSCEWISYKASYAGWKDGEYGNDRTLWIKGKPATGKSVLAGYVIDQLKGSGQACSYFFFKHGDKSKANLGRCLRCLAFQMAISNAEASDAILKMQADGICFNGVDERTLWRILFLSGIFQAAMTRHYWVIDALDECSNPPVLLNAILSNMDESIPLRILVTSRDTVELDQGFSAIPPNLVQFLPISVTDTKSDLRLLIERRTQALGVVKPNDRGKLAEKILDKSKGSFLWTILVLEELLRCHSRKEIHQILEDVPRGMGSLYKRTLDYMSQVTRGKELTKTILMWAACAVRPISISELDGALTLDIHDSFPNLEESIAALCGQLVVVDKYGRVNMVHETAREFLVAGGLESEFSIEKTKAHTRMAEVCLSYLVGEEMKPPRTKRRRSSANLPTRLDFAIYAYTAYSYHLSKADPLATEAFQLVTRFLKSNVLTWIETIADSQNLTHLIRASKHLKTYVDRCAVERSPLDPQMRALRQWSTDLARIPAMFANVLTVSPSAIYSLIPPFCPTESMVYKTGGSNQRLAVLGTYNKQWDDRMLCIDFHQGQPRALRYGDEFLAVALSSGAVVLYHATSYQEYKVLKHGEAVNFIAFKTKTDLVATCGIKTTKIWDIRKGQVVDSLMSPPRPLGMEFDGDMLLIASRNNYIETWNLGHDAQAESVRRPWSGANTPDTNQMPLRGTPCALTLSTSHGMLAVAYSGQPITLWDMEEDTYAGKCGKKLSSGETCTHVVVALAFNPNPDINLLAVAYLDGDLALLDPYTDRQLECFRANCQTLSPSPNGRFLAAGGANGIVHVYEFDTFKLLYRVKSSNSYIKQLAFARDSMLLADIRGTQCTVWKPEALLRESLGDDSSGLTSTTVVETLSMEAKAKITAMVVHHTFAVVFYGKDDGSVVLYERKTAASLGILYRHKSPVRLLAWIEPRDALLSVDASNRIFLHRIQKSADKGWLSDPTVLFKSHLDSEKAITDVLVGEIAAKFLVSTRESDYLFNLDNGKYEIERTYPQVPGTRKWLPHPQSSLHLICVDNVKACAYCWSDWSEVSSIAFSLDSHTVELKSAILYSLDQKQRVMLHLIHPSSSVNINRITIIDVDCLAVEGNDDLLRKQIDAAATLDQLATDEDREDTVKASNLAAPLSSRVTTFELSVTHVLGVDESKKLIFLNRSFWVCSVDLSESRLEIAQRKDSPAIEVFEHFFIPYDWFAGKRNIVCALAKRDIMLTRGGDLAVIRGGIDYAERMSALSQRATEAALVTDQLKEFADKSVTISNEDFLYRGSHAGGSRFPTALAAHLNEYLTPSSPITPDMIRCVGAATAMHDILAWGVADPGDGVLTSRPVYGRFELDFGNKSQAKVVYSDNKTEEAFQDGIIDHFEEALLRSSEAGIHVKMVLIVNPHNPLGRCYPKSTLVKIMQFCQKHRLHLLSDEIYACSVFNSDEPATPFTSILSIDSTNLIDPDLLHVTYGLSKDFGAAGLRLGAIITRSQPVLRAIEAAMRFHNPSGASLAIGNAMLEDRVWCRSFVDSSRSKLSQAHRHVTSQLKAMNIKYLPGSNAGFFVWIDLSPYLPSELDGELNQEFALAKRLREAGVFLHPREEHSLEPGWFRIVYTQDPRTVTEGLQRVKMAIS

SEQ ID NO: 77768 - protein, 307 aa, Arabidopsis thaliana
MDKRWSLKGMTALVTGGASGIGYAIVEELAGFGARIHVCDISEAKLNQSLSEWEKKGFQVSGSVCDVASRPEREELMQTVSSQFDGKLNILVSNVGVIRSKPTTEYTEDDFAFHISSNVEAAYHFSQLSHPLLKASGYGSIIFVSSIAGVISFDAGSIYGLTKGALIQLAKNLACEWAKDGIRANAVAPNVINTPLSQSYLEDVSFKKALLSRTPLGRVGEPNEVASLVAFLCLPAASYITGQTICVDGGLTVNGFSYQPEEALLSRTSLRRVGEPNEVSSLVVFLCLPAASYITGQMVKPFVLMEV

SEQ ID NO: 77769 - protein, 289 aa, Streptococcus suis 89/1591
MPKTILITGSTDGIGKHLAMKLASEGHEVILHGRNSEKFRVALSDIQLKTGNKKIHGYLADFSKLADVYRFSQEIKRDFEQIDVLVNNAGAYFGDARVATAENIEMTFMLSVQVPYILTTELLPLLEKAVGRVIHTSSFMHHFAQTRGLDFGLEQSYSAAMAYNNAKLYTIWLAIAQAEALEKQGSSVTVNAYHPGLIATNLGNDGVKRNLRSRILTSLMKPFSKDLDQGIETGYYLSLSPEVAGQSGRYFAEKKVAKVSLKGFDVPKSQALLAYLDKKIQVFKESYRD

SEQ ID NO: 77770 - protein, 262 aa, Glycine max
GGYKWSLSIYPTGNTKGGGEGHVSIYLVLMDSSSLPVDWEVNAIVNFSAYNFIDDEYVATQDTNVRRFHVLKTEWGVAKFIDIDTFNDPSNGYLMDDTCVFGAEVFVVKTTTKGDCLSMIHGPIPLSHSWKFDNFSLAKLDKYESESVVGGNYRWKLILYPNGIFEGKGNSISLFLTLEVSTLPPNTKLVVECTLRAKKQISGHHAQTGFCRKFSSSNSTWGTRQLVALAKLTDPNSGFLVNDTCILEAEFTILGLITPRID

SEQ ID NO: 77771 - protein, 467 aa, Glycine max
MAATRPVQCLLRRVCRGSRTIGVATEVNASSSSQKIIDKEYEHSAHNYHPLPIVFAQAKGTSVWDPEGNKYLDFLSGYSAVNQGHCHPKILKALQEQAERLTVSSRAFYNDRFPDFAEYVTNMFGYDMVLPMNTGAEGVETALKLARKWGYEKKRIPKDEAIIVSCCGCFHGRTLGVISLSCDNEATRGFGPLLPGNLKVDFGDAEALEQIFKEKGEHIAAFILEPVQGEAGVIFPPDGYLKAVRDLCSKYNVLMIADEIQTGLARTGKMLACEWEEVRPDVLILGKALGGGVIPVSAVLADKDVMLCIQPGQHGSTFGGNPMASAVAIASLEVIKNERLVERSAQMGEELTGQLLKIQQQYPDYVKEVRGRGLFIGVEFNSKKLFPVSGYELCKKLKYRGVLAKPTHDAIIRFTPPLCISVDEIQQGSKALADVLEIDLPKLQKTKPIDAAPVATSACDRCGRVLY

SEQ ID NO: 77772 - protein, 424 aa, Agrobacterium tumefaciens str. C58 [sequence omitted]

SEQ ID NO: 77773 - protein, 331 aa, Zea mays
MSGAIGGAEVHGFRGAAAQLPRSRVLGRPIRVAPPAAARPGGASAGSIRAVSAPAKKDASEVKRSKVEIIKEKSNFLRYPLNEELVSEAPNINESAVQLIKFHGSYQQTDRDVRGQKNYSFMLRTKNPCGKVPNQLYLAMDTLADEFGIGTLRLTTRQTFQLHGVLKKNLKTVLSTVIKNMGSTLGACGDLNRNVLAPAAPFVKKDILFAQQTAENIAALLTPQSGAYYDLWVDGEKIMSAEEPPEVTKARNDNSHGTNFPDSPEPIYGTQYLPRKFKVAVTAAGDNSVDILTNDIGVVVVSDDAGEPIGFNIYVGGGMGRTHRVETTFPR

SEQ ID NO: 77774 - protein, 349 aa, Rubrobacter xylanophilus DSM 9941
MARIAVIGGDGIGPEVVGAGVRVLEAAARADSSLELEFERFPWGCEHYLKHGRMMPEDALETLSSFDAIYLGAVGWPSVPDHVSLWGLLLPIRRGFDQYVNLRPVRLLRGVGSPLAGRAQPDLLVVRENTEGEYSDAGGRLHRGTPHEIAVQESVFTRRGVERIVRYAYERARERRGLLTGATKSNGISVTMPFFDEIFREVGEEFPEVEASLMHADALAARLVLDPAAFDVIVGSNLLGDILSEITAAVCGAIGIAPSANLDPTGEHPSLFEPIHGSAPDIAGRGVANPAGAIWAASLMLDHLGHGEAASRVLGALEETLAGGVRTPDLGGDAGTEEVTRAVVRRLLF

SEQ ID NO: 77775 - protein, 108 aa, Oryza sativa
MSSSPHKDEVNYETKDETTVTSPHDEEQGTTSGEGQLKRDLRGRHMQMIAIGGAIGAGLFVGSGSALHKGGPASLVIGYLIIGVMLLCTNLALAEMAVLYPVNGAFYT

SEQ ID NO: 77776 - protein, 481 aa, Agrobacterium tumefaciens str. C58
MAQSYDVIIIGSGPGGYIAAIRAAQLGMKVAVVEREHLAGICSNWGCIPTKALLRTADVMHTATHAKDYGLTLEGSIKPDVKAIVARSRGIAARMNNGVGFLFKKNKVDIIWGEAKITKPGEIVVGKSTKPVVQPQGPVPKNTLGEGTYTAKHIIVATGARPRALPGIEPDGKLIWTYFEAMKPEELPKSLLVMGSGAIGIEFASFYRTMGVDVTVVEIMSQVMPVEDAEISAFAKKQLEKQGIKIHLETKVSKVEKAANSVTATLEKKDGSSEKIIADRMISAVGVVANVEGIGLEAAGVKTDRGFIIIDGYGKTNVPGIYAIGDVAGPPLLAHKAEHEAVICVEKIAGLPNVHPMDKLKIPGCTYCNPQVASVGLTEAKAKEQGRDIRVGRFSFAANGKAVALGEDQGMVKTIFDKKTGELLGAHMVGAEVTELIQGFVVAMNLETTEEDLMHTIFPHPTISESMKESVLDAYGRVLNA

SEQ ID NO: 77777 - protein, 250 aa, Triticum aestivum
SRTRAPAPASPRTTPSSSRYARVELPRYRMPENSIPKETAYQMITDELMLDGNPRLDLASFVTTWMEPECNKLIMDSINKNYVDMDEYPVTTELQNRCVNMIAHLFNAPINEDEKAIGVSTVGSSEAIMLAGLAFKRKWANKRKEEGKPYDKPNIVTGANVQVCWEKFARYFEVELKEVKLTEGYYVMDPLKAVEMVDENTICVAAILGSTLTGEYEDVKLLNDLLVGKNKETGYAFYLLAVVSQFGKLP

SEQ ID NO: 77778 - protein, 817 aa, Debaryomyces hansenii CBS767
MNEFPDEHRNSTSFTMHLLGDQVLGELYQDSRELKQWLIKSNCQHHYNKFIENGITFDLLKELDSSSLKEIGINKLGDRLRLELAISSMKSEKLADNITVDELYKIMNLHLTDSITLLSGGNISNGSVSTPTNESGTLTTLTNNPYLHSNVSSSSNAANKDANKNVTFILQDGSTKKVNVTGCFNAQSIKRKVLKRLGIKQQETLYNTYIHTSLNSKSNPGVNLLFDVELVTICYSPDRLEKHRIILCRKDEYPSDMAIESSKRLMAKYERYSQTDSLKTKSQDNFSQYHMPDPRKTHASPILRNFFGQRPPSELISSNLAEYFPEAHQKDLEATVRNSVRYSVRLSRRFNLPSSILSGASSNISIHNSQNKRSSILSNGTVSGPNGAPGTPSVSSMDQNSVAAKRKPSGRTIGEMMVNNINAIDQAVSSNDVQSVFSKPQSIGSDISGPGQGSFEPKSMKSHTSPILNRSSIAASFVDPFHTDNNRNSRIELLSIDSDDDEDDFIDEYGTYTSGELDHDFKDNMLDSISEDGPKNWLQGARIGAGSFGTVYLGMNPLTGELMAVKQVSLPDKNSINNSLQTAMIEALQHEMTLLKEINHENIVRYLGSSTDDNFLNIFLEYVPGGSVQSMLSSYGPFEEPLIRNFIRQILIGLSYLHGEDIIHRDIKGANILIDIKGTVKISDFGISKKVGNSDVDMDDETNSQKKGERRASLQGSVYWMAPEVVKQTAYTKKADIWSVGCLIVEMFTGKHPFPDFSQMQAIFKIGTHITPQIPEWCTSEAKDFLYKTFELDYEKRPDAIDMLAEPFLNPLIMSKQ

SEQ ID NO: 77779 - protein, 580 aa, Arabidopsis thaliana
MVGGGNRRDEGSMPIQNTNLFAALDTSRKKKKSDKAGKSKASSKREDSQKEPEPQVFWAPTPLKAKAWADIDSDDEDDDYYATTAPPQSLWSTSEASHSDAKDVPAEEIESEEDTLDDGDDDDVEEDHEQGTETQVHPEAEPEVKKAPEVRAPPKEAERQLSKKERKKKELAELEALLADFGVATKDENGQQDSQDKGEKKEVNDEGEKKENTTGESKASKKKKKKDKQKELKESQSEVKSNSDAASESAEQEESSSSIDVKERLKKIASMKKKKSSKEVDGASTAAAKEAAARKAKLAAAKKKEKKNYNQQPVRYISLAVYSTKKKSWYSIYFTLLRQFVVLLATLDDGEVEMWRRVIGNVAVRHQLQRALSSKAGGSGKSANVSAAVDSMLLRSLKEHYLEVSKMTPPPKVSPPSPFEIVKGSLEGSTGAVLKKSVGNEEINLFVMRLAHGGDEEDDGGINQLFLHVAVSKPNQPDSLHFLCGLYPDALGIHSVSMRPKLEALEMSDDPTQYTGPSFEELDEKMRDVFHGFLEERGVNESLFPFLQAWLYVKDHRNLLRWFKSVGTFVHENPSAENTA

SEQ ID NO: 77780 - protein, 246 aa, Salmonella enterica subsp. enterica serovar Typhi str. CT18
MLEQVCQLARNAGDAIMQVYDGAKPMEYARKQDDSPVTAADIAAHTVILEGLRTLTPDIPVLSEEDPPAWEVRQHWQRYWLVDPLDGTKEFIKRNREFTVNIALIEQGKPVLGVVYAPVLKVMYYAAEGKAWKEECGVRKQIQVRDARPPLVVISRSHTDDELTEYLQQLGEHQTTSIGSSLKFCLVAEGQAQLYPRFGPTSVWDTAAGHAIAVAAGAHVHDWQGKTLDYTPRESFLNPGFRVTIY

SEQ ID NO: 77781 - protein, 159 aa, Triticum aestivum
MPKRTTHTYSSEDALPEGPESDLFVYYCKHCASHVLITDTLLQKMPKRKTDRAHVLDKAKHLARLNVKDAGKILLKRGEGKLEKQFRMTCVGCDLFVCYRSEEDLELAPYIYVVDGALNSLAGETNPHDAPVPPCITQLQGGLVQVAIEVEDRAHRSIT

SEQ ID NO: 77782 - protein, 275 aa, Bacillus pumilus SAFR-032
MSGLTDTVTLANGVKMPKLGFGVWQVKDGDEAVNAVTDALEAGYRSIDTAAAYQNEEGVGKAIQQSGISRDDLFITTKVWNRDQGYESTLEAFETSMNKLGLDVLDLYLIHWPVEGKYKETWKALEKLYKDGRVRAIGVCNFHQHHLDDLLEEAEVVPMVNQIELHPKLTQEPLRDYCKEKGIHVEAWSPLGSGKLLNHPVLQDIAKKHDKSVAQVILRWDLQHGIITIPKSVTKSRIIENTQVFDFELSAHEMGVIDQLNEDERTGPDPDNFDF

SEQ ID NO: 77783 - protein, 595 aa, Oryza sativa Japonica Group
MGGEVPEPRRLNRALSFDDWVPDEALHLVMGHVEDPRDREAASRVCRRWHRIDALTRKHVTVAFCYAARPARLRERFPRLESLSLKGKPRAAMYGLIPDDWGAYAAPWIDELAAPLECLKALHLRRMTVTDADIAALVRARGHMLQELKLDKCIGFSTDALRLVARSCRSLRTLFLEECHITDKGGEWLHELAVNNSVLVTLNFYMTELKVAPADLELLAKNCKSLISLKMSECDLSDLISFFQTANALQDFAGGAFYEVGELTKYEKVKFPPRLCFLGLTYMGTNEMPVIFPFSMKLKKLDLQYTFLTTEDHCQIIAKCPNLLILEVRNVIGDRGLEVVGDTCKKLRRLRIERGDDDPGLQEEQGGVSQLGLTAVAVGCRELEYIAAYVSDITNGALESIGTFCKNLYDFRLVLLDRERQVTDLPLDNGVCALLRNCTKLRRFALYLRPGGLSDDGLSYIGQYSGNIQYMLLGNVGESDHGLIRFAVGCTNLQKLELRSCCFSERALSLAVLQMPSLRYIWVQGYRASQTGLDLLLMARPFWNIEFTPPSPESFNHMTEDGEPCVDSHAQVLAYYSLAGRRSDCPQWVIPLHPA

SEQ ID NO: 77784 - protein, 1264 aa, Arabidopsis thaliana
MAALQTLREWIGIQQFPPATQSKLLEILGKYKEEDVSSLTVLVMGKGGVGKSSTVNSVIGEKAAAVSTFQSEGLRPTLVSRTRSGFTLNIIDTPGLIEGGYVNDQAINIIKRYDELFPGLRSYSPNLGLICGICINLDSWMLNLNRFLLNMTIDVLLYVDRLDVYRVDDLDRQVVGAITDAFGKEIWKKSALVLTHAQFSPPDGLNYNHFVSKRSNALLKVIQTGAQLKKQDLQGFSIPVILVENSGRCHKNESDEKILPCGTSWIPNLFNKITEISFNGNKAIHVDKKLVEGPNPNERGKKLIPLMFAFQYLLVMKPLVRAIKSDVSRESKPAWELRDSVKPDQMSASTVSITANTAAATRRTPILAGEKKSNFDYPQSESLANGGVGEAGGTSRDLSRGEATLDRSQGQDLGPVTRRSVSAATGTNTTATQRRTRKVATPKSEKARWKTVVRIFAKQLGALLIIVGLIQLTRKMILKASSPSSPISSYETEMAFSGLESRIAEVDGLVKATTNSMQVQVELLDKKMEREAKVLRQEIERKASAFQSELKKIESRTESLEKSVDEVNAKPWVTKDELERIYEELKKGNVDDSAFSEISIDELRAYARDIMEKEIEKHAADGLGRVDYALASGGAFVMEHSDPYLVGKGSSWFATTMRRAHTNAVKMLSPSFGEPGQCFPLKGSEGYVQIRLRGPIIPEAFTLEHVAKSVAYDRSSAPKDCRVSGSLQGPESSAETENMQLLTEFTYDLDRSNAQTFNILESSSSGLIDTVRLDFTSNHGSDSHTCIYRFRVHGRAPDPVPVVGTNLDQDSSPERSQSEIVVESLLASSNLRSSMPTQQIQSLRVFVATWNVGGKSPHSGLNLDALLHVHSEFDEIVPLNAGNVLVLGDNEPAAKWLAMINQSLNKSSSSSGGRLSPKTPSFGAGSMFFAKPSLKKISESFRTECRRKLKICNCSTFSEDIVRKYGRESCFRCPEGLVNQSGVLSDDEEDEDDDDDDEDEDEGGGKVASLVSNQMTMKYGLVASKQMVGIFLTVWMRKELIQHVSHLRISSVTRGIMGCLGNKGCIAVSLQLYKTSFCFICSHLASGEREGDERRRNLDVIEILKNTSFPRICRTSFTRVPDRITKHDRVIWLGDLNYRIALSYSETKTLLDKNAWDTLLNKDQLKIERDAGRVFKGWHEGKIFFAPTYKYSYNSDAYAGDTSKEKKNKRRTPAWCDRILWHGDGIRQLSYVRGESRFSDHRPVCSVFVVDVEVCEGKTGTRRQ

SEQ ID NO: 77785 - protein, 381 aa, Vibrio campbellii AND4
MSKRDFYEVLGVSRDASERDIKKAYKRLAMKYHPDRNQSDDSAAEKFKEVKVAYEILTDAQKRAAYDQYGHAAFEQGGMGGGGGFGGGGADFGDIFGDVFGDIFGGGRRGGGGHRAQRGADLRYNMELSLEEAVRGVSREIEVPTLVECDTCDGSGAEKGSSAETCGTCHGHGQVQMRQGFFAVQQTCPTCHGKGKIIKNPCKSCHGQGRKQKTKTLNVKIPAGVDTGDRIRLSGEGEAGEHGAPAGDLYVQVHVKEHHIFEREGNNLYCEVPVSFAMAALGGEVEVPTLDGRVNLKVPTETQTGRMFRMRGKGVKGVRGGGVGDLIVKLVVETPVKLSSRQKDLLKEFEESCGGEAATKHKPKSEGFFNGVKKFFDDLTS

SEQ ID NO: 77786 - protein, 334 aa, Rhodopirellula baltica SH 1
MSDFFTPPKPVTPLPSPEVTARQSEEFAARLRKRAKHLRRWPTKQDITCYRLYERDVPEVPLVVDRYEDHLHIGEFERPHDRSDDEHTVWLEHMVKVAAKTLDVSRSKVFFKQRKRQRGTAQHETVASRHYQIEAKEGGLKFQVNLSDYIDTGLFLDHRITRSMVRDEVAGKRFLNLFAYTGSFTVYAADGAAASTTTVDLSNTYLTWAKENMRLNGFEGDSHEYVAEDAMTFIKNLPATAVFDVAVVDPPTFSNSKRTQKDWVVQDDYKDLLQQTLKHIARDGVIYFSTNFRQFQMDESAFPGAKVHEISRQTVPEDFRNRRIHRCWRITRTS

SEQ ID NO: 77787 - protein, 358 aa, Synechococcus sp. RS9916
MIDELSWAPGFHTMRIGINGFGRIGRLVFRALWGRAGIELVHVNDPAGDAAAGAHLLEFDSVHGRWNQEIQVHAEGFSVGGQPLTWSQHNTPTDVPWQDLGVDMVLEASGRFKTPDTLNPYFDQAGLQRVVVGCPVKGTVAGHEALNIVYGINHDLYKPEQHRLVTAASCTTNCLAPVVKVVHETFGIDHGMITTIHDITNTQVTVDAFKSDLRRARSGLTSLIPTTTGSAKAIAMIFPELKGKLNGHAVRVPLLNGSLTDAVFELKRAVTVDEVNAAFEAAAAGPLKGILGFETRPLVSCDYTNDNRSSVIDGPSTMVVDGTQLKVYAWYDNEWGYSSRMADLVCHIVELDEACDQR

SEQ ID NO: 77788 - protein, 525 aa, Colwellia psychrerythraea 34H
MSKDIHDHRILILDFGSQYTQLIARRVREIGVYCELWSWDVTEEQIKGFNPTGIILAGGPESVTEANSPRAPEYVYTAGVPVLGICYGMQTMAEQLGGGVESSSHKEFGYAAVELIAQSALFNKVEDSIGDNGNALLDVWMSHGDKVSAIPEGFVTVAQTASCAYGAMANEEKQFYGVQFHPEVTHTKQGSRILENFVVDICKCEKLWTSASIIDDAIAKMKAQVGDDEVILGLSGGVDSSVVAMLLHRAIGDKLTCVFVDNGLLRLDEGQQVMDMFGDHFGLNIIKIEAEDRFLNRLAGESEPEAKRKIIGNVFIDVFEEESNKLDNAKWLAQGTIYPDVIESAASATGKAHVIKSHHNVGGLPDYMKLGLVEPLRELFKDEVRKIGLELGLPYDMLYRHPFPGPGLGVRILGEVKKEYADLLRRADAIFIEELHKHDLYTKVSQAFTVFLPVKSVGVMGDARKYDWVVSLRCVETIDFMTARWSHLPYDFLGLVSNRIINEIDGISRVVYDISGKPPATIEWE

SEQ ID NO: 77789 - protein, 363 aa, Anabaena variabilis ATCC 29413
MSGKNIVFLVLLLFIPVSLAAHYLEWGDLIVFVTAGLAILPLAAWMGAATEEIAVVVGPTLGGLLNATFGNATELIIALVALNAGLVNVVKASITGSIIGNLLLVMGLSMLLGGLRHKEQTFQPIVARVNASAMNLAVIAILLPTAMNYTAKGIGEATLQYLSVAVAVVLILVYVLTLIFSMKTHAYLYDVGVAEIETEENPHPKPNIFLWSGVLLVCTLLVAVESELLVDALEVATSQLGLTALFTGVILVPIVGNAAEHATAVTVAMKDKMDLSVSVAVGSSMQIALFVAPVLVIAGWILGQPMDLDFQPFELVAVVVSVLIANSISSDGKSNWLEGTLLLAAYAVLGFAFYFHPDVGGLG

SEQ ID NO: 77790 - protein, 403 aa, Silicibacter pomeroyi DSS-3
MTAPSDVFDRPRIRLKPKANARAIRHGAPWVFDNEVVTDRRTRKIAPGTVAVLEDDNRAPLGLVAVNPGSRILARMLDRDPEAELNAAWFEARLTRALALRERLFDAPFYRLVHAEADGFPGVIIDRFGEACVIQPNAAWAEAHLELLSAALIKVTGVSTVLKNASGRTRALEGLDDQNAVLAGAAPTAPVPVLMNGATYMADLTGGQKTGLFYDQRPNHAFAARLAGQGTRVLDVFSHVGGFALAMLAGGAGSALAVDGSAPALALAEQGALASGLAGRFETRQGDAFDVLTALAEEGETFDVVICDPPAFAPSKQALDAGLRAYERVARLAAALVRPGGYLGLCSCSHAADLSRFREASVRGIGRAGRSAQLIHTGFAGPDHPQLPQLAESGYLKAVFFRL

SEQ ID NO: 77791 - protein, 304 aa, Amycolatopsis methanolica
MSRIAYFGPVGTFTEQAARTFMAAGDELVAAETIPKALDAVRRGEADAACVPVENSVEGAVPATLDSLAVGEPLIGVAEALLPVHFSVLTRDDVGEIRTVASHPHALAQVRKWLEDNLPGARVVAAGSTAAAAVAVQAGEFDAAVTAPVAVEHYPLKVLATEVADVRDARTRFLLMRRPPVVLPEPTGADRTSIVAAAANRTGTLAELLTELATRGINLTRLDARPHKQNFGEYRFFIDFEGHVAEPRIADALAALRRRCRDVRFLGSFARADGVAATIEPAARNEDFTDAADWVAAVQRGEQA

SEQ ID NO: 77792 - protein, 417 aa, Rhizopus niveus
MSLSNKLSIRDLNLKDKRVLIRVDFNVPMKDGAITNNNRIVQALPTVKYALDNGASAVILMSHLGRPNGEAVAKYSLKPVAAEVEKLLGKPVEFLNDCVGPDVEKACQSAKDGKVILLENLRFHIEEEGSAKVDGQKVKADAEAIKKFRASLTTLADIYINDAFGTAHRAHSSMVGVDLSQRAAGFLMQKELEYFAKALENPSRPFLAILGGAKVSDKIQLIENMLDKVNALIICGGMAFTFKKTLDNVKIGKSLFDEPGSKLVQNLVKKAAEKNVKIVFPVDFITADKFAPDASTGYATDDDGIPDGWQGLDCGERSNKLFREEILKSKTIVWNGPSGVFEFDAFSSGTKAVLDAVINATKEGATTIIIGGGDTATAALKWGAEGQVSHISTGGGASLELLEGKELPGVTALSSKN

SEQ ID NO: 77793 - protein, 417 aa, Yarrowia lipolytica
MSLTNKLSIKDLDLKNKRVFIRVDFNVPLDGTTITNNQRIVAALPSIKYAIDQGAKAVILASHLGRPNGQRVEKYSLKPVQAELSKLLGKPVTFLDDCVGPKVEEEVSKAKDGEVILLENLRFHPEEEGSHKDADGKKIKADPAKVEEFRKSLTSLADVYVNDAFGTAHRAHSSMVGIELPQRAAGFLVAKELEFFAKALEHPERPFLAILGGAKVSDKIQLIDNLLDKVNALIIGGGMAFTFKKTLENVKIGNSLFDEDGSKIVAGLVEKAKKNNVKLVFPVDYVTADKFSKDAKVGHATDAEGIPDGWQGLDCGPKSIEEFQKVIGESKTILWNGPPGVFEFDNFAKGTKAVLDACVKAVDNGATVIIGGGDTATVAKKYGAEDKLSHVSTGGGASLELLEGKTLPGVAALSEKK

SEQ ID NO: 77794 - protein, 417 aa, Rhizopus niveus
MSLSNKLSIRDLDLKNKRVLIRVDFNVPMKDGAITNNNRIVQALPTVKYALDNGASAVILMSHLGRPNGEAVAKYSLKPVAAEVEKLLGKPVEFLNDCVGPDVEKACQSATGGKVILLENLRFHIEEEGSAKVRWSKVKADAEAVKKFRASLTALADIYVNDAFGTAHRAHSSMVGVDLSQRAAGFLMQKELEYFAKALENPARPFLAILGGAKVSDKIQLIENMLDKVNALIVCGGMAFTFKKTLDNVKQIGKSLFDEAGSKLVRNLVKKAAEKNVKLVFPVDFVTADKFAPDANTGYATDADGIPDEWEGLDCGKKSSELFREEILKSKTIVWNGPSGVFEFDAFANGTKSVLNAVIEATKEGATTIIGGGDTATAALKWGAEGKVSHISTGGGASLELLEGKELPGVTALSSKN

SEQ ID NO: 77795 - protein, 486 aa, Synechococcus sp. WH 5701
MSPTSLSPSAAAGAGGAVDPAGRLSTAALRELVNSGLTRPIAWRQAQLQRLDGLLSENEPAILEALSADLGKPPVEAYFEVVAVRQELRLAQKKLKRWMAPRPVSVPLSQLPGRAELVAEPLGCVLIIGPWNYPFSLTLQPLVSALAAGNTAVLKPSEQAPHTSALIARLVGRHLDPKVAAVLEGGADVAGELLELRFDHIFFTGGGRVGRLVMAAAARTLTPVTLELGGRSPAIVLADADLDVSARRLAWGKGLNAGQTCIAPDHLLVEDSVRPALIERLRGEFQRAYGDDPLASPDLARIVNQAQFERLLALLEGARRGGRVLSGGQVDPQTRRIAPTLIACDSAFELLSRGCDDDPLLAGELFGPLLPVVGVSGLPQAIDLIRQGPKPLALYLFSRSQAAQDQVLTSTSSGGVCLNDVVMQAVVPELSFGGVGESGMGRYHGQAGFDTFSHLRSVLRRPFRFDLPFRYPPYGDRLALMKRLLG

SEQ ID NO: 77796 - protein, 352 aa, Schizosaccharomyces pombe 972h-
MSLFGQATTSTVSNATGDLKKDVEVAQPPEDSISDLAFSPQAEYLAASSWDSKVRIYEVQATGQSIGKALYEHQGPVLSVNWSRDGTKVASGSVDKSAKVFDIQTGQNQQVAAHDDAVRCVRFVEAMGTSPILATGSWDKTLKYWDLRQSTPIATVSLPERVYAMDCVHPLLTVATAERNICVINLSEPTKIFKLAMSPLKFQTRSLACFIKGDGYAIGSVEGRCAIQNIDEKNASQNFSFRCHRNQAGNSADVYSVNSIAFHPQYGTFSTAGSDGTFSFWDKDSHQRLKSYPNVGGTISCSTFNRTGDIFAYAISYDWSKGYTFNNAQLPNKIMLHPVPQDEIKPRPKKGR

SEQ ID NO: 77797 - protein, 350 aa, Sulfitobacter sp. EE-36
MNIRTQVKTHSHTATPFAATRIADNVLDLIGQTPMVRLPRYLDREDVNLVAKVEALNPGGSAKDRPARHMIERALADGRLKPGDTVVESSSGNMGIGLAQACAVHGLQFICVVDPNAQSQNVAIIRALGGQIELVDHAPDGDFLAARLDRVAKLLEENSRRFWPNQYANLDNPESHELGTIAEIDAALGGQIDVLFVACSSTGTARGCRDYLRRMGRKTKVVAVDAMGSTLFNGTAGPRKISGMGAGRIPELANGQEFDDLVRVSDVTCVAGCRRAVAREGLLVGGSGGGVLEAVRGMQDELAGLTVAAIIHDSGSRYLGTVFDPEWVERELGICEADVTALAGLAPADS

SEQ ID NO: 77798 - protein, 325 aa, Prochlorococcus marinus subsp. marinus str. CCMP1375
MSIPPAIVASARMGWKWQWNQLMNGLAPADAEGNYTRTQSQALDSKPPKAEDLLNRSSEDFPLLVVARSCPWAHRTWLLYELKDLNKSLNILIAKPNPKAGLWKIDPSWKGCKSVLEIYKLCNAPPTHRATVPVLVDPKPNNKKTPELLGNESAQLVETLNIWPTEESTPNFYPKELHEEIKDWQELLQDSVNNGVYKCGFARNQRSYEEACKTLFNSLKIVEKNLSIKGPWLCGEKLTIADIRLFPTMIRWESVYAPLFRCNQSPLTKFPNLLQWRKNFFNLPKVSKTCDSKNWRNDYFGALFPLNPSNIVPLGPNIQEIINSA

SEQ ID NO: 77799 - protein, 513 aa, Lactococcus lactis subsp. lactis
MSDTTLEKIIVLDYGSQYNQLIARRIREIGVFSELMSHKVTAKEIREINPIGIILSGGPNSVYDEGSFDIDPEIFELGLPVLGICYGMQLMSYKLGGMVEAAGEREYGVAPLQLTEKSALFAGTPEVQDVLMSHGDRVTAIPEGFHVVGTSPNSPFAAVENTERNLYGIQFHPEVRHSVHGTEMLRNFALNICGAKGNWSMENFIDMQIKDIREKVGDKKVLLGLSGGVDSSVVGVLLQRAIGDQLTSIFVDHGFLRKGEADQVMETLGGKFGLNIIKVDAQKRFMDKLVGLSDPETKRKIIGNEFVYVFDDEANKLEGVDFLAQGTLYTDVIESGTDTAQTIKSHHNVGGLPEDMQFQLIEPLNTLFKDEVRALGTQLGMPDEIVWRQPFPGPGLAIRVLGDLTEEKLETVRESDAILREEIAAAGLERDVWQYFTVNIDVKSVGVMGDQRTYDYTLAIRAITSIDGMTADFAQLPWDLLQKISKRIVNEVDHVNRIVYDITSKPPATVEWQ

SEQ ID NO: 77800 - protein, 389 aa, marine gamma proteobacterium HTCC2143
MESGSITFAFFLIFSGAAVLASVALYTRQPILIAYIALGALIGPYGLGYVTDLNLLSDIAHFGIIFLLFLLGLDMQPQALIATMKKASWVAIFSSLAFFSIGYSVAWAFNFAHTEAIIIGAAMMLSSTIIGIKLLPTTVLHHRHMGEMMIGLLLIQDVIAIFVLLVLLSGDLGQFDYMILGKTVIALPIFIGISVLVVKYILLKLIKAFDRFHEYIFLLAIGWCLGMAEAAHLVGLSAEIGAFIAGISLATSPISQYIAINLKPLRDFFLVLFFFSLGARFDLSLLIDILLPAIVLATLILIFKPIIYYGLLRNVSERKPLAWDIGFRLGQISEFSLLIAYVAAGASLIGTEASHLIQATAIITFIVSSYIVIFNCMTPIAVSDRLRRD

SEQ ID NO: 77801 - protein, 328 aa, Oryza sativa
MDPPRCRNSGGFSGQSSRREKGQRSQRVTSSPRTPNPPEPSASRRRRRRRLGRGNPSVRSRPPSLAGHLRTPPPPPAPRLRPLRRRRPVRSRRRQAAMEDWDSEDFQPAVPSAKAEPLKSKWADEDVEEDDVKESWEEEEEEKPKPPPVEKTAPKPSGKGAAKKGKQQASTSSEVVQDEALDDPALEKLRQQRLVEEADFKSTTELFGKKDGSEKSLDTFIPKSESDFAEYAELIANKLRPYEKSFHYMGLLKNVMRLSMASLKGADAKDISSSIAAIANEKIKAEKEAAAGKKKQGAKKKQLHIENKDDDFIPGKGNFDDPDEYDFM

SEQ ID NO: 77802 - protein, 382 aa, Methanococcus maripaludis S2
MLVVRADYKKYPIPVLEKMRIDEDEFYKKYDACVVVQTCNRIEAYFDTEVNSDLNCILNDFSGFDILKGKNATFHFLKVSCGMDSMILGENQILGQIKTSFQKARELKKTSRYLDSVFLKAIHVGQRARTETKINEGSVSIGSAAVELAEKNFGLANKNVLLIGAGEIGTLVAKALMEKHIKAVIVANRTYERAETLAKELKGMAVHFDKLKEAINFSDVIICATSSPHYILKKEDLIDVGNKIIIDIANPRDVDDAVREFENINLYTIDDLRNISDKNLQKRIEEVPAVEKIIDEEYDVLMKQIEKINVEEVLKDFNNYIEEIRTKELEKAIKLSKTKNPEEIMENFSKAFAKRITHDFVSYSINTSKEDLMNSAWWKNGK

SEQ ID NO: 77803 - protein, 582 aa, Arabidopsis thaliana
  misc_feature (443)..(443): Xaa can be any naturally occurring amino acid
MTGLGVRSSSYGSLEKTGLNGVVLPIQITTTTRTKPSKMQKDREGIVHWICKFAGRKKVGMLLLFLISAVVFLRVLYVGKGEDSQEGQGPPSLHFNGSSGVNYSNMLQTNEELNMNIGNISFKAKEVIVFPPPPIHFLGYSLPQGHPCNSFTLPPPPADRKRTGPRPCPVCYLPVEGAVALMPNAPSFSPVLKNLTYIYEEPLNRETEFGGSDFGGYPTLKHRNDSFDIKETMSVHCGFVKGPQPGRNTGFDIDEADLLEMKQCRGIVVASAVFDAFDDVKAPQNISKYAEETVCFYMFVDEETESILKRERGLDGNKKVGIWRVVVVHNLPYSDGRRNGKVPKLLVHRMFPNARYSLWIDGKLELVVDPYQILERFLWRKNATFAISRHYKRFDVLVEAEANKAAGKYDNASIDFQVDFYKNEGLTPYSVAKLPITSDVPEXGCVILREHVPISNLFTCLWFNEVDRFTSRDQISFSTVRDKIAAKTNWTVSMFLDCERRNFVVQRYHRAEQERFARQRPPVPNFPPPPPSPPPPVLISSDLPRKMSSGRATPPRRRGRDRRSGQRGHRKANLPVRLPDSA

SEQ ID NO: 77804 - protein, 552 aa, marine gamma proteobacterium HTCC2143
MYIYNQYDQQLVDERVAQYRGQTERYLAGEISDDQFLPLRLQNGLYIQRLAPMLRVAIPYGTFNSQQMRKLAHISRHYDKGYGHFSTRQNIQLNWPQLEEVPDILAELAEVQMHAIQTSGNCIRNTTTDQFAGAAADELEDPRPYCEIVRKWSTFHPEFAFLPRKFKIAFCASKADRAAIQMHDIGIEVVHNASGETGFRILVGGGLGRTPVIGTEIIEFLPKQHLITYLEAILRVYNQLGRRDNKYKARIKILVRAMGIDAFRDKVEQQWALLKDGPSTLTEEEFERSKSYFHSPEYIEVDDSDADLKLQQQALQDPGFGNWLKRNVDAHQAPGYAIVTLSLKTTGYAPGDISDVQMEAVADMAEQFSFGEIRASHQQNLVLAHVRKEQLFALWEQAKTFGFATPNINYLTDMICCPGGDFCALANAKSLPVADAIQRKFDDIDYMYDLGEIDLNISGCMNACGHHHIGHIGILGVDKKGKEFYQISLGGSQDRDASLGKILGPSFSQAEVPDVIEKILNTYISLRIDGESFLDTYRRAGLAPYKESVYAK

SEQ ID NO: 77805 - protein, 101 aa, Rubrobacter xylanophilus DSM 9941
MQSGTPESGEAGLSESHRVTFKKSGVTIEVAEDEYILEKAEEAGLDLPYDCRSGTCTTCMQRCLEGEVDQDLAFAISEEELEEGYRLICIGSPLSDVVLDA

SEQ ID NO: 77806 - protein, 376 aa, Actinoplanes teichomyceticus
MSTGIAVAAVAATAGSASASPALAAAPPATVAAGYAHTCAIRTGGTLWCWGSNANGQLGDGTKTSRTTAVRVGDATTWAGVDAGTSHNCAVRTDGTLWCWGSNSRGQLGDGSTTDRTAPVRVGTATNWTTVSAGDRHTCAVRTDGTLWCWGFNRLGQLGDGAQVYVATTPLQVGTASTWASVTTGFAHTCGTRTDGTLWCWGDSSAGQLGLGILSYRTTPGQVGTATNWATVTAGYTFTCATRTDGTLWCFGENGYGQLGVTGTYQASPVQVGSVATWTGVAAGFDTACASRADGSLWCWGNNAAGQIGDGTTTHRYAPTRVGTATTWTAALAAGYHNCGFRTDDSLWCWGSNANGELGDGTTTARPAPQQVSLPA

SEQ ID NO: 77807 - protein, 461 aa, Aspergillus fumigatus
MASRLPFHRLSELHLRSIPRTAQCSRLPCIGARRSITSLALRRHKSGAVLLHAPFLGANLPRGSLARLGGYQIRNYADTIVKVPQMAESITEGTLKQFSKQVGDYVERDEEIATIETDKIDVSVNAPESGTIKELLVNEEDTVTVGQDLVKLELGGAPGPKEETATEKPKEPADVGKRPPLESNKPQPSEAPKASSPPPEQPPTAKPQPPAPKSDSPSDVKPSFEGREERRVKMNRMRLRIAERLKQSQNTAASLTTFNEVDMSSLMEFRKLYKDDVLKKTGVKLGFMSAFSRACVLAMKDVPAVNASIEGPNGGDTIVYRDYVDISVAVATEKGLVTPVVRNAETMDLVGIEKAIADLGKKARDNKLTIEDMAGGTFTISNGGVFGSLMGTPIINLPQTAVLGLHAIKDRPAVVNGKVEIRPMMYLALTYDHRLLDGREAVTFLVKVKEYIEDPRRMLLG

SEQ ID NO: 77808 - protein, 216 aa, Arabidopsis thaliana
MAPPIEVSTKSYVEKHVSLPTLNERILSSMSHRSVAAHPWHDLEIGPEAPIIFNCVVEIGKGSKVKYELDKTTGLIKVDRILYSSVVYPHNYGFIPRTLCEDSDPIDVLVIMQEPVIPACFLRAKAIGLMPMIDQGEKDDKIIAVCADDPEYRHYNDISELPPHRMAEIRRFFEDYKKNENKEVAVNDFLPATAAYDAVQHSMDLYADYVVENLRR

SEQ ID NO: 77809 - protein, 321 aa, Mycoplasma pulmonis UAB CTIP
MNKEKTIIFSMPNTHVLAQEICDELKMKLHSVNKTIFADGEVLLSSKETVRSKDVFIVASTSHPANNNIMDLLIFVDSLKRASAKTINVILSYYGYARQDRKAEGRQPIAAKLLADLLQVAGISRIVVVDLHNPSIQGFFNIPVDDIKAQYILSKEFTIKDEKFTIVSPDHGGTIRARIMAEIISNDVKIAIIDKRRVSTNKTEVLGVIGDINNENAVIVDDIIDTGGTIVNAAEVLKKNGAKKISIVASHGIFSKGFDIFEDADVIDEVIVTNSIDNYELAKKYKKLKIVSLAPFLSKVIRSIMDSKSVSDIYAKYLESK

SEQ ID NO: 77810 - protein, 200 aa, Helicobacter pylori 26695
MCGAWFFGARVFEFFTSLFESMKVLKLLPNFLTILRIVLSLFLLFLLLNTRTYFSFLTPFQTNMISSLVFLFAALTDLLDGYIARSYKAKSRFGEIFDPLADKILILSAFLGLVYLDRVNAWIPFVILGREFFISGLRVLAANEKKDIPVNALGKYKTVSQVVAIGALLADVTYSYALVAIAVFLTLYSGIDYTIKYYKS

SEQ ID NO: 77811 - protein, 519 aa, Helicobacter pylori 26695
MLLIVFFKFYFQYSIKKKSFYFIFVIIQAIFIFNLRRCRMDNQKITHQNITQKQGELKRDMKMRHLLMIAFGGAIGTGLFVGTGGNIASAGPLGTLIAYCFGGLVVYCIMLSLGELASVYPTTGSFGDYAAKFIGPGTGYMVFWMYWLGWVITVALEYIAIGMLMQRWFADIPIHYWVILCIALVFLLNFFSVKIFAEGEFFFSLIKVLAVIAFIGIGAIGIIYQIYSHGFGSIFDNFHFGDKGFFPNGSAAVFSAMLAVIFAFTGTEVIGVAVGETKNASEVMPKAIKATLWRIVFFFLGSVFVISVFLPMNDSSITQSPFVSVLERINLPFIGMGIPYVADIMNAVIITAMFSTANSGLYGASRMIYGLSKQKMFFKVFSQLNRQGTPTYAMFFSLSFSLIGLLVQIYAKENVVEALINVISFTVIIVWVSVSVSQYSFRKQYLKAGHSLEDLPYKAPFLPFLQLIGITGCAIGVIGSAMDKDQRIGMILTIVFAVICYIGYYFTQKANENNKKDLI

SEQ ID NO: 77812 - protein, 312 aa, Zea mays
  misc_feature (62)..(62): Xaa can be any naturally occurring amino acid
  misc_feature (75)..(75): Xaa can be any naturally occurring amino acid
MYGIAVAALGMLSTIATGLAIDAYGPISDNAGAEMAGMSHRIRERTDALDAAGNTTAAIGKXALVSLALFGAFVXSRAGVKVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATQGGLLFKIAAAVRIQSLGLPEPPEARFTVSLTTLTPCSST

SEQ ID NO: 77813 - protein, 406 aa, Helicobacter pylori 26695
MSLIRVNGEAFKLSLESLEEDPFETKETLETLIKQTSVVLLAAGESRRFSQTIKKQWLRSNHTPLWLSVYESFKEALDFKEIILVVSELDYIYIKRHYPEIKLVKGGASRQESVRNALKIIDSAYTLTSDVARGLANIEALKNLFLTLQQTSHYCIAPYLPCYDTAIYYNEALDREAIKLIQTPQLSHTKALQSALNQGDFKDESSAILQAFPDRVSYIEGSKDLHKLTTSGDLKHFTLFFNPAKDTFIGMGFDTHAFIKDKPMVLGGVVLDCEFGLKAHSDGDALLHAVIDAILGAIKGGDIGEWFPDNDPKYKNASSKELLKIVLDFSQSIGFELFEMGATIFSEIPKITPYKPAILENLSQLLGLEKSQISLKATTMEKMGFIGKQEGLLVQAHVSMRYKQKL

SEQ ID NO: 77814 - protein, 176 aa, Salmonella enterica subsp. enterica serovar Typhi str. CT18
MSLLNVPAGKELPEDIYVVIEIPANADPIKYEVDKESGALFVDRFMSTAMFYPCNYGYINHTLSLDGDPVDVLVPTPYPLQPGAVIRCRPVGVLKMTDESGEDAKLVAVPHTKLSKEYDHIKDVNDLPELLKAQITHFFEHYKDLEKGKWVKVDGWDNAEAAKAEIVASFERAAKK

SEQ ID NO: 77815 - protein, 332 aa, Salmonella enterica subsp. enterica serovar Typhi str. CT18
MKTLGEFIVEKQHEFSQATGELTALLSAIKLGAKIIHRDINKAGLVDILGASCAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLIYTTGCGVHAFTYDPSLGVFCLCQERMRFPEKGKTYSINEGNYIKFPNGVKKYIKFCQEEDSSTSRPYTSRYIGSLVADFHRNLLKGGIYLYPSTASHPQGKLRLLYECNPMAFLAEQAGGKASDGKERILDIIPESLHQRRSFFVGNRHMVDDVERFIREYPDA

SEQ ID NO: 77816 - protein, 489 aa, Novosphingobium aromaticivorans
MRCDMAICPSRSTGIGKFVCGASGNPLDPTRHAGEMAPRKDAGEVSATAPSSLRYQDTENTPMPIAIKMPALSPTMEEGTLAKWLVKVGDKVSSGDIMAEIETDKATMEFEAVDEGTIVSIDVAEGSEGVKVGTVIATLAGEDEDASAPAPKAVAPAAAPVPVPAPKAEPAPAAVSTPAPAAASASKGDRVIATPLAKRIAADKGIDLKGVAGSGPNGRIIRADVEGAKPAAAAPVSTVAPAVASAAAPARAPAAVPDFGIPYEAQKLNNVRKTIARRLTEAKQTIPHIYLTVDIRLDALLKLRGDLNKALEAQGVKLSVNDLIIKALAKALMQVPKCNVSFAGDELRSFKRADISVAVAAPSGLITPIIVDAGSKSVSAIATEMKALANKAREGKLQPHEYQGGTASLSNLGMFSIKNFDAVINPPQAMIMAVGAGEQRPYVIDGALGIATVMSATGSFDHRAIDGADGAELMQAFKNLIENPLGLVA

SEQ ID NO: 77817 - protein, 562 aa, Photobacterium sp. SKA34
MNNDKRPLYIPYAGPALLETPLLNKGSAFSVEERMYFNLEGLLPEAIESIEEQTERAYQQYLKFDNDMDKHIYLRNIQDTNETLFYRLVENHVTEMMPIIYTPTVGSACEDFSNIYRRGRGLFISYPNRDRIEDMLNNASRQNVKVIVVTDGERILGLGDQGIGGMGIPIGKLSLYTACGGISPAYTLPVVLDVGTNNPQRLSDPMYMGWRHSRITGKEYDAFVDEFIQAVKQRWPEALIQFEDFAQKNAMPLLERYKDKVCCFNDDIQGTAAVTVGSLLAACKAAGNKLSEQRVTFLGAGSAGCGIAEAIIAQMVSEGISDAQARSQVFMVDRWGLLIDGMPNLLNFQQALVQKNTQLADWDVADNNISLLDVMRNAKPTILIGVSGVPGLFSEEVIREMYAHCERPIIFPLSNPTSRVEATPFDIIRWTDGNALVATGSPFEPVVYEGKTYPIAQCNNSYIFPGIGLGVLAVNARRVTNEMLMESSQALAECSPLAIHGHGPLLPPLEEIQKVSRKIAFAVAKKAVEQHKAPKNSDERIREKIDANFWKSEYRRYKRTSF

SEQ ID NO: 77818 - protein, 406 aa, Streptomyces avermitilis MA-4680
MRTSRALAAGAAVALAVGLAAPTAAALSDPSNIVALSRVIARGGQLTITVEGSRCQVNGSTVSSPVFPTTRLSPAGHNSASARVTIDRNARPGSYGITARCGNGTGVVNGANGGPGNGVGNGNGNGLGNGFGNGFGNGFGNGFGNGLGNGFGNGFGNGFGNGFGNGFGNGNGVGNCNGFGNCNGVGNGNGFGNANGNGLGNGNGHGNGFGNGNGFGNGNGNGIGNGNGFGNGNGLGNGNGHGNGLGNGNGFGNGNGNGLGNGFGNGNGLGNGNGNGFGNGNGLGNGFGNGNGLGNGNGLGNGNGLGNGNGNGHGNGLGNGNGLGNGNGLGNGHGTGLGNGNGNGNNAQSLTRPNAFTVIGGVRGGLGGSSSIGATPTDMAIGGGLVAAAVIAGGFFWMRRRTENKS

SEQ ID NO: 77819 - protein, 536 aa, Oryza sativa Japonica Group
MDSSPSTQDCGGWLLYVSLAAKCGGDPCRVVGFVAVAVVAFAVTSLLHWLSPGGPAWGRYWWNRRGGLGIAAAIPGPRGLPVLGSMSLMAGLAHRKLAAAAGGSPARRRLMALSLGETRVVVTADPGVARELLASAAFANWPGEGVRVRDAVPPRHRHLFSPRQVSASAAQRAVIARQMVEAMRSAAAAAAGGGVAARPFLKRASLHNVMWSVFGRKYELAAPESEETAELRSMVDEGYDLLGQLNWSDHLPWLAPFDLKKTRSRCSSLVPRVNRFVTRIIDEHRARLSLAVDAAVDFTDVLLSLHGGDKLSDADMVAVLWEMIFRGTDTVAVLIEWVAARLVLHQDVQARVHDELDRVVGSDRAVTESDASKLVYLQAVIKEVLRLHPPGPLLSWARLATSDVHVGGFLIPSGTTAMVNMWAITHDPAVWPDPNEFKPERFVAGPSSDQATEFPIMGSDLRLAPFGSGRRSCPGKSLAIATVGFWVATLLHEFDWLPLSDKSRGVDLSEVLKLSCEMATPLEARLRPRRKVMSVE

SEQ ID NO: 77820 - protein, 406 aa, Novosphingobium aromaticivorans
MLNELRIPRMGSVENARLLNWRVQEGEAYEPGQVLYEIETDKTSVEVEAEGPGVLARHLAAVGDEFKVGDRIGLWALPGTAPATLRAALSPQPMRASERAPSPSSTLPAAVSAPGLHALRPVSRDAAGGRRVSPLARRLAAQNGVDLATVTGTGMGGKISGKDVLAASAKPRPAPVPVSPPRPGSDGEIVPHSLRRRTIAQRMVEAAAIPTLTADMEVDLTALFARRRSVEGNGASVLGMIAEAAIAALLQHRRLNAHWREDAMVQFGAVHLGIAVDTPEGLVVPVVRNAESLNARGLTDAIAALADKARAGTLRPQDMEGGTFTISNPGSMGPVVRAEALLNPPQVALLGLPGIVRAPVAIKDGDAWAMAVRPLLRLSLSFDHRALDGGPVIAFLNTLKATLERP

SEQ ID NO: 77821 - protein, 178 aa, Bordetella pertussis Tohama I
MSLDRVAPGKKLPDDFNVIIEIPMNADPVKYEVDKESGAIFVDRFMLTAMHYPCNYGYIPQTLSKDGDPADVLVLTPFPIQIGAVVRCRAIGVLEMDDESGGDAKLLAVPIEKLYPPYRNIKSYEDLPAEDVSRIQHFFEHYKDLEKGKWVKVKGWKGVDAAHEEIVRSAERYAKGQA

SEQ ID NO: 77822 - protein, 821 aa, Anabaena variabilis ATCC 29413
MVEIIIDPQTSNSVFKEQALVLPLNQVGIADIPLVGGKNASLGEMIQQLRRKGVKVPTGFATTANAYRYFITSAGLEAKLREIFADLDVEDVQNLRQRGKQARLLMLQTPFPQELQTAIAQAYATLCQEYGDDTDVAVRSSATAEDLPDASFAGQQETYLNVHGLQAVLESCHKCFASIFTDRAISYRQIKGFDHFNIALSVGVQKMVRSDLATSGVMFSIDTETGFKDAALITAAYGLGENVVQGAVNPDEYLVFKPTLKQGYRSIIEKRLGTKEIKMIYDLGGSKLTKNISVTPSERSVFALNDEDILQLAHWACIIEEHYSQVRGVYTPMDIEWAKDGLTNELFIVQARPETVQSQKVNNVLRNYRLSPAPIPNPQPLIPLITGRSVGEMIGQGKARVILDVHQISQFQAGEVLVTNRTDPDWEPIMKRASAIVTNSGGRTCHAAIIAREMGIPAIVGCGNATTFLKTGQEITVSCAEGETGKVYSGLIPYEVQEIPLEKLPSTHTKIMMNVGNPEEAFGLTSIPNDGVGLARMEFIINNHIKAHPLALIHFDELEDELAKYKIAELTAQYEDKTLFFVDKLAQGIATIAAAFYPKPVIVRLSDFKSNEYANLLGGKQFEPKEENPMIGWRGASRYYDPRYREGFALECQAMKRVRDEMGLTNVILMVPFCRTPNEGRRVLDEMIKHGLVQGENGLQVYVMCELPSNVQLADEFSQVFDGFSIGSNDLTQLTLGLDRDSELVAHLFDERDEAVKRMIAKAIATVKQYGRKIGICGQAPSDYPDFARFLVEQKIDSISLNPDSVLKTLLEIAAAEEKEL

SEQ ID NO: 77823 - protein, 506 aa, Oryza sativa
MAPPQTIPRRGLFIGGAWREPCLGRRLPVVNPATEATIGDIPAGTAEDVEIAVAAARDAFSRDGGRHWSRAPGAVRANFLRAIAAKIKDRKSELALLETLDSGKPLDEASGDMDDVAACFEYYADLAEALDGKQQSPISLPMENFKSYVLKEPIGVVGLITPWNYPLLMATWKVAPALAAGCTTILKPSELASVSCLELGAICMEIGLPPGVLNIITGLGPEAGAPLSSHSHVDKVAFTGSTETGKRIMISAAQMVKPVSLELGGKSPLIVFDDIGDIDKAVEWTMFGIFANAGQVCSATSRLLLHEKIAKKFLDRLVAWAKNIKVSDPLEEGCRLGSVISEGQYEKIKKFISTARSEGATILYGGGRPQHLRRGFFLEPTIITDVSTSMQIWQEEVFGPVICVKEFRTESEAVELANDTHYGLAGAVISNDQERCERISKALHSGIIWINCSQPCFVQAPWGGNKRSGFGRELGEWGLDNYLTVKQVTKYCSDEPWGWYQPPSKL

SEQ ID NO: 77824 - protein, 517 aa, Oryza sativa Japonica Group
MEVTSTPAMLLYAALFAAALLYLAVAVRRGRGAGLPPGPTGLPLVGSLLSLDPELHTYFAGLAARYGPIFSIRLGSKLGVVVTSPALAREVLRDHDLVFSNRDTPDAACSISYGGGQNIVWNPVGPTWRLLRRICVHEMIGPAGLDSLHGLRRREFMATLHHLRARSGEPVNVGAQMFLTVMNVVTGALWGGNVGSESERTTVGKEFRELVADITELLGAPNVSDFFPALAPLDIQGIRNKSDLLKDRFDDIFARIIQKRTESDHAAAAGETASDFLEYMLKLEKEGGDGKTAFTMTNVKALLMDMVIGGTETTSNTVEWGMAEMLQNRGTLRKVREELDAVVGRDGVVEESHLPKLHYLNLVVKETLRLHPALPLMVPHCPGEDATVGGHRVPAGARVFVNVWAIQRDPAVWKDPEHFIPERFLPADGGGGRRLDFTGSEQEYMPFGSGRRICAGVAMAERMVAYSLAMLVQAFDWELPAGERLDLAERFGIVMKKATPLVAVPTPRLSNPQLYSA

SEQ ID NO: 77825 - protein, 215 aa, Synechococcus sp. WH 5701
MPADALAQRLETLQEQLPPQARLLAVSKGQPAARLREAVALGLRSFGESRLQEAQAKQAELAELEPLDWHFIGRLQANKARGVLRHFGTIHSVDSLPLAERLQRIAAEEQLSPRVFFQVKLRPDPGKTGFEPRELEQCWPRLRALEPLVPVGLMTIAPLGLEADQRFGLFQDCAALAATLGLKELSMGMSSDWPEAVRAGSTWVRLGSALFGPRA

SEQ ID NO: 77826 - protein, 363 aa, Schizosaccharomyces pombe 972h-
MSKKPVLNLDTSNGFSEEYISHPERNDNQGIVEITDLVFSSESKLTQRKESRDSKTFVPSFLEELDDDHLHELVTNGGILYMNSLGEGVSGSVRKCRIRGTQMIFAMKTVLAAPNTALQKQLLRELKINRSCTSPYIVKYYGACYNNAECQLNIAMEYCGAGSLDAIYKRVRSQGGRTGERPLGKIAFGVLSGLSYLHDRKIIHRDIKPSNILLTSKGQVKLCDFGVSGELVNSLAGTFTGTSYYMAPERISGGSYTISSDIWSLGLTLMEVALNRFPFPPEGSPPPMPIELLSYIINMPPPLLPQEPGIKWSKSFQHFLCVCLDKDKTRRPGPQKMLTHPWVKAFERIHVDMEEFLRQVWSD

SEQ ID NO: 77827 - protein, 257 aa, Synechococcus sp. WH 5701
MARALLKPLLDQGVIARDQVQAVVASEDSARRLQAELGVAVGRDPAQAWAAPAVLLAVKPQLLSAVAAAAPPPHSGDEAPLLISVLAGVTLERLERSFPGWRCVRAVPNTPCLVGAGITGLAWGKDLPDEQRQWVLDLFARVGVVKELPESQLDGLLALASSGPALAAVLLEALADGGVASGLPRPLALELALGMMVGSVKVLQEQGLHPAQLKDMVASPAGTTIAALRQLEQAGVRSALIEAVLAAAERSRALNAG

SEQ ID NO: 77828 - protein, 340 aa, Vitis vinifera
  misc_feature (79)..(79): Xaa can be any naturally occurring amino acid
  misc_feature (100)..(100): Xaa can be any naturally occurring amino acid
MVDKFKKSSDSKRFRSRYGYYEKAVLTLAKAKKFSFIEDILEHQKQYNEISTEVFAVRLMTLYGKAGMFEHAHKLFDEXPKLNCERTVVSFNALLSVCVXSKKFDKIDGFFQELPGNLGVVPDVVSYNIIVNAFCEMGSLDSALSVLDEMEKVGLEPDLITFNTLLNAFYQNGSYADGEKIWDLMKKNNVAPNVRSYNAKLRGVISENRMSEAVELIDEMKTSGIKPDVFTLNSLMKGFCNAGNLEEAKRWYSEIARNELPPVRATYMTLIPFLVEKGDFDMATELCKEVCSRRWLIEPALLQQVLEGLVKESKIEEATELVELAKLKKFRITLELPSDK

SEQ ID NO: 77829 - protein, 383 aa, Vitis vinifera
  misc_feature (134)..(134): Xaa can be any naturally occurring amino acid
  misc_feature (141)..(141): Xaa can be any naturally occurring amino acid
  misc_feature (210)..(210): Xaa can be any naturally occurring amino acid
MSFLSRRLYRAFSTSTAATAQATGNLESVFKDIYRERNLKRLVQKFKKSSELDRFRTKTGIYEETVRRLASAKRFRWIEEILEEQKKYKDISREGFAVRLISLYGKSGMFDHAFKVFDEMPDQKCERSVLSFNXLLGACVXSKKFDKVEGFFSELPSKLSVEPDLVSYNIVIKGLCDMGSMDSAVGMLDEMEKKSLEPDLITFNTLLNRXYTSGRFLDGEKIWGRMEKKNILPDIRSYNAKLVGLVSSEKRMLEGIGLVEEMQTKGIKPDGYSFNALIKGFCNDGKVDEATNWYGKMRENDCSPDKLTFATLVPLYCEKGSFDQAFELCKEIFNRKCLVDEVLLQNAVDGLVKGGKVVEAKKLVQLGNSNSYRRYNLKIPTDK

SEQ ID NO: 77830 - protein, 572 aa, Magnaporthe grisea 70-15
MARHALALALASTCSLATALSTPQVLPRAAGPCAGNTATTRSQWCDFSIDTDYHNIVPDTGVTREYWLELAEIQAAPDGRERSGMAINGSIPGPTLFADWGDNVIVHVTNNLPASSNNGTSMHFHGIRQNYTNQNDGVTAITQCPTAPGSTVTYKWRATQYGSTWYHSHWALQAWHGMLGGLVINGPATQNYDEDLGMLFLNDWDLQTVDQLYHEAQTSGPPTLDQGLINGTNVFTSSDGTTTGHRWNTTLTAGKSYRIRLVNGAIDTHWKFSLDNHTLTVIGMDLVPIKPYTTNIVNIGMGQRYDLIVTADQASTADAFWMRAIPQSACSENDNANNIRGIVYYGQASDKVPTTTGYHYEDSCDDEDPANLVPHLAKDVGASTWADTETASVAFNEENLFRWYLNTTTMVVDWKNPTVKQVASGNTSVFEASNAVMVLDKPDEWIYLAIQNTLPVPHPIHLHGHDFQVLAQGIGEYQTGTTALNLVNPPRRDTALLPASGYVVLAFQTDNPGAWLMHCHIGWHTSEGFAMQFVERQSEMLALIDQEQLESSCAAWASYQTANKVAQEDSGI

SEQ ID NO: 77831 - protein, 233 aa, Zea mays
MAGDGELKLLGVWTSPFVIRVRVVLNLKSLPYEYVEENLGSKSALLLGSNPVHQSVPVLLHGGRPVNESQVIVQYIDEVWAGAGPSVLPADPYERATARFWAAYVDDKVGSAWTGMLFSCKTEEERAEAVSRAVAALETLEGAFAECSKGKAFFGGDAIGFVDVVLGGYLGWFGAIDKIIGRRLIDPARTPLLARWEEQFRAADAAKGVVPDDADKMLEFLPTVLAWVAAKAK

SEQ ID NO: 77832 - protein, 394 aa, Rubrobacter xylanophilus DSM 9941
MSGAAHRALGLATLAFALCFSVWGLIAPLAPRFQELYGLSDTQISLVIATPVLLGSLFRIPAGILADRFGGRRVFTGMLLFLVLPVVLIGFFGGSFYGLLFWGFLLGVAGSSFAVGVPFVSKWFPPERQGVALGVYGVGNIGSALAAYAAPAIAGAWGWRWAFWVFAVPLLAMAAVFWAVGRDAPGGGPPPSLAEGLRLFREELGPWVLSLFYFLTFGGFVALGIYLPKLLVDLFGLGQTDAGLRAAGFVVLATLARPVGGWLSDRVGGGPLLAVVFALLPLMALLLAFGGGMVSFTVGALSSAALLGVGNGAVFKLVAALYPGRTGVVTGLVGAAGGLGGFFPPLVMGVVRDLTGSYAPGFVLLALFAAGCFAVNAACMRRWKAQGQGRTEGV

SEQ ID NO: 77833 - protein, 187 aa, Brassica napus
  misc_feature (164)..(164): Xaa can be any naturally occurring amino acid
MELDSDNTLLKTGLVIVATLAISKLIFSFFTSQSRKKRHPPTLQAWLPLIGSLIRFLKGPVVMLRDEYPKLGSVFTVNLLHKKMTFLIGPEVSAHFFKAHDSVLSQQEVYKFNVPTFGPGVVFDVDYTVRQEQLRFFSEALRVNKLKAYVDMMITEAEGFFSNXGESGEVDLKEELDSLIILTASRC

SEQ ID NO: 77834 - protein, 148 aa, Thermoplasma acidophilum DSM 1728
MTERTLVLLKPDAVKRRLIGRIISRLEDKGLKVVALKFMQMTKDQAENHYSVHRSKPFFKDLVTYITSGPIVAMVLEGPKAIEVVRILAGSTDGSKAQPGTIRGDFSMGIEKNIIHASDSPEAYSHEMPIFFNESEIVEWSYGDEIIY

SEQ ID NO: 77835 - protein, 193 aa, Solanum peruvianum
FVFAGVGSAIAYGKLTTNAALDPSGLVAIAVCHGFALFVAVSISANISGGHVNPAVTCGLTFGGHITFITGSFYMLAQLTGAAVACFLLKFVTGGCAIPTHGVGAGVSILEGLVMEIIITFGLVYTVFATAADPKKGSLGTIAPIAIGLIVGANILAAGPFSGGSMNPARSFGPAMVSGNFEGFWIYWIGPLV

SEQ ID NO: 77836 - protein, 121 aa, Thermoplasma acidophilum DSM 1728
MEKSYVKFETPEDVSQKALDLVESSYRTGKVKKGTNEVIKSIERGESKLVVIAEDVNPPEVVYYLPSLCEDKKVPYVYVKKKADLGSKVGIASAASVSIVDYGKNEELYKSIVSALEQIKK

SEQ ID NO: 77837 - protein, 134 aa, Populus trichocarpa
MAGRGKTLGSGTAKKATSRSSKAGLQFPVGRIARFLKAGKYAERVGAGAPVYLAAVLEYLAAEVLELAGNAARDNKKTRIVPRHIQLAVRNDEELSKLLGDVTIANGGVMPNIHNLLLPKKTGGSSKASADDDS

SEQ ID NO: 77838 - protein, 219 aa, Physcomitrella patens subsp. patens
AKVAKTEARDLVHHVHVSFLKQKLEHDLRDTISYQELLELCRSVGMAPSDEDATRMVDVLNQAGVVLIFRDKVHLHPDKIVELVANVLPLSLLGEDDQRRMELSALAQKKEEIDKKAHKQMRMVLWSGLFGLTFQVLIFFRLTFWDLSWDVMEPIAFFTTATGIICGYAYFMFTSRDPSYQDLMQRIFQSRQQKLFKLQNFDYERFKELQMQCQTPITR

SEQ ID NO: 77839 - protein, 276 aa, Mesorhizobium loti MAFF303099
MPELITLNDGAAIPQLGLGVWQVDHGITADVVGWAIKAGYRLIDTAQGYQNEEGVGEAIRAADVARSELYITSKLRNGAHERDAALRAFDDTMEKLGIEQIDLFLIHWPVPSRDKYVEAWKTLIELKQAGRIKSIGVSNFNRDHLERIIGETGVVPVANQIELHPRFQQRELREFHAGHNIQTESWSPLGSGRLLGDPTIAGIAKKHGKSAAQTIIRWHLQQGLIVIPKSVRQDRIAANFDVFDFELDAQDLKTIAGMDSADGRDGPNPATAAFLF

SEQ ID NO: 77840 - protein, 352 aa, Thermus thermophilus
  misc_feature (185)..(185): Xaa can be any naturally occurring amino acid
MDWLLTPGPVRLHPKALEALARPQLHHRTEAAREVFLKARGLLREAFRTEGEVLILTGSGTLAMEALVKNLFAPGERVLVPVYGKFSERFYEIALEAGLVVERLDYPYGDTPRPEDVAKEGYAGLLLVHSETSTGALADLPALARAFKEKNPEGLVGADMVTSLLVGEVALEAMGVDAAASGSQXGLMCPPGLGFVALSPRALERLKPRGYYLDLARELKAQKEGESAWTPAINLVLAVAAVLEEVLPRLEEHLALKAWQNALLYGVGEEGGLRPVPKRFSPAVAAFYLPEGVPYARVKEAFAQRGAVIAGGQGPLKGKVFRLSLMGAYDRYEALGVAGMFREVLEEILPAS

SEQ ID NO: 77841 - protein, 379 aa, Arabidopsis thaliana
MSTTGQIIRCKAAVAWEAGKPLVIEEVEVAPPQKHEVRIKILFTSLCHTDVYFWEAKGQTPLFPRIFGHEAGGIVESVGEGVTDLQPGDHVLPIFTGECGDCRHCKSEESNMCDLLRINTERGGMIHDGESRFSINGKPIYHFLGTSTFSEYTLVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 77842 - protein, 467 aa, Bacillus pumilus SAFR-032
MEQAKDQSQQYQRKMTSRHLFMLSLGGVIGTGLFLSSGYTINQAGPAGTILAYLVGALIVYLVMLCLGELSVAMPVTGAFHTYATKYIGPGTGYTVAWLYWLTWTVALGSEFTAAGLLMQRWFPDTSVWMWSGVFALLIFLLNAFTVKFFAESEFWFSSIKVMAIILFIILGGAAMFGLIPLKGGEAAPFFSNFTGEGGLFPNGFLPILMTMLAVNFAFSGTELIGIAAGESVNPDETIPRAIRTTVLRLVLFFVGTIVVLAGLIPVEEAGVIKSPFVVVFDRIGIPYAADFMNFVILTAILSAANSGLYASSRMLWSLSEERTLPKKLAKLTSKGIPLNALILSMIGGILSLLSSVIAPETVYLVLVSISGLAVVIVWMGIAASQFMFRKRFLQEGGKLHDLSFRTPLYPVVPIAAFFLCLASVIGIAFDPNQRIALICGIPFIAICYAAYYVTAWIQKKREEPGV

SEQ ID NO: 77843 - protein, 242 aa, Leccinum scabrum
  misc_feature (46)..(46): Xaa can be any naturally occurring amino acid
  misc_feature (133)..(133): Xaa can be any naturally occurring amino acid
AVNDPFIDLEYMVYMFKYDSVHGRFKGDVHAKDGKLYINGKAITVXAERDPANIKWGGVGAEYVVESTGVFTTVEKAGAHLKGGAKKVIISAPSADAPMFVCGVNHDKYDPKYTVISNASCTTNCLAPLAKVXNDKFGIVEGLMSTIHATTATQKTVDGPSAKDWRGGRAVNGNIIPSSTGAAKAVGKVIPSLNGKLTGLAFRVPTNDVSVVDLVVRLEKSASYDEIKAAIKAASESPDLKG

SEQ ID NO: 77844 - protein, 386 aa, Bordetella pertussis Tohama I
MKIHEYQGKELLKQFGVTVPRGIPAFSVDEAVAAAEKLGGPVWVVKAQIHAGGRGKGGGVKLGRSIDEVRQLSSEILGMQLVTHQTGPQGQKVRRLLIEEGADIKKEYYVGIVTDRGTQRVCVMASSEGGMDIEEVAAHSPEKILKVFVDPAAGLTDAEAAELARGIGVPEASVGKAAAEFQKLYKAYWDTDASLAEINPLILTGSGDIIALDAKFNFDSNALFRHPEIVAYRDLDEEDPAEIEASKFDLAYIQLDGNIGCLVNGAGLAMATMDTIKLFGGEPANFLDVGGGATAEKVTEAFKIMLKNKSVKAILVNIFGGIMRCDVIAEGVITACKAVNLNVPLVVRMKGTNEELGKKMLAESGLPIISADTMAEAATKVVAAVK

SEQ ID NO: 77845 - protein, 187 aa, Synechococcus sp. RS9916
MAAMMPALRPPRHPSLDLKPLIRDIPDFPKPGILFRDITPLLRDPEGWRAVMNQMGAICERLQPDLIVGIESRGFIVGTALATDRKLGFVPVRKPGKLPGEILGIDYALEYGTDRLEIHADALQGGAKVLLVDDLLATGGTAAAAAQLISQAGGDLVGCSFVIELAALAGREKLPQATPVESLVIYS

SEQ ID NO: 77846 - protein, 387 aa, Pantoea agglomerans
MNPDNPLLALRDKISAVDKKLLTLLAERRLLAVEVAQAKLATHRPIRDVERERALLENLIVLGKAHNLDAHYITRLFQLVIEDSVLTQQALLQKNLNHPHAHAARIAFLGPKGSYSHLAARNYASRHFDSMVECGCLKFHDIIKQVENGVADYAVMPIENTSSGSINDVYDLLQQTSLSIVGELTLPIDHCVLVNGPTDLQQIETVYSHPQPFQQCSQFINRFPHWKIEYTESTAAAMEKVAALNSPKVAALGSEAGGELYQLQVLERNLANQQQNHTRFIVLARKAIEVSDQVPAKTTLIMATGQQAGALVDALLVLRQHNLIMSKLESRPINGNPWEEMFYIDVQGNLQSERMQQALQELQTMTRSLKVLGCYPSENVVPAEPGR

SEQ ID NO: 77847 - protein, 450 aa, Yarrowia lipolytica CLIB122
MASAIFFLDLKGKPLLSRNYRGDIPMSAVDKFPMLLLQAEEESPVVPPCFTHEGVNYLYITHNNLYLLALTKRNTNAAEILLFLHRVVQVLTEYFKGLEEESIRDNFVLIYELLDELMDYGFPQTTDTKILKEYITQKSHILEIAMEIAQVPKEQPRPPMAVTNAVSWRSEGIKYRKNEAFLDVVEAVNLLMSPSGQVLRSEVLGSVQMKCYLSGMPELRLGLNDKVLFDHVSNTGAGGGGSGGSARASRGKSIEMEDVKFHQCVRLSRFENDRTISFIPPDGQFELMSYRLNTTVKPLIWVDCKINKYSNTRIEILAKARGQFKKRSTANNVEIHIPVPEDADSPKLAATAGSIKWHPEKACVTWKIKQFGGGREFSMRAELGLPSVQDADEQAKSKRPIQVKFSIPYFTTSGIQVRYLKIVEPKLQYTSYPWVRYITTSGEDYTIRLA

SEQ ID NO: 77848 - protein, 273 aa, Leccinum scabrum
  misc_feature (133)..(151): Xaa can be any naturally occurring amino acid
AVNDPFIDLEYMVYMFKYDSVHGRFKGDVHAKDGKLYINGKAITVYAERDPANIKWGGVGAEYVVESTGVFTTVEKAGAHLKGGAKKVIISAPSADAPMFVCGVNLDKYDPKYTVISNASCTTNCLAPLAKVXXXXXXXXXXXXXXXXXXXATQKTVDGPSAKDWRGGRAVNGNIIPSSTGAAKAVGKVIPSLNGKLTGLAFRVPTNDVSVVDLVVRLEKSASYDEIKAAIKAASESPDLKGIIEYTDEALVSTDFTGHHASSIFDASGSIML

SEQ ID NO: 77849 - protein, 294 aa, Oryza sativa Japonica Group
MEQYEKEEKIGEGTYGVVYRARDKVTNETIALKKIRLEQEDEGVPSTAIREISLLKEMHHGNIVRLHDVIHSEKRIYLVFEYLDLDLKKFMDSCPEFAKNPTLIKSYLYQILRGVAYCHSHRVLHRDLKPQNLLIDRRTNALKLADFGLARAFGIPVRTFTHEVVTLWYRAPEILLGSRQYSTPVDMWSVGCIFAEMVNQKPLFPGDSEIDELFKIFRVLGTPNEQSWPGVSSLPDYKSAFPKWQAQDLATIVPTLDPAGLDLLSKMLRYEPNKRITARQALEHEYFKDLEMVQ

SEQ ID NO: 77850 - protein, 537 aa, Neurospora crassa
MTDNPEEPLIANTQSTERDQDDGSHDVEHAHDSRGGKQHISPPGLFIWLLTFSAGISGLLFGYDTGVISATLVSIGTSLSHRPLTSLDKSVITSCTSLFALLALPFASALADDRGRKRVVLFADTLFIIGALCQAASRTVEVMVIGRSVVGIAIGAASFVTPLYIAELAPATHRGRLVTMNIVFITLGQVVAYVVGWIFGTYGSPETTGWRWMVGLGAVPAVCQVVILLWMPESPRWLVKDGRSQEARAVIAKIAAGDDAQDPSTRREVDAVLKSIEIEVREEATAMRLGGAGAGYANGNAVNAWMEAMRELIRVRRNRRALAIACLLQGLQQLCGFNSLMYFSATIFTMVGFSEPTLTSLVVAVTNFAFTLVALVLIDRVGRRRILLWSLPFMIAGLVLAGYGFSFIELPNSETSSPSTTGGQGGAVIILASIMIYVAGYAIGLGNVPWMQSELFSLSVRSVGSGVATATNWSANFVIGLTFLPLMEALSPSWTFVLYAVICAVGYGLIWTVYPETAGLSLEDAATLLEADDWGVR

SEQ ID NO: 77851 - protein, 175 aa, Oryza sativa Japonica Group
MAPTVMASSATSVAPFQGLKSTAGLPVSRRSNSAGLGSVSNGGRISCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 77852 - protein, 518 aa, Silicibacter pomeroyi DSS-3
MSWQKEVDEINRRREIAKELGGAEAVKRQHDAGRLTVRERIDMLVDEGSFRELGALTGKATYDKDHNLVDVTPANAVIGRGTIDGRKVSIDGDDWTIRGGSSEATVSEKWIYAENYAEAMRMPLIRLVESAGGSVKILDQNAATKLPAYPTWNLARMMGTIPIVGLALGPCAGLGAIKAATAHYSVMVKGTSQVFAGGPPVVERGMGVKVDKEDLGGSKIHTRESGVMGNEARSEAEAFEMARRFLSYLPSSVYEMPPVIESDDPKERREEELIEIIPRDKRKVYKSRKILDMVFDRGSVFELTKGYGRSVVTCFARLGGRPVGVITTDPMQYGGGMTKASAAKMEAFIDLCDTFHLPIVHMVDQPGTIVGPEAERSGAVKGSVRVCMAIEQSQVPWCAIITRRCYGLAGSTFGRVQGINLHYAWPSGRWGSIPVDGGAEAAFKKELDALDPEARAARLAEIEGHFFHMESPFLTAEKFRIPDIIDPRDTRALLNDWLDDSWKLIADQLGPKGRTFRM

SEQ ID NO: 77853 - protein, 393 aa, Prochlorococcus marinus str. MIT 9515
MSEVNLSKRALSLEPSLTLQISAKAKKLSEEGKDICNLSAGEPDFDAPKEILNATSQAIFDGHTKYGPAAGDKELRKAIAKKLQIQNNLNVEFENVMVTNGAKQAIYNLFQVLLNDGDEVIIPAPYWLSYPQMVRLAGGKPIFLNSAPEDGFKINIQDLRSKISSKTKFIIINSPNNPTGRIMAKEELLQIAEVVREHKNINVLSDEIYELILKKEFRHLSLASLATDLKERIFIINGFAKGWAMTGWRVGYLVGKKEVIKASSALQSQSTSNVCSFVQRGALEALKINQEFFLKINSHYDLRREILYEGLRNIEGLVVHQPNGAFYAFPRLPNKSISSVDFCKKILNDYGLVIVPGKPFGDNQSFRISCATSKEKIIDGLSRLKKAVHNYYF

SEQ ID NO: 77854 - protein, 323 aa, Lactococcus lactis subsp. lactis
MAEFLTIGEPLVVLASQDMELSLDKASHFEKFLAGAELNVAVGISRLEHEAAYLSKVGDDPFGDFIIETSAKAGIDVNHLKKDSKYLTGFYLKELVSDGDPEVAYFRKNSAAANFAVPELEDVDLAGVKLAHLSGIFPALSSTSLETFKVFNAQLNEANILTVFDPNLRPALWESHEQMVDVTNELARGSQIILPGINEGELLMGSREPEKIADFYLKQSDLTHTVVVKLGADGAFVKTKNDKSFTVSGFKVKKVVDTVGAGDGFAVGLESALLEGWPIEDAVSRACAVGALAVRSHGDSEGYPTKEELIEFFNTDDRFGQCY

SEQ ID NO: 77855 - protein, 147 aa, Brassica napus
SIDQHFQSTPFEKNIPVILGLLSVWNVSFLGYPARAILPYSQALEKFAPHIQQVSMESNGKGVSIDGLPLPFETGEIDFGEPGTNGQHSFYQLIHQGRVIPCDFIGTVKSQQPVYLEGEVVSNHDELMSNFFAQPDALAYGKTPEQL

SEQ ID NO: 77856 - protein, 219 aa, Triticum aestivum
SAEIAAWCDADRSRTLLFHTFSNTGWLAYGAVLENLQSRADIVERIKGCIVDSAPVLEIRPEVWAAGFSAAMLKKSSSLTGPSADSPDGSTLNGALNKVTSVSELTKPSWGETFLLSTLQKFFEIVLHLPDVNRRMHKVLSVLSDKQPPCPQFYLYSSADRVIPAECVESFINMQRSLGLSVSAHNFVSSPHVDHYRSFPHLYSAKIDEFLKVCSLVSV

SEQ ID NO: 77857 - protein, 189 aa, Prochlorococcus marinus subsp. marinus str. CCMP1375
MESPSLIELTKIQRIYLLIASFVLACFLFLLRGGLGLNSEKSLNILALSSLQPEVALNNGHPTIFEFYADWCEACQEMAPSIKSIKEKYQDQIDIVLLNVDNEKWLDLIEKYEVNGIPQLNLFDQFGVIKGQSIGLKNIDQIDQIANSLLNNEQLPVFPGINNLDGKNIAISPLKEDIIVSKISPRSHS

SEQ ID NO: 77858 - protein, 644 aa, Staphylococcus aureus subsp. aureus COL
MLRGQEERKYSIRKYSIGVVSVLAATMFVVSSHEAQASEKTSTNAAAQKETLNQPGEQGNAITSHQMQSGKQLDDMHKENGKSGTVTEGKDTLQSSKHQSTQNSKTIRTQNDNQVKQDSERQGSKQSHQNNATNNTERQNDQVQNTHHAERNGSQSTTSQSNDVDKSQPSIPAQKVIPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMATTSRIIGHDAREEWRKNDGVVPVISSLHPSNQPFVNVTNDEPATRRGIWQVKPIIQGWD

SEQ ID NO: 77859 - protein, 188 aa, Rubrobacter xylanophilus DSM 9941
MTLANQLTLARLVAVVPLMIALYVPFPGNRTVALLLYVAAILTDYFDGIVARRSNKVTGFGKLMDSIADKALIVSVFFALVDLGLMASWMAAIMVIREFAVTGMRMVALEGGEVIAANRWGKAKMNAQSLAVFVLLLGHAGLWMPGLLVEAGWWLMVVAVILTLVSGWSYLKDTPRILSIQSRRDQRL

SEQ ID NO: 77860 - protein, 247 aa, Oryza sativa
  misc_feature (91)..(91): Xaa can be any naturally occurring amino acid
  misc_feature (106)..(106): Xaa can be any naturally occurring amino acid
  misc_feature (152)..(152): Xaa can be any naturally occurring amino acid
CCPESAYGGRAVSQSLEQRRESLVSCRDGPSVMASSATTVAPFQGLKSTAGMPVARRSGNSSFGNVSNGGRIRCMQVWPIEGGQKFENLSXLATVNVEELLKEIQXLLPVPVWCPWLEFSQGPICLTVKNHRFPRITTTGGYWDHCAKLPMXFGCTDATQVLKELEEAKKAYPDAFVRIIGFDNVRQVQIISFIAYKPPGCEESVGTNQQWEFNPRKVGTSFGIFPPFAVHQVPRLEYGRLLLLRSL

SEQ ID NO: 77861 - protein, 437 aa, Chlorobium tepidum TLS [sequence omitted]

SEQ ID NO: 77862 - protein, 129 aa, Glycine max
  misc_feature (17)..(17): Xaa can be any naturally occurring amino acid
SRHAYVSSEFGSSRPPXLANPTTGCQKMREIDDDLKLRAFWDKRISQEVLGDALGEEFKGYVFKITGGCDKQGFPMKHGVLTPGRVRLLLHRGTPCSRGYVTRNEEGIRTSSSLLLCRPHLLDMHLVVV

SEQ ID NO: 77863 - protein, 246 aa, Photobacterium sp. SKA34
MFSGELASGNPCGVLELDSWLSDEELQKITCEAGLPVTSFVMETNGQFHIRWFSLDGEINLCGHGSLGAGAAIISKYKLDSVLFNSKYGSVSIAKKSGVYTLELPSWKGKICVVPSEISDLTVDAIEVFSTRDLVLVLPSIESVRSFKPDDMRFKQLSKYHALIVTAANGENGYVLRYFAPKIGISEDLATGSAQCSLAPYWFDKLNSDSLQVHQLSSSGGYFGVRRISGDSIVLLANAKLREIAV

SEQ ID NO: 77864 - protein, 388 aa, Vibrio campbellii AND4
MNLHEYQAKQLFAEFGLPVPEGYACDTPQEAFEAAGRISTEKKVVKCQVHAGGRGKAGGVELHDTKDGVKEFAQKWLGKNLVTYQTDADGQPVTKILVEEASNIANELYLGAVVDRATRKVVFMASTEGGVEIEKVAEETPELIHKAAIDPLVGPQAYQGRELAFKLGLKGDQIKQFVKIFMGLGTMFSQYDLALLEINPLVITGEGNLLCLDGKINIDSNALYRQPKLREMHDPSQEDEREAHAAQWELNYVALDGNVGCMVNGAGLAMGTMDIVNLHGGKPANFLDVGGGATKERVAEAFKIILSDDNVKAVLVNIFGGIVRCDMIAEGIIGAVKEVGVTVPVVVRLEGTNADLGREVLANSDVDIIAAESLTDAAQKVVAAAEAK

SEQ ID NO: 77865 - protein, 377 aa, Bacillus pumilus SAFR-032
MRAVTYQGKNSIAVKKVDAPSIQDREDVIIRITSTAICGSDLHLYQGNFPLPIGYVIGHEPMGIVEEVGPDVTAVKKGDRVVIPFTVACGQCQYCHHHLESQCDNSNPHYDSGGLFGYSEKYGNYPGGQAEYLRVPFGNYTPFKIPDDCELEDEQLLFLSDVLPTAYWSVEHAGVKKGDTVIVLGCGPVGLMAQQFAWQKGAERVIAVDYIDYRLRHAKQMSGVEVFDFTEDPDMGETLKELTKGGADVVIDCVGMDGKKSPLEKIEQKLKLQGGTIGPIQIATKAVRKCGTVQMTGVYGGLYNMFPLGAFFARNVTLKMGQAPARGYMSKLYQKVTTGEIDPRAIITHQLPLDDAAHAYHIFNDKKDDCIKVILKP

SEQ ID NO: 77866 - protein, 402 aa, Vibrio campbellii AND4
MTIEILVPDLPESVADATVATWHKQPGDVVERDEVLVDIETDKVVLEVPAPEAGVLEAIIEEEGATVLSKQLIAKLKPGAVAGEPTTDSTEDKQASPDKRHKAALAEESNDSLSPAVRRLLAEHGLEASQVKGSGVGGRITREDIEVHLANAKSASKAEAPAVVEAPAAARSQKRVPMTRLRKTVANRLLEAKNNTAMLTTFNEVNMKPIMDLRKQYKDQFEERHGTRLGFMSFYVKAVTEALKRYPEVNASIDGDEIVYHNYFDISMAVSTPRGLVTPVLKDCDTLGFADIEKGIKELAIKGRDGKLTVDELMGGNFTITNGGVFGSLMSTPIINPPQSAILGMHKIQDRPMAVDGKVEILPMMYLALSYDHRLIDGRESVGFLVTIKELLEDPARLLLDV

SEQ ID NO: 77867 - protein, 712 aa, Anabaena variabilis ATCC 29413
MEPSSLVLALEQNSEVLGKEPLVPFAILLVILLVVPILFERLRLPGIVGLVLSGLVLGPSGWNLFHTKSPMISLLSDIGLVYLMFVAGLEVDLELWRRRQSRALGFGCVSFTVPLLIGTLVGRFFHFGWNTSVLIGSLLTSYSLLAYPIINRLGVISNQAVTITIGATLFTDISALIVLAICIPAFQMGMSNIYQILSVLVWLIVYSIVILVGFDWAGREFFRRSGDDEGNKFVFVLLTVFLAAVVAQMIGIEKILGAFLAGLAVNEAVGEGPVKEKIVFVGSVLFIPIFFINLGLLIDLPGLVNSLFTLQLTSLIVIGLIASKFIAAWLAKVFYGYSWQEMLTMWSLSMPQVGTTLAATFVGYHTGLLSSAVLTSVVILMLVTATLGPLITSRTARALTTVSMTASVDANLPEPQVIETQNGNFTIVVPIYNPHTQQYLVEMAAMLARQAQGRIIPLTIATAAAQMDAPQLESTLQRSERLLAKATSQSQALGVEASPLLRIDDASAPGISRAAREQKANLIVMGWGKRTGLRARLFGNVIDNVLWSSHCPVAVTRLVESPKKIQRILVPVENLITPTLQPVQFAQMLAEANQAQVTVLNVCDRRTSSSKIAWRRSQLALLVSKLALPNSPEVQIIAHENAAQAILQAARLYDLVVLPFIRNRTSPGGLALSDVTTQLASQLTCSIVMLGEPQRLQTGNITSVAPNTTTPV

SEQ ID NO: 77868 - protein, 99 aa, Robinia pseudoacacia
MASRQQNREELDEKARHGETVVPGGTGGKSLEAQEHLAEGRSRGGQTRKEQLGTEGYQEMGRKGGLSTMDKSGGERAEEEGADIDESKFRTGTNRNQNK

SEQ ID NO: 77869 - protein, 462 aa, Anabaena variabilis ATCC 29413
MRVCVIGTGYVGLVTGACLAHIGHDVICIDNNEEKVKIMKAGQSPIFEPGLSEIMQSAIQSGKIQFSTDLAAGVAHGEILFIAVGTPPLPTGESDTRYVEAVARGIGANLNGGYKVIVNKSTVPIGSGDWVRMIVLDGIAERQKTLVTAGGGSVEDKLPELPQFDVVSNPEFLREGSAVYDTFNPDRIVLGGNSPRAIALMQELYAPIVERKFAENQSLPPVPILATDLSSAEMIKYAANAFLATKISFINEVANICDRVGADVTQVAKGIGLDSRIGNKFLQAGIGWGGSCFPKDVAALIHTADDYGYEAQLLKSAVSVNERQRLIALEKLQQVLKILKGKTVGLLGLTFKPDTDDLRDAPALNLIEQLNRLGAKVKAYDPIVSQTGMRHGLSGVLVETDAERLADGCDALVLVTEWQQFSGLDYAKMAKLMNNPVVIDGRNFLDPETLVRAGFQYVGVGR

SEQ ID NO: 77870 - protein, 804 aa, Kluyveromyces lactis NRRL Y-1140
MATKSNSSNSKKKTGVSSGASEETKTKFKLPQQFIVRPIDNNADNGQGVIEINAEVMKYLELKNDNFCMISREGEKGIVGISRALKDDSSQTNVIKVGKALRSVGNLLLGERVELKKVSKQPEYLKSVSVGTVQHLQISPVPLSFVTEIENRFNQSGILMPGMIFRSLQLDEKTLVDLIIFDVNQSLEELPDTYEAVLPNVPRTSDNSLISPDSVNKSFSKLSLSEHAQDIDNNYLSSPGLFKMKATNVFVTAESEPSSKYGLPHPVLYNAVGGLKKETSILKSTVEFPLHQPQLFTDFGINPPRGILLHGPPGTGKTMLLRCVANETDAHILTISGPSIVSKYLGETEAALRDIFNEAKRYQPSIIFIDEIDSLAPNRANDDSGEVESRVVATLLTLMDGMDGSGRLAVVAATNRPNSIDPALRRPGRFDQEIEISIPDVEARHDILRKQFSRMSKQRQLLSPEDISNIASKTHGYVGADLIALCRESVMKTIQRGLNENIERDDLKVGINDVLEAMADIRPSAMREIFLETPKVYWDDIGGQEELKQKMKEMIQLPLEAAETFAKLGVSAPKGVLLYGPPGCSKTLTAKALATESGINFLAVKGPEIFNKYVGESERAIREIFRKARAASPSIIFFDEIDALSPDRDSGSGTSAANHVLTSLLNEIDGVEELKGVIIVAATNRPDEIDPALLRPGRLDRHIYVGPPSYDARLQILQKCTKKFNIDTAIVDLKALAECTDGCSGAEVVLLCQEAGLAAIMEDTTTDKVEQRHFTKALAGISRGITPEMLEYYSAFAARSGISK

SEQ ID NO: 77871 - protein, 865 aa, Ustilago maydis 521
MSGVCILPTPIREATADMSATYSSDRSGSAESSGSSMPGSHLPQQEPPSSGPNSRQSRRRSQSFDTTDSDSDSDEGQNVGPQPAATVGDDATSDDENDDDDADLGPPPPPATDAGSHDSSQSPSSDNRVPKRAHGLSEDTAQPLQKKRKAIALAHEATYLSNLPSADRYFKSLMHRDTVNSVTVTPRSNFVITTSIDGWVKFWKKSSLSSRASAESRPPSSSNSALSTSSLFSGSSVVEFVKQYRAHLAPIIAWSCSADGASYATLDAEANVKIFDVDNFDLINMIKLPFKARTLAWVHRQGSARSLLAITDEESNLIRIYDGRSAPDEHLQEAHLDTDDPRQSESDPATAGIKSIGTSHQPLFTVSKVHRAPVHILCFNAQHNVVVSCDVTGFVEYWTTEEPFSAPSTSKITGMFELKSTTDLFEFKKTKTVPTTLTISKDGERLAIFSISDRQIRIFDFRTAKIIRRYDESLEALQAAQALPPPEEASAVLEGKGENKGLLTNGAQVEVNFKVDQMEFGRRIALEREISASSAQGPLSGLANAASAALWNVLFDESGNFIIFASLQGIKFVNLVTNRCVRLLGKDESVRFMHLALFQGAPDKKLTSLAAAASENPLLAKQGLVDPTLFATAFGRARFYMFTRVDPDAMGASSGDGASGGGASENRDVFNERPTREEQTIASATAQAGSGLNRSGAGAADKNAAGGSVKNTKATLHTTHGDIHLTLYTELVPKTCKNFIGLAKKGYYDNVIFHRIIKKFMLQTGDPLGDGTGGESLWGGNFEDEFHPSLNHSRPFTLSMANAGPNTNGSQFFITTVPTPWLDRKHTVFGKVDAGIDVVKRIEQAKVDSNDKPRQDIRIINVSLR

SEQ ID NO: 77872 - protein, 383 aa, Colwellia psychrerythraea 34H
MATSAILVLEDGTVFKGTAIGAQGSAVGEVVFNTSMTGYQEILTDPSYAEQIITLTYPHIGNTGTNSEDKESNSIVAKGLVIRDLPLLASNFRNEQNLSDYLIAHNILGIADIDTRKLTRILREKGAQNGCILTLDDSSDESLQADALTQAKAFPGLKGMDLAKVVSTKEQYQWTDGSWELGKGFTKPDNLEFHVVAYDFGAKHNILRMLVDRGCKLTVVPAQTPASEVIAMNPDGIFLSNGPGDPEPCDYAISAIQSFLETEIPVFGICLGHQLLGLASGASTVKMKFGHHGANHPVKDFARDVVMITAQNHGFAVNEENLPSNLTVTHKSLFDDSLQGIHRTDKPAFSFQGHPEASPGPHDAAPLFDHFIDLIKTYKSNNA

SEQ ID NO: 77873 - protein, 82 aa, Glycine max
MKQSSLAAKRKRLLWTAEEEKVLKEGVSKFSTENQNIPWRKILEFGCRVFDETRTPVDLKDKWKNIISKKSRSTDCSYTFDL

SEQ ID NO: 77874 - protein, 639 aa, Kluyveromyces lactis NRRL Y-1140
MVSKLDAKQFKKHNRDTFINAVETLQDCLKPVTLVVQESILPILDSLFTFSQLKTATQIENVVKCDDEAANVLQSLKEDTTLIYLVDVRTELNINDIILNTINELQISKPNVISVTYNDRSEELGLVRDYLRELVRVPLTLVKWHVLPTESLDENILDCKLLLTSEGINMYYPSDPYFRSASINILLDNLSNVLLSILDKENITISKSLALGDNSRRLVDIVKQRMAIRDTAETQFIKNAKFGKLKSGERNDLIVFERSVDTITPMMADLTYSGILSEVDQISNVPKDGGIWDLLKFLNFGAVGSNLNTLAKDLQSQYESRHAANTISEIKNFVDNLGDLQNRQALLKQHTVQSSELMEYLKDTDFKDKIDFEHGVYADLLDYSTIVNTITEMMCFDKSELSILRLCCLFSQIKHGIREKEFNLLRQELVDTFGNEMIFKLNTLDRYRLFSKKHTDGLKNYQLICKSFDTIPDVDIEPTKPRDMNYAFSGVVPIVSRLLQSMFDRSVFVKNNNSILQSFIHSREPTLDKLEPLMKESQIPLDERHWVKTEGKIIGDVKDESDLTFLIFIGGITHGEISTINYLKEKLRAKKIRKEFIIITDGIITGNDIFSSSGIQTSKKKNVLTEQLGDTLISQNQGK

SEQ ID NO: 77875 - protein, 271 aa, Vitis vinifera
MASIIESGWLYLVTHFSDFQLASLGSFFIHESVFFLSGLPFIFLERAGWLGKYKIQRKMNSSAAQERCIMRLILYHFGVNLPVMIFSYPLFRYMGMQSSLPLPSWKVVLTQIIFYFILEDFVFYWGHRVLHTKWLYKHVHCVHHEYATPFGLTSEYAHPAEILFLGFATIVGPAITGPHLMTLWLWMVLRVLETVEAHCGYHFPWSLSNFLPLYGGADFHDYHHRLLYTKSGNYSSTFVYMDWIFGTDKGYRRLKALKSNEVEVEAGSKQI

SEQ ID NO: 77876 - protein, 335 aa, Zea mays
MAAHATLPFSCSSTLQTLTRTLSSRGAHQLRGGFLRLPSLAALPRLAHPCRRHVSASAAAAPNGASVEGEYDYDLFTIGAGSGGVRASRFASALYGSRVAICEMPFATIASDELGGLGGTCVLRGCVPKKLLVYASKYSHEFEESRGFGWTYETDPKHDWSTLIANKNTELQRLVGIYRNILNNAGVTLIEGRGKIVDPHTVSVNGKLYTAKHILVSVGGRPSMPDIPGIEHVIDSDAALDLPSKPEKIAIVGGGYIALEFAGIFNGLKSEVHVFIRQKKVLRGFDEEVRDFVAEQMSLRGITFHTEQSPQAITKSNDVPDVKGPLAELVRWYSS

SEQ ID NO: 77877 - protein, 193 aa, Streptococcus pyogenes M1 GAS
MGWWKESIAIVKALDPAARNSLEVILTYPGIKALAAHRLSHFLWRHHFKLLARMHSQFWRFWTQIEIHPGAQIAPGVFIDHGAGLVIGETAIVEKGVMLYHGVTLGGTGKDCGKRHPTVRQGALISAHAQVIGPIDIGANAKVGAAAVVLSDVPEDVTVVGVPAKIVRVHGQKDNRQIQSLQKQREVSYQLSK

SEQ ID NO: 77878 - protein, 789 aa, Oryza sativa
  misc_feature (458)..(458): Xaa can be any naturally occurring amino acid
  misc_feature (712)..(712): Xaa can be any naturally occurring amino acid
  misc_feature (741)..(741): Xaa can be any naturally occurring amino acid
  misc_feature (766)..(766): Xaa can be any naturally occurring amino acid
MGGARAQVNKPHKTRFASKASRHAHKIDKVRTGKPEGSHRAAVKGARAARVQRSKAIRDQKRAALLKEKRSSVGSSSAPRVVVLFGLSSSANVRSLAKDLLTIASGDEEKPTSSTVASPTYKLRTTVLEAPYGDLTSCMELAKVADLLAFVLSANSLYDCDSSSPIDDFGSQCLSVFRAMGLPSTAVFIRDLPSENKSRQELKKTAISFVSPELPEDCKFYAADTKDDLHKFMWLFKEQHLSCPHWRNQRPYVMSEEACIKPDDSSGLCTLLMSGYLRAHNLSVNQLVHLSGVGDFQLGQIDILKDPFPINERKNSNAMVSEDSGIQIVDTFVPDPSSQEPLLVENTPDPLEGEQTWPTEAEMEEAYLNNKQRKLKRKLPRGTSEYQAAWIVDDTDDEDGDSENDNQDGAGMVIDEQDHSDNGGDGSDMDVVSHARGKFDEETIGGTEMADDENLTKXEQIEAEIKKIKEANAEDEEFPDEVETPLDVPAKRRFAKYRGLKSFRTSSWDPKESLPQDYARIFAFDNFTRTQKHVLAKMAERDEGTLKDCAQRGSFVRLHLKNVPTEIASKLVHPSRRLPVVVSGLLQHESKISVLHFSIKKHDSYEAPIKSKDSLIFNVGFRQFTARPLFSTDNINCNKHKMERFLHHGRFSVASVYAPICFPPLPLIVLKSRDGEQPAIAAVGSLKSVDPDRIILKKIVLTGYPQRVSKLXKAVVRYMFYNPEDVKWFKPVELWTKHGRXRGRIKETVGTHGAMKCIFNSSVQPXHHTVCMSLYKRAYPKWPEQLYQI

SEQ ID NO: 77879 - protein, 193 aa, Solanum peruvianum
FVFAGVGSAIAYGKLTTNAALDPAGLVAIAVCHGFALFVAVSISANISGGHVNPAVTCGLTFGGHITFITGSFYMLAQLTGAAAACFLLKFVTGGCAIPTHGVGAGVSILEGLVMEIIITFGLVYTVFATAADPKKGSLGTIAPIAIGLIVGANILAAGPFSGGSMNPARSFGPAMVSGNFEGFWIYWIGPLV

SEQ ID NO: 77880 - protein, 468 aa, Haemophilus influenzae
MRRRFKKRGTVMSAGKIVQIIGAVIDVEFPQDAVPKVYDALKVESGLTLEVQQQLGGGVVRCIALGTSDGLKRGLKVENTNNPIQVPVGTKTLGRIMNVLGEPIDEQGAIGEEERWAIHRSAPSYEEQSNSTELLETGIKVIDLICPFAKGGKVGLFGGAGVGKTVNMMELIRNIAIEHSGYSVFAGVGERTREGNDFYHEMKDSNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPADDLTDPSPATTFAHLDSTVVLSRQIASLGIYPAVDPLDSTSRQLDPLVVGQEHYDVARGVQGILQRYKELKDIIAILGMDELSEEDKLVVARARKIERFLSQPFFVAEVFTGSPGKYVTLKDTIRGFKGILDGEYDHIPEQAFYMVGSIDEVLEKAKNM

SEQ ID NO: 77881 - protein, 311 aa, Pantoea agglomerans
VGTNTADEESSQIHAQGLVIRDLPLIASNFRSEEGLSAYLQRNNIVAIADIDTRKLTRLLREKGAQNGCIIAGDNPDAALALQKAQAFPGLKGMDLAKEVCTTETYSWQQGSWTLEGGLPEQADAESLPYHVVAYDYGAKRNILRMLVDRGCRLTVVPAQTPAEEVLKLNPDGIFLSNGPGDPEPCDYAISAIQAFLKTEIPVFGICLGHQLLALASGAKTVKMKLGHHGGNHPVKDLDNNRVMITAQNHGFAVDENNLPANLRVTHISLFDKTVQGIHRTDKPAFSFQGHPEASPGPGDAAPLFDHFIEL

SEQ ID NO: 77882 - protein, 386 aa, Ustilago maydis 521
MSHASPSVTAPISGPQSARVGQPPAPSASLVAKYRGATVEDLQVPPAISVPRSTSITSALRVALDHDYSQLPLVSDKNRKLLGYVQKDRLEEQVKGGSGDKSVATIMTKFSGGASPSSSSAGVAATYTVITPDTGLAELEVFLQSQPFAFITDPGRAFVLGVATQEDLSKYVSRRGLDGIRSGAATPTQATTSTTAATEVDNDEPMPSTSVGVPAGQASASSSSAAAATAAASSTQVSTQPVLTRREEEEARKDRTLAEFMQLLDGYTPLIPDQVTDFYLEKVGFECHDPRLKRLLSLAAEKFVSDIAADAFQYARIRTNAGPGGRPRGQVGAGAAGASGAAAGGATGGAAPAGARDRSRTVLTMDDLSAALGEYGINARRAEYFR

SEQ ID NO: 77883 - protein, 311 aa, Pantoea agglomerans
VGANAADEESSQIHAQGLVIRDLPLIASNFRSEEGLSAYLQRNNIVAIADIDTRKLTRLLREKGAQNGCIIAGDNPDAALALQKAQAFPGLKGMDLAKEVCTTETYSWQQGSWTLDAGLPEQATAESLPYNVVAYDYGAKRNILRMLVDRGCRLTVVPAQTPAEEVLKLNPDGIFLSNGPGDPEPCDYAISAIQAFLKTEIPVFGICLGHQLLALASGAKTVKMKLGHHGGNHPVKDLENNRVMITAQNHGFAVDENNLPANLRVTHISLFDKTVQGIHRTDKPAFSFQGHPEASPGPGDAAPLFDHFIEL

SEQ ID NO: 77884 - protein, 326 aa, Bacillus pumilus SAFR-032
MKTAISNNTQHACQSSVDQWAEEIRPYYKNGQNAGYIPALGKVNSSQLGISVIGPDGSSVRYGDWDVPFTLQSISKVISFIAACLGRGVPYVLDRVDVEPTGDAFNSIYRLEMHKPGKPFNPMINAGAITVSSILPGKTSTEKLAYIFDLIENLIGKRPSVNEEVYQSEWATAHRNRALAYYLKETNYLESDVEETLEVYLKQCSIEVTTEDIALIGLIISSDGYHPFKQVQVIPKDIARLTKALMLTCGMYNASGNFAAFVGVPAKSGVSGGIMACVPPSARREFPFQTGCGIGIYGPAIDDCGNSITGVMMLKKLAKEWDLSIF

SEQ ID NO: 77885 - protein, 334 aa, Salmonella enterica subsp. enterica serovar Typhi str. CT18
MVISLKNRNFLKLLDYTPAEIQHLIDLAIELKAAKKAGCEKQTLIGKNIALIFEKTSTRTRCAFEVAAFDQGAQVTYLGPSGSQIGHKESMKDTARVLGRMYDGIEYRGFGQHIVEELGEYAGVPVWNGLTDEFHPTQILADLMTMLEHAPGKTLPELSFAYLGDARNNMGNSLMVGAAKMGMDIRLIAPKSFWPDAALVAQCREIASVTGARITLTESVEDGVHGVDFLYTDVWVSMGEPKEAWAERVSLMTPYQVNQQVVNATGNPDVKFMHCLPAFHNEHTKVGREIEMAYGLKGLEVTEEVFESAGSMVFDEAENRMHTIKAVMVATLGD

SEQ ID NO: 77886 - protein, 144 aa, Brassica napus
KNLPLVGEVGFGADLVRIDAHSMCSPGFSCDSALQVTYIVAGSGRVQVVGADGKRVLETHIKAGSLFIVPRFFVVSKIADPEGMSWFSIVTTPDPIFTHLAGRTSVWKALSQEVLQAAFKVDPEVEQSFRSKRTSDAIFFPPSN

SEQ ID NO: 77887 - protein, 280 aa, Pantoea ananatis
RDLPLIASNYRSEESLSAYLQRNNIVAIADIDTRKLTRLLREKGAQNGCIIAGDNLDAALALQKAQAFPGLKGMDLAKEVTTAETYAWQQGSWTLEGDLPEQKQAEALPYHVVAYDYGAKRNILRMLVDRGCRLTVVPAKTPAETVLAMNPDGIFLSNGPGDPEPCDYAIEAIQAFLKTDIPVFGICLGHQLLALASGAKTVKMKLGHHGGNHPVKDLDNNRVMITAQNHGFAVDEANLPANLRVTHISLFDKTVQGIHRTDKPAFSFQGHPEASPGPGD

SEQ ID NO: 77888 - protein, 253 aa, Triticum aestivum
MADKENAAPAAAAGPRLTRAAAKRAATCSAGPSGGAKRKRVALSELPIVSNAGIVLRQPSKPAKPAAAAEGEEQHGGLSRCASTSPTPVGEEVSGGGGITQLSGSYASDIYTYLRTMEVEAPRRPAADYIEAVQTDVTANMRAILIDWLVEVAEEYKLVADTLYLTVSYVDRFLSANPLGRNRLQLLGVAAMLIASKYEEISPPHVEDFCYITDNTYTRQELLTMESDILKLLNFEIGSPTIKTFLRRFTRSG

SEQ ID NO: 77889 - protein, 276 aa, Pseudomonas syringae pv. syringae B728a
MSAEDPRFAGIARLYGIEGLARLRAAHVAVVGIGGVGSWAAEAMARSGVGEISLFDMDDVCVSNSNRQLHALSSTVGQSKVEVMAERIRAINPDCIVHAVADFVTRDTMAECITPDMDFVIDCIDSVNAKAALISWCKRRKIQMVTTGGAGGQIDPTLIQIADLNRTFNDPLASKVRSTLRRDYGFSRTPNRHYSVPCVFSTEQLRYPKPDGSICLEKKFVGEGVKLDCAGGFGAVMMVTATFGMVAATRAVDKLVAGTRRPSERIKPALVTPDQA

SEQ ID NO: 77890 - protein, 413 aa, Pseudomonas syringae pv. syringae B728a
MALNPPPHAGRTMPLFSPWRGDFPAIAALQRQGQTYLDNAATTQKPQALIDALTHYYANGAANVHRAQHLPGAHATQAFEASRGKAARWLNAGENGQIIFTHGATSALNLLAYGLEHEFAAGDEIAISALEHHANLLPWQQLAQRRGLKLVVLPLDIDGVIDCDAAANLIGPRTRLLAVTQLSNVLGTWQPLARLIALAKTQGAITVVDGSQGVVHGRHDVQALGCDFYVFSSHKLYGPEGLGVLYGCNEALPSLAHWQFGGEMVLTADYQHAKFRPAPLGFEAGTPPIASVIGLGATLAYLDSLDHQAVAEHEARLHRRLLEGLQQRNGIQVLGSPDLALVSFVVDDVHNADVAHLLTEQGIAVRAGHHCAMPLFKTLGLPGAIRVSLALYNDSDDLLQFFSALDQALELLR

SEQ ID NO: 77891 - protein, 334 aa, Salmonella enterica subsp. enterica serovar Typhi str. CT18
MSTFYQKPFLKLLDFTASELTALLQLAAKLKADKKNGKEEQKLVGKNIALIFEKDSTRTRCSFEVAAYDQGARVTYLGSSGSQIGHKESIKDTARVLGRMFDGIQYRGYGQEIVETLAEYSGVPVWNGLTDEYHPTQLLADLLTMQEHLPGKAFNEMTLVYAGDARNNMGNSMLEAAALTGLDLRLVAPKACWPQAALVAECSAMAKKNGGAITLTEDIASGVKGADFIYTDVWVSMGEPKEKWAERIALLRDYQVNSQMMALTGNPQVKFLHCLPAFHDDETTLGKKMAEEYGLHGGMEVTDEVFESAASIAFDEAENRMHTIKAVMVATLSK

SEQ ID NO: 77892 - protein, 201 aa, Triticum aestivum
MQNPGGNHPAPAAAAAGKFKSSAQGAVVASGHGHQPSPATPAAAKSRSSGHCHHSSPSMPVVGKSKPSAHAVAPGQASTSHQPHPVGGADAAASSLKRKRGVFQKDLQHMMYGFGDDPNPLPETVALVEDIVVEYVTDLVHKAQNVASKRGKLLTEDFLYLIRKDMRKLHRATELLSMNEELKQARKAFDVNEETLVVTNE

SEQ ID NO: 77893 - protein, 270 aa, Pseudomonas aeruginosa PAO1
MQVDEQRFGGIGRLYGREGLQRLADSHVAVVGIGGVGSWAAEALARSGVGEISLFDLDDVCVTNTNRQVHAIEGSVGKAKVEVMAARILAINPACRVHAVADFVTRETMAEYIVDFDYLIDCIDSVAAKAALIAWCKRRKIPVITTGGAGGQVDPTQIQVADLNKTFNDPLAAKVRSTLRRDYNFSRTPGRTYSVPCVFSSEQLRYPKPDGTVCQSKSFVGEGVKLDCAGGFGAVMMVTATFGMVAAARAVERLAEGRALRPSRRTPGNA

SEQ ID NO: 77894 - protein, 397 aa, Pseudomonas syringae pv. syringae B728a
MNNAMQLLQPYPFEKLRALLAGVTPNPEKRPVALSIGEPKHRSPDFVAKALADNLDQMAVYPTTLGIPALREAIAGWCSRRFGVPQGWIDPARNVLPVNGTREALFAFTQTVVNRSDDGLVISPNPFYQIYEGAAFLAGAQPHYLPCLSDNGFNPDFDAVSPDIWKRCQILFLCSPGNPTGALIPVETLKKLIALADEHDFVIAADECYSELYFDEQTPPPGLLSACVELGREDFKRCVVFHSLSKRSNLPGLRSGFVAGDAQILKAFLLYRTYHGCAMPVQTQLASIAAWNDEEHVRANRDLYREKFAAVLDILTPVLDVQRPDGGFYLWPNVGTDDAAFCRDLFVDQHVTAVPGSYLSREVDGVNPGAGRVRLALVAPLAECIEAAERIRAFLSK

SEQ ID NO: 77895 - protein, 136 aa, Bacillus sp. SG-1
MAAVAAIYPVFQSLNAEVLAISTDSVYAHKVFTEVSPSLSKVAYPLVSDRTHEISRSYRVLNEKTGAALRATIIIDPEGVIASRLVNPLEVGRNVYEILRLLQALQYSRETGELVPANWVPGNPGISRQSKLFGKI

SEQ ID NO: 77896 - protein, 529 aa, Arabidopsis thaliana
MSIGLTECVTNKLAAEHPQVIPISVFIAILCLCLVIGHLLEENRWVNESITAILVGAASGTVILLISKGKSSHILVFDEELFFIYLLPPIIFNAGFQVKKKKFFHNFLTIMSFGVIGVFISTVIISFGTWWLFPKLGFKGLSARDYLAIGTIFSSTDTVCTLQILHQDETPLLYSLVFGEGVVNDATSVVLFNAVQKIQFESLTGWTALQVFGNFLYLFSTSTLLGIGVGLITSFVLKTLYFGRHSTTRELAIMVLMAYLSYMLAELFSLSGILTVFFCGVLMSHYASYNVTESSRITSRHVFAMLSFIAETFIFLYVGTDALDFTKWKTSSLSFGGTLGVSGVITALVLLGRAAFVFPLSVLTNFMNRHTERNESITFKHQVIIWWAGLMRGAVSIALAFKQFTYSGVTLDPVNAAMVTNTTIVVLFTTLVFGFLTKPLVNYLLPQDASHNTGNRGKRTEPGSPKEDATLPLLSFDESASTNFNRAKDSISLLMEQPVYTIHRYWRKFDDTYMRPIFGGPRRENQPEC

SEQ ID NO: 77897 - protein, 520 aa, Wolbachia endosymbiont strain TRS of Brugia malayi
MSAIAIIDFGSQFTQLIARQIREMDVYCEIFPSNISFETISKFNGFILSGGPQSVHDGCSEASGVAHEIIKFNEATNVPILGICYGQQLICHYFGAKVKKEFKQEFCKTKIKILKESSIVKDVWNVNSEVDVLMNHADSVETAPQGFTVIASGVINQTIAIVANEQRRIYCTQFHPEVKPTANGSKLLSNFLDIANCKRDWTMKSIIEKQKEKIKNVVGEKKVIAAVSGGVDSSVAVALTYKAVGKQLNCIFIDTGLLRKNQTIALLEEIPVNYVDKSNLFLSRLKGITDPEEKRKIIGNTFIEVFEEEAKKIGNADFLMQGTIYSDVVESGHASGNASTIKSHHNVGGLPEKMNLKLVEPLRYLFKDEVRLLGKEIGLSNEIIFQHPFPGPGLAVRVIGEVDEERVRILQEIDEIYINTMKNYDLYDKIWQAFAVLLPIRTVGVMGDGRTYGYVCALRAVTSFDGMTADAFPFENKSQHSLIFWDFLQNVSSIIVNNVSGVNRVVYDLTSKPPATIEWE

SEQ ID NO: 77898 - protein, 788 aa, Physcomitrella patens subsp. patens
MLRAVGKKVRRVLREELLAGLQGRGLGRIYDASGTGVRKHGWGISSRETHTNSLYIHHTIGGVGRDSVAVTVGLLHSLERLQPGIGYFRPIDQTTIGGYRSKLIKSVFKMKDDPAIMQGVTQDRAYELVTNDKIDDLLEEVLKAYEACRVKHDFVVVEGTSLRGGGDDTVTLNAKIAQTLGSSALLVTDAGIACGKMDKMKNWDGFDWEKRVVNNAKLSDLVFRREHVDVVGAIVHRTPQTERKDKLLRKVFEEMKIPFVGALPEDSVLRSVQVQDVAKKLEAGLLYPVEDEEVAMSTEVTQYLVATEQLSDLLRHLPRYVDPTKGSIVITSANRVDILLGLIHLHESKSNANIAAVVLSGGKPPPREVHELLKARNSGTLPIILSPQMTFETASALANVEGYISSKTPLKVERAQTLFDDNINMKLIKDAMFQERPVRMNSKLFQHNLFTRAKQCIQTIVLPEGEEPRTLQAAGTVLRRGLCNLILLGDREKIETLAKQFRVDISQARIVDPRDCPETEKYARYFYESRKHKGITLGQAHNILIGDVNYFGTCMVAEGAADGMVSGAVHTTANTVRPALQLIKTLPGIPVVSSVFFMCLPGKVLVYGDCAINSDPTSEELAAIAIASADTAAAFGIKPRVAMLSYATGDSNKGPLIQKVIDATAIARKLRPDLLIEGPLQYDAAVDPVIAKTKMKGAESEVAGKASVLIFPDLNTGNNTYKAVQQTTGAVAMGPLLQGLRKPVNDLSRGCTVPDIVTTIALTAVQAAAMKETAKRETPKENLVASAA

SEQ ID NO: 77899 - protein, 454 aa, Coccidioides immitis RS
MTLERTSTNQSRRSKRSHHSHSNSETHSRSHNSIRRTRTNQSLNGKETPDHLQGHLNHLTPDQERALEEFKAVCVEKGLYTPAEEGKAASHEDPTLLRFLRARKFDVNGALDQFKATEEWRKANQIDALYENFDVDSYENARRVYPQWTGRRDRRGIPVYVFVIKHLNSKNMAAYSSGAASTATSSTHTSSTVPSRLLRLFALYENMTRFVVPLCSSLPRPNPETPISSTTNIVDISGVGLKQFWNLKGHMQDASVLATAHYPETLDRIFIIGAPSFFPTVWGWIKRWFDPVTTSKIFILSSSEVKSTLTSFMDPSSFPKQYGGELDWEWGDMPNLDEPAQELVGALEELGPKGDGEISTESSNKTVEERKRNFVKGPVAWLKDRIEIFGSIGGQKRRKTIPVQGEQKPSESDQAVVSEANGVVIEVTPAATTEGEEKLVTTPEAQVNGTTVSS

SEQ ID NO: 77900 - protein, 525 aa, Arabidopsis thaliana
MSSELQISPAIHDPQGQEKQQQAAGVGILLQIMMLVLSFVLGHVLRRHKFYYLPEASASLLIGLIVGGLANISNTETSIRTWFNFHDEFFFLFLLPPIIFQSGFSLQPKPFFSNFGAIVTFSVLGTFVASMVTGLLVYLGGVMFLMYRLPFVECLMFGSLISATDPVTVLSIFQELGSDVNLYALVFGESVLNDAMAISLYRTMSLVRSHSSGQNFFMVIVRFLETFVGSMSAGVGVGFTSALLFKYAGLDVDNLQNLECCLFVLFPYFSYMLAEGLSLSGIVSILFTGIVMKHYTYSNLSANSQRFVSAFFHLISSLAETFVFIYMGFDIAMEKHSWSHLGFIFFSILFIVIARAANVFGCGYLVNLARPAHRKIPMTHQKALWYSGLRGAMAFALALQSVHDLPEGHGQTIFTATTAIVVLTVLLIGGSTGTMLEALEVVGDSHDTSLGDGFEVVNSRYMTSYDDEDTPPGSGFRTKLREFHKSAASFTELDRNYLTPFFTSNNGDYDDEGNMEQHHGNNIIL

SEQ ID NO: 77901 - protein, 1664 aa, Clostridium thermocellum
MKRKNKVLSILLTLLLIISTTSVNMSFAEATPSIEMVLDKTEVHVGDVITATIKVNNIRKLAGYQLNIKFDPEVLQPVDPATGEEFTDKSMPVNRVLLTNSKYGPTPVAGNDIKSGIINFATGYNNLTAYKSSGIDEHTGIIGEIGFKVLKKQNTSIRFEDTLSMPGAISGTSLFDWDAETITGYEVIQPDLIVVEAEPLKDASVALELDKTKVKVGDIITATIKIENMKNFAGYQLNIKYDPTMLEAIELETGSAIAKRTWPVTGGTVLQSDNYGKTTAVANDVGAGIINFAEAYSNLTKYRETGVAEETGIIGKIGFRVLKAGSTAIRFEDTTAMPGAIEGTYMFDWYGENIKGYSVVQPGEIVAEGEEPGEEPTEEPVPTETPVDPTPTVTEEPVPSELPDSYVIMELDKTKVKVGDIITATIKIENMKNFAGYQLNIKYDPTMLEAIELETGSAIAKRTWPVTGGTVLQSDNYGKTTAVANDVGAGIINFAEAYSNLTKYRETGVAEETGIIGKIGFRVLKAGSTAIRFEDTTAMPGAIEGTYMFDWYGENIKGYSVVQPGEIVAEGEEPTEEPVPTETPVDPTPTVTEEPVPSELPDSYVIMELDKTKVKEGDVIIATIRVNNIKNLAGYQIGIKYDPKVLEAFNIETGDPIDEGTWPAVGGTILKNRDYLPTGVAINNVSKGILNFAAYYVYFDDYREEGKSEDTGIIGNIGFRVLKAEDTTIRFEELESMPGSIDGTYMLDWYLNRISGYVVIQPAPIKAASDEPIPTDTPSDEPTPSDEPTPSDEPTPSDEPTPSDEPTPSETPEEPIPTDTPSDEPTPSDEPTPSDEPTPSDEPTPSDEPTPSETPEEPIPTDTPSDEPTPSDEPTPSDEPTPSDEPTPSDEPTPSETPEEPIPTDTPSDEPTPSDEPTPSDEPTPSDEPTPSDEPTPSETPEEPIPTDTPSDEPTPSDEPTPSDEPTPSDEPTPSDEPTPSDEPTPSDEPTPSETPEEPIPTDTPSDEPTPSDEPTPSDEPTPSDEPTPSDEPTPSDEPTPSDEPTPSETPEEPIPTDTPSDEPTPSDEPTPSDEPTPSDEPTPSDEPTPSETPEEPIPTDTPSDEPTPSDEPTPSDEPTPSDEPTPSDEPTPSETPEEPIPTDTPSDEPTPSDEPTPSDEPTPSDEPTPSDEPTPSETPEEPIPTDTPSDEPTPSDEPTPSDEPTPSDEPTPSDEPTPSETPEEPIPTDTPSDEPTPSDEPTPSDEPTPSDEPTPSDEPTPSETPEEPIPTDTPSDEPTPSDEPTPSDEPTPSDEPTPSDEPTPSDEPTPSDEPTPSETPEEPIPTDTPSDEPTPSDEPTPSDEPTPSDEPTPSDEPTPSDEPTPSDEPTPSETPEEPTPTTTPTPTPSTTPTSGSGGSGGSGGGGGGGGGTVPTSPTPTPTSKPTSTPAPTEIEEPTPSDVPGAIGGEHRAYLRGYPDGSFRPERNITRAEAAVIFAKLLGADESYGAQSASPYSDLADTHWAAWAIKFATSQGLFKGYPDGTFKPDQNITRAEFATVVLHFLTKVKGQEIMSKLATIDISNPKFDDCVGHWAQEFIEKLTSLGYISGYPDGTFKPQNYIKRSESVALINRALERGPLNGAPKLFPDVNESYWAFGDIMDGALDHSYIIEDEKEKFVKLLED

SEQ ID NO: 77902 - protein, 462 aa, Chromobacterium violaceum ATCC 12472
MPAGWEARANTADRGFMDSALIINQWLDEHHITEVECLIPDMTGLARGKIVPRHKYDPAVGLRLPEAVLSMTVTGDYPDRDFTSVADPDMKLLPDLSTLRPVPWNKEPTAQIIHDCYSFAGDAVDLAPRNVLKRILKLYEDQGWKPVIAPEMEFYLVEIQPDEDLPLRPPVGRTRRTEAGMQSFSIDAVNEYDDIFDVMYDWCEAQGLALDTLIHEMGTAQMEINLDHGDPLQLADQVFLFKRTVREVAIRNNMYATFMAKPMQGQPGSAMHMHQSVVDIASGGNIFSLDDGQPSEAFLHFIGGLQRYLPAAMPFFAPYVNSYRRLSRYTSAPINLSWGYDNRTCGLRVPHSDPEARRVENRLAGVDVNPYLAMAASLACGYLGMRDRIDPSEPLSGSAYEQPHQLPRHLDDAIDMLLRCRPLSELFGEHFIETYAAIKEAEYREYFDVISPWERRFLLLHV

SEQ ID NO: 77903 - protein, 453 aa, Actinoplanes teichomyceticus
MSFEAPPSSLGGHALLAFLIAVATLLLVAHLLARLAERVRMPAVVGELATGVILGPSLLGHLLPGLTDWVFPPGTDQMHLLDAVGQIGILLLVGLTGTHLDVAMVRRRKATAARISLGGLLLPLALGVGVGYQLAGWLSGAVVGDRLVFAGFMGVAMCVTAIPVIAKTLSDMRLLHRDVGQMTLAAGTIDDAVGWFLLSVVSMAATAGLTTGHVVQAVAYLLGFVVLAVLLGRPLVRRVMRLADRGEGSGSSIVTAVVVVLTGAAITQALGMEPVFGAFVAGILVGLPAAANQAKLAALRTVVLSVLAPLFLATAGFRMDLTALADPQVAIAAVLVLAIAIVGKFAGAYAGARLSRLSRWEGLAIGAGMNSRGVVEVVVALTGLRLGVLNTATYTIVVLVAIVTSVMAPPLLRYACARIAQNEDERLRKLHHDTWNGVPAGAGQSPSPAGEQA

SEQ ID NO: 77904 - protein, 193 aa, Solanum peruvianum
FVFAGVGSAIAYGKLTTNAALDPAGLVAIAVCHGFALFVAVSISANISGGHVNPAVTCGLTFGGHITFITGSFYMLAQLTGAAVACFLLKFVTGGCAIPTHGVGAGVSILEGLVMEIIITFGLVYTVFATAADPKKGSLGTIAPIAIGLIVGANILAAGPFSGGSMNPARSFGPAMVSGNFEGFWIYWIGPLI

SEQ ID NO: 77905 - protein, 101 aa, Oryza sativa
LKSCNALLLKVNQIGTITEAIQAAKDAFGAGWGVMVSHRSGETEDVTIADIVVGLRAGQIKTGAPARSERLAKLNQILRIEEELGDNAIYAGQNFRTAINL

SEQ ID NO: 77906 - protein, 384 aa, Methanococcus maripaludis S2
MDEQDILNELREYRNQDLKYEEGYILGSMCTKPHPMARKISEMFFETNLGDPGLFKGTSKLEKEVVSMIGGILHNKNAFGYLISGGTEANLTAMRAFKNISKSKGKPQNIIIPETAHFSFDKAKDMMDLNVVRPPLTKYFTMDVKFIKDYIEDSKNEVSGIVGIAGCTELGSIDNICELSKIAVENDILLHVDAAFGGFVIPFLDDKYKLDGYNYDFDFSLNGVSSITIDPHKMGLAPISAGGILFRDNMFKKYLDVDAPYLTEKQQATIIGTRSGVGVASTWGIMKLLGIDGYETLVNESMEKTMYLVKKAREYGFETAIDPVMNIVALNDENKHDTCMKLRDENWYVSVCRCVDALRIVVMPHLEIEHIDGFLESLSNTKKY

SEQ ID NO: 77907 - protein, 410 aa, Alkaliphilus metalliredigens QYMF
MSNPFQTALSTLKAASEVAGLEPNVVKMLSQPKRIFEFTIPMKMDNGDLEIFTAYRVHYNDALGQTKNGIRFVPNLDLDTVKALGFWMTVKHAVSGIPAGGGKGGIRVDPKKLSEGELERLTRSYIRKLPMKGAWVDIPGADIGTSAKTQGWMLDEYEEIMGFHSPAAINDKPAELNGTVGSMEATGTGAFFVTMEAVKDLSIPKGSTVVIQGFGNVGRIAGRLLHQEGYVVIAVSDISGGIYNPQGLDVEKLEAYVDETGSIKDFPGTTVVSNEALLQLECDILMPSAVQSVITEQNAHNIKTKLIMECANGPTTPAGEAILEKRGIIIVPDVLTNSGSAIVCSFERTQGLTDTYWDIETVNSKLKERIVKAYKETTTTAKDKNTSLRNAAWVNGLTKVAKAMKARGWV

SEQ ID NO: 77908 - protein, 174 aa, Vitis vinifera
MQQRKSASSFGRPSGTDGSDFSYRMVVDSRYTKVAKGKSRLHVLIIAQAIIHLIGGLSRFLLSTSKEGPDKLAIATVALGFISLVIGELGQRRSRENFLRLYMITSSIAFLLSTAFVVQKNSLIEVLQDMSGGEMKLFELLEIGYVVLGFLLQISTISTIITLIWNMSPPKKAS

SEQ ID NO: 77909 - protein, 404 aa, Methanococcus maripaludis S2
MIQKCRVCGKEYDVDAIIYNCECGGLLEIKYDFESIKEKVSKESLRERELGVWRYLDYLPVKDPAKIVSLHEGGTPLYKCENLAKKLGMKELYVKNEGANPTGSFKDRGMTVGVTRANELGVEVVGCASTGNTSASLAAYSARAGKKCIVLLPGGKVALGKLAQAMFYGAKVIQINGNFDEALVMVKNLALENKLYLLNSVNPFRLEGQKTIGFEICDQLDFEVPDMVILPVGNAGNISAIWKGFKEFKETEMIDRLPKMTGIQAEGAQPIVKAIKEGLDEIVPDENPETIATAIRIGNPVNAAKALDAIKSSGGLAESVNDEEIIEAQKLLAQTEGIFVEPASASSIAGLIKLINMGLIDKDQKIVCITTGNGLKDPDAAIKASKMPTEIECDMEVLRKAIEE

SEQ ID NO: 77910 - protein, 233 aa, Physcomitrella patens subsp. patens
MYNEATGKNMGYAKFASALGKDNKAMVPSRVGMLSIYISIGASGAASFLDQAVAASDDRLLLVAAALSVHFVKRSVEVLFLHRFSGSMSVGDAVTISTSYSLQVVLLLYSQLLSADIEAPSPDTKYLGVAVFLIGLTGNFYHHWILANLRKDGQKKYVVPHGGLFGLFVCPHYVFEVIDFVGMALISQTVYGWCMVSFATLYLTGRGIATKNWYKKNVDGFPQQRSVILPGIF

SEQ ID NO: 77911 - protein, 291 aa, Physcomitrella patens subsp. patens
MLRRNTRLRREYLYRKSLEGKERVLYEKKRKIRQALAEGKPIPTELRNEEAALRQEIDLEDDQTQELKSTIDDEYSNAGIENPKILLTTSRDPSSRLTQFVKELKIVFPNAQRINRGGQVISEIVESCRAQEYSDLIMVHEHRGEPDGLIVCHLPYGPTAYFGLSNVVTRHDIKDKGVLGTMSEQYPHLIFNNFNTKLGQRTVNILKHLFPVPKPDAKRIITFANQSDYISFRHHMYEKPAGVKSIDIKEVGPRFELRLYQVKLGTMDQTEAQNEWVIRPYMNSGKKRIAL

SEQ ID NO: 77912 - protein, 184 aa, Triticum aestivum
  misc_feature (178)..(178): Xaa can be any naturally occurring amino acid
MGMTPLPVFVLLLLICFCKSDDRLTPAKPLSPGDKLVSNGGIFALGFFSLTNSTANSYIGIWYHHIPERTYVWVANRDNPIASSSHGKLVLTNGSNLVLSDSKGRTLWTTTNNIAADGLKAVAILLDSGNLVIRSPNGTDIWQSFHHPTDTMLPNMSLPLKNYTNFANHLVAWRGPDXPSTSNY

SEQ ID NO: 77913 - protein, 260 aa, Pseudomonas syringae pv. syringae B728a
MTITLKTPEDIEKMRIAGRLAADVLEMIAPYVKPGVTTEELDRLCHDYIVNEQKAIPAPLNYKGFPKSICTSINQVVCHGIPSDKKLKDGDSLNIDVTVIKDGYHGDTSRMFHVGTVPVWAERLSKVTQECLYKAIEIVKPGTRLGDIGAVIQKHAEKNGFSVVREFCGHGIGKVFHEEPQVMHFGEAGTGIELQEGMTFTIEPMINQGRPETKILGDGWTAITKDRKLSAQWEHTLLVTADGYEIFTLRSDDTIAQKAP

SEQ ID NO: 77914 - protein, 488 aa, Synechococcus sp. WH 7805
MSTPLIPVILCGGTGTRLWPLSRASYPKQYWPLGGSGDETLLQQTQQRLKGLDNLAPPLLICNDDHRFIVAEQMRQTGVEPGAILLEPMGRNTAPAVAVAALQATARGEDPLLLVLAADHVIRDAAHFRTAIDAGRTEAEAGRLVTFGIVPTTPETGYGYIEAAEPLQPGALTPVPIARFVEKPDRATAEQFLASGRFTWNSGMFLFKASAMLAELERLAPEVVSCCRAALEQDVADLDFLRLEREAFAKCPNVAIDVAVMEKTELGTVLPLAAGWSDVGSWSALWETADRDDDGNVLRGRVISEGSRNCYLRSEHRLVVGLGVENLVVVETDDAVLIADRSQAQNVKTIVKQLEADGSSEGKAHRKIYRPWGHYTGVVEDSRWQVKRISVKPGASLSLQMHHHRAEHWIVVKGTALVERDGDQQLIGENQSTYIPLGCRHRLTNPGRIPVELIEVQSGAYLGEDDIVRFDDVYGRSNAAARGALTPQ

SEQ ID NO: 77915 - protein, 506 aa, Escherichia coli CFT073
MNEGSMETKDLIVIGGGINGAGIAADAAGRGLSVLMLEAQDLACATSSASSKLIHGGLRYLEHYEFRLVSEALAEREVLLKMAPHIAFPMRFRLPHRPHLRPAWMIRIGLFMYDHLGKRTSLPGSTGLRFGANSVLKPEIKRGFEYSDCWVDDARLVLANAQMVVRKGGEVLTRTRATSARRENGLWIVEAEDIDTGKKYTWQARGLVNATGPWVKQFFDDGMHLPSPYGIRLIKGSHIVVPRVHTQKQAYILQNEDKRIVFVIPWMDEFSIIGTTDVEYKGDPKAVKIEESEINYLLKVYNTHFKKQLNRDDIVWTYSGVRPLCDDESDSPQAITRDYTLDIHDEDGKAPLLSVFGGKLTTYRKLAEHALEKLTPYYQGIGPAWTKESVLPGGAIEGDRDDYAARLRRRYPFLTESLARHYARTYGSNSELLLGNAGAISDLGEDFGHEFYEAELKYLVDHEWVRRADDALWRRTKQGMWLNADQQSRVSQWLVEYTQQRLSLAS

SEQ ID NO: 77916 - protein, 394 aa, Triticum aestivum
  misc_feature (357)..(357): Xaa can be any naturally occurring amino acid
  misc_feature (362)..(362): Xaa can be any naturally occurring amino acid
  misc_feature (367)..(368): Xaa can be any naturally occurring amino acid
  misc_feature (374)..(374): Xaa can be any naturally occurring amino acid
  misc_feature (384)..(384): Xaa can be any naturally occurring amino acid
MSFDNFVQITGDTRAVKKALFAVSTILYKCPSKENISLETSIDEHPPTIILPSELPVYPASSLYSVSDASMSSGHPSLSILGARSRGSHVPEFTVPTDAHGGLPIYHSMVPAIPTYNTPKCSGELLVRVVCPGDKIGLVIGKGGVTIKSIRKESGASVDVDDAKNDKEESIITIASTEATDDVKSSAVEAVLLLQAKINDENEDRMHLRLLVPANVIGCLIGKGGSIINDMRTKSKAIIYISKGTKPRKASSSDELVEVFGEVDNLRDALVQIVLRLREEVLKDSVGRQNSGKDGKLTVATTEPVYSSSFPMPALLPYSQQVTPLRHDQRGEAERGSNVLPSAAACINGIQPQGRLXIWVWXTSPVXXKPYGKXFPGMEMLSLXNGFQKVMGNM

SEQ ID NO: 77917 - protein, 1009 aa, Ustilago maydis 521
MPFNYGFLSHSDPLAFDPNNYVLTTNGFGLFLTQVIIIIVFCQLLGKLFKLIGQPAVVGELLAGILLGPTALGNIPGFTSTIVPTQALGLLKLMANIGLSLFLFLIGLETDTDLMAKYWQKVLLITLPGMAIPFSIAVGIARLIWQLETDQTVQFTTFFLFVGTVMAVTSLSVLSRIMAEMNILSTRLGCITIASGVCNDLIGYVLLALGSALGTGGKQIDALYQLLAAAGYILVLWFVFRPLMNHLIVRSGFDMTTGAEDRVPEHLLVIALCGTLVSAFYTDSMGVHPIVGAFSFGVCCPHGNFAVKVTESIETLVMMVLLPLYFVTSGLSTNFKLLNDATCWGLILLLLVGIFVSKFGATAASAKLAGMTWRESMCVASLMQSKGIIEIIILNVALQLNVVSAKVFAMLVICFLCTTMSVRPLSRYVYFSSLAQQEAAVDAQGEKEKYVNDKDGTSDESRSGDDVDSADFAVTVAIASPSPAIKTLMFLLHLLGQHYSAPNVSQGGTDMGENASGQISVDLLRLLPIEYTTSSIMQLINYSEERHRDEMMESLKMVQKLCKVPSSAMLARERKLDHYTATMTTPRAKSDADAAYSAPPDTFIVPRHEMIKTIGQQNARAQQRLGKSDAMLSELGRGMALVAWESLNSYGRGLSWLGAAAAASGLSFVKTHDDEDASVSFWQASSDAQSLPSRLFRNLRKQCATGVLLDLSLTRPSTEPRDEKALEALRRQLEDSHGLQRPPGSRRIIVPFFGGADDRAAVELLRRMVLNSPGSVQGLVITFANTGDEEVGAVAASATPTTLLPSSFTVDPLTTDDAHIRSINLETIHQQEAARVDARFLFHQQDASNAAATVKSIPDDFVAAAACHTDRAGLGSSCSQWEDERRTKPSKTHGTTEACTDSGIVFLTLASTPECTSRPIRTMCTVLLPLLDERQDMVLIGRGKWNQRPKQFRQEVESMHVEHASAAWTLAEELREEYRAVGNCLGAVTEGVLLQHLRSCAIVVQAFQR

SEQ ID NO: 77918 - protein, 80 aa, Synechococcus sp. WH 7805
MSQEAILEKVRSIVAEQLSVDAGEVKPESNFQNDLGADSLDTVELVMALEEAFDIEIPDESAEGIATVGDAVKYIEDKQA

SEQ ID NO: 77919 - protein, 484 aa, Ustilago maydis 521
MGQTLSEPVVKKTTSSGGNDSVLYAISEMQGWRISMEDSHTTILDIKNEDGDIVGNFFGVFDGHGGATVAQYCGRNLHNTLLSEDKFKQGDYTEALQQTFLDVDEELKKDPNYTSDPSGCTAVTAFIKTTAKDPKRVEKIFVANAGDSRCVLSQAGNCIEMSNDHKPTLDSERERIEYAGGYVSWGRVNGNLALSRAIGDFEFKRTFDLPVERQIVTAFPEVLDREVLEAEDEFLVLACDGIWDCLSSVKVVDIVRRSIANGKELADICEDLMDRCLAPDSDTGGIGCDNMTVCIVALLNGRSKDEWYSWIKDNIEVPKFGRTTPKEVPPVFSNTQTSTRGQETGMEGAVSIQSLLSGGLARGENGEQGAAGALQLPGGLAGALSGAGIVFRPGGRSDEGEVVYEAHVVDEEDSGDEQPDQSSSESAPKASTTEKATDGDAAEPRLVESPHTDAKPASSNQESDKMEVDDDTNTSAKSQDASNA

SEQ ID NO: 77920 - protein, 393 aa, Colwellia psychrerythraea 34H
MKNEFIAPSRGFERSEFEQRTGKLQQQMAVQGIDAVFFSTEHEFRYFSGFASQFWQSPTRPWFLVIPAKGQPIAVVPGIGAAGFDDTWIDDVRTWPSPRPEDDGVSLLADTLAEVSKQTRCIGAMLGPETHLRMPIANYQTLQASLNQHDMVDVSEIVRKLRSIKSVAEVDKIRFVCDVTAAGFDFLLENLHAGMTERQACKAMHLEMLRLGADACPYLISASGQGGYDNIIMGPTDRRLDQGDLLIIDTGANFDGYFSDFDRNFAFGDVDRATHDAYEAVYASTEAGLDIAAPGRSTGDVWKAMWSVLEAAGSLGNDVGRMGHGLGMQLTEWPSNVQGGDVILQPGMVLTLEPGMTFAPGKVMVHEENILITEKGCEMLHKRAWEKLPIITR

SEQ ID NO: 77921 - protein, 252 aa, Triticum aestivum
MNQFAPQQSSLAMDSGESSAASNAAHAAMAVDYAPEVAGCVSSMVDLGGAAGVESQRLFLARRTALEMLRDRGYSVPEDELARTLPEFRAWWSETPEIERLSFSTTLASDESNKVRIVFCPPEPVKIAAIREVYVRIKEENLSCLILILQSKITSRARESIKEMFKFKVDVFQITELLVNITKHVLKPKHEVLTAEEKAKLLKQYNVVDSQLPRMLETDAVARYYGLGKGTVVKFTYDSELTVDHVTYRCIF

SEQ ID NO: 77922 - protein, 119 aa, Leptospira interrogans serovar Lai str. 56601
MSLICIVGKKEKESKMALAEVNDTNFKSETSGGLVLIDCWAEWCGPCRMVAPVLEELSGELDGLVKIKKLNVDDNQDTAQSLGISSIPTLLLYKDGQLVDKVIGALPKAQIKNFIERHK

SEQ ID NO: 77923 - protein, 129 aa, Streptomyces avermitilis MA-4680
MSSTVELTKENFDQTVTDNEFVLIDFWASWCGPCRQFAPVYEKAAEANPDLVFAKVDTEAQPELAAAFDIQSIPTLMIVRDQVAVFAQPGALPEAALEDVIGQARKLDMDEVRKAVAAQQAQAQAQQGE

SEQ ID NO: 77924 - protein, 1139 aa, Hypocrea jecorina
MNEDEAIQNITKKIEREKALINAANAMRSQTNNEAVRSPLDSQMRDGRRNLQFFEEKLRDIQLRKVGQGVEGMSLGADDAGRPPPPPKDASSAAWGDQAAYGQQSQVGPPSDLAPPRHNFGAPGPGAASKARPNFTKLDLIKYDTPYLGPRIQHMLSQIQFKLNVEEQYLKGVEKMVQLYGMEGDRKSKADAAARRVESKQKILLLKQALKRYEELHVDMDSADAQDDDSINTPNLRKPLSGQLSIRVVAIKDVDHATTGRFARGPETFVAVKVEDTVMARTKVSRNDRWEAEYHNMEVDKANEIELTIYDKPGEHPMPIAMLWVRISDIVEEMRRKRIEAEMNSSGWVSADRMGSTGAPSQFPMSPTSGSFGGSPQAPGGGQGQAPGPFGDPAPQPQVVTGPIDGWFNLEPAGQIQLEFSFVKENRDKRQVDLGLGRKGAVRQRKEEVHEMFGHKFVQHQFYNIMPCALCGDFLKYSAGMQCEDCKYTCHNKCYPSVVTKCISKSNAETDPDEEKINHRIPHRFQPFSNVTANWCCHCGYILPFGKKNCRKCSECGLTSHAQCVHLVPDFCGMSMAVANQILEGIRVQKQRQQKTTSLSEKTLRSGATKSPTTAGHGSSASFSSAGAGSVPGTPSAEATEAARLMYNQTSPQRPGQPGRAPSDLSAAAAASAAMAAAQGRTGYDSGPQDPYGQGHYGAAGPAPQHHKYNPADYANVDQGFPAQPPAQQRPPQPQQQQQAPPAQMPPQQPPPQQPLPPQPGQQYQQQQPAAQKPQPQPPATAQGAAAGPPGSQRKALPSATDPGTGARIGLDHFNFLAVLGKGNFGKVMLAETKRSKRLFAIKVLKKEFIIENDEVESIKSEKRVFLIANRERHPFLTNLHACFQTETRVYFVMEYISGGDLMLHIQRGQFGTKRAQFYAAEVCLALKYFHENGVIYRDLKLDNIMLTLDGHIKIADYGLCKEDMWYGSTTSTFCGTPEFMAPEILLDKKYGRAVDWWAFGVLIYQMLLQQSPFRGEDEDEIYDAILADEPLYPIHMPRDSVSILQKLLTREPDQRLGSGPTDAQEVMSQPFFRNINWDDIYHKRVQPPFLPQIKSATDTSNFDSEFTSVTPVLTPVQSVLSQAMQEEFRGFSYTADLD

SEQ ID NO: 77925 - protein, 371 aa, Rubrobacter xylanophilus DSM 9941
MYSTDQPAGAGERGISELRAGIDEIDAEIVRLLDRRARLARKIGEFKRRNGLEAYVPARERAVLDRVLRISEGDFPRRGLETVFREIISSSISLEERMKVAYLGPETTFTHEAALRAFGASVELEPQATVSDVFARVERGEAQHGVVPLENSMEGAVTHTLDELMNSPLKICGEVYLPIMQNLLSREDSLEKVRVVCSHPMALAQSAPWLRKNLPAARLQEVESTGEAARMAASRPGFAAVGSALAAESYGLKVLARGIQDARTNTTRFIVLGRKWAGRTGRDKTSVVFSVKDRPGVLRDALSAFAEEGINLTRIESRPSRKRAWTYVFFADFQGHPEEERVGRALEALEEHCPYVVLIGAYPEARDPEGL

SEQ ID NO: 77926 - protein, 241 aa, Arabidopsis thaliana
MIASPSLIPNSKTTSQPPPIQTSHIQLPSLSLCVVLGFLLLFASKMGKAKKPQKFAVVKKMISHKALKHYKEEVLNPNKKDLTELPRNVPSVPAGLFFSYNSTLVPPYRVLVDTNFINFSIQNKIDLEKGMRDCLYANCTPCITDCVMAELEKLGQKYRVALRIAKDPHFERLPCIHKGTYADDCLVDRVTQHKCFIVATCDRDLKRRIRKIPGVPIMYVTNRKYSIEKLPEATLGGAPRY

SEQ ID NO: 77927 - protein, 193 aa, Solanum peruvianum
FVFAGVGSAIAYGKLTTNAALDPTGLVAIAVCHGFALFVAVSISANISGGHVNPAVTCGLTFGGHITFITGSFYMLAQLTGAAVACFLLKFVTGGCAIPTHGVGAGVSILEGLVMEIIITFGLVYTVFATAADPKKGSLGTIAPIAIGLIVGANILAAGPFSGGSMNPARSFGPAMVSGNFEGFWIYWIGPLV

SEQ ID NO: 77928 - protein, 223 aa, Enterobacter cloacae
  misc_feature (25)..(25): Xaa can be any naturally occurring amino acid
IWYNNFFGAETEAILPYDQYMHRFXAYFQQGNMESNGKYVDRNGNAVDYQTGPIIWGEPGTNGQHAFYQLIHQGTKMVPCDFIAPAITHNPLSDHHPKLLSNFFAQTEALAFGKSRDVVEQEYRDQGKDPATLDHVVPFKVFEGNRPTNSILLREITPFSLGALIALYEHKIFTQGAILNIFTFDQWGVELGKQLANRILPELGDDNAINSHDSSTNGLINRY

SEQ ID NO: 77929 - protein, 223 aa, Enterobacter cloacae
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSRDVVEQEYRDQGKDPATLDHVVPFKVFEGNRPTNSILLREITPFSLGALIALYEHKIFTQGAILNIFTFDQWGVELGKQLANRILPELGDDNAINSHDSSTNGLINRY

SEQ ID NO: 77930 - protein, 220 aa, Azorhizophilus paspali
LTDPSYAQQIVTLTYPHIGNTGITPEDAESVRVWAAGLIIRDLPLLTSNWRSKQSLPDYLRENGCVAIADIDTRRLTRILREKGSQNGCILVGDDASEEKALELARSFPGLKGMDLAKVVSCSEPYEWRSGVWSLATDSHPEIPAGKLPYHVVAYDFGVKLNILRMLVARGCRLTVVPAQTSASKVLAMSPDGVFLSNGPGDPEPCDYAIQAIREILETD

SEQ ID NO: 77931 - protein, 223 aa, Escherichia coli
IWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQEYRDQGKDPATLDYVVPFKVFEGNRPTNSILLREITPFSLGALIALYEHKIFTQGVILNIFTFDQWGVELGKQLANRILPELKDGKEISSHDSSTNGLINRY

SEQ ID NO: 77932 - protein, 222 aa, Azorhizophilus paspali
LTDPSYAQQIVTLTYPHIGNTGTTPEDAESSRVWAAGLIIRDLPLLASSWRNKQSLPDYLKENGCVAIADIDTRRLTRILREKGSQNGCILVGDDATEEKALELARSFPGLKGMDLAKVVSCTERYEWRSSVWNLETDSHPELPAGKLTYHVVAYDFGVKLNILRMLVARGCRLTVVPAQTPASEVLALNPDGVFLSNGPGDPEPCDYAIRRSRTSSRPTSR

SEQ ID NO: 77933 - protein, 579 aa, Ustilago maydis 521
MTGTSITPPSRSTGPESVLIIGGGATGLVTLRNLVQEYGHDSSGSYALFEPLLVERRSDVGGVWYWSDDTYSLERNIGADKVQGQSPLFDHRGQPHWPSPAYLNLRGNVLPEFLEFSGKRFEPPKNNEVFPSLEETHLYLKSFAEPYRQYIKTGVEVLRVHELPNDQGWQVTLKHWTSSELDAAQAVSFTPKLETKRFDRVIVAAGWYDTPYYPDVQGISLAKEYGHIHHCKHYRDSTPYIAKKVVVVGNNNSSNEVAAHLAALNSAAHPVYRSSKSAAIEKCPALPDERIKDVGMITRYTVVHSTAEKASKGTKLDLTLLDGSVIRDVDYVILGTGYGQKYPWLHVLTDSARLTNSSETQVLTPDYLKATRVPFLYNHAFFSKSPRLTLAFVGLVVSYMPFSFNDLLSAWIIAVWSGKITSVPQSITDRLKFETDRLHYLYTQRLSSATTEEAKKNTDPDDPTTYAGYHLLGGSLKDGPPSEMHFAAELYNELAQADKERVAKFTYKWDEEREQKQTSMYRRKKQWLEDNSDRIKHDPFDLLGTNAHRYGHLVDQLVHPHWRNRANTHTAELTRRANL

SEQ ID NO: 77934 - protein, 373 aa, Colwellia psychrerythraea 34H
MTLSSNTVTKQRFTLVCQKIQIETRDVKTFIFSMPKQQIGFNYHAGQYLNFTVNMAGTMQTCCYSLSSSPTTSDYVSITIKRIPQGKVSNYFHDHFKVGQSIDVQGVAGHFYLTDPMPKNVLLISAGSGITPMLSMLRFMVATQCKNQVIFVHSAKQKMDLIAQAEISNLAKQHGNCQIIYTLTQGANSQWYGYQGRLNEQILGNIEQISHYQTFVCGPKLFRKATQALLFKLGLQPSNCHEESFGAHEYSKEQTINTEESTPPLAPVIESQKVRPQNLEHQSSKAKVSIYFSRWKKRVQGNKQDSLLDQGETAGLILPYSCRAGSCGSCKAKLISGQVKQNSTDGLSAREQQQGYILLCSCSALTDVEISHE

SEQ ID NO: 77935 - protein, 263 aa, Brassica napus
MALTTKPHQLQRSFLSSNHRVSTQRYSESAPSCLRFRRTGVQCSVVTKECRVKGLKARQIIDSRGNPTVEVDLVTDDLYRSAVPSGASTGIYEALELRDGDKSVYGGKGVLQAIKNINELVAPKLIGVDVRNQADVDALMLELDGTLNKSKLGANAILGVSLSVCRAGAGAKGVPLYKHIQELSGTKELVMPVPAFNVINGGSHAGNSLAMQEFMILPVGASSFSEAFQMGSEVYHTLKGIIKSKYGQDACNVGDEGGFAPNV

SEQ ID NO: 77936 - protein, 1648 aa, Ustilago maydis 521
MTIVAGASNLRVAANNYERTSTWHRLAPRLSRTLGSFVASQVTMSASRGAHASAPPPTEERHHSDDSHNASLSTTPKQSHMLTSNPSSASKPDPTTASLRPSNNSLRPAIIPHDTPSAPTQRQQQSSLSSYSTASDKRTASYDDVNPSNIARAQPSTRPSLPRQASHTQRSVSYATSDLETVSALSASEYSSAGEDDADQWQRSQLRGRPIDNAFRQATTIGRSGLLVEPSRSASAMTSASANKPRRPSAHNRDSSKPRRHSKAYRANDDYLSPADDDRYGPLDDQDDEVEPHDRGEELVRRRMKARQREKALRKKAEKERSRQSIAACAPTTNNAQSSNAPLPSPSPKPTSTLLGQRSTSPSPRPDRSARPTTIMLPPPAFGNQQPASLSPSSVPPFPSPGAPSSRLSSAAAYPSPHAHIRRPSSTNAQNRFSAISHAQQSAVGPRSAFQPPQSASNTHDFFAAAGPAFSTGRAATDASSSMTGSVRADDDHDEDRDTIASLANRRHRDDADNPTGEAAQLDDDDNVDDMDADYNDDGQAANGGEDDDEDDDDDDDDDDDQDVEYTLKDRQDAINIEHPFGLPIWKPALYKKSRSVTRNAEIALHSIPSAAAERHLLPGNILWTIFFGSWLSLICYIFSILINVVPLGGSRYARVVWELGGYLFWPFGKYVEVEVSPDSADRFSGATHNAADAETQWVENSFTPVAARFPHDHAHVVPFNSRPESLLSTPRDKLGNSQHDTIRADDSTRQAADAGSSSGSEARRSTPRASEHAESSRTSQQEQEETSSLKGKAKASDYGSIYDSQAGQQLTDLERIEAEQRVYGYVDDQNGIDVGASQRLGGRVAFAIFYGMFLFPFMGLVCLACWGMVFPIPMAKLTWVLLKNLATRPLALHFRSAPGMEKQHHRHHQHGEIDEIAGAAKKFFLPLKPGEPAPRPKSINAGKLTLQRRSNILLCTYRAVGGQYYKYTVGGVNILFVNTLPLVFFTIIDFFIIERYVEHHAITHGFLAFISGQGVIFMLALGSVIPLSYFIGMAVASISAQSSIGMGAVINATFGSIIEIILYAIALTQEKARLVEGSLIGSILAGVLLMPGLSMCSGATRRKEQRFNARSAGVTSTMLIMAIIGILTPTLFYQIYGTFQLTCEGCPAGSVPGESWSCRRCFYEHVPPATDPFFQNNVRGLMYTCTVILVLSYGVGLWFSLRTHASQIWQNPQPVHPGQNMVANQATLAHLPSAQRASIYKRLVPAAVMQQLLPTTHPAGGAAAERGGGAVHGHSSAISAAGSAPGTVKGPSFGHARQGTDATQDGPRPLQLPEHFSQEEYDRAVALTTSAFHNVLQQQQRRYDQQAANTAGGERDHLRHHQAQAQVQHGKHVSMHEEAAVNEEDEGHGGHDAPSWSRGTSLTVLLSCTVLYAIIAEILVDVVDVVLDGSGIDEKFLGITLFALVPNTTEFMNAMSFAINGNIALSMEIGSAYALQVCLIQIPAMVVFSAYYNSGISDELNLIHRSFTLIFPRWDVIAIIFSVFLLTYTYIESRSNYYRGTICILSYMVLVAGFYFAPATGDVEDPGDDNRGLRAGIEVGKAMFAVHDGRFGAQVAGWTRASAALAFGGTRSHAALTSDMLPDIPAWLPHLDLAHWTYALYASLWSR

SEQ ID NO: 77937 - protein, 514 aa, Escherichia coli K12
MLVSKKPMVLVILDGYGYREEQQDNAIFSAKTPVMDALWANRPHTLIDASGLEVGLPDRQMGNSEVGHVNLGAGRIVYQDLTRLDVEIKDRAFFANPVLTGAVDKAKNAGKAVHIMGLLSAGGVHSHEDHIMAMVELAAERGAEKIYLHAFLDGRDTPPRSAESSLKKFEEKFAALGKGRVASIIGRYYAMDRDNRWDRVEKAYDLLTLAQGEFQADTAVAGLQAAYARDENDEFVKATVIRAEGQPDAAMEDGDALIFMNFRADRAREITRAFVNADFDGFARKKVVNVDFVMLTEYAADIKTAVAYPPASLVNTFGEWMAKNDKTQLRISETEKYAHVTFFFNGGVEESFKGEDRILINSPKVATYDLQPEMSSAELTEKLVAAIKSGKYDTIICNYPNGDMVGHTGVMEAAVKAVEALDHCVEEVAKAVESVGGQLLITADHGNAEQMRDPATGQAHTAHTNLPVPLIYVGDKNVKAVEGGKLSDIAPTMLSLMGMEIPQEMTGKPLFIVE

SEQ ID NO: 77938 - protein, 468 aa, Escherichia coli W3110
MIREPPEHILNRLPSSASALACSAHALNLIEKRTLDHEEMKALNREVIEYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMRTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 77939 - protein, 341 aa, Escherichia coli K12
MKALSKLKAEEGIWMTDVPVPELGHNDLLIKIRKTAICGTDVHIYNWDEWSQKTIPVPMVVGHEYVGEVVGIGQEVKGFKIGDRVSGEGHITCGHCRNCRGGRTHLCRNTIGVGVNRPGCFAEYLVIPAFNAFKIPDNISDDLAAIFDPFGNAVHTALSFDLVGEDVLVSGAGPIGIMAAAVAKHVGARNVVITDVNEYRLELARKMGITRAVNVAKENLNDVMAELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMRSGQSGKVILSWD

SEQ ID NO: 77940 - protein, 462 aa, Lactobacillus johnsonii NCC 533
MQQFGVIGLSVMGKNLALNVKNHGYSVSGFSIDKPEVDALAKYEDKNLKPTYTWEEFVNSLEKPRKILIQIMAGKPVDETLQKLLPLLDKGDILIDGGNSNFHDTNRRYKEMEKHGIHFIGMGVSGGEEGALNGPALMPGGDEKAYEEVAPILEAMAAKTPTGQPCVGYIGPAGSGHYVKMVHNGIEYGIMQIISEVYDVLRTVGHYSNNEMSEIFKNWDKGGLQAYLIEITSKVLKQKDNLTDDHIIDHILNEASYKGTGNWMLEDAIRLGAPITVIAEAVLARFMSKATLRNDPEPKIDPEKAPKDLVDQLAKALYLAMAVSYGQGFEQLTMAAKAYNWRLHYSTIAQNWEAGCIIRSQMLHDIKFAYNADKDLPNLFKAPFFDKVKKENIGALRDVVKIAADAGVPTPTLSAALNYLESIFNPRLPQNIIQGQRDYFGAHTYQRNDRPGTFHTEWYEEK

SEQ ID NO: 77941 - protein, 134 aa, Glycine max
  misc_feature (85)..(85): Xaa can be any naturally occurring amino acid
RRRRRENSNAELVQWERFLPRMVLRVLLVEADHSTRQIIAALLRKCSYTVIAVPDGLKAWETLKKKASELDLILTEVELPAISGXALLSLIMEHDICKSIPGIMMASHDSVSMALKCMLKGAVDFFIKPIPKNE

SEQ ID NO: 77942 - protein, 295 aa, Schizosaccharomyces pombe
MPIYNILRKVIHLAKFAKSKLISITSDRDQISMSIPEVSSHDSCLNDCHSVNSEEQAKPVCCLELNAHKDGIKVVDTSNDASTFSNSPLVPDNFGVVYPGIIYRSACPRASNFNFLESLHIRTIISLRQEEYSEEDLHYFTKHHINYYHIAMPGSKHRKNDCISSSSNPDISDVDDLVRKTLQLLLNKENWPVLLHCSRGKHRTGIVIGCLRALMNWPVGNRLQEYISFSHPKEREVDEEYIQNFSSDPSLKSSLNDLKRYISDSSSELADVVLSSESPTVQAATVNETCRSPGS

SEQ ID NO: 77943 - protein, 457 aa, Zea mays
MWEFGFKKSIPSLDLKIGKLLLSLLLVMVLSLMGPEIRTGFLKDGKPIKLTKGQEITVTTDYDIKGDEKMIAMSYKKLPVDVKPGNVILCADGTISLAVLSCDPDAGTVRCRCENTAMLGERKNCNLPGIVVDLPTLTEKDKEDILGWGVPNDIDMIALSFVRKGSDLVTVRQVLGQHAKRIKLMSKVENQEGVVNFDEILRETDAFMVARGDLGMEIPVEKIFLAQKMMIYKCNIAGKPVVTATQMLESMIKSPRPTRAEATDVANAVLDGTDCVMLSGESAAGAYPEVAVKIMARICIEAESSLDHEAVFKAMIRSAPLPMSPLESLASSAVRTANKAKAALIVVLTRGGTTAKLVAKYRPRVPILSVVVPVLTTDSFDWTISSEGPARHSLIYRGLIPLLAEGSAKATDSESTEVILEAALKSAVQKQLCKPGDAIVALHRIGVASVIKICIVK

SEQ ID NO: 77944 - protein, 513 aa, Oryza sativa Japonica Group
MAVAAPGQLNLDESPSWGSRSVDCFEKLEQIGEGTYGQVYMAKETETNEIVALKKIRMDNEREGFPITAIREIKILKKLHHQNVIQLKEIVTSPGPERDEQGKPIEGNKYKGSIYMVFEYMDHDLTGLADRPGMRFTVPQIKCYMRQLLTGLHYCHVNQVLHRDIKGSNLLIDNEGNLKLADFGLARSFSSDHNGNLTNRVITLWYRPPELLLGSTRYGPAVDMWSVGCIFAELLNGKPILTGKNEPEQLSKIFELCGTPDELIWPGVTKMPWYNNFKPQRPMKRRVKESFKHFDQHALDLLEKMLTLDPSQRISAKDALDAEYFWTDPLPCDPKSLPKYEASHEFQTKKKRQQQRQAEEAAKRQKLQHPPPHSRLPPIQNPGQPHQIRPGQPMHNAPPVAAGPSHHYAKPRGPGGPNRYPQGGNQGGYNPNRGGQGGGYGSGPYPQQGRGPPPYPGGGMGGAGGPRGGGGSGYGVGGPNYQQGGPYGASGPGRGPNYNQGGSRNQQQYGNWQ

SEQ ID NO: 77945 - protein, 223 aa, Escherichia coli
IWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQEYRDQGKDPATLDYVVPFKVFEGNRPTNSILLREITPFSLGALIALYEHKIFTQGVILNIFTFDQWGVELGKQLANRILPELKDDKEISSHDSSTNGLINRY

SEQ ID NO: 77946 - protein, 291 aa, Trichodesmium erythraeum IMS101
MWEYTEKVMDLFYNPQNQGTITDKKEGEKIVSGEVGSIACGDALSLHLKVNEASGEILDAKFQTFGCASAIASSSALTAMLKGKTIDEAMNIKNQDIAGYLGGLPEEKMHCSVMGQEALEAAIFKYKGIEVEVHEEDDEGSLVCSCFAITENKIKRVILENNLKTAEEVTNYVKAGGGCGSCLADIDDLVASVYEAPDTTTQQIPTTTKPATNLTNLQKITLIQQVLQQEVRPVLAEDGGDVELFDVDGDRVLVKLKGACGSCSNVLVTLKGAIEATLKERVSESLVVEAV

SEQ ID NO: 77947 - protein, 183 aa, Escherichia coli
DRNGNVVDYQTGPIIWGEPGTNGQHAFYQLIHQGTKMVPCDFIAPAITHNPLSDHHQKLLSNFFAQTEALAFGKSREVVEQEYRDQGKDPATLDYVVPFKVFEGNRPTNSILLREITPFSLGALIALYEHKIFTQGVILNIFTFDQWGVELGKQLANRILPELKDGKEISSHDSSTNGLINRY

SEQ ID NO: 77948 - protein, 393 aa, Physcomitrella patens subsp. patens
MSNSENMDKQPLSMADLGVALPPTSGALSAADRAGLVNVLKDKLQLLAGMPSGYLESLPAKVKRRVSVLQELQAEHDELEAKFFEEKAALEAKYQKLYEPLYVKRADIVNGVVEVEPAKDEAPEAAEPAEEGKEEVKGVPEFWLTAMKTHEILGMQITDRDEGALKFIKDIKCSSLDEPTVNKGFKLDFYFEENPYFKNSVLSKTYHMIDDNEPILEKAVGTEIEWNSGKNLTQKVMKKKAKKGSKNTKPVTKTENCDSFFNFFNPPQVPEDDQDIDQEMVEQLQDLLEQDYDVGSTIRDKIIPHAVSWFTGEALQGEDFEDDDEEGDDDDDDDEDDYDEDEDDEEEDEDEEDDDEEEVRGRKRVVPTRKGGASKASDGQQQSGEQPPECKQQ

SEQ ID NO: 77949 - protein, 443 aa, Escherichia coli CFT073
MCVPEMIKKELVMVSLEKNDHLMLARQLPLKSVALILAGGRGTRLKDLTNKRAKPAVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGARCTVACMPVPIEEASAFGVMAVDENDKIIEFVEKPANPPSMPNDPSKSLASMGIYVFDADYLYELLEEDDRDENSSHDFGKDLIPKITEAGLAYAHPFPLSCVQSDPDAEPYWRDVGTLEAYWKANLDLASVVPELDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 77950 - protein, 317 aa, Oryza sativa
RRPFWTLVLKILFLFFCFVLQEIASYLGVDLGTVLIKRFADGEIYVQLQESVRGCDVFLVQPTCSPVNENLMELFVMIDACRRASARSITVVIPYFGYARADRKAQGREAITAKLSANLLTEAGSDRVIVCDIHSTQALGYFDIPVDHIHGQPVILDYLASKTISKDLVVVSPDVGGVVRARAFAKKLSDAPLAIVDKRRQGHNMSEVMHLIGDVKGKVAIMVDDMIDTAGTITSAAALLKQEGAEAVYACSTHAVFSPPAIERLSGGIFEEVIVTNSILLPEHKCFPQLTVLSMANLVAETIWHVHRDGSVSSIFQ

SEQ ID NO: 77951 - protein, 376 aa, Wolbachia sp. wMelPop
  misc_feature (133)..(133): Xaa can be any naturally occurring amino acid
  misc_feature (136)..(136): Xaa can be any naturally occurring amino acid
  misc_feature (138)..(138): Xaa can be any naturally occurring amino acid
  misc_feature (185)..(185): Xaa can be any naturally occurring amino acid
VFVYSQDFTVFGGSLGASHAKKICKIMDMAINARVPIIGLNDSGGARIQEGVNSLAGYGEIFQRNVNASGVIPQISLIMGPCAGGAVYSPALTDFTFMVKNSSYMFITGPDVVKKVTYEDVSFEDLGGAKIHXSKXGXADFAFNNDVEMLLKMREFFTFLPANNQESPKSAPICNDVDDIDESLXTLIPTNPNTPYDMYELIEKVCDERNFFELKPDFARNIITGFGRIGGNTVGIVANQPMHLAGCLDIDSSRKAARFVRFCDAFNIPIITLIDVPGFLPGTNQEYNNIIQHGAKLLYAYAEATVPKISLITRKAYGGAYIVMNSKHLKGDINYAWPTAEIAVMGPESAVEIIFRHEKDQQTLIKEYKEKFANPF

SEQ ID NO: 77952 - protein, 256 aa, Bacillus cereus E33L
MYVKEKVVIITGGSSGMGKGMATRFAKEGARVVITGRTKEKLEEAKLEIEQFPGQILPVQMDVRNTDDIQKMIEQIDEKFGRIDILINNAAGNFICPAEDLSVNGWNSVINIVLNGTFYCSQAVGKYWIEKGIKGNIINMVATYAWDAGPGVIHSAAAKAGVLAMTKTLAVEWGRKYGIRVNAIAPGPIERTGGADKLWISEEMAKRTIQSVPLGRLGTPEEIAGLAYYLCSDEAAYINGTCMTMDGGQHLHQYPF

SEQ ID NO: 77953 - protein, 223 aa, Klebsiella oxytoca
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSREVVEQEYRDQGKDPATLEHVVPFKVFEGNRPTNSILLREITPFSLGALIALYEHKIFTQGVIMNIFTFDQWGVELGKQLANRILPELKDGSEVSSHDSSTNGLINRY

SEQ ID NO: 77954 - protein, 210 aa, Zea mays
  misc_feature (57)..(57): Xaa can be any naturally occurring amino acid
  misc_feature (175)..(175): Xaa can be any naturally occurring amino acid
LFPHSFFVQKASSFNQKEKTSSLNQNDTVSAMEFFQKAKAIRMRNSHNKYLSADDDXETVTQDRNGSNKNARWTVEPVRDSYHVIRLKSCYGKYLTASNERFLLGATGKKVIQLKPSRLDSSVEWEPVREGSKIKLRTRNGNYLRGNGGLPPWRNSVTHDNPHLSATQDSSRGKXDVGEILGILKSRRRLSSLRHEDAASAAETQPHPHA

SEQ ID NO: 77955 - protein, 132 aa, Triticum aestivum
  misc_feature (51)..(51): Xaa can be any naturally occurring amino acid
  misc_feature (72)..(72): Xaa can be any naturally occurring amino acid
  misc_feature (81)..(82): Xaa can be any naturally occurring amino acid
  misc_feature (97)..(98): Xaa can be any naturally occurring amino acid
  misc_feature (103)..(103): Xaa can be any naturally occurring amino acid
  misc_feature (106)..(106): Xaa can be any naturally occurring amino acid
EALGKSTPEPAVKSSSINCIVTSGSLVPSIAKCLLYCLDDVVSSDNVYSSXWESGKLQCFKWIKERHGGPNXRFCAVGDGXXERSALPIMKWPFLKXXFRPNXPQXFPGLTRQHTPWSCVQSIGQNVDFCPG

SEQ ID NO: 77956 - protein, 448 aa, Psychrobacter arcticus 273-4
MSISQAIEKIEARYAHQPEFIQAVKEVAITIAPLYDSHPEYDTFKVFERLVEPDRVIAFRINWENDKGEVQVNRGWRVQFSNALGPYKGGIRFHPTVNQSVLKFLGFEQIFKNALTGLPMGGAKGGSDFDPKGKSDNEIRRFCYAFMRELHPYINKDTDVPAGDIGVGGREISYMFAMYKNLTREYGGVLTGKGVGFGGSLMRTEATGYGAVYFLENMLTAQNEHIAGKRVLISGAGNVSLHAAEKVHMLGGVVVTVSDSQGTLYDEKGLNQEKINWLKEQKAKSQPLADYVAVYGGEWFAGQKPWHIKGDIAIPSATQNEVNEGDAKLMVENGIKYVVEGANMPLTAEAIDHIRLHRVHYAPGKAANAGGVAVSGLEMSQNSVRQYKSFEQIDARLKCIMKNIHDSAAEASGKYHQTDKGYIDYMTGANIVGFERVADALVAYGILN

SEQ ID NO: 77957 - protein, 156 aa, Nicotiana glutinosa
MAEVEYRCFVGGLAWATTDQTLGDAFSQYGEILDSKIINDRETGRSRGFGFVTFKDEQAMRDAIEGMNGQDLDGRNITVNEAQSRGSGGGGGGYRGGRGGGGGGYGGGGRREGGYGGGGGGYGGGRREGGYGGGGGYGGGRREGGYGGGSEGNWRN

SEQ ID NO: 77958 - protein, 376 aa, Psychrobacter arcticus 273-4
MSDKFIKSKAAIAWGPNQPLSIEEVDVMLPRKGEVLVKIIASGVCHTDAFTLSGEDPEGVFPAILGHEGGGIVEQIGEGVTSVQVGDHVIPLYTAECGECKFCTSGKTNLCSAVRETQGKGLMPDGTTRFYKDGQPIYHYMGCSTFSEYTVLPEISLAKVSKEAPLEKVCLLGCGVTTGMGAVMNTAKVEEGATVAVFGLGGIGLAAVIGAKMAKASRIIGVDINEDKFELAKKLGATDCINSKDYDKPIQEVIVEMTDGGVDYSFECIGNVDVMRSALECCHKGWGESVIIGVAGAGKEISTRPFQLVTGRVWKGSAFGGVKGRTELPGYVERYLEGEIPLNDFITHTMPLENINEAFDLMHKGESIRTVIHFDM

SEQ ID NO: 77959 - protein, 137 aa, Salmonella enterica subsp. enterica serovar Paratyphi B str.
MANQPSAEELKKKLSEMQFYVTQDRGTEPPFTGRLLHNKRDGVYHCLVCDTPLFHSHTKYDSGCGWPSFYQPVSEEAIRYIDDFSHGMQRVEIRCGNCDAHLGHVFPDGPQPTGERYCVNSASLAFSDEKNGDQLKG

SEQ ID NO: 77960 - protein, 188 aa, Streptococcus pyogenes M1 GAS
MILLIDNYDSFTYNLAQYLSEFDETIVLYNQDPNLYDMAKKANALVLSPGPGWPKEANQMPKLIQDFYQTKPILGVCLGHQAIAETLGGTLRLAKRVMHGRQSTIETQGPASLFRSLPQEITVMRYHSIVVDQLPKGFSVTARDCDDQEIMAFEHHTLPLFGLQFHPESIGTPDGMTMIANFIAAIPR

SEQ ID NO: 77961 - protein, 262 aa, Colwellia psychrerythraea 34H
MAITIKSQDEIAKMRIAGQLAADVLEMIAPHVKAGISTDELNTLCADYTENVQHAISAPLNYHHFPKSICTSVNHVVCHGIPDATVLADGDIINIDITVIKDGYHGDTSKMFIIGEPSAEDNRLCRITQESLYLALKKVKPGATFGEIGATIQKFIKKSGRYSIVKDYCGHGIGKEFHEEPQIMHYKNNDKTKMEVGMCFTIEPMVNLGRAGTTLDKTDNWTVYTADGKRSAQWEHTIVVTKTGCEILTLREEETIARILHN

SEQ ID NO: 77962 - protein, 696 aa, Oryza sativa Japonica Group
MESAHGGSDRPGLAMCDFVGWVRCRFQMEIASRVHGLYRQQPALKFRRASIPEKDTDATNASSVSPVSSSSSWRRDSSCTKGEGSMDSQEPRVDAEQKPVLSDNPEEQTIPSKDEKVLEPTISHDSNGINLPSEGQAQAGTSNIGGGHNAAYPQTMYSSQAQPFYYQGPGYDNPSNEWDGYPPYVSVEGLEAGPAVVYNDDPQLMYHGGYGYDPYAHYSPISTPVPAAVSGDGQLYSPQQFSFSAPYYQQSVPPGMPYLSSPTPISQGEAMVPIDPTQGAFIAETLSPNSFLFGPRPEWFRSSEGNGSFPSPAASPQPAGGVSGPFGQSNFPMASGMQSPQHRPFYGFGTPSDSYGRVFSHGGYFPQATNYGGPFPSFGLNGTSSIPMEKGRRRGRGNALLCSCNGSLDFLNEQSRGPRATRPKKQPEDGGKDEKPSAGVDCELYNRPDFVTEYKNARFFIIKSYSEDNVHKSIKYGVWASTTNGNKKLDSAYREAKEKEEHCPIFLLFSVNASAQFCGVAEMIGPVDFEKSVDYWQQDKWTGQFPVKWHIVKDVPNNLFRHIILENNDNKPVTNSRDTQEVKLEQGMEMLKIFKDHEEDASILDDFDFYEERERALLDNKARLHQQHQLPSSTVVEPKKPLTVATDLVGHITKSFAQAVRLGEAKNVSPNSADKGASGDSSVAAKPLEVKEAGLA

SEQ ID NO: 77963 - protein, 492 aa, Bacillus thuringiensis serovar konkukian str. 97-27
MFQKIAKECLAGFTVAIVALPLAIAFGIAATGTSEGALVGLYGAIFAGLFAALFGGTPGQVTGPTGPITVIATGVIATHGLEASFIAFMMAGLFQILFGVCKLGSYVRYIPYPVVSGFMNGIALIIILGEMKHVQNSFLLVVLTIIVMIVSGKWIKAIPSSLVALVGVTALLPLFSSALEGLTVKLPVIGNLSLNKVIEKIGTIPEAMPTLHIPSLGGTGIAELVLPALSIALLGSIDSLLTSVVMDNVTGTRHKSNKELVGQGIGNMVSGLFGGLAGAGATVRSIVNIRSGGKTALSACMHSVILFIFIMGLGSVVQYIPLAVLSGILILTGIGMFDWESMKKMHVAPKGDVIVMLVTMIVTVKFDLMIAVAFGILLSFIIYMVKCKERKASIVKEKEATYKIKGPLSFLTVDRVFYALQDVKSPVVLRMEDARYMDVSGAMALLNFIEQSDKSGLSVTLEQVPAHIKKTLVTMASNEQKDKLLFAEANVM

SEQ ID NO: 77964 - protein, 443 aa, Physcomitrella patens subsp. patens
MQAWQLLAIFASTITGLVLSPLPVGAWAFLGLTVAVVTKTLTFAAAFGAFTNDVIWLIVISFFFARGFVKTGLGDRVATYFVKWLGKSTLGLSYGLALSETLLAPAMPSTTARAGGVFLPIIGSLSLSSGSKPEDKSASKLGAYLVMTQFQAAGNSSALFLTAAAQNLLCLKLAQELGVIVSNPWVSWFKAASVPAFIALLTTPLILYNLFPPEVKDTPDAPAAAAKKLVALGPVTQNEWSMVATMLLAVTLWVFGETLGIASVVSAMLGLCILLLVGVLNWDDCLSEKSAWDTLTWFAVLVGMAGNLSSLGLVKWMSDAVAKTLASYSLSWPAAFGVLQGTYFVSHYLFASQTGHVGALYSAFLAMHIASGVPTILAALALAFNTNLFGGLTHYSSGQAAVYFGSGYVELKDVFKYGAVMAVWNILVWSVAGGLWWKAIGLY

SEQ ID NO: 77965 - protein, 384 aa, Pseudomonas aeruginosa
MTKPATTPAILALADGSIFRGESIGADGQTIGQVVFNTAMTGYQEILTDPSYAKQIVTLTYPHVGNTGTTPQSARSWKVWAAGLVIRDLPLLASNWRNKQSLPSYLKENDTVAIAGIDTRRLTRILREKGAQNGCILAGADATEEKALELARSFPGLKGMDLAKEVSVKERYEWRYSLWNLETDSHPEIPASELPYHVVAYDYGVKYNILRMLVARGCRVTVLPAQTPASEALGLNPDGIFLANGPGDPEPCDYAIRAIQEVLETDIPVFGICLGHQLVALASGAITVKMPSGHHGANHPVQDLETGVVMITSQNHGFCADEAAVPANLRATHKSLFDGTLQGIERTDKVAFSFQGHPEASPGPCDVAPLFDRFISAMAPVVDR

SEQ ID NO: 77966 - protein, 522 aa, Zea mays
MGACFSSASAAPAGAAVDERRPSKEGDGKKRRRAAGASPDAAAPVRVEFGYERDFEARYEVGRLLGHGQFGYTFAATDRGSGDRVAVKRIDKAKMTRPVAVEDVKREVKILKALKGHQNIVHFYNAFEDDSYVYIVMELCEGGELLDRILAKKNSRYSEKDAAVVVRQMLKVAAECHLRGLVHRDMKPENFLFKSNKEDSPLKATDFGLSDFIKPGKKFHDIVGSAYYVAPEVLKRRSGPESDVWSIGVITYILLCGRRPFWDKTEDGIFKEVLRNKPDFRKRPWSSISPGAKDFVKRLLVKNPRARLTAAQALSHPWVREGGEASDIPVDISVLSNMRQFVKYSRFKQFALRALASTLNEEELSDLKDQFDAIDIDKSGSISIEEMRHALAKDLPWRLKGPRVLEIIQAIDSNTDGLVDFKEFVAATLHIHQMAELDSERWGIRCQAAFSKFDLDGDGYITPEELRMVQHTGLKGSIEPLLEEADIDKDGKISLSEFRKLLRTASMSNVPSPRGPPNPQAL

SEQ ID NO: 77967 - protein, 193 aa, Solanum peruvianum
FVFAGVGSAIAYGKLTTNAALDPAGLVAIAVCHGFALFVAVSISANISGGHVNPAVTCGLTFGGHITFITGSFYMIAQLTGAAVACFLLKFVTGGCAIPTHGVGAGVSILEGLVMEIIITFGLVYTVFATAADPKKGSLGTIAPIAIGLIVGANILAAGPFSGGSMNPARSFGPAMVSGNFEGFWIYWIGPLV

SEQ ID NO: 77968 - protein, 371 aa, Acidovorax sp. JS42
MADNASSPTPQASPALADLRVQIDSLDHQLLQLLNQRARVAEQVGELKKREGTPYFRPDRVAQVIEKITNANPGPLKGAHVSAIWREIMSACLALESPQRVAVLGPEGTFCEQAAIEYFGGAADLMYCNSFDEVFHATAAGSAQYGVVGVENSNEGVVTRSLDMFLHTPCHVVGEVSLLVRHNLLRSTNSAEHIEAVLAHPQALAQCQGWLSKHLPHAERRPVSSNAEGARLAATNPAWAGISSERAAQQFGLHVVAHAIQDDAYNRTRFAVICLPHTLATPAPTGRDCTSLIISVPNRPGAVHDLLVPLKKHGVSMTRFESRPARTGQWEYYFYIDIEGHPAQPNVAAALAELQQLCAFYKVLGTYPVPA

SEQ ID NO: 77969 - protein, 530 aa, Glycine max
MAEIEGSPGSSMHGVTGREQTFVASVASPIVPTDTTAKFALPVDSEHKAKVFKLFSLANPHMRTFHLSWISFFTCFVSTFAAAPLVPIIRDNLNLTKSDIGNAGVASVSGSIFSRLAMGAVCDMLGPRYGCAFLIMLSAPTVFCMSFVKDAAGYIAVRFLIGFSLATFVSCQYWMSTMFNSKIIGLANGTAAGWGNMGGGATQLIMPLVYELIRRAGATPFTAWRIAFFVPGFMHVIMGILVLTLGQDLPDGNLGALQKKGNVAKDKFSKVLWYAITNYRTWVFALLYGYSMGVELTTDNVIAEYFYDRFNLKLHTAGIIAASFGMANLLARPFGGYTSDVAARLFGMRGRLWNLWILQTLGGVFCIWLGRANSLPIAVLAMILFSIGAQAACGATFGIIPFISRRSLGIISGLTGAGGNFGSGLTQLIFFSTSRFSTSTGLSLMGVMIVCCTLPVTLVHFPQWGSMFLPPSKDVNKSTEEYYYTAEWNEEEKQKGLHQNSLKFAENSRSERGKRVASAPTPPNTTPTHV

SEQ ID NO: 77970 - protein, 227 aa, Streptococcus pneumoniae TIGR4
MENLKKMAGITAAEFIKDGMVVGLGTGSTAYYFVEEIGRRIKEEGLQITAVTTSSVTSKQAEGLNIPLKSIDQVDFVDVTVDGADEVDSQFNGIKGGGGALLMEKVVATPSKEYIWVVDESKLVEKLGAFKLPVEVVQYGAEQVFRHFERAGYKPSFREKDGQRFVTDMQNFIIDLALDVIENPIAFGQELDHVVGVVEHGLFNQMVDKVIVAGRDGVQISTSKKGK

SEQ ID NO: 77971 - protein, 193 aa, Solanum peruvianum
FVFAGVGSAIAYGKLTTNAALDPAGLVAIAVCHGFALFVAVSISANISGGHVNPAVTCGLTFGGHITFITGSFYMLAQLTGAAVACFLLKFVTGGCAIPTHGVGAGVSILEGLIMEIIITFGLVYTVFATAADPKKGSLGTIAPIAIGLIVGANILAAGPFSGGSMNPARSFGPAMVSGNFEGFWIYWIGPLV

SEQ ID NO: 77972 - protein, 176 aa, Physcomitrella patens subsp. patens
MASIVVTPAAFAAASSGLSTSQSTSAKAFTGLKSATLFPSKAQTLSSVQNGSRVQCMQVWNPIGQTKFETFSYLPPLSDDAIAKQVEYMIQQKLIPCLEFDNSNGVSRVNNSSPGYYDGRYWTMWKLPMFGCQDSAQVLREIEECKKTFPGCYVRVLGFDNVKQVQICGFLVARPN

SEQ ID NO: 77973 - protein, 604 aa, Rhizobium leguminosarum bv. viciae 3841
MSASNAFFSETILLLGGAVVAAPIFKKLGLGTVLGYLAAGIVIGPVFHGITDGEQILAVAELGVVFLLFIIGLELKPTRLWQMRRDIFGLGSAQVVLTGLALTALAWFSQALDWRGSIVAGFGLALSSTAFAMQILEGDGDVNTRYGQRSFSMLLFQDLAIVPLLALITILDGGDKGSNAPLLDFAIAVGAVAAMIVMGRYLLTPLFQIIARTGAREAMIAAALFVVMGSASLMQLAGLSMAMGAFLSGVMLAESSYRHELEADIEPFRGVLLAIFFIAVGLSLELDVLADNALFVIVAVPIVMAVKAIIIYGLCRISGSPHNDAIRIAFLLPQGGEFGFVLFTAAGAVGLMSTSTASLLIAIVTLSMALTPIGAALSKRLLRGDEQEELDEDFEGAGADVLMVGFSRFGQIAAQILLAGGRSVTVIDFSADRIRQASSFGFRIYFGDGARKDVLRSAGIDRAKIVLVCTQKKEITDKVVELVQADYPHTRLYVRSYDRIHSIELRNKGVDYELRETLESGLLFGRRTLEALGVSEVDAYEIGEDIRKRDEARLVLQVSEGLQAGRDMLFSHPVRPEPLVKPKRAADPFEDDPLAGTADATADA

SEQ ID NO: 77974 - protein, 198 aa, Klebsiella oxytoca
AYFQQGNMESNGKYVDRNGNAVDYQTGPIIWGEPGTNGQHAFYQLIHQGTKMVPCDFIAPAITHNPLSDHHPKLLSNFFAQTEALAFGKSREVVEQEYRDQGKDPATLEHVVPFKVFEGNRPTNSILLREITPFSLGALIALYEHKIFTQGVIMNIFTFDQWGVELGKQLANRILPELKGGSEVSSHDSSTNGLINRY

SEQ ID NO: 77975 - protein, 313 aa, Cryptococcus neoformans var. neoformans JEC21
MDVSHVLDEYTASNTTAVLPRAAPVHTDPALLAAFDASPLDPAAYADRERHLLQLTLTSTHALVAALFALPTTPSSAGPVTAFPPPTTLLPREKPLPTPKAPTKWERFAKEKGISHRKKEKDVWDEERQEWVPRWGRFGKNKDKEDQWLHEVKPGDEADQDPGKTARGERKARIAQNTKQHSANLAVASASVTAARATAASERAARKEELNRNMLISKTSTASLGKFDNKIEGEPKARGMKRKFDANIPGGSEGTEKERQLSVLKRVERGETNKSKRGGEGVQGGLNVRKALRFSGEGGKLRPKTTGKKGKRK

SEQ ID NO: 77976 - protein, 935 aa, Rhodopirellula baltica SH 1
MIRPATKTLLVVLALSFEWSVGLDSLIGRTNQAIADTLPIDELPDDREVLFSRDVAPVLKKNCVACHNSSDDEGGVNLESGEQIRTSELDDLVLPGKPESSRLFLLASHADDPVMPPEDNDVSASILTPMELALLKRWIQSGAVVDQAPSTPIKREWQPLPSSLQTVYGSSMTDDGRLSAISFGNEIRLFGAKSAQPIETLAIVEGEVTKPAHDDFVQDLHIDSTGRQIISAGYRNVKLWEMSPFESATIPAINLDDTLAIAMNASGSHFAVLSRRGELSVAEVGKDRWLWMKSFDLPDHLKTEGLKTDNPTKIRIALDNAAQQAAIQWDSAIRIVRIDRKDVETFDAANTLTSMQWIEEDHLATATDKGQVLFWKRDEEVWTKTEHNVFEQAVLAIHSASESPGRLIAMDAAGNLANWNPTDQSFEATGQLPSPAVSASLSSNGATLWISTESGALGRYNIADQSYLEIAKKDPVAAAQLANDNWQTLVTETLVAAQEKDAKQAEDDVMAEQKNLESIAKDIETKTKLRDEKQARVEEAKQAAESAAKKLAEAEQALATKESELDAAVTALGQAEKIKVSGETRLKELEAERERHQQILAKLKQDHESRKATATASQSRHDSSRATDATFAVMLSGSRILTHAANTDDASEDSWSLWAESGDWLAELPELPTDGQLIASGDRCVLIQGTNGQTQAFVARPRLWSLRQTIGATTGPSPFADRVLSIDVHPSGKLLATGGGEPSRTGEWMLWKVSDGSLIRKIPNPHGDTVFCVRFSPDGQTLATGGADQMIKLWDVESGKLIKTLEGHTHHVTSIAWNANLRELATGSADATVKVWNIETGQATRTITGFKTEVTKLVFVGRENRLGVTSGDSVFRVYRTDNGARETNTKVAGDYLYALDSDRDGSQFIVGGASGTATLIDKSGKQSLEYSLGEE

SEQ ID NO: 77977 - protein, 499 aa, Legionella pneumophila str. Paris
MGYNVPHYIGGQLINETDTEAQAIYNPALGEIIGQVHFASKATCDRAVAIAKAAGNEWSQTPAIKRARVLFRFRELLEKYQMDLARIVTREHGKTLDDAKGSVARGIEVVELHCGLVNELKGDFSAEVASHIDCHTFRQPLGVCAGVSPFNFPVMVPIWMMIPAIACGNTFILKPSEQDPSAPVRLLELLSDAGLPPGVANCIQGNKTTVEHLLAHPDVAAFTAVASTPVAEYIYTTAAAYGKRAHTFGGAKNHCVVMPDADLDQAANAIVGAAYGSAGERCMALSVVVTVGQHTADALINKISPLIRAIRVDAGDVEGTDMGPLVSQAHRQRVLAAIEKGVNEGARLIIDGRTFQHPQYPQGFYLGPCLFDEVTEEMSVYQNEIFGPVLVIVRVNHFEEALALVNKHQYGNGTAIFTRDGFTAREYSQRVQAGLVGINIPIPVPIANHPFGGWKRSVFGDTNMHGEESIHFYTRRKTVTSKWPITELKDSSFAMPTHD

SEQ ID NO: 77978 - protein, 223 aa, Klebsiella pneumoniae
IWYNNFFGAETEAILPYDQYMHRFAAYFQQGNMESNGKYVDRNGHAVDYQTGPIIWGEPGTNGQHAFYQLIHQGTKMVPCDFIAPAITHNPLSDHHQKLLSNFFAQTEALAFGKSREVVEQEYRDQGKDPATLEHVVPFKVFEGNRPTNSILLREITPFSLGALIALYEHKIFTQGAILNIFTFDQWGVELGKQLANRILPELKDGSEVSSHDSSTNGLINRY

SEQ ID NO: 77979 - protein, 288 aa, Salmonella enterica subsp. enterica serovar Paratyphi B str.
MLKYDSTHGRFDGTVEVKDGHLIVNGKKIRVTAERDPANLKWDEVGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 77980 - protein, 223 aa, Klebsiella pneumoniae
IWYNNFFGAETEAILPYDQYMHRFAAYFQQGNMESNGKYVDRNGHAVDYQTGPIIWGEPGTNGQHAFYQLIHQGTKMVPCDFIAPAITHNPLSDHHPKLLSNFFAQTEALAFGKSREVVEQEYRDQGKDPATLEHVVPFKVFEGNRPTNSILLREITPFSLGALIALYEHKIFTQGAILNIFTFDQWGVELGKQLANRILPELKDGSEVSSHDSSTNGLINRY

SEQ ID NO: 77981 - protein, 245 aa, Wolbachia endosymbiont of Drosophila melanogaster
MIILSNLSCYAVFGIELEFYIEGIEKEYLFLNSIKNKIASLEFSCEKENSTHQYEIKSGCYTNSYNLIKHFELAKQSLTETAQKLGGNVSFKAKPYLDRAGSALNVHVNLVNSNNGNLFYINEQKYSDYLIHSIGGLCAMMKKHMLFFAPNDDSYLRFQYPDIHTPTTISWGVNNRTAAIRIPYFGNDSKRCRLEHRVPGTDCNLEKVLTAIIEGIVFGIENKIAPPNRVYGIASDPQYKMESLI

SEQ ID NO: 77982 - protein, 296 aa, Psychrobacter arcticus 273-4
MNEDTQGQSSITQPEPVEEQISVPEVLTTSDRDAEQYERRFKGTQTLYGTSAVDTFATAHVYVIGIGGVGSWAAEALARTAVGNITLIDLDILVASNVNRQLPALDSTFGQSKIEAMAARIREINPKVTLHLIDDFLTTENVATLLPSREEAKMAAQTTPIVILDCVDDMDAKLAIALHCRFNKLKLVCAGGAGGKIDPSQIRIGDLRDTYQDPLLAKLRNKLRHEKGINSALKEKFGIKCVYSTEPPRVDKSCQVGGLHCGGYGSAVVVTSVVAMLMVSEALQLLLKQAAVKPSL

SEQ ID NO: 77983 - protein, 298 aa, Ustilago maydis 521
MSRPEHLAPPEIFYNDTEAQKYTANTRVQTIQAEMTERAIELLMLPEHRKPALLLDIGCGSGLSGEIITEHGHEWIGFDISPSMLEVALEKETDGDLVLADAGQGCGFRAGSFDGAISISVLQWLCNADASSHNPAQRLASFFTTLYSSLSRGSRAVFQFYPESDDQVKFIMQFATRAGFGGGLVVDYPNSRKAKKFYLVLWVGGEMMIGPNGQSTKQELPQGLTHDHQDTTTTSHSVKYEKRRLDKDNSKRGSRKKKRSAETAKEYIVRKKELNRKRGKEDVPLDSRYTGRRRKGGF

SEQ ID NO: 77984 - protein, 230 aa, Camellia sinensis
MSPSQSPSVAQVQIESHVFPPTVKPPGTSKPFFLGGAGERGLEIQGKFIKFTAIGVYLEDSAIPSLAVKWKGKTAEELTDSVDFFRDIVSGPFEKFTQVTMILPLTGQQYSEKVTENCVAYWKAVGTYTDAEAKAIEKFIEVFKDETFPPGGSILFTQSPLGSLTIAFSKDGSLPETGTVVMENKQLSEAVLESIIGKHGVSPAAKKSLAARMSELLKEKPEAQTAAAAE

SEQ ID NO: 77985 - protein, 450 aa, Bacillus pumilus SAFR-032
MSLKQKGVAHALKEEQTLSWWQLSLIGVGCTIGTGFFLGSSIAITKSGFSVCISFLLAAVGTYLVFKHLAAMTADNPDKGSFCSYARKAYGRWAGFSNGWVYWFAEMLITGSQLTAISLFTRHWFPSVPLWVFSAIYSALALLVIIIGLSSFQKTENVLAVLKTAAIFLFMILAVLVLFGILTDHKPTLHLPNKDHEWMPLGALGLWNGLIYAFYAFGGIEVMGLMAVHLKDPKDAAKSGRVMLIILAVIYIVSIGLALLLVPVTAFNENSSPFITSLDPFHLSIFLHIFNGIFIIAGFSTLVASLYAVTTLLGTMSEHQDAPACFKQKDPSHVGWPSIILTAAGLIVSILLALFLSKHIYEHLTTAAGLTLLYTWVFILFSSKKLSKPSTRQTCEMFLALLLIGAAISGTLTEASGRPGFFISLGIIAVIAVMVLFMRKKWKQQDQTAS

SEQ ID NO: 77986 - protein, 213 aa, Psychrobacter arcticus 273-4
MRGVNKVIIIGNLGADPEARQFNNGGSVTNISVATSEQWTDKQSGEKREATEWHRISLFNRLGEIAAQYLRKGSKVYIEGSLRTRKYQDPNGQDRYITEIRAEQMQMLDGATGGSGDGSGFASNNQQGGYGNQGGGFSNQGGQNDYGQQGGNQPAHQGGYNQGGGAAQGGHQNIFNNQKAPAQQKPFDQPTQAPAQSKPTAMLDGPVDDDIPF

SEQ ID NO: 77987 - protein, 186 aa, Leptospira interrogans serovar Lai str. 56601
MTTIFLLISWYFKVSFQSIQGIRMNQNSEFDIVTLIELAKRNKYERAVAGFHTLDRIERLELPKKIKARKLAVQAMFALASEEVQYQYFTKEERIQLDREANLTNESYSKFNGLFEAPQAPIAEEDTEEDFIPEEAPRPILDGEDDEDEDSLDEDDDDDEDEDEDDDNEDEDDFDEDEEDSEKEED

SEQ ID NO: 77988 - protein, 597 aa, Nocardioides sp. JS614
MATEVNLPALGESVTEGTVTRWLKQVGDSVAVDEPLLEVSTDKVDTEIPSPIAGTLLEIRANEDDTVEVGAVLAVIGDAGESSGDSGGAQAEAQPDPEPEPEAQPEPEPAQEQAQQEAQQPAAEQPAPAAEAKPSGGSGTAVTLPALGESVTEGTVTRWLKSVGDEVAVDEPLLEVSTDKVDTEIPSPVAGTLLEIKVAEDETVEVGAELAVIGSGQAAPAESKPEPTPEPEPEPTPEPEPEPEAAPEPEPAPAPQEQAAPPAPAPAAAAQPTAQPAAQPVASGDGPGYVTPLVRKMAAQHGVDLASVTGTGVGGRIRKQDVLDAAKAQQQAQQQAQQPAQAAPAAPAAPSAPVSSGAPSPLRGTTVKMSRLRKIIATRMVDSLQTSAQLTQVVEVDVTNIARLRDEAKADFLSREGVKLSYLPFFAKAAIDALKHHPALNATIDTEAGEVTYYDRENLAIAVDTEKGLITPVIKDAGDLSIAGLAKKIADVAQRTRTNKIGPDELSGGTFTITNLGSVGALWDTPIVNKPQVAILGPGAVVKRPVVIDDPNLGETIAVRYMVYLALTYDHQLVDGADAGRFLTDVKQRLESGQFEV

SEQ ID NO: 77989 - protein, 459 aa, Nocardioides sp. JS614
MADADFDVLILGAGSGGYACALRSAQLGLSVGLVEKSHLGGTCLHIGCIPTKALLHAAEVADQAREAETFGVRATLEGIDMAGVNAYKDGVVSRLFKGLTGLIKGRGITVIEGAGRLTGPRTVTVGETAYTGKHVVLASGSYARTLPGLEIDGERVITSDHALRLDRVPASVVVLGGGVIGCEFASVWRSFGADVTIVEALPRLVAVEDEASSKALERAFRKRGIVFRTGTPFQSVKHTDTGVAVTVEGGDVIEADLLLVAVGRGPVTEGLGYDEQGVTMDRGFVLTDERCRTNLDGVYAVGDIVPGPQLAHRGFQQGIFVAEDIAGLDPSPIDEAGIPRVTYSHPEVASVGLDEARAAETYGADGIETLTYDLGGNGKSQILKTQGFVKLIRRKDGPVVGVHMVGDRVGELIGEAQMIYNWEGYPEDVAPLVHAHPTQNEALGEAHLALAGKPLHAHS

SEQ ID NO: 77990 - protein, 432 aa, Leptospira interrogans serovar Lai str. 56601 [sequence omitted]

SEQ ID NO: 77991 - protein, 322 aa, Vibrio campbellii AND4
MSKIYEDNTLTIGNTPLVRLNKVSKGKVLAKIEARNPSFSVKCRIGANMIWEAEKAGTLKPGVELVEPTSGNTGVALAFVAAARGYKLTLTMPESMSLERRKLLKALGANLELTEAAKGMKGAIAKAEEIAAGNPDKYLLLQQFNNPANPEIHEKTTGPEIWEATDGEIDVFVAGVGTGGTITGTSRYIKGEKGKAITSVAVEPSESPVIAQALAGEEIQPAPHKIQGIGAGFIPGNLDLELLDRVEQVTSEEAIEMARRLMEEEGILAGISSGAAVVAANRIAELPEFAGKTIVTVLPSSGERYLSSALFAGIFTDKENQQ

SEQ ID NO: 77992 - protein, 447 aa, Physcomitrella patens subsp. patens
MEADEIRVVLERASELHGKFNEAIERALKSDFLQSSSGGILDSDFASALDGDEINGMESFNREFIKAAGKDGISNAEARTLGLIRDALEALEEQLQALQQSDYILYYKELDGLIRVCAASANRLSNLRIEVMYVRIETCNYDYPGLLLGALKNVLSVACAIESRVEVPGLLIWIIAKSKNSPLESLLGAFEMYSMQNHQRAEKDAVLAELEESRHLLLIKLKNHRGREWEVVREALAFAGEPVEERDDLLLPPYPRPVVDDSLAVNTQPSKQLSRTISLPKGRAVKKLILSERDQEVDKDVHRNKDISEAVKGKQDSQEQVIPEHQVHGEGVVTSAGGFMRGLGGRVGHALVHVAKAVFVVASVVAFLAFTEHNHRQVEQMPRPAPSATKPIFELESRVRAPSPLKCSPGKKRIVLEDGSEKCVVKERFELPFPREVESPDVLHGRG

SEQ ID NO: 77993 - protein, 501 aa, Burkholderia cepacia
MTPLERELALASFGPAAAHDPADDATPHAASAAADAAPRAPHNPHLAHWRTHLNGLAARSHRALPLRPCGRLTRAAGLVLEAIGLRLSVGAECTIELPPGSTLPHAEAEVVGFAGDRLFLMPTTDVAGVLPGARVWPRESAPVADPLAGAKRLPVGWEMLGRVVDASGRPLDGLGPLASKVDAPLSAPSINPLDREPIHHVLDVGVRAINALLTVGRGQRMGLFAGSGVGKSVLLGTMARYTSAEVIVIGLIGERGREVKEFIEQILGEDGLARSVVVAAPADVSPLLRMQGAAYATSLAEYFRDQGKHVLLLMDSLTRYAMAQREIALAIGEPPATKGYPPSVFAKLPALVERTGNGPEGGGSITAFYTVLTEGDDQQDPIADSARAILDGHIVLSRALAEAGHYPAIDIEASISRAMTALIDETHLDHVRQFKQMLSRYQRNRDLIAVGAYAPGRDAQLDRAIALYPRIEAFLQQGFRECAPFASSLTALDALFDAYGG

SEQ ID NO: 77994 - protein, 182 aa, Vitis vinifera
MGSTGLLFLFLLMSLLQLFHPQLVLVSGDYDLIQKTCRSTKYYDLCISSLKSDPNSPNADTKGLAMIMVGIGEANATAISSYLSSQLVGSANDSSMKKILKECVNRYNYSSDALQASLQALTMEAYDYAYVHVIAAADYPNACRNSFKRCPRLPYPPELGPREDVLKHLCDVVLGIIDLLDW

SEQ ID NO: 77995 - protein, 473 aa, Bacillus thuringiensis serovar konkukian str. 97-27
MQQPTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVITILAFVVLGGSALLGFISYDGKEAAPLFSNFVSEGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPTSFQKVNKRGIPITALVVTIAVAGLSLFTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYINKKRQKPMKVETTNETNNQTR

SEQ ID NO: 77996 - protein, 362 aa, Saccharomyces cerevisiae
MRSLNTLLLSLFVAMSSGAPLLKIREEKNSPLPSIKIFGTGGTIASKGSTSATTAGYSVGLTVNDLIEAVPSLAEKANLDYLQVSNVGSNSLNYTHLIPLYHGISEALASDDYAGAVVTHGTDTMEETAFFLDLTINSEKPVCIAGAMRPATATSADGPMNLYQAVSIAASEKSLGRGTMITLNDRIASGFWTTKMNANSLDTFRADEQGYLGYFSNDDVEFYYPPVKPNGWQFFDISNLTDPSEIPEVIILYSYQGLNPELIVKAVKDLGAKGIVLAGSGAGSWTATGSIVNEQLYEEYGIPIVHSRRTADGTVPPDDAPEYAIGSGYLNPQKSRILLQLCLYSGYGMDQIRSVFSGVYGG

SEQ ID NO: 77997 - protein, 273 aa, Nocardioides sp. JS614
MRFSQVDVFSSQPLRGNPVAVVHDADGVTDEQMAAFARWTNLSETTFLLAPTQAGADYRLRIWTPGGELPFAGHPTLGSAHAWLEAGGVPATDGELVQECGAGLVRLRRGTTLAFAAPPLIRSGPVDDADLDAIVRALRVRRDDLLEAAWIDNGPGWVGVLLADAETVLGLRPDWAAFGDRQIGVVGRHAADGPADVEVRAFCPDLGIPEDPVTGSLNAGIGQWLAGSRLPSAYVASQGTALLRAGRVHVVKEGQTVWVGGDTRTTISGSVDL

SEQ ID NO: 77998 - protein, 362 aa, Saccharomyces cerevisiae
MRSLNTLLLSLFVAMSSGAPLLKIREEKNSSLPSIKIFGTGGTIASKGSTSATTAGYSVGLTVNDLIEAVPSLAEKANLDYLQVSNVGSNSLNYTHLIPLYHGISEALASDDYAGAVVTHGTDTMEETAFFLDLTINSEKPVCIAGAMRPATATSADGPMNLYQAVSIAASEKSLGRGTMITLNDRIASGFWTTKMNANSLDTFRADEQGYLGYFSNDDVEFYYPPVKPNGWQFFDISNLTDLSEIPEVIILYSYQGLNPELIVKAVKDLGAKGIVLAGSGAGSWTATGSIVNEQLYEEYGIPIVHSRRTADGTVPPDDAPEYAIGSGYLNPQKSRILLQLCLYSGYGMDQIRSVFSGVYGG

SEQ ID NO: 77999 - protein, 906 aa, Bacteroides fragilis NCTC 9343
MDKKRVYTFGNGLAEGKAGMRNLLGGKGANLAEMNLIGVPVPPGFTITTDVCTEYYEMGQEKVVSLLKEEVEKAIANIENLMRSKFGDVENPLLVSVRSGARASMPGMMDTILNLGLNDEVVEGLTRKTGNARFAWDSYRRFVQMYGDVVLGMKPVNKEDQDPFEAIIEEVKHAKGVKLDNELEVEDLKELVKKFKAAVKAQTGKDFPTCAYEQLWGAICAVFNSWMNERAILYRKMEGIPDEWGTAVSVQAMVFGNMGDTSATGVCFSRDAATGEDLFNGEYLINAQGEDVVAGIRTPQQITKIGSQRWAQLAGVSEEERASKYPSMEEAMPEIYKQLDELQTKLENHYKDMQDMEFTVQEGKLWFLQTRNGKRTGAAMVKIAMDLFRQGMIDEKTALMRVEPNKLDELLHPVFDKSALKQAKVLTRGLPASPGAATGQIVFFADDAAEWHAAGKRVVMVRIETSPEDLAGMAVAEGILTARGGMTSHAAVVARGMGKCCVSGAGALNIDYKARTVEVDGVLLKEGDFISLNGSTGEVYQGKVETKAAELSGDFADLMKLADKYTRLQVRTNADTPHDAEVARNFGAVGIGLCRTEHMFFEGEKIKAMREMILAENAEGRRKALAKILPYQQADFKGIFKAMAGCPVTVRLLDPPLHEFVPHDLKGQQEMADTMGVSLQYIQQRVESLCEHNPMLGHRGCRLGNTYPEITQMQTRAILGAALELKKEGIETHPEIMVPLTGILYEFQQQESVIRAEADKLFEEVGDRIDFKVGTMIEIPRAALTADRIASSAEFFSFGTNDLTQMTFGYSRDDIASFLPVYLEKKILKVDPFQVLDQNGVGQLVRMATEKGRAIRPDLKCGICGEHGGEPSSVKFCHKVGLNYVSCSPFRVPIARLAAAQAAIEE

SEQ ID NO: 78000 - protein, 360 aa, Wolbachia endosymbiont of Drosophila melanogaster
MFIGNQSSNKVERAISEIRRGRPIVIYDESNYLLFAAAEALERDLFNQYKLTSSNVYVTLTSSKVKYISQNKEHNSKRLLVNNFDELLYLINCSKEDCIKELQCSKTIDECAIALLKFSELLPYALVADMTFENNHEMRNWCEKNDVIALDTSFINNFQENQDVYEVCKTSLFLKQTQEVNIISYRTESGGREHHAIIIGNPDKDDEPLVRIHSSCYTGDLLDSLSCDCRSQLHQAIQMIADSGSGIILYLMQDGRGIGLTNKLRAYSMQRGHNLDTVDANRILGFEDDERSFAVAAKMLKKLNINKIQLLTNNDRKLSELESSGIGVTKCLPLIVERNKYNDSYMETKFGKLGHRLRVF

SEQ ID NO: 78001 - protein, 284 aa, Bacillus sp. SG-1
MGIPEGVRLFAKLEYFNPGGSIKDRLGVKLIASAEQSGALQAGGTIIEPTAGNTGIGIALAAVGKGYKVIFVVPEKFSVEKQTLMRALGAEVVNTPTELGMKGAIQKAKELSQEIEGSYCPQQFDNPSNPETYFETLGPEIYSALNGKVDVFVAGGGTGGTFMGTARYLKEKNPSVKTVIVEPEGSILNGGESGPHKTEGIGMEFLPSYMDTNYFDEIYTIRDADAFRALKELALKEGLLVASSSGAAFVAALEEAKKAEKGTNIVTIFPDSSERYLSQGIYEE

SEQ ID NO: 78002 - protein, 291 aa, Arabidopsis halleri subsp. gemmifera
MTNNFQRALGEGGFGIVYHGHLNDSEEVAVKVELLLRVHHTNLVSLVGYCDERGHLALIYEYMSNVDLKHHLSGKHDVSILKWSTRLRIAIDAALGLEYLHIGCRPSMVYRDVKSTNILLDERFTAKIADFGLSRSFQLGDESHISTVVAGTPGYLDPETGRLAEMSDVYSFGIVLLEMMTNQRVIDQNREKRHITEWVALVLNRGDITKIMDPNLYGDYNSNSVWKALELAMSCANSSSEKRPSMSQVISVLKECLTSENLMRNKNHDMESDSSLELTKSFDTEVVPRAR

SEQ ID NO: 78003 - protein, 411 aa, Arabidopsis thaliana
VLDCCKTFEKPSPIQSHTWPFLLDGRDLIGIAKTGSGKTLAFGIPAIMHVLKKNKKIGGGSKKVNPTCLVLSPTRELAVQISDVLREAGEPCGLKSICVYGGSSKGPQISAIRSGVDIVIGTPGRLRDLIESNVLRLSDVSFVVLDEADRMLDMGFEEPVRFILSNTNKVRQMVMFSATWPLDVHKLAQEFMDPNPIKVIIGSVDLAANHDVMQIIEVLDERARDQRLIALLEKYHKSQKNRVLVFALYKVEAERLERFLQQRGWKAVSIHGNKAQSERTRSLSLFKEGSCPLLVATDVAARGLDIPDVEVVINYTFPLTTEDYVHRIGRTGRAGKKGVAHTFFTPLNKGLAGELVNVLREAGQVVPADLLKFGTHVKKKESKLYGAHFKEIAADAPKATKITFDNSDDEN

SEQ ID NO: 78004 - protein, 474 aa, Legionella pneumophila str. Paris
MLRRTKIVATLGPASKEPEILRSMLAAGVNVVRINFSHADSSALQLIALVRKIADELNHPVAVMADLQGPKIRVGRFQNKSITLIDGQNFTLDCMAPDTLGDINGVSVAYPNLASELSIGDHLLINDGLIELEVIEISGSKIHCKVVEGGVLTDLKGLNRKGGGLAARTLTEKDRNDLRTAIEAEVDYISLSFVKDAEDIRQARALMKDYGAKITPIIAKIERMEALDHLTDIIREADAIMVARGDLGVEVGAAEVPAIQKHIIEQTRLLDKVVITATQMMESMISNPQPTRAEVSDVANAILDGTDAVMLSAETASGLFPVKVITMVNKICLSAEKHASFFYHSDPETCHYQRADQAIAMATMHTANHFPIQAIITLTESGDTALWVSRHHSTVPIFAISANKRTIGRLSLVNNVFPIYIDFHQFNPEGLNQQILHELIKSGHLEKRGYVLLTRGTQIGMPGGTNCMEIIPVV

SEQ ID NO: 78005 - protein, 223 aa, Citrobacter freundii
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSREVVEQEYRDQGKDPATLDHVVPFKVFEGNRPTNSILLREITPFSLGALIALYEHKIFTQGAILNIFTFDQWGVELGKQLANRILPELNDDKEITSHDCSTNGLINRY

SEQ ID NO: 78006 - protein, 396 aa, Legionella pneumophila str. Paris
MNLIKMSDIDLSGKRVLIREDLNVPIKDGMITSDQRLQAALPTIKSALDNGAAVIVLSHLGRPEEGKYEKKFSLEPVADYLRKNLEYPVRFVKDYLSGVDVKPGELVVCENVRFNPGEKANDEALAKKLANLCDVFVMDAFGTAHRAQASTYGVAQYAPVAVAGPLLIRELEALNQVLKAPKKPIVAIVGGAKVSSKLSLLKQLVGMVDVLIPGGGIANTFLKAQGFEIGISLYEPDLLDEARHILILAKEKGCQIPLPTDVVVGKTFSETCPAFNKSLSNVAEDDMILDIGPETIRDYVDLIHEANTIIWNGPVGVFEFPQFAYGTRAIAIAIAESDAFSIAGGGDTLAAVDLYDLNQQISYISTGGGAFLECLEGKTLPAVAILQERAKHVKTN

SEQ ID NO: 78007 - protein, 330 aa, Legionella pneumophila str. Paris
MTIRVAINGYGRIGRCILRSIFEYNRQNEFEVVAINDLSGIDVTAHLTRYDSTHGPFRSDVSIEGNMLIVDGHGIQVIAERDPAKLPWKQLDIDIVFECTGFFTSRDAAMGHINAGAKKVLISAPAKGVDTTVVYGVNHSVIKASDVIVSNASCTTNCLAPVVKVLNDAIGIESGLVNTVHAYTKDQMLLDGSHKDLRRARSATQSIIPTKTGAAAAVGLVLPELAGKLDGFAMRVPVLNVSVVDLTFQAKRATSVEEVNDIMRKAKSRILQINEDPLVSCDFNHNPASAIFDTTETKVIGSLVKVVAWYDNEWGFSNRMIDTAHQMMNC

SEQ ID NO: 78008 - protein, 223 aa, Citrobacter freundii
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSREVVEQEYRDQGKDPATLEHVVPFKVFEGNRPTNSILLREITPFSLGALIALYEHKIFTQGAILNIFTFDQWGVELGKQLANRILPELNDDKEITSHDCSTNGLINRY

SEQ ID NO: 78009 - protein, 214 aa, Enterobacter cloacae
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSRDVVEQEYRDQGKDPATLDHVVPFKVFEGNRPTNSILLREITPFSLGALIALYEHKIFTQGAILNIFTFDQWGVELGKQLANRILPELGDDNAINSHDS

SEQ ID NO: 78010 - protein, 146 aa, Zea mays
MSRRGDWVYENNGGTCVAIAGADYCVVAADTRLSVGYNILTRDHSKICELADKCALASSGFQGDIKALHKNLAARELLYQHQHNKRMSCPAMAQLLSNTLYYKRFFPYYAFNVLGGLDSEGKGCVFTYDAVGVYERTGYSAQGTGS

SEQ ID NO: 78011 - protein, 574 aa, Vibrio campbellii AND4
MISGILASPGIAIGKALLLQEDEIVLNTNTISDDQVETEVARFFDARNKSAAQLETIKQKALETFGEEKEAIFEGHIMLLEDEELEEEILALIKNDKMTADHAIHSVIEEQACALESLDDEYLKERATDIRDIGSRFVKNALGINIVSLSDIDQEVILVAYDLTPSETAQINLDYVLGFACDIGGRTSHTSIMARSLELPAIVGTNDITKQVKNGDMLILDAMNNKVVINPSEAELEEAKAVKAAFLAEKEELAKLKDLHAETTDGHRVEVCGNIGTVKDCDGIIRNGGEGVGLYRTEFLFMDRDALPTEEEQYQAYKDVAEAMNGESVIIRTMDIGGDKDLPYMDLPKEMNPFLGWRAVRISLDRREILRDQLRGILRASAHGKLRIMFPMIISVEEIRELKKAIEEYKAELRAEGHAFDENIEIGVMVETPAAAAIAHHLAKEVSFFSIGTNDLTQYTLAVDRGNEMISHLYNPLSPAVLTVIKQVIDASHAEGKWTGMCGELAGDERATLLLLGMGLDEFSMSGISIPKVKKVIRNSNFAEVKAMAEEALSLPTAAEIEAVVEKFIAEKTQ

SEQ ID NO: 78012 - protein, 575 aa, Bordetella pertussis Tohama I
MASSPADTPHRSWLRWLPGLAVLKTYQAAWLPRDLAAGLVLTAMLVPVGIAYAEASGVPGVYGLYATIVPLLAYALFGPSRILVLGPDSALAAPILAVVLSVSEGDPMRAVATASLMAIVSGLFCIILGLLRLGFITELLSKPIRYGYMNGIALVVLASQLPKLFAIPTDDGGPLRELWQLAQAVLDGKTNGYSLAVGSATLVLILLLKRFKRLPGILIAVVLATLAVSLFGLDGRGVQVLGEIPQGLPGFTIPWLSNADLATIVLGGCAVALISFADTSVLSRTYAARTHTRVDPNQEMVGLGVANLATGFFQGFPVSSSASRTPVAEAAGSRTQLAGVVGALAVAALLLAAPNLLRHLPSSAMAAVVIAAAIGLFEFKDLRRIFRIQQWEFWLSMLCFAAVVAFGAIPGICLAVVVAVLEFLWDGWRPHFAVLGRVPDLRGYHDLKRYPHAALIDGLVLFRWDAPLFFANAELFQQRLLEAVQASPTPVRRVVVTAEPVTSVDVTSADMLRELSHHLAESGIALHFAEMKDPVRDKLKRFELSEVFGADRFHPTVESAVDDYLKRPPHGTIDP

SEQ ID NO: 78013 - protein, 318 aa, Musa acuminata AAA Group
MDSFPVIDMEKLLGRERGAAMEILRDACEKWGFFEILNHGISHDLMDEVEKVNKEQYNKCREQKFNEFANKALENADSEIDHLDWESTFFLRHLPVSNISEIPDLDDQYRKAMKEFAAAIEKLAERLLDLLGENLELEKGYLKKAFSNGSKGPTFGTKVSSYPPCPRPDLVKGLRAHTDAGGIILLFQDDQVSGLQFLKDGEWLDVPPMRHAIVVNLGDQLEVITNGKYKGVVHRVVAQTDGNRMSIASFYNPGSDAVIFPAPAPVEKEAEEKKEVYPRFVFEDYMKLYVGHKFQAKEPRFEAMKAMEAVATHPIATS

SEQ ID NO: 78014 - protein, 209 aa, Klebsiella oxytoca
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSREVVEQEYRDQGKDPATLEHVVPFKVFEGNRPTNSILLREITPFSLGALIALYEHKIFTQGVIMNIFTFDQWGVELGKQLANRILPELKDGSEV

SEQ ID NO: 78015 - protein, 483 aa, Bacillus thuringiensis serovar konkukian str. 97-27
MFQTIKNDWFSNVKGDVLSGIVVALALIPEAIAFSVIAGVDPTVGLYAAFCIAVTISFVGGRTGMISAATGAMALLMVTLVKDHGLQYLFATTILTGIVQIIFGVFKLSSFMKFVPKSVMSGFLNALGILVFTAQLPQFKNATWQMYALVALGLAIIYVFPRITTAVPSTLIAIIIVTSIAIMSGLQLKTVGDMGSLPKELPFFSIPDVPFTLETLGIILPYAVMLAIIGLLESLLTASVLDDMTHTESNKHKEARGQGIANIVAGFFGGMAGCAMIGQSVINIKSGGRGRLSTFVAGGFLIVLLFVLGDYVVHIPMAALVAVMIMVSIGTFDWNSVATIHKVPKGNAFVMIVTVVVVLITHNLGLGVVIGTVISAVLFAFNMAKIHVKHLYIENKKIYEIHGQLFFASTADFINAFSFNEDVKEIEMNFTHAHVWDDSAVASIDKVIMKYEQSGVKVSITGLNERSAKLVTNLATYNKRIAS

SEQ ID NO: 78016 - protein, 451 aa, Psychrobacter arcticus 273-4
MTKHYDYIAIGGGSGGIASINRAASYGKKCAIIEANQLGGTCVNLGCVPKKVMWYGAQVAEAIHKYAPDYGFDVEFKGFDFQKLVNSRQQYIENIHRSYDNNLAKNGVEVIKGFAKFVDTNTVEVNGELITADHILIATGGHPIRPDIKGTEHGIDSDGFFALNELPKRVAIVGAGYIAVEIAGVLNSLGAEVHQYVRQHSPLRSFDHSIVETLLIEMEQDGIQLHTNTTLTEVVKNDDGSLTLCTESGSLDTVDCLIWAIGRAPSTDNINLQVTGVETTEFGKIKVDKFQNTNVKGIYAVGDIIENSVDLTPVAIAAGRRLSERLFNNKPDEHLNYELIPTVVFTHPAIGTIGLSEIDAVNQFGKDNIKCYSSTFTPMYSAVTQHRQKCMMKLVCLGDDEKVIGLHGIGFGIDEMIQGFAVAIKMGATKADFDNTIAIHPTGAEEFVTMR

SEQ ID NO: 78017 - protein, 298 aa, Bacillus thuringiensis serovar konkukian str. 97-27
MPNIAVVGSISMDLVAVSKKRPKAGETVIGEAFHTIPGGKGANQAVAAARLGANVAMVGAVGDDNYGTVVKKNLENERVFIDYVVPVTDAATGIAHIVLAEEDNSIVVVQGANALVNESVVNRSKDLLIKADMVVLQLEIPLETVKYVLAICEEHKIPVMLNPAPAQVLSEDILEKATYITPNEHECRVVLDDFTSPIEDLLAKYPNKLLMTEGSNGVRFHNGTEIVHVPSIAVDVVDTTGAGDTFNGALAVALSEGETLQKAIRFANIAGGLSVTKLGAQGGMPTRDRVREVQVIVG

SEQ ID NO: 78018 - protein, 135 aa, Arabidopsis thaliana
MAWLSVLLHNTMFDTGSRIELVDHVSASYRWCAGILYWVTFLARDLASSDPEPRLYQAKVRLCGPTFCQIYIFRLRPTDEEIAAVQVDPPPPLYDDDPELPTILFTVTGPGSGYMSIPEVFFTRIPAEVEPVSSP

SEQ ID NO: 78019 - protein, 354 aa, Zea mays
MALSPTPTAVAAPPPEPGPEPAPSAELPLPDAIAAALPPDPYEQLEVARKITAVAVASRASRLELEAARLRQRLADRDRLAAELADRAAKLEQALRDADARLRSALDDNAKLAKERDSLAQTSKKLARDLAKLETFKRHLMQSLGDDNSQTHHQETVDIRTYEQSVAKANSWKDGLEKNSHPVSSLSDESVEADSVNQEVTTRPFEQKLTITHITPRLTSDPAPKLRTAATSPRRYSTAVSPKLASGATSPRLEGHMAMSPWLPSSKMSSAANSPPRGQSISGRGTRVDGKEFFRQARHRLSYEQFAAFLSNIKELNAHRQSREETLRKADEIFGAENMDLFRSFQGLLSRSLS

SEQ ID NO: 78020 - protein, 416 aa, Thermosynechococcus elongatus BP-1
MTIAPSRSLADLCRADFPILARQVHDRPLIYFDNAATSQKPLAVLNTLEDYYRRYNANVHRGVHTLSAEATTAYEGAREKVARFINAAHAEEIIYTRNASEAINLVAYSWGMNTLRDGDEIILTVMEHHSNLIPWQFVAQKTGARLKFVELTPEQTFDLNHYESLLSDRTRLVAVAHVSNTLGCLNPIPEIVRLAHAKGARVLVDACQSVPHLPIDVQQLGCDWLVASGHKMCAPTGIGFLWGRAELLRQMSPFLGGGEMIADVFLDHATYADIPHKFEAGTPAIAEAIALGAAVDYLSQWGMEHIHAYEQELTAYLFKRLQELPAVTVYGPKSGDRAALASFTVGEVHPHDLSTILDQSGIAIRAGHHCTQPLHRYLGVQSTARASLYFYNTRAEIDQFIAALGEAIAFFSDVFT

SEQ ID NO: 78021 - protein, 119 aa, Arabidopsis thaliana
MAWLSVLLHNTMFDTGSRIELVDHVSASYRWCAGILYWVTFLARDLASSDPEPRLYQAKVRLCGPTFCQIYIFRLRPTDEEIAAVQVDPPPPLYDDDPGGSFYSSLGFSMVTFFEVLFS

SEQ ID NO: 78022 - protein, 476 aa, Bacillus sp. SG-1
MNGGNVMRKPDPAKDIKMDEKPKVTNKEPQNVVQDEPAAEVKNEMPVKEQKNGEEITNPYQIAQQLIKRAAESLDLPEGVYNILKKPKRVMKVSIPVRRDNGEYVNFTGIRSQHIDILGPTKGGIRFHPEVSEDEVKALSMWMSLKSALVGLPFGGGKGGVIVNPKDLSERELEELSRGYIRELEPIIGPEKDVPAPDVNTNGQIMGWMLDEFDRLRGKDVSGFITGKPVIIGGSEGRIEATGRGVVINIMEAAKRLGLEMGKLSAVVQGFGNVGSITAKLLHEQGVKVMAVTDAGGGAYQPNGLDIVALIDYVNEHGTVKGFEGSQDITNEELFAADCDILVPAALENQITEETAPTIKAKIVAEAANGPTTPQGNEIMEEKGIFIIPDILCNSGGVTVSYFEWVQNAMHYFWKEEEVNEKLKEKMENAFDSVYRMKMEKNASMRESAYLVGVGRLAEAMKARGWIKNWSMPIEC

SEQ ID NO: 78023 - protein, 284 aa, Bacteroides fragilis NCTC 9343
MKKFIKGVRFTPSNYPDEIEDKIQKYRKQGYKLPPRKVLRTPEQIEGIRESAKINTALLNHIAENIREGMSTEEIDRLVYDFTTSHGAIPAPLNYEGFPKSVCTSINDVVCHGIPSSTEILKSGDIINVDVSTIYNGYFSDASRMFMIGEVSPEKQRLVQVTKECMEIGIAAAQPWARLGDVGAAIQEHAEKNGYSVVRDLCGHGVGIKFHEEPDVEHFGRRGTGMLILPGMTFTIEPMINMGTYEVFVDSADDWTVCTDDGLPSAQWENMILINETGNEILTY

SEQ ID NO: 78024 - protein, 202 aa, Nocardioides sp. JS614
MTEVAAKPSNWNVPNVLTTLRIVLVPFFGWALLVDGGDSILWRSVAWVVFVVAMVTDKIDGDLARKHNLVTNFGKIADPIADKAITGMAFVGLSIVGDIWWWVTIVVLLREWSVTLLRLSVLKKVVIAAADLGKLKTTFQAIALGSLCLPLRDPDLPDWAGVPGEVFFYAAQACLAVAVALTLWSGWEFFRGVWQQRHALRG

SEQ ID NO: 78025 - protein, 567 aa, Bacillus sp. SG-1
MDVRDILNHQKFERNDDQYKAVGDYGMTASATKEASDIGAEVLRNGGTAADAIVAMQFALAVSEPFNTGVGASGFIMYHHKSSGETKVFNGHSKAPESAHPELCYDDSGELIPFVERTMNESFVGIPGIMKALDTINKTYGTKELGELIDPSIDLAENGIEVNFLWDMALKLYGSRVGDSSREFFFPKGVPLVEGDLVRNEALAKTFRIFKEEGIDALYKGRIGQAIVDRLQSHNGHMSMSDLENYECQIQEPVIRNYRGFDVAVPAPPNGGGTNLLQILKIIEQFDLSGYDASSWEKYFILSEAMRLVFSDKLAYMSDPDFHNIPINGLLDPEYITERAKFIDFNGRNPDIDFGNPWKYDTSGMTPGAASQKRTEGGETTHFTAVDRWGNVAACTSSLEHYFGAGIMIEEYGFLLNNDLTDFKVEKNHINEMRGGKYPVSAKCPTIILKDGEPFITLGSPGGPTIVSSVAHVILNVLDFKMDLKEAIEHPRIYNSTAPEVWVEDDFEDGVKEKLKSLGIEILDDSMPIGNVQAIMIDSENNRLYGAADSTRPGKASGVWKDEAEKP

SEQ ID NO: 78026 - protein, 364 aa, Bartonella vinsonii subsp. berkhoffii
MLAVFLLKHCYMLRKCLLKRNMAFETLGISIAKSKLNLDQMMAHKKAVVTANTSGVSFLMKKNKVDTFFGTAKILAAGQIEVVARDGNKQTIATKNIIIATGSESSSIPGVNVEIDEKVVVSSTGALALEKVPTRMIIVGAGIIGSELSSVWSRLGAKVTIIEYLNKVLGSMDGEVSRQFQKIMEKQGIEYKTGVKVTAITQSGSGAQVSFEAVKGGESETLEADVVLIATGRSPYTEGLGLVETGVKVDERGFIDIDAYWQTNIPGIYAIGDVVKGPMLAHKAEEEGVAVAEILAGQKGHVNFDVIPSVVYTQPEIASVGKTEEELKAAGIDYNVGKFPFMANGRARAMQKSDGFVKILADKK

SEQ ID NO: 78027 - protein, 175 aa, Citrobacter freundii
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSRDVVEQEYRDQGKDPATLDHVVPFKVFEGNRPTNSILLREITPFSLGALIALYEHKIFTQ

SEQ ID NO: 78028 - protein, 120 aa, Citrobacter freundii
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSREVVE

SEQ ID NO: 78029 - protein, 312 aa, Pseudomonas aeruginosa
MTDTAKRPLYVPHAGPSLLEMPLLNKGSAFSTQERIDFNLQGLLPHNIETIEEQTERAYSQYNLCNTDLDRHIFLRSIQYNNETMFFRLLEEHLEEMMPIIYTPTVGQACQEFSKIYRTHRGLFISYPDRERIDDILRSATKNNVKIVVVTDSERNLGLGDQGIGGMGIPIASCPCTCGGISPAYTLPVVLDVGTNKPDLLNDPMYMAWRHERVSGAQYEEFVDLFIQAIKRCWPNVLLQFEDFAQTNAMPLLERYKDELCCFNDDIQGTAAVAVGTLLAACKAKGEKLSEQTVTFVGWPPPVAASPNRSSR

SEQ ID NO: 78030 - protein, 135 aa, Hafnia alvei
DRNGNPVTYQTGPIIWGEPGTNGQHAFYQLIHQGTKLVPCDFIAPAISHNALGDHHSKLLSNFFAQTEALAFGKSREEVEEEFAKAGKTAAEVAHIVPFKVFEGNRPTNSILLREITPYSLGLLIALYEHKIFTQ

SEQ ID NO: 78031 - protein, 324 aa, Mesorhizobium loti MAFF303099
MEKIILDCDPGHDDAIAILLAAGNPKIDLLGITTVSGNHNVENTTRNALSVCTAYGIKVPVAKGSPGPLIIDQVLAVEIHGDTGLDGPVLPPASFELDRRHAVDFIIDTVMAHEPKTVTLVPVGPYTNIALAVRKDPRIVERVKRVVAMGGSFTRGNITPAAEFNVYADPEAADVVFRAGWDVTMVGLDLTHQALATPDLQDRVRAVGGPMAKFILDIWAFIATTHGGLLQIEFPAIHDACCVAAMIDGSVFTTEKADIRVEIAGRWTKGMTVCNFEKMGGMRHFGGTASEQTDFRHTVAMKLDHAKFCDLIVDALERLTRQKA

SEQ ID NO: 78032 - protein, 185 aa, Zea mays
  misc_feature (176)..(176): Xaa can be any naturally occurring amino acid
MAGGDDLKLLGMWASPYVLRVKLALSLKGLSYEYVEEDLRDKSELLLKSNPVHSKVPVLIHNGKPVCESQVILQYIDEAFAGTGPSLLPADPYERAIARFWAAYIDDKMTPAWNKSTMGKTEEEKAEGKKQSLVALETLEGALRDCGKGKPFFGGDSVGYVDVVLGGMLRWVRAAXEMHGVKPFR

SEQ ID NO: 78033 - protein, 263 aa, Bacillus cereus E33L
MQEVWKDIDAHAKQWIRDAGEHLMASMKKALIIETKSNAADLVTNMDREIEQFLIGKIKETFPHHNILGEEGYGDEVTSSDGVVWLIDPIDGTMNFVHQKRNFAISIGIYENGIGKIGLIYDPVHDELYHALKGAGAFCNEVPIPLLQRGTVEQGVVALNAIWLTDNPLLNMESMMALVKKARGTRSYGCAALEMVYVATGRIDAYVTPRLSPWDFGGGQIIVEEVGGKVTTFSGTPLSIVEKSSVLVAKPGVYEEVLSFISK

SEQ ID NO: 78034 - protein, 160 aa, Glycine max
MKVRNKSGDSGGHGSEAKGPMGPVFSTFVYEEEYGSDSQMEAIHGFAREGDMANLLKCIENGVSMNLKDSEGRTPLHWAVDRGHLNVTELLVGKNADVNAKDNDGQTPLHYAVTCEREAIAEYLLKHNADIYSKDNDGSSPRDICESNWPCMQHVGGEVN

SEQ ID NO: 78035 - protein, 228 aa, marine gamma proteobacterium HTCC2080
MEDINVATNLHRVWRRIGEAEQLANRHSGSVSLLAVSKTKPDRYIRAAWEAGQRAFGENYAQEAEEKARRLDDLTIEWHFIGPIQSNKTRGLAETMAWVHSIDRLKIARRLSDQRPQHLPPLNLCLQVKLSDEPSKSGIAPSEIPALAAQITELPNLSLRGLMAIPAATSDYQQQRMAFKQLQTQLFELQKQHPEVDTLSMGMSGDLEAAVVEGSTLVRVGTDIFGAR

SEQ ID NO: 78036 - protein, 128 aa, Glycine max
GAYFFGFYFGRTPLIKLSPKKTWEGFIGASVATMIAAFTFANFLGRFQWLTCPRKDLATGWLQCDPDPIFKPDYIPLPGLISHWLPWKEIAVLPVQWDALWMGLFASIIAPFGGFFASGFKRAFKIKD

SEQ ID NO: 78037 - protein, 354 aa, Glycine max
MNAESPPGLLMSVSCLSDYDLLCGEDSSGILSGESPECSFSDIDSSPLPPSPPPSPTTEDCYSIASFIEHERNFVPGFEYLSRFQSRSLDANAREESVGWILKVHAYYGFQPLTAYLAVNYMDRFLDSRRLPETNGWPLQLVSVACLSLAAKMEEPLVPSLLDLQIEGAKYIFEPRTIRRMELLVLGVLDWRLRSVTPLCFLAFFACKVDSTGTFIRFLISRATEIIVSNIQEASFLAYWPSCIAAAAILTAANEIPNWSVVKPENAESWCEGLRKEKVIGCYQLMQELVINNNQRKLPTKVLPQLRVTTRTRMRSSTVSSFSSSSSSSTSFSLSCKRRKLNNRLWVDDKGNSE

SEQ ID NO: 78038 - protein, 275 aa, marine gamma proteobacterium HTCC2080
MTQLPQNIGFVGAGNMASAIIGGLLSAGYDSARLCAIDPSEAAQTKLHNLGISEVGGQPGPTFRTSELVIVAVKPQFMQAATEGIKKHLAPETVVMSVAAGISVSALKDQLSNSNAPVVRCMPNTPALVGAGASGLFASPEVTDRQRAGIDAVMGVVGTTVWLEKESHIDVVTAISGSGPAYFFAFMEAMIATGERMGLDHETASQLTLQTALGAAKLATQQSDPVNELRRNVTSPGGTTERALESFDQDNLEALVNRGMQACLARAQEMAKEFG

SEQ ID NO: 78039 - protein, 109 aa, Triticum aestivum
  misc_feature (19)..(19): Xaa can be any naturally occurring amino acid
  misc_feature (38)..(38): Xaa can be any naturally occurring amino acid
LPLPNPDLIQRLGTPNYMXPEHWRPNIRGPISYETDSXWGFAWSFLEMFSGVQTWCAKSPDEIYQSVVLKKEKPMFLYNLPTEVANVLSGCYELEVTHERWQRKIADIK

SEQ ID NO: 78040 - protein, 389 aa, Xanthomonas campestris pv. campestris str. ATCC 33913
MNFHEYQSKQLLAEYGIPVPAGKVASTPDEAVEVANSLGKGPWMVKAQIHAGGRGKAGGVKFCKTTDDVKAAADKMLGTKMSTYQTAGVELPVNLVLVTTAGEIVKELYLSILVDRGTKTITYIASSEGGVEIEQVAAETPELIHSLNVDFVEGVQGYHGRDFGFKLGLNAKQAGQFASIMVNLYRLFNDKDLALVEINPLAILDDGNLYALDGKFDSDDNAAFRQKALVAMRDKTQEDETEVTASELDINYVTMDGNIGCMVNGAGLAMATMDVIKLNGGEPANFLDVGGGANKQRVIEAFKLILSSDKVEGIFVNIFGGIVRCDMIAEGIIAAVKEVGVKVPVVVRLEGTNVEEGKQLLRDSGMAIIPADNINDGAKKVVEAVKNAA

SEQ ID NO: 78041 - protein, 271 aa, Haemophilus influenzae R2866
MQHKLIAFIGGGNMAQAIILGLLKQGYPAEQIIVNDPNEEKKAFFANLGVATSENNVESVIKAEVVLLAVKPQMMADVCLPLSAVDFSDKLLISIAAGISTERLNALIPSVKSIVRVMPNTPALVGEGMAGLFAPKNTSENHRTFAQDLLGAVGRTVWVDDETQMHAVTAASGSSPAYFFLMLEAMQQALIKMNIDEKTARELVQQSMLGAAKMVIENPQIALSTLRENVTSKGGTTAAALAVFDAQHLNQTIEQAMQACLSRSQEMETLF

SEQ ID NO: 78042 - protein, 233 aa, Klebsiella pneumoniae subsp. pneumoniae MGH 78578
MNDIAHNLAQVRDKISGAAARCGRAPEEVTLLAVSKTKPASAIEEAIAAGQRAFGENYVQEGVEKINHFQQAGVSGLQWHFIGPLQSNKSRLVAEHFDWCHTVDRLKIATRLNEQRPAHLPPLKVLIQINISDEQSKSGIPLEALDGLAAEIAELPHLELRGLMAIPAPESEYVRQFAVARQMAVAFARLKTRYPTVDTLSLGMSDDMEAAIAAGSTMVRIGTAIFGARDYSK

SEQ ID NO: 78043 - protein, 98 aa, Zea mays
  misc_feature (55)..(55): Xaa can be any naturally occurring amino acid
  misc_feature (58)..(58): Xaa can be any naturally occurring amino acid
EEADKDKNIKYVENASKAIDFRPMVSIKEQLKNDKDHESLLLWKEQILGVVDLNXLVXKLKPDIKIMSLSILSTRRIDILLSLAVDLNEIGVWFTLKE

SEQ ID NO: 78044 - protein, 646 aa, Clostridium tetani E88
MNLISVENLSKSYGEKSLINNISFSINEGDKIGIIGINGTGKSTLLKIIAGIESYDNGNIITKNNMVVEYLPQNPYFDENSNVIQQVFKGTSSIMKTIRDYENLLEEVELNPEDETLQKKLMDLTSKMDNLNLWQIESEAKAILTTFGITNFYEKVKNLSGGQKKRIALCSSLVNPCDLLILDEPTNHMDNEIISWLEEYLNKRKGALVMITHDRYFLDRVTNKIFEISKGQLYTYLGNYSIFLEKKIEREELERSSEAKRQNLLKRELQWIKRGAKARSTKQKARIDRFNKLSEENIDLDDNKVEISTSFTRLGKKVIELKDISISFGAKTLIKDFSYIVLPKDRIGIVGSNGLGKSTLVKILSGDLIPDKGTIEIGETVKIGYFSQEWKSVQNDLRVIEYIRETAEFITTSNGSKISASQMLERFLFTSEMQWSLINKLSGGEKRRLYLLKVLMEAPNVLLLDEPTNDLDTETLTILEDYLENFNGSVISVSHDRYFLDKIADKIFVFEGNGIIQKYTGNYSECWEKIKKIKEGDYEEFKKDLKKDNDNKNSNEGKNAKSRSKDKALKFSYKEKLEYEQIDEVIEGLEERIAKLDEEIAENTSNFQKLQELLNEKEDAEKLLEEKMERWTYLNELAEKIEEMKK

SEQ ID NO: 78045 - protein, 325 aa, Lentisphaera araneosa HTCC2155
MSAKFIGAGSPLVDVLGRVDDAFVDSVGGEKGGMIMVDHNEMDSIIDSLANPEVAPGGSASNTLIGLMKLGESGAFLGKVGRDQRGDYFVESFESAGGSAHAFKSCAFTPTGTCISLVTPDAQRTLRTHLGAAATLAVDEVSKADFENCTHAHLEGYMLFNYDLTIKTLHAAKEAGCTVSLDLAAFEVVQANAEVLGEILDQYIDMVFANEDEAKAWCGSEDPQVALDSLSKYCDVVAVKLGPEGAWVRKGEETVFVNSYKVEAVDTTGAGDLWASGFLYGLYNDYGLEKSAKLGAKTGSEVVQIMGAVIPEAGWDRIKTFLNEL

SEQ ID NO: 78046 - protein, 438 aa, Alkaliphilus metalliredigens QYMF
MVEFKFPDIGEGISEGILTKWMVKAGDNIKEGESLCEVETDKVTTELPSPATGLVNSLKGEEGDTIYVGDVIVKIDTGDHAEEESKNRTTSESNEKKLEKVEEEENAGVVGALEVSDEVMGASQEARGEKAVKGQSKKVLATPVARQMAYDLGIAIGTIKGTGPLGRVMKADIKVAHERKQQNGPLESQPKKSSMEPKEAQGQLSDKEERIKLSMLRKTIGKRMTESFYTAPHALCIDEVDVTDLVAYREEMKNHFVEEKEIKITYLPFMIKAVMLALKDYPRFNAQLDEENQMLILKKYYNIGIAVDTPEGLTVPVIKDVDQKGLMSLMEESVRLSQSAKDKSLKLNQLKGSTFTITNLGSLGVKSGMPIINYPEVAIIGIGQIEQKPVVVDNEVVIRWMMPLSLSFDHRVLDGGDVGRFLNQFKKYIKDIKGLLLR

SEQ ID NO: 78047 - protein, 565 aa, Myxococcus xanthus DK 1622
MRSESVALSRVVSEADVPPPPSRAARLRALATETFDVLIIGGGVTGAGSARDAALRGLKVALVERDDFASGTSSRSSRLIHGGLRYLEHGHLGLVFESSIERQRLLRLAPHLVRPLAFIWPVYAGARVPRWKLNAGLMLYDALSLFRNVKGYRRLNARQVHAAEPGLRTDHLKGGARYYDAATDDARLTLANAVGASEAGAVVLNHASVKALVLEQGQAHGATVVDHLTGEEVTVRARALVNATGPWSDEIRRLDAPNGASPAVRGSKGVHLAVPRERINHRDAFTLLSPKDGRVMFVLPADNFTIIGTTETSTRAHPAEVRASESDVAYLLESANAFFPEARLTRADVVSAWAGIRPLVASGYHGTQADAGSASREHAIDVSPSGVLAISGGKLTTYRVMARDVVDAVERRLGQPRRRSPTDVLPLPGGDIRALDAEFAAARTEVGDDATAVHLVRAYGSRWRRVWALTREDAALSRPLAEGLPYRAAEAAWGVTHELVHTLSDLLIRRLKVAFETRDQGQAAARVAAEVMAPRLGWDAAETQRQLDVYAADALRLFGVDPAEA

SEQ ID NO: 78048 - protein, 101 aa, Serratia plymuthica
DRNGNPVDYQTGPIIWGEPGTNGQHAFYQLIHQGTKLVPCDFIAPAISHNPLGDHHAKLLSNFFAQTEALAFGKSLETVEAEFAAQGKTPEQVKHVAPFKV

SEQ ID NO: 78049 - protein, 551 aa, Streptococcus pneumoniae TIGR4
MYQALYRKYRSQNFSQLVGQEVVAKTLKQAVEQEKISHAYLFSGPRGTGKTSVAKIFAKAMNCPNQVGGEPCNNCYICQAVTDGSLEDVIEMDAASNNGVDEIREIRDKSTYAPSLARYKVYIIDEVHMLSTGAFNALLKTLEEPTQNVVFILATTELHKIPATILSRVQRFEFKSIKTQDIKEHIHYILEKENISSEPEAVEIIARRAEGGMRDALSILDQALSLTQGNELTTAISEEITGTISLSALDDYVAALSQQDVPKALSCLNLLFDNGKSMTRFVTDLLHYLRDLLIVQTGGANTHHSSVFVENLALPQKNLFEMIRLATVSLADIKSSLQPKIYAEMMTVRLAEIKSEPALSGAVENEIATLRQEVARLKQELSNVGAVPKQVAPAPSRPATGKTVYRVDRNKVQSILQEAVENPDLARQNLIRLQNAWGEVIESLGGPDKALLVGSQPVAANEHHAILAFESNFNAGQTMKRDNLNTMFGNILSQAAGFSPEILAISMEEWKEVRAAFSAKAKSSQTEKEVEESLIPEGFEFLADKVKVEED

SEQ ID NO: 78050 - protein, 219 aa, Oryza sativa
MAESKLIYAMVARGTVVLAEHTAYAGNFRDIAAQCLQKLPAGDNRLTYTCDAHTFNFLIHQGYAYCVVATESSGRQIPLALLDMIKEDFNKRYAGGKAATAAANSLSRDFGPRLGEQMKYCMDHPEEVSKLAKVKAQVSEVKGIMMENIDKAIDRGQQIDVLVSRTEQLHDQAADFRQQGTRVRRKMWYQNMKIKLIVLGIIIALILIIILSVCHGFKC

SEQ ID NO: 78051 - protein, 210 aa, Mycobacterium smegmatis
MITAFARVDGHPVGVIANQPMVLSGAIDNEASDKAASFIRFCDSYNLPLVFVVDTPGAMPGVAEEKGGIIKRGGRFFNAIVEADVPKVTVIIRKAYGGGYAVMGSKQLSADLNFAWPTARIAVIGAEGAAQLLVKRFPDPNAPEVQKIRDDFIEGYNLNMATPWIAAERGYIDAVIQPHETRLLLRKSLRLLRDKQNGPKVQRKHGLLPL

SEQ ID NO: 78052 - protein, 486 aa, Zea mays
MAPPRISFLELCLSFLCFVVFYYFHMRSKRKKPFRAAGLAAGPPRSGMQFFVTADPANVRHVFTSNFANYPKGPEFEEIFDVLGGGIFNADGESWRRQRAKAQLLMSSAPFRALVSRYSRAKVDTALLPLLSHMAATGEAFDLQDVFLRLTFDTTTTLVFGVDPGCLSVGLPEVPFARAMDDAMGVLLLRHVVPMTWWKLARRLRIGHERKMAEAWRTIDQFVADTIAKRRAEKARHGNGQVSADLLSSYINDDEDEEGGVDAFLRDTTINLMLAGRDTTGSALSWFFYLLTRNPRVVGKIRQELECVKSKSSGSGGGMASFDPDELSRLTYLHAALCESLRLYPPVPQELKEAAAADVLPCGHEVRAGDKILVSLYAMGRMEEVWGSDCREFRPERWIPELEDGRRVVQVRYVPSYKFMSFNSGPRTCLGKDMAFVQLKAAAAAVVSNFDVEAVPGHVVEPKLSIILHMKNGFMATVKRRRQTFA

SEQ ID NO: 78053 - protein, 162 aa, Brassica rapa subsp. pekinensis
MAPIAVGDVVPDGSISFFDENDQLQTVSVHSLAAGKKVILFGVPGAFTPTCSMKHVPGFIEKAEELKSKGVDEIICFSVNDPFVMKAWGKTYPENKHVKFVADGSGEYTKLLGLELDLKDKGLGVRSRRFALLIDNLKVTVANVESGGEFTVSSADDILKAL

SEQ ID NO: 78054 - protein, 241 aa, Rickettsia conorii
MIDLTGKTSLITGASGGIGGAIARLLHKLGSHVIISGSNEEKLQSLGKVVKDNYTIEVCNLADKEECRNLISKASKLDILVCNAGITSDTLAIRMKDEDFDKVIDINLKANFILNREAIKKMIQNRYGRIINISSIVGISGNPGQANYCASKAGLIGMTKSLSYEVATRGITVNTVAPGFIKSDMTDKLNEKQREAIVQKIPLGTYGMPEDVAHAVAFLASDQASYITGQTIHVNGGMLMV

SEQ ID NO: 78055 - protein, 389 aa, Xylella fastidiosa 9a5c
MSRDLPVIRLKNAWRSSHPWLFQKLLEKPSVRLKPGTIVDVVGVDGEWVGRGFYNGHSRIAVRILETRQDVVVDEAWFVRRIAEAVGLRREVLKLDAVSDAWRVVHSEGDGLSGLVVDRYGDLLVVQFFAAGMFRHREWIYTALRQQFPGARFHSFADEHVQKQESFDFHSTIDTESVVITEHGVKFLVDPMGAHKTGFFADQRENRQWLSQGVAGKTVLDLCCNTGGFAVYAALRGAADVVGVDIDQDVIQIAKANAKLNSVRPKFLQADIFPYLRDAAVRGDQYDVVILDPAKMTRDRDQIINALKKYLDMNKLALGVVKKGGLFATFSCTGLISEEQFLEMLRRAAFYSGRTIQILKVAGAGPDHPFMAHVQESRYLKATFCRVLD

SEQ ID NO: 78056 - protein, 293 aa, Ustilago maydis 521
MTDRFAPLRDEKLTLGSSITMVDGYAMPRFGIGAWDMRGSECKQALLNAFDKAGYRHVDTARYYRNEADCGEAVRECSVPRSELFYTTKVYLNEMGGGSKTRLAVEDSLAKAGLDYLDLVLLHAPDGGKKFRLDSWDTLTELVQEGKVRSLGVSNFGPHHIQELIDSKPKVLPVCNQIECHPFFAQKEVRAASEAHSIIVQAYCPLARGHYYGDPTLKKVAAETGKTEAQVMLRWLVQHGIVALPKSSNLQRQVENAECLTFVLSDEQMKELDALDRGDKGWVEEQCQSQRCE

SEQ ID NO: 78057 - protein, 279 aa, Nicotiana tabacum
MGSSQAAVSFLTNVARAAFGLGISATVLNSSLYTVDGGQRAVLFDRFRGVIDDTVGEGTHFLVPWLQKPFIFDIRTRPHTFSSVSGTKDLQMVHLTLRVLSRPEVARLPAIFKTLGLEYDEKVLPSIGNEVLKAVVAQFNADQLLTERPQVSALVRESLIRRAKDFNIVLDDVAITHLSYGAEFSKAVEQKQVAQQEAERSKFVVMKAEQERRAAIIRAEGESESAKLISDATAAAGMGLIELRRIEASREVAATMAKTPNVAYLPKQGNMLLGLNASR

SEQ ID NO: 78058 - protein, 367 aa, Arabidopsis thaliana
MTADEYAKGITISGRLKNVDLALSLFHESANKTTSVYNALMGAYLCNGLSHHCEQLFLDFNSQQDGPSSSTPSVSTYNILISLYGRLIMVERMESVFLQLQQLNILPDSSTYNNLIAGYIYAWDWDKMEATFHSMKNGLVKPTLATYLLMLRGYANSGNLLRMEDMYQAVKRHVDRNEIKLIESMICAYYRSCHKDRIRKIKTLSKLIPKKSYKPWLYLLLMQVYAKDDNLHAMENFIDQAITKGLQIETDGIMRSIVASYFRCNAVDKLAKFVQRANSAGWKMSRSMFHGLMIMYGSQKRFKEMENVLSEMESFKISRSKKTLCILLRVYAATHGQEHKVNQVAGMMLKHGHDFQRPEASKRVMGK

SEQ ID NO: 78059 - protein, 463 aa, Bacillus thuringiensis serovar konkukian str. 97-27
MQHSNKSGTLNRGLKERHITLMSLGSAIGVGLFLGSASAIKLAGPSILLGYMIAGLVIFFIMRALGEMAIEQPVAGSFSKYAYDYLGPLAGYITGWNYWFLWVVTCMAEITAAGIYMQYWFPDIPRWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFWRILLFYVGALFVMMAIYPWNELGEKGSPFVLTFQQIGIAKAAGIINFVVLTAALSSCNGGLFSTGRMLYTLAQQKKAPERFGRLNKNGIPSQGIVATAIVLLIGVILNYLVPAKVFTWLTSISTFGAIWTWGIILVAQIKFRKSLPTQKRQKLSYKMPLYPLSSYFSLAFLVLVLGIMAYSEDTRIALIVGPIWLIGLAIVYYMKGFHKIDETPNSKIS

SEQ ID NO: 78060 - protein, 388 aa, Oryza sativa
MRHPGAGGGSGDAGFVRADQIDLKSLDEQLERHLGRPAERAASQHGGSGSRRGESARLGLGEEPPQAPHHQRRREDWEIDPAKLVIRGVIARGTFGTVHRGVYDGQDVAVKMLDWGEDGHRSEREISSLRAAFAQEVAVWHKLDHPNVTKFIGAIMGARDLNIQTEHGHFGMPSNICCVVVEYLAGGALKNFLIKNRRRKLAYKVVVQLALDLARGLSYLHSKKIVHRDVKTENMLLDKSRTVKIADFGVARIEASNPSDMTGETGTLGYMAPEVLNGHPYNRKCDVYRFGICLWEIYCCDMPYPDLSFSEVTSAVVRQNLRPEIPRCCPSSLANVMKRCWDANPDKRPAMAEVVSMLEAIDTSKGGGMIPTDQPQGCFSCFGRHRGP

SEQ ID NO: 78061 - protein, 221 aa, Zea mays
MGKEGVAAGPAAEGSKSRSECINSSNPYHECSDYCLRKIAEARQRLDDELPDSWKRPPEQRTVHPDCINASNPYHECSDYCFKRIADAKSPACGLEREERQPPADVFAAAGMSDAVEQHRPIDNDSDEQEGAGPDDGYPQMTEKQKKLFELRLKMNEARKANQQAMVAEKKRMEPRGESRGVSKQKWLDDRKKKIGKLLDSNGLDMKMAYMLDTQETARAK

SEQ ID NO: 78062 - protein, 457 aa, Alkaliphilus metalliredigens QYMF
MTYDVLVLGGGPGGYVAAIKAAHLGGKVALVENGYFGGVCLNWGCIPTKALLKNARVYQDVLMGDFYGIEGIDKSQLSINWPAMLKRKDRIVRQLVGGVKGLLKKNKVDVFDGFGTLIDANHIEVKGQQLEGKKLIIATGTSPMIPDIPGLEASMKAGNILTSKELLSIEALPKSVVILGGGVIAIEFATLLNALDVEVTVIQRSDRILKGVEEEMALTLSKDLIKRKVKIVTNSSVEKIEGTRVFTKINGEEEIFEGDKILLSLGTSPNVKGLEALSLDMDKKGIITNDKMETSITGVYAIGDVNGKYQLAHVASAEGIVAAENAMGGNEELNYNIVPSCIYSFPEIASVGLTEEEARQKDYDVVVSKFPLAANGKAMAEGENIGFVKIIADKKYGEILGTHIMAVHATDMISEAIVSMQLEGTAYDVAKAIHPHPTMSEIVMEAAHGIMDQPIHF

SEQ ID NO: 78063 - protein, 220 aa, Oryza sativa
EEEQPSKFSKCFFDLSIHHCRLSKPSRRPYRFRERHPFPCKTVFLRPEMVVKAIEKAIPIPRAQPIALDGPAREELKAMEAQKVEIDRTAALQVRRELWLGLAYLVVQTAGFMRLTFWELSWDVMEPICFYVTSMYFMAGYTFFLRTKKEPSFEGFFESRFAAKQKRLMHARDFDLRRYDELRRACGLPVVRTPTSPCRPSSSSSSSTQESHCHSYCHCQ

SEQ ID NO: 78064 - protein, 308 aa, Wolbachia endosymbiont of Drosophila melanogaster
MKIIIGNASKELGESVVNRLDVQPSSAWISKFTDGEVNVEVANDLYNQEVYIIQSLSPPVNDNLMELLLIIDAVNRLGAKRIVVIIPYYGYSRQDRIIKNNNVQSALSAKLVANLIQTAGASSVAVIDLHSSQIEGFFDVPITNLNCFEAFVDSIHTENLAIVAPDVGAIGRARAFAKTLEEKYKIGLNDKIIVVDKYREKAGTSQVMNIIGEVANKNCVIVDDIVDSGGTLCNAALALKGHGAKSVISCITHGVLSGSAVEKISSSSLDKLVITDTILHKFEKTGKIEVVSVVDILTHFIQGGKDAS

SEQ ID NO: 78065 - protein, 478 aa, Burkholderia vietnamiensis G4
MDITYDALHLFIDGEWIGASERETAPVINPATQIQIGRVPLATAADLDRALQAAVPAFDVWRNTVPAERARILKRAAELMRERAEHIATVMTLEEGKPLAESRDEVLRAADYFEWFAEEARRIDGRVVPSNRPGVQQLVKKQAIGPVAAFTPWNFPAITPARKLSAALAAGCSVIIKPGEESPATALALARALDDAGLPKGVLQVVFGVPDQVSTQLIASPVIRKVTFTGSVPIGRLLSARAAEGVKPITLELGGHGPVLVFNDADVEKAAVEGAANRFRGTGQVCISSTRFLIQREVYDEFVGHFVRATSALKVGNGMDAGTQVGPLANPRQLAKMEELIADAVERGATILAGGKRIEGEGYFFEPTVLADVPKDARVMHEEPFGPIAVLMRFDALADGLAEANRLPYGLSAYAFTSSARTAIDVADGLEAGMIGINQYRIVSTELPFGGMKESGHGSEGGTEGIEYYLTHKFISQA

SEQ ID NO: 78066 - protein, 203 aa, Shewanella sp. MR-7
MSIKYVATSKLPTPWGVFAMHGFEDTETGKEHVALTFGTLNSDAPVLGRIHSECLTGDALFSLRCDCGFQLQTAMQNIAETGSGFILYLRQEGRGIGLLNKIRAYELQDKGANTVEANEQLGFPADMRKYDMIQPMLEQIGVKHVRLMTNNPRKVKAMKEIGIEVVERVPLQVGKNRYNEAYLKTKSTELGHMMSEYHFTDEE

SEQ ID NO: 78067 - protein, 386 aa, Wolbachia endosymbiont strain TRS of Brugia malayi
MNIHEYQAKEILHKFNVPVPKGFVAMSAEEAETKINQLKSDVLVVKAQIHAGGRGKAGGVKLAKSAEEAQQFVKGMLGITLVTHQTGPNGQQVRRVYIEEGSSIKKEYYLSIVIDPKLSRPAFIFSSEGGMDIEEVAKNFPTKIVKLDIDYAADFASFDSRKLSNIFNLSPEQIEKITNVAKNIYDTFIATDANQIEINPLVETNSGDFIALDAKISFDDNALYRHPEIVELRDYDEEVKEEIEASKHGLSYIKMDGNIGCMVNGAGLAMATMDIIKYYGAEPANFLDVGGGASKETVTEAFKIILSDSNVKGILVNIFGGIMRCDIIASGIVEAAKGMSIKVPLVVRLSGTNFEKGKRILEESGLNIIAADELDEAAQKIVKEVE

SEQ ID NO: 78068 - protein, 571 aa, Alkaliphilus metalliredigens QYMF
MFKGTGASPGIAIGRALVYQEQELNIKKESVEGLEKELDKFQSSIKKSKVQLEYVKQEAMKKLGADKASIFEAHIMVLDDPELINQVKDKITNEKVSAEYAVNEVINSFITLFEGMDNEYMKERAADIRDVGNRILKNLLNVEIINLATLTDEVILVANDLTPSDTATMNKEKVLGFITNIGGRTSHTAIMAKSLEVPAIVGLKSITDEVKSGDLLIFDGGEGFGHINPDEQLLADFREKKQQYEFIRKELEKLKSEPSVSKDGRRVELGANIGTPKDVKGVLDNGGEGIGLYRTEFLYMNRDHMPSEEEQYEAYKEVLQKMEEKPVIIRTLDIGGDKELPYLNLPKELNPFLGYRAIRICLDQPEIFKVQLRALLRASVYGNLKIMYPMISSVEEVRAANEILQEVRGELDQKGIEYSKEIEVGIMVEIPATVVIGDMLIKEVDFFSIGTNDLIQYTTAVDRMNEKISHLYEPFHPAILRMIKMVIDHAHGGGKWAGMCGEMAGDPKIVPILLGLGLDEFSMSPISILQARKIIRGLSYSEMKKIAEKALNFPTAAEVKKFVAEEIDKIS

SEQ ID NO: 78069 - protein, 351 aa, Clostridium beijerinckii
MKGFAMLGINKLGWIEKERPVAGSYDAIVRPLAVSPCTSDIHTVFEGALGDRKNMILGHEAVGEVVEVGSEVKDFKPGDRVIVPCTTPDWRSLEVQAGFQQHSNGMLAGWKFSNFKDGVFGEYFHVNDADMNLAILPKDMPLENAVMITDMMTTGFHGAELADIQMGSSVVVIGIGAVGLMGIAGAKLRGAGRIIGVGSRPICVEAAKFYGATDILNYKNGHIVDQVMKLTNGKGVDRVIMAGGGSETLSQAVSMVKPGGIISNINYHGSGDALLIPRVEWGCGMAHKTIKGGLCPGGRLRAEMLRDMVVYNRVDLSKLVTHVYHGFDHIEEALLLMKDKPKDLIKAVVIL

SEQ ID NO: 78070 - protein, 511 aa, Rhodococcus sp. RHA1
MTDKLAEIDTEHAKALAGGGEKYTERHKKRGKLLARERIELLLDPDSPFLELCPLAAWGSDFPVGASTVVGIGVVEGVECLIVANDPTVRGGTSNPWTLRKGFRANDIARQNRLPVISLVESGGADLPTQKEVFIPGGRMFRDLTQLSAAGIPTIALVFGNSTAGGAYIPGMSDHVVMIKERSKVFLAGPPLVKMATGEESDDETLGGAEMHARKSGLADYFAVDEQDAIRIGRSIVKRLNWKKQGPAPRAEVIEPLEDPEELLGIVPADLKIPFDPREVVARIVDGSDFDEFKPMYGSSLVTGWAELHGYPVGILANARGVLFSEESQKATQFIQLANRSNTPLLFLHNTTGYMVGKEYEEGGMIKHGSMMINAVSNSTVPHISILLGASYGAGHYGMCGRAFDPRFLFAWPSSKSAVMGGAQLAGVISIVSRASAESRGQAFDEEADAGMRAMIENQIEAESVPMFLSGRLYDDGVIDPRDTRTVVGMCLSAIANAPIEGAENFGVFRM

SEQ ID NO: 78071 - protein, 140 aa, Salmonella enterica
PKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 78072 - protein, 263 aa, Calystegia sepium
MSFGQGKWSLQGMTALVTGGTRGIGYGIVEELAGFGAEVYICSRKQNEVDECVGKWREKGFKVAGSACDISSRTQREELIKNVAHHFNGKLNILVNNAGTILPKDATEFKAEDYTLIMGTNFEASFHLCQLAHPFLKASSMGTIVFNSSVAGIIPVFKTTLYAASKGAINQVTKNLACEWAKDNIRVNSVAPWVIRTKLVNDFDSESEGSEEIERMIRRTPISRPGEVGEVSSLVAFLCLPAASYITGQTICVDGGYTITGFP

SEQ ID NO: 78073 - protein, 408 aa, Streptococcus pneumoniae TIGR4
MLDVEAIRKDFPILDQIVNDEPLVYLDNAATTQKPLVVLKAINSYYEQDNANVHRGVHTLAERATASYEAARETIRKFINAGSTKEVLFTRGTTTSLNWVARFAEEILTEGDQVLISVMEHHSNIIPWQEACRKTGAELVYVYLKDGALDMEDLRAKLTDKVKFVSLAHASNVLGVVNPIKEITQLAHQVGAIMVVDGAQSTPHMKIDVQDLDLDFFAFSGHKMAGPTGIGVLYGKEKYLEQMSPVEFGGEMIDFVYEQFASWKELPWKFEAGTPNMAGAIGLATAVDYLEKIGMDAVEAHEQELIAYVYPKLQAIEGLTIYGSQDLAQRSGVIAFNLGDLHPHDLATALDYEGVAVRAGHHCAQPLLQYLEVPATARASFYIYNTKADCDKLVDALQKTKEFFNGTF

SEQ ID NO: 78074 - protein, 361 aa, Arabidopsis thaliana
MAPVTEVSPMINTLEVADDKMTNLSSSGKPPRNISAMRHCNSTAWLTDYEGDERFGAKSPEGVNSTFQPVFRSGSWSDKGPKQSMEDEFICVDDLTEYIGSSTGAFYGVFDGHGGVDAASFTKKNIMKLVMEDKHFPTSTKKATRSAFVKTDHALADASSLDRSSGTTALTALILDKTMLIANAGDSRAVLGKRGRAIELSKDHKPNCTSERLRIEKLGGVIYDGYLNGQLSVARALGDWHIKGTKGSLCPLSCEPELEEIVLTEEDEYLIMGCDGLWDVMSSQCAVTMVRRELMQHNDPERCSQALVKEALQRNSCDNLTVVVVCFSPEAPPRIEIPKSHKRRSISAEGLDLLKGVLNEL

SEQ ID NO: 78075 - protein, 340 aa, Alkaliphilus metalliredigens QYMF
MKKVVTLGEIMLRLSTPGYERFVQADGFDACYGGGEANVCVSLANYGLDARFVTKVPKHEIGQSAVNALRKFGVDTSYILRGGDRLGIYFLETGASQRASKVIYDRAHAAIAEANASEFNWKEIFAGVDWFHFTGITPALSDQAAEFTLEACKAAKEMGVTISVDINYRKKLWTPERAGEVMSKLMPYVDVCIGNEEDAEMVFGVHAADTDVTKGEINHAAYEEVAKQLIERFGFKYVASTLRESYSASDNGWSAVLYDGKKSYVSKKYDVRIVDRVGGGDSFASGLIYGLVTEMQLQDALEFAVAASALKHTISGDANLVSIDEVETLTKGDGSGRVQR

SEQ ID NO: 78076 - protein, 506 aa, Arabidopsis thaliana
MASISLLQVSVAILCFLILHYFLFKKPHGRYPRNWPVLRMLPAMLKALHRIYDYSVEILETSDLTFPFKGPRFTGMDMLLTVDPANIHHIMSSNFSNYIKGPEFQDVFDVLGDSFITTDSELWKNMRKSYQAMLHSQEFQRFSMSTMTSKLKYGLVPLLNHFAEEGTTLDLQSVFGRFTFDTIFILVTGSDPRSLSIEMPEDEFAKALDDVGEGILYRHFKPRFLWKLQNWIGFGQEKKLTEANATFDRVCAKYISAKREEIKRSQGTSNGGSQDLLTSFIKLDTTKYKLLNPSDDKFLRDNILAFILAGRDTTATALSWFFWLLSENPHVVAKIHQEININTDLSRTGNSQENVDKLVYLHGALCEAMRLYPPVSFGRKSPIKSDVLPSGHKVDANSKIIICLYALGRMRAVWGEDASQFKPERWISENGGIKHEPSFKFLSFNAGPRTCLGKHLAMTQMKIVAVEILRNYDIKVLQGQKIVPALGFILSMKHGLQITVTKRCSA

SEQ ID NO: 78077 - protein, 140 aa, Salmonella enterica
KPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 78078 - protein, 238 aa, Triticum aestivum
  misc_feature (219)..(219): Xaa can be any naturally occurring amino acid
MRMRVLPAFTFSSSTAAAPPPPTSDPPPPPPPPPPAAAPAAYAVYLNIYDISPINNYLYWFGLGIFHSAVQVHGMEFGYGAHEYATSGVFQVEPKSCPGFIFRRSVCMGTTNMSRAEVRAFLEDLAEDYHGDTYHLIVKNCNHFTADVCKRLTGKPTPGWVNRLARLGSVCNCVLPENIKVSAVRDETAHLEFSDDDLESDTSIIDSDIGDLDHLLTTXTSDVVPPKDKTLTPGRDNL

SEQ ID NO: 78079 - protein, 229 aa, Psychrobacter arcticus 273-4
MISPSKPYLIAPSILSADFAKLGEEVERVLASGADVIHFDVMDNHYVPNLTFGSMICKALRDYGIEAPIDVHLMVSPVDSMIEQFLEAGASIITFHPEASSHIDRSLQLIKDGGAECGLVLNPATPLHYLDYVMDKVDQILLMSVNPGYGGQSFIEGTLEKVRQVRQRIITSGREIRLEVDGGIKASNIRAIAEAGADMFVAGSAIFNQEDYKAAIDAMRTELALANRE

SEQ ID NO: 78080 - protein, 382 aa, Zea mays
QATGENAVRAPAEAKLKVAINGFGRIGRNFLRCWHGREDSPIDVVVVNDSGGVRNASHLLKYDSMLGTFKADVKIVDDTTISVDGKPITVVSSRDPLKLPWGELGIDIVIEGTGVFVDGPGAGKHIQAGAKKVIITAPAKGADIPTYVVGVNEGDYDHSVADIISNASCTTNCLAPFVKILDEEFGIVKGTMTTTHSYTGDQRLLDASHRDLRRARAAALNIVPTSTGAAKAVALVLPQLKGKLNGIALRVPTPNVSVVDLVINTVKTGITADDVNAAFRKAAAGPLQGILEVCDVPLVSVDFRCSDVSCTIDASLSMVMGDDMVKVVAWYDNEWGYSQRVVDLAHLVAAKWPGAAAAGSGDPLEDFCKDNPETDECKVYEA

SEQ ID NO: 78081 - protein, 592 aa, Arabidopsis thaliana
MATGVTHVFHKTCANNTYNIAHPSQTCDNILNHTYNFNIGGGRCAGCGEKIYDSLIYICNKCVLVPLRKGRFGSSYFHFNCAKYPPSEVIDVPQHHDHKLKLEMVKSCFSCATCGKDSDGYSYKCHECDLKFHVNCEKHPAEVTHFSHPLHPLKLVKVEPPAYTDKKCRLCGEKLANSEVFYHCSACNFSLDLQCIFYPPKQNPHDPNIHGHQLTLMPKSISFSCTSCGLKGDRSPYVCLPCDFTSHNDCSGFPWVININRHDHRVSRTSLIGVVNSVCGICRKNMDWSCGGYSCKRCPTSVFHTKCVTREDVWDGKEMKDEPEEEEDILPFKVIDENTIQHVSHKEHNLRLDKSGIFIEERICEACVYPIYHHSFYSCMSCSFILHESCAYLPLWKRHVVSNDRHKYKYWDYFIRCTACGLFSNGFRYEAMRASLDLRCASITEPFVHKSHPHPLFYTSPRGICIVCKKEAQHVLRCVEDDCEYIMDYKCALLPYEKETDPKTWFYTSKDCELTLHTNCVLGDFRGLKPRRKETIYVHDVSVYFVVVRNNSMSRPLCKQCKSRCIFPVILKTWNESSLRNEYYCSELCLYS

SEQ ID NO: 78082 - protein, 487 aa, Zea mays
  misc_feature (303)..(303): Xaa can be any naturally occurring amino acid
MPSSGITAVDAAAKGMKLERYASGGALLLRRATSAKLVSASSHLLFRATVLATLALVFLFTLHYPSLLSRSFHLSAGGGGGADDGARSSASHRSLLMSSASYGGAAWEKEVRRSARPSRDGGISVLVTGAAGFVGTHCSLALRARGDGVLGLDNFNSYYDPSLKRARQALLASRGVLVLDADINDAPLLERLFDVAAFTHVLHLAAQAGVRYAMEAPQTYVASNVAGLVSVLEVAAKHADPQPAVVWASSSSVYGLNTDAPFSEDHRTDRPASLYAATKKAGEAIAHAYNHIYGLSITGLRFXTVYGPWGRPDMAYFFFARSIVAGEPVTLFRAADGSDARRDFTYIDDVVKGCLGALDTAGKSTGSRSGRKSGPAPLRVYNLGNTSPVPVTRMVAILEKLLGRKANKRVVTMPSNGDVPFTHANVSHAAHDFGYRPTTSLEAGLRHFVDWFVSYYKLDAKIAKPAAADDDKPAKKKKKNKAMSASS

SEQ ID NO: 78083 - protein, 336 aa, Pseudomonas aeruginosa UCBPP-PA14
MAFNMHNRNLLSLMHHSTRELRYLLDLSRDLKRAKYTGTEQQHLQRKNIALIFEKTSTRTRCAFEVAAYDQGANVTYIDPNSSQIGHKESMKDTARVLGRMYDAIEYRGFKQEIVEELAKFAGVPVFNGLTDEYHPTQMLADVLTMREHSDKPLHDISYAYLGDARNNMGNSLLLIGAKLGMDVRIAAPKALWPHDEFVAQCKKFAEESGAKLTLTEDPKEAVKGVDFVHTDVWVSMGEPVEAWGERIKELLPYQVNMEIMKATGNPRAKFMHCLPAFHNSETKVGKQIAEQYPNLANGIEVTEDVFESPYNIAFEQAENRMHTIKAILVSTLADI

SEQ ID NO: 78084 - protein, 500 aa, Medicago sativa
FLHLRPTPSAKSKALRHLPNPPSPKPRLPFIGHLHLLKDKLLHYALIDLSKKHGPLFSLSFGSMPTVVASTPELFKLFLQTHEATSFNTRFQTSATRRLTYDNSVAMVPFGPYWRFVRKLIMNDLLNATTVNKLRPLRTQQIRKFLRVMAQSAEAQKPLDVTEELLKWTNSTISMMMLGEAEEIRDIAREVLKIFGEYSLTDFIWPLKYLKVGKYEKRIDDILNKFDPVVERVIKKRRGIVRRRENGEVVEGEASGVFLDTLLEFAEDETMEIKITKEQIKGLVVDLFSAGTDSTAVATEWALAELINNPRVLQKAREEVYSVVGKDRLVDEVDTQNLPYIRAIVKETFRMHPPLPVVKRKCTEECEINGYVIPEGALVLFNVWQVGRDPKYWDRPSEFRPERFLETGAEGEAGPLDLRGQHFQLLPFGSGRRMCPGVNLATSGMATLLASLIQCFDLQVLGPQGQILKGDDAKVSMEERAGLTVPRAHSLVCVPLARIG

SEQ ID NO: 78085 - protein, 293 aa, marine gamma proteobacterium HTCC2080
MSLNRDDATQVARVLTESLPYIQRFTGRTIVIKFGGNAMVDPELFETFARDVVLMKLVGMNPIIVHGGGPQIGALLDRLKIKSEFVEGMRVTDAPTMNVVEMVLGASVNKEIVDCIHRNGGRAVGLTGKDGELLKAQKLQLEHSGENLRDIGLVGEVTSVDTQVLNMLGDSDFIPVIAPIAGGADGKTYNINADLVAGKIAEVLHAEKLMLLTNVAGLLDQDGEVLTGLSTTEVDRLIADGVIQGGMLPKIRCALDAVKQGVKSAHIIDGRVPHAALLEIFTDEGIGTLISNK

SEQ ID NO: 78086 - protein, 192 aa, Bacillus cereus E33L
MSMTEICLVRHGQTDWNFQEIIQGREDIPLNEVGKKQASQSAAALQAEAWDVIISSPLIRAQETAKEIAGATGLQSILLDERFVERNFGEASGKPVSTVRELIAEGKVEGMEQDEEIVARCFAAVKDVAETHSGKRIIIVAHSHAIKAILHAIAPEDITFKTPLKNACISYVNENSGKWDVLKYNIAEHIHV

SEQ ID NO: 78087 - protein, 50 aa, Clostridium perfringens
TSSDGMTSNWAHIPYEVIDKVSRRIVNEVKGVNRIVYDVTSKPPATIEWE

SEQ ID NO: 78088 - protein, 500 aa, Medicago sativa
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMAPFGPYWKFVRKLIMNDLLNATTVNKLRPLRTQQIRKFLRVMAQGAEAQKPLDLTEELLKWTNSTTSMMMLGEAEEIRDIAREVLKIFGEYSLTDFIRPLKHLKVGKYEKRIDDILNKFDPVVERVIKKRREIVRRRKNGEVVEGEVSGVFLDTLLEFAEDETTEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDSKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIG

SEQ ID NO: 78089 - protein, 570 aa, Vitis vinifera
MAEPQQALSRTFPVKPKLKAKSKKPSKTPESKYWSSFKSHTIPNLISSITSLSFSPATPHHFAAAYSTSLTLFNSKTLEPISSISSFKDVVSCASFRSDGLLIAASDHSGLVQVFDVKTRTALRKLRGHTRPVRLVRYPRSDKLHLFSGGDDAVVKYWDVAAESGVVEFRGHKDYVRCGDGSPASSELFATGSYDHTVKVWDVRVSNSDAAMKINHGKPVEDVIFLPSGGLIATAGGNCVKIWDVIGGGKLLYSMENHNKTVTSICVGKIGRDGGEGSEQYRVLSVGLDGYMKVFDYSKFKITHSMRFPAPLLSIGFSPDCATRAIGTSNGVIYAGKRKVKGEVESGLREFPSLGLMEEPQRRVLRPSYFRYFHRSQGEKPSEGDYLITRPKKVKIAEHDKLLKKFRHKDAFVSALSGKNPENVVAVMEELVARKKLLKCVSNLDTEELGLLLAFLHRHSTVPRYAGLLMGLTKKVVQMRAEDIIASDVLKGHIRNLKRSVEEEVRIQQSLQEIQGRSWSMTSDIRPKVMKEFVTNEERKPTSLYGFKIDKKALNELPPNRKFCAIGNGK

SEQ ID NO: 78090 - protein, 617 aa, Triticum turgidum
MASWFETYHHPSKGKGKRRILRVQTRDTREQLCAHLCLLPLLLTAGENSYPVIVMIGTRVLAHSRVDPAIRWGAAAHGFVVIAPKKREAGQETSTSERKKTKRKWRRNFCGWTSHEAKEPSTSETKKTKRKWGRNFCGWTSHEAEEPLTSETKKTKRKWGRNFCGWTSHEAEEPSTSETKKKRKNGASSSEPDKKRWFKTKIWRKKKAKNKQLATLVKEISLPNSPKARAAAGEILRIGNHNIPSRVFTYSQLSDATNSFSQENLLGEGGFGRVYKGYIPETMEVISIPSPSFLFYVSLSWHLKMLCYIQQQHLPDVNYVIAVKQLDKDGLQGNREFLVEVLMLSLLHHPNLVTLLGYCTECDQKILVYEYMPLGSLQDHLLDLTPKSQPLSWHMRMKIAVDAARGLEYLHEVANPPVVYRDLKASNILLDGNLSAKLADFGLAKLGPVGDKTHVTTRVMGTYGYCAPEYAMSGKLTKMSDIYCFGVVFLELITGRRAIDTTKPTREQILVHWAAPLFKDKKKFTKMADPKLDSKYPLKGLYHALAISSMCLQEEASSRPLISDVVTALTFLADPNYDPPDDIEPLPITVPDFDRGISLGEPEEVKEKFEGKQVEDS

SEQ ID NO: 78091 - protein, 500 aa, Medicago sativa
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKLLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVIEGEVSGVFLDTLLEFAEDETTEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIG

SEQ ID NO: 78092 - protein, 179 aa, Triticum aestivum
  misc_feature (178)..(178): Xaa can be any naturally occurring amino acid
NPVLKGKKKREGKSQPHRLLHIASSPLPPPGSTMPSPDAATGEASTPLSTRVRAFKIHPNVVRNFLDHHIRVKDQAARCGGSSFSSKSKDAARMFGCVIGMKSGQTVEILDSLDLLLDPVSGTLCRALLEKKEHYEKFFPGSVVLGWYSSRTMAAEQDTDMQIHKALMDAEGRAFYIXL

SEQ ID NO: 78093 - protein, 362 aa, Oryza sativa Indica Group
MECWEKKPRNLGGSLPVPNVQDLAARPDHLTPTLLRRYLRPHHLPLPADDHHAMAMIPVVDFARLIDHHEEAAKLRHACEEWGFFQVINHGIADETVEEMKRDVMAFFNLPLADKAAFAQQPEWIEGYGQAFVTSEDQTLDWSDLYFLTTQPPSYRDLRFWPPETSSTFRRSMDRYSLETQRVATELLRAMARTLGLRDADKMTRLAAAQSMRMNYYPPCPAKERDRVLGVSPHSDAVGLTLLLQVSPVKGLQIRRGDDWIPVDPIPGALVANVGDVVEMVTNGRYKSIEHRVVVDAAQERVSVAAFHNATFGSTYGPLEEMVGGGEARYRSISVEDYVRLVVSSKLQGKNILDAVKIITTT

SEQ ID NO: 78094 - protein, 282 aa, Thermosynechococcus elongatus BP-1
MVRLGYLGPVGTYSEEAAQSYAQWHRGEALTLVPVTTIAGCLEALAAGELDLALVPSENSVEGSVNITLDSLWRLDTLHIQYAFIRPIVHAFIAQTTDLAEIEAVYSHPQALGQCQGWLQAYLPQARQCPVTSTAEGLQYVAQSDRVGAIASVRAAQLHHLPIIATEIQDIPDNCTRFWVVSRQQGEGWPQPGDTHTSIAFSLKANAPGALLKVLQLFSDRQINLSRIESRPSKRALGDYLFFVDLEVNGRPDVVADCLVALKEATDVLKVFGSYQFLDLGE

SEQ ID NO: 78095 - protein, 456 aa, Klebsiella pneumoniae subsp. pneumoniae MGH 78578
MSLFHSVSDLIGHTPLLQLHKLDTGPCSLFLKLENQNPGGSIKDRVALSMINEAERQGKLAPGGTIIEATAGNTGLGLALIAAQKNYRLILVVPDKMSREKIFHLRALGATVLLTRSDVNKGHPAYYQDYARRLADETPGAFYIDQFNNDANPLAHATSTAPELYQQLEGDIDAIVVGVGSGGTLGGLQAWFAEHSPKTEFILADPAGSILADQVDTGRYGETGSWLVEGIGEDFIPPLARLEGVHTAYRVSDREAFHTARQLLQVEGVLAGSSTGTLLSAALRYCRAQSRPKRVVTFACDSGNKYLSKMFNDDWMRQQGLIARPEQGDLSDFIALRHDEGATVTAAPDDTLAAVFTRMRLYDISQLPVLEDGRVVGIVDEWDLIRHVQGDRQRFSLPVSEAMSRHVETLDKHAPESELQAILDRGLVAVIADNARFLGLVTRSDVLTAWRNRVAQ

SEQ ID NO: 78096 - protein, 460 aa, Salmonella enterica subsp. enterica serovar Paratyphi A str.
MATGKIVQVIGAVVDVDFPQDAVPRVYDALEVQNGNEKLVLEVQQQLGGGIVRTIAMGSSDGLRRGLDVKDLEHPIEVPVGKATLGRIMNVLGEPVDMKGEIGEEERWAIHRAAPSYEELSNSQELLETGIKVIDLMCPFAKGGKVGLFGGAGVGKTVNMMELIRNIAIEHSGYSVFAGVGERTREGNDFYHEMTDSNVIDKVSLVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDTARGVQSILQRYQELKDIIAILGMDELSEEDKLVVARARKIQRFLSQPFFVAEVFTGSPGKYVSLKDTIRGFKGIMEGEYDHLPEQAFYMVGSIDEAVEKAKKL

SEQ ID NO: 78097 - protein, 693 aa, Chromobacterium violaceum ATCC 12472
MQTFFLAPTGFNAGLTSVTLGAIRSLEQAGLRVGFVKPIAQDTKDGEAERSTHFAQAICRLNPPQPISMERVEYLLSQGQVDQLMEEVVSLYQQAAQNVDAVIVEGLVPDQKQVFSTFLNTKIARNLQAQTILVSSVKELGAAEIAEQLEMNIQAFGSQAIAGYILNHVLPAVDRAELAREVRESGNLKKAGLPLLGVIPYQSELLAPRTQDVARYLNANVVHAGQQASRRVRNMVVAARTAPNIVNLLKPGALIITPGEREDVVMATSMAAMNGVPLAGLLLTCDSQPDPRIQQLCQQAFTGGLPVLATSLNSMETAGALNAMSHQVPSDDLERMEKVIEHVAEFLDVSSLKQSVGEPRELRLPPPAFRFQLMEKARKANKRIVLPEGNEPRTIQAAAICQEKGIARCVLLGNRAEILQVAETQGVTLPESVEILDPNEIRGRYVEPMVELRKGKGLNAPMALAQLEDTVVLGTMMLAMNEVDGLVSGAVHTTANTIRPALQLIKTAPGSSIVSSVFFMLMPEQVYVYGDCAVNPDPTAEQLADIAIQSADSAVAFGINPRVAMISYSTGSSGSGSDVEKVREATRIAQEKRPDLLIDGPMQYDAASVESVGRQKAPDSQVAGRATVFVFPDLNTGNTTYKAVQRSANVVSVGPMLQGLRKPVNDLSRGALVDDIVYTIALTALQAEQTPAS

SEQ ID NO: 78098 - protein, 143 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 78099 - protein, 368 aa, Oryza sativa Japonica Group
MGSTAADMAAAADEEACMYALQLASSSILPMTLKNAIELGLLETLQSAAVAGGGGKAALLTPAEVADKLPSKANPAAADMVDRMLRLLASYNVVRCEMEEGADGKLSRRYAAAPVCKWLTPNEDGVSMAALALMNQDKVLMESWYYLKDAVLDGGIPFNKAYGMTAFEYHGTDARFNRVFNEGMKNHSVIITKKLLDLYTGFDAASTVVDVGGGVGATVAAVVSRHPHIRGINYDLPHVISEAPPFPGVEHVGGDMFASVPRGGDAILMKWILHDWSDEHCARLLKNCYDALPEHGKVVVVECVLPESSDATAREQGVFHVDMIMLAHNPGGKERYEREFRELARAAGFTGFKATYIYANAWAIEFTK

SEQ ID NO: 78100 - protein, 160 aa, Glycine max
MHQAIPYRSWRPLHNPTTHFSPLPLIAHSHNDDDKMRNIVNNNNNNIHSSAGRMVLNMVSENAVIVIGRRGCCMSHVVKHLLLGLGVNPAVYEVEEKDEEGVAKQLEETVRSDGNTQQGKVQFPAVFIGGKLFGGLDRIMATHIYGELVPILKKAGALWL

SEQ ID NO: 78101 - protein, 141 aa, Salmonella enterica
PKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 78102 - protein, 402 aa, Clostridium tetani E88
MDPLNFILSLAIILLSTKLLGILAQRFHMPQVVGALLAGLILGPSCLAIVNKTATIAELSQLGVILLMFSAGLETDLEELKKCGKASFIIALLGLIISLIGGFLIAGIFNNPGKILTGDFHKVLENIFIGIILTATSVSITVETLQEMGKLKTASGTAILGAAIIDDILGIIALTIVTSLADSSVKLSFVLLKIVAFFIIAFFISFVFVSLFKNMWNKKGEARRVPILALGFCLIMAFAAERFFGVADITGAYVAGIIISRTPACEYIEKKIEVVSFLFLSPIFFANIGISTTIDHMNSTMIMFTIALTVIAIVTKIYGCKFGARICGYTKEESLQIGIGMVSRGEVALIIANIGASTNILESKFFAPVILMVIITTLITPVLLKLVYSKDVEHKNVLHKAS

SEQ ID NO: 78103 - protein, 129 aa, Salmonella enterica
NGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAM

SEQ ID NO: 78104 - protein, 600 aa, Cryptococcus neoformans var. neoformans JEC21
MLRTPFTLSSRSTDSVFKIRQSLSIVLSHASTKIISRGYITIPTTSTVASHRPTIQRFKMTIAVPARTLSSSQPLKRSTSPLPAITPAQNLLRLKAHLQNLPTPLLKHVHLSKIRREDPNLFFSVMRDELTELAPIVYTPTVGEACQKYSQIYSGPEGLYLNIEDKDRIPEILHQYASKLVAPPQILVVTDGSRILGLGDLGIGGMGISVGKLNLYVAGGGVNPHGCLPVVLDMGTNNEAVRNDPLYIGLKQPRVGLEEATEFMDAFMAAASEAFPKAVIQHEDFYSEAAFDFLARYKEKYRMFNDDIEGTGSVILAGFLAAAKHASEASGKPLRDHKVVFLGGGSAAVGVAKEMMNFFMMQGLTEDEARERFWLIDTKGLITSTRADVVSGKVASHKKFFIRNDTEGKEYPSLESVIEYVQPTALVGLSTTFGAFSESAVRRMAELNQSPIIFPLSNPTSKCELAFSDALEWTDGRVLFASGSPYAPQQFKGTFREPGQGNNFLVFPGIGFGALQAGCKRITTGMITASAIALSEALTPEEKQKGLLYPRLERIRAVSARVAAGVVKQAQEDGVDTNEKLRGLDIETLTEEMNKAQWWP

SEQ ID NO: 78105 - protein, 144 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDL

SEQ ID NO: 78106 - protein, 594 aa, Neisseria gonorrhoeae FA 1090
MALVELKVPDIGGHENVDIIAVEVNVGDTIAVDDTLITLETDKATMDVPAEVAGVIKEVKVKVGDKISEGGLIVVVEAEGAAAAPKAEAAAAPAQEAPKAAAPAPQAAQFGGAADAEYDVVVLGGGPGGYSAAFAAADEGLKVAIVERYKTLGGVCLNVGCIPSKALLHNAAVIDEVRHLAANGIKYPKPELDIDMLRAYKDGVVSRLTGGLAGMAKSRKVDVIQGDGQFLDPHHLEVSLTAGDAYEQAAPTGEKKIVAFKNCIIAAGSRVTKLPFIPEDPRIIDSSGALALKEVPGKLLIIGGGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASGRKITKANFPWAASGRAIANGCDNGFTKLIFDAETGRIIGGGIVGPNGGDMIGEVCLAIEMGCDAADIGKTIHPHPTLGESIGMAAEVALGVCTDLPPQKKK

SEQ ID NO: 78107 - protein, 517 aa, Cucurbita maxima
MAVATDPLGCMQKLVQMLQAPPYVAAAVQSSALLLTFFIGDWRKRRRSPLPLLPAIPGIPVLGNLLQLKEKKPHKTFAQWSETYGPIYSIKAGASTVIVLNSSDLAKEAMVTRYSSISSRKLSKALTILTADKCMVAMSDYNDFHKLVKRYILANVLGANAQKRLRQRRDTMIDNISRELFACVKDSSSESVNFRKIFESELFGLALKETFGRDMESLYVDGLGTTLLREDLFRTLVIDPMEGAIEVDWRDFFPYLRWIPNKGVEDRIRKMDFRRRVTMKSLMEEKKKQIAAGEDLNCYSEFLLSEAKSLTEEQISMLLWEIIIETSDTTLVVTEWAMYELAQNPKRQERLYQHIQSVCGSAKITEENLSQLPYLTAVFHETLRKYSPVSIVPLRYAHEDTQLGGYFIPAGSEVAVNIYACNMDKKQWESPEEWKPERFLDESYDPMDLYKTMAFGGGKRVCAGAPKAMLIACTTLGRLVQGFTWKLREGEEDKVDTLGLTARKLQPLHIVAKPRIN

SEQ ID NO: 78108 - protein, 143 aa, Salmonella enterica
FMPKPMFGDNGSGMHCHMSLAKNGTNLFSGDKYAGLSEQALHYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 78109 - protein, 529 aa, Neisseria gonorrhoeae FA 1090
MSIVEIKVPDIGGHENVDIIAVEVKAGDTIAVDDTLITLETDKATMDVPADAAGVVKEVKVKVGDKISEGGVILTVETGAAAAEAAPAAAAEAQPAPAAAGGATVQVAVPDIGGHTDVDVIAVEIKVGDTVAEDDTLITLETDKATMDVPCTAAGVVKAVFLKVGDKVSEGSAIIEVETAGSAAAAPAPAAQAAAPAAVPTSAAPAAVPTSASPAAAKIDEAAFAKAHAGPSARKLARELGVDLGQVKGSGLKGRIMGDDIKAFVKSVMQGGAAKPAAAGASLGGGLDLLPWPKVDFSKFGNVEVKELSRIKKISGQNLSRNWVVIPHVTVHEEADMTELEEFRKQLNKEWEREGVKLSPLAFIIKASVSALKAFPEFNASLDGDNLVLKNYFNIGFAADTPNGLVVPVIKDVDQKGLKQISQELTELSKKAREGKLKPQEMQGACFTISSLGGIGGTGFTPIVNAPEVAILGVCKSQIKPVWNGKEFAPRLMCPLSLSFDHRVIDGAAGMRFTVFLANLLKDFRRITL

SEQ ID NO: 78110 - protein, 187 aa, Oryza sativa
  misc_feature (174)..(174): Xaa can be any naturally occurring amino acid
GRVGCNFLLDEHDHAVLGDFGIPSLLFGLSLPNPDLIQRLGTPNYMAPEQWQPSIRGPISYETDSWGFAWSILEMLSGIQPWRGKSPDEVYQLVVLKKEKPIFPYNLPPAIENVLSGCFEYDFRDRPQMTDILDAFERMVSPALPSRTNWSFFKDKLQVGDKVRSRKLKNTCSXTTHGSPDGTIVGM

SEQ ID NO: 78111 - protein, 328 aa, Triticum aestivum
  misc_feature (16)..(16): Xaa can be any naturally occurring amino acid
  misc_feature (38)..(38): Xaa can be any naturally occurring amino acid
PRVRGRTHRIETTFPXLADPLGYVPKEEILCSTHASDXYAIKAIVVTQRENGRRDDRRYSRLKYLLDSWGIDKFRAEVEKYYGKKFEDFHPLPEWQFNSYLGWQEQGDGKLFYGVHVDNGRLGGQAKKTLREIIEKYSLDVSITPNQNLILCGVDQAWREPITAALAQAGLLEPKDVDLLNITSMACPALPLCPLAQTEAERGILPILKRIRAVFDKVGIKDEESVVVRITGCPNGCARPYMAEVGFVGDGPNSYQIWLGGTPNQTTLAETFMNKVKLQDIEKVLEPLFSYWNSTRQEGESFGSFTNRMGFEQLKEVVNKWEGSASAA

SEQ ID NO: 78112 - protein, 628 aa, Psychrobacter arcticus 273-4
MFAAAAGSPNLMLQATIFLGAALLFVPLGKRFGIATVLGYLITGLILGPSVLDVAGDAESLLHFSEFGVVMLLFIIGLELQPSRLWALRRSIFVLGGLQVGLTGVLLMGLLHQIFGLQLDTAFIVGFGLALSSTAFVLQILTEKQQLSSTHGREAFTILLFQDIAVIPLLAVIPFLSGVREQSYDLIYFGKVFAVFAGLIFASRYVVRPFFKFVASSGASELLTAVALFIVMGVSILMGQIGLSMALGAFLTGVLLADSEYRHELEASIEPFKGLLLGLFFMSVGMLTDVNLILAKPIFIIGCAMALMFIKFGVITAIAKLFGNRWPTSIRLGVTLAQGGEFAFVLFSVASAQNVLQPELANTLNLIVTISMALTPLAFLLLEKVGEPLFAKSKPSREYDTIPDHEHQVIIAGFGRVGQIIGRVLRMHNIEFTAIERSANRVDFVRKFGNQVYYGDPKNPEILRAAGIKKARIFILAIDDLERSITTAQYLRKNYPDLIILARARDRQHYYRLREVGVRHIWRETYLSSLDMSRESLQLLGISAEKARETVQTFRDYDDDLIERQQAIYDDEASMIESAQSAMAELESLFDEDIGKARKMDLSDFYEVLKSQAIPVDDENNSTTESKH

SEQ ID NO: 78113 - protein, 500 aa, Vicia villosa
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSLVAMVPFGPYWKFVRKLIMNDLLNATTVNKLRPLRTQQIRKFLRVMAQGAEAQKPLDLTEELLKWTNSTISMMMLGEAEEIRDIAREVLKIYGEYSLTDFIWPLKHLKVGKYEKRIDDILNKFDPVVERVIKKRREIVRRRKNGEVVEGEVSGVFLDTLLEFAEDETTEIKITKDHIKGLVVDFFSAGIDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRGMCPGVNLATSGMATLLASLIQCFDLQVLGPQGQILKGGDAKVSMEERAGLTVPRAHSLVCVPLARIG

SEQ ID NO: 78114 - protein, 500 aa, Lens culinaris
FLHLRPTPTAKSKALRHLPNPPSPKPRLPFIGHPHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQSAEAQKPLDVTEELLKWTNSTISMMMLGEAEEIRDIAREVLKIFGEYSLTDFIWPLKYLKVGKYEKRIDDILNKFDPVVERVIKKRREIVRRRKNGEVVEGEASGVFLDTLLEFAEDETMEIKITKEQIKGLVVDFFSAGTDSTAVATEWALAELINNPRVLQKAREEVYSVVGKDILVDEVDTQNLPYIRAIVKETFRMHPPLPVVKRKCTEECEINGHVIPEGALVLFNVWQVGRDPKYWDRPSEFRPERFLETGAEGEAGPLDLRGQHFQLLPFGSGRRMCPGVNLATSGMATLLASLIQCFDLQVLGPQGQILKGDDAKVSMEERAGLTVPRAHSLVCVPLARIG

SEQ ID NO: 78115 - protein, 314 aa, Zea mays
MGGGVMRTAAKVGIARGAAAVAAAKGGRFRHAAPAFATAPAATGSDAAPLVSASGGEVPPAAAQWAASWELDDWEFADCGDVAPAAVVAEREATAAAAKPRLVFAPPSREEAEEATTELRDAIGRAYFNESPVEVVKEQDKEFNKLATDAIIPSMPGHVVQAFTLLKSSTEAQSVVASLASDRNVWDAVLKNEKVMEFYKTHQTIQTSPNEAVTVELPGKLEDAASENTSSGELPAGSGPSFSDFVDNAKKTVMDVVHNITDFFKDLFDDSAKTQTGAGPSAAEKGPSTAEMAVGGSFMALAIAVILVVLFKRA

SEQ ID NO: 78116 - protein, 500 aa, Lens culinaris
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMVLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGCVTPEGALILFNVWQVGRDPKYWDRPSEFRPERFLETGAEGEARPLDLRGRHFQLLPFGSGRRMCPGVNLATSGMATLLASLIQCFDLQVLGPQGQILKGGDAKVSMEERAGLTVPRAHSLVCVPLARIG

SEQ ID NO: 78117 - protein, 522 aa, Vigna radiata
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAVATEWALAELINNPKVLEKAREEAYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIGVASKLLSK

SEQ ID NO: 78118 - protein, 521 aa, Vigna radiata
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRAMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIGVASKLLS

SEQ ID NO: 78119 - protein, 544 aa, Nocardioides sp. JS614
MDHPFAITLDVGSSRANKTGSWRTERPVYVHNQPPCNRACPAGEDIRTWLYDAEEGGDAYKRAWRRIMEVNPFPAVMGRVCYHPCETGCNRGQLDEAVGINSVERFLGDEAIRCGWQVTVDRPSSGLRVLVVGAGPSGLSAAYQLARLGHAVTVLESAPKPGGMMRYGIPEYRLPRAVLDAEIQRILDLGVRLQVGVTVTDLDATMREGRYDAAFLAVGAQLGKRAYLPAGAASHVVDAVALLHQLGEGERPMLGRRVAIYGGGNTAVDAARTAKRLGAEESLVVYRRTRDRMPAHEAEVREAEEEGVRFTWLSSITQVEEGSLTIERMELDETGFPQPTGVTEQLPADSLVLALGQDTDLRFLDGVAGIEVDHGVVSVDDQMMTGRPGIFAGGDMVPDQRSATVGIGHGRRAAMGVDAWLRDRTAPRPAEPAPAEFDALNTWYFADAPRAHRPLLEAVRRSSTFDEVVESLDADSALYEARRCMSCGNCFSCDNCFGVCPDNAITKTGDPDTPYLIDLDYCKGCGLCAAECPAGAIRMAPEEI

SEQ ID NO: 78120 - protein, 239 aa, Yarrowia lipolytica CLIB122
MHVVKEVCKAVEERIGELGKLRKPKVHTIHMNDYIYPGHDPKYNDHPRRFDIARLKKDVDELSVLNIEAGALEFSKTATYNESRHNLSNYVDTYHPNWPHVVLIEGYYALYDEDLRRLSSMMIFVDSDADIRLCRLVEKKADPSGSNLAEVLDDYFTHSRVEMSNFILSTKEHADVVLPRGAEPMGVKLVSVGLFNRLNQEVMSIIEGEPVEKQERLRIQSKWDLREEHLDQTRYVDLT

SEQ ID NO: 78121 - protein, 583 aa, Bradyrhizobium japonicum USDA 110
MPMAACICDIIKTRFPKNSERSFPGGTSRAPAGWTICPKAEIEMRAMLMPNLERVELDGPAASVGQRHEAVVTAFPNATEAGVEILRAGGNAIDAAVAAAWALCVCEPSASGLGGQTVLLVRFADDRIRIIDGHSRAPAAASLDTIKAGQQRRGYRSCTIPSTPATLDWAHRKYGVLSRETVMAPAIRIAEEGYPITPLQHRQARWVADDLRASPAGELFLQDGLPPEIGHMFRQPELAGTLRRLADFGTEDFYHGGIARQIAADMRAAGGLITEEDLASCGPPAQVEPVSTSYRGHRILSIPPPSGGLQLLFALNIIAQISATNSESSDDSWHEAIALASSAVFRERELRPLLPDDLIPQSRQGRLSEDYARQVADSILAPQSTKELATDSAEEPGDTTHLSVCDRDGIIVVLTQSIQSVFGAKVAHRDLGFLYNNYLCTCPRLSHPYELGPGCRPRSNMAPTLVLQGATGRPLLALGAAGSRRIISAILHVLSGVIDLGLDITDAVAAPRVHGLVGRKVWIERPAASNALLARLRARNRIPIVKSRLNFAMGSVNALQLMTDGSAKGAADPRRDGLVEVLS

SEQ ID NO: 78122 - protein, 199 aa, Rhodiola sachalinensis
VHVDAAYAGLNRYRVGDILRVTGFYNSAPQFHFVRRKNVLLSIDSDKTDESELQQAVENASSLLKNFHTSVVEYTSYADTKTIPGHYVIYWELLIKDSADSPTDDALNQCCLAMEESLNSVYRQGRVECNSIGPLEIRVVQSGTFEELMDYAISRGASINQYKVPRCVNYTPIMELLDARVVSSHFSPSLPHWSPERRR

SEQ ID NO: 78123 - protein, 308 aa, Thermosynechococcus elongatus BP-1
MSPRVLILGLGHWGQTLAYLFEQRGCTVSSWGRSQGALSAALFQDIHLLVSALPIKAVREVAAQVTRLHPPLGIILVSATKGLESETFATAADIWQTYCPHHDLVVLSGPNLASEIQQGLPAAAVVGGNLAATKQVQDCLGSPTFRLYSNEDRRGVEMGGIFKNVIAIACGVNDGLGLGVNARSALITRGLVEMVRVGTHWGGQVETFYGLSGLGDLLATCTSALSRNYQVGWHLAQGKSLSQALALTKGTAEGVNTARVLCTYAQQHQLDIPITAMVNAVLCGSLTPQAALHCLLERPFKPEVIPGQ

SEQ ID NO: 78124 - protein, 306 aa, Wolbachia endosymbiont of Drosophila ananassae
MNVPRVTKLDNGLRIITEQVRDIDSVALSIRVGVGSRAESAKQNGISHFLEHMAFKGTKTRTAFEIAKAFDDIGGVFNASTGRESTTYYAKVLKKDIKTGIDILIDILMNSTFPEDELEREKGVVIQEIFQTNDSPSDIVFDKYFEAAYKDQPFGRSILGTQDTVKSFTRGDLDNYINEHYFGENMLFAVAGNVEHEEVVALTKDFFSKIHSKKLKKSQNATSHTGGEYLEHRKLDQVHLLIGLPSVSRHDDKYHTFQVLDSILGSGMSSRLFQEVREKQGLAYSVYSFNSSYTDTGCFHFCWYRQ

SEQ ID NO: 78125 - protein, 481 aa, Burkholderia vietnamiensis G4
MANVTYTDTQLLIDGEWVDAASGKTIDVVNPATGKAIGKVAHAGIADLDRALAAAQRGFEAWRKVPAHERAATMRKAAALVRERADAIAQLMTQEQGKPLTEARIEVLSAADIIEWFADEGRRVYGRIVPPRNLGAQQMVVKEPVGPVAAFTPWNFPVNQVVRKLCAALATGCSFLVKAPEETPASPAALLRAFVDAGVPAGVVGLVYGDPAEISSYLIPHPVIRKVTFTGSTPVGKQLAALAGQHMKRATMELGGHAPVIVAEDADVALAVKAAGGAKFRNAGQVCISPTRFLVHNSIRDEFTRALVAHAQGLKIGNGLDEGTTLGALANPRRLTAMASVVENARKVGASIETGGERIGSEGNFFAPTVIANVPLEADVFNNEPFGPVAAIRGFDKLEDAISEANRLPFGLAGYAFTRSFANVHLLTQRLEVGMLWINQPATPWPEMPFGGVKDSGYGSEGGPEALEPYLVTKSVTVMAV

SEQ ID NO: 78126 - protein, 365 aa, Rickettsia conorii str. Malish 7
MTLKLGIVGLPNVGKSTLFNALTASQAADAANYPFCTIEPNSSKVLVPDARLHKLASLAGSGKIIPSYIEFVDIAGLVKGASKGEGLGNKFLSHIREVDAILHVLRCFEDEDITHVHNKVDPLHDLEIIETELILADIESVEKRLATSEKRLKSGDKAMAEQIELLKEVYKVLGEDKPARVLNEALRVDNLKQLQLITSKPVLYICNVLEKDAAIGNEFTKLVAERAKKENAKSVVISSKIEAEIALLESMEEKEEFLKFIGLDETGLNKVIKEGYNLLNLKSFFTIGPKEAHSWTFKDGTLAPAAAGIIHTDFEKGFIRAEVIGYKDYINLGSEAKAKEVGKMRLEGKEYKMQDGDIVHFRFNV

SEQ ID NO: 78127 - protein, 296 aa, Azoarcus sp. EbN1
MDYKTLEDYVGHTPLVRLKRIGAGRNNVILAKLEGNNPAGSVKDRPALSMIVQAEARGEIRPGDTLIEATSGNTGIALAMAAAMRGYQMILVMPENQSVERRQTMRAFGAELVLTPRDGGMEMARDVAERMRDEGRGIILDQFANPDNPLSHYEATGPEIWEQTDGRITHFVSSMGTTGTIMGCSRFLKERNPAVRIIGCQPDEGSQIPGIRKWPEAYLPKIYEKPRVDALENVSQADAEEMTRRLAREEGIFAGISSGGAMHVAVRIAAELENAVIVSIICDRGDRYLSTGVFPG

SEQ ID NO: 78128 - protein, 413 aa, Cucumis sativus
GDDVEDVRREVQIMHHLTGHPHIVELKEVYEDRHYVNLIMELCAGGELFDRIIAKGHYSECTAASLCRQIVTVVHNCHSMGVMHRDLKPENFLFLSADENSPLKATDFGLSVFFKPGDVFKDLVGSAYYVAPEVLRRRYGPEAAVWSAGVILYILLSGVPPFWAENDQGIFDAVLRGHIDFSSDPWPSISSGAKDLIRKLLHSDPKERLSAIEALNHPWMKEDGEASDKPLDIAVLTRMKQFRAMNKLKKVALKVIAENLSEEEIVGLKEMFKSMDTDNSGTITFEELKAGLPKLGTKLSESEVRQLMEAADVDGNGSIDYIEFITAAMHMNRVEREDHLFKAFEYFDKDKSGYITMEELETALKKYNMGDETTIKEIIAEVDTDNDGRINYDEVVAMMRKGNQELTTTSRQK

SEQ ID NO: 78129 - protein, 132 aa, Salmonella enterica
FGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAM

SEQ ID NO: 78130 - protein, 199 aa, Lentisphaera araneosa HTCC2155
MNPQNSHYVPMVVEQSANGERGYDIYSRLLKDRIVMLSTPVDDHVASLLVAQFLFLQAEDPKKDIQFFINSPGGSVTAGLMIYDTMQILSCDIQTVCIGQAASMGAVLLSAGTAGKRYCLPHSRVMIHQPSGGAGGTAADITIQAAEIKRLKKELYDILSHHTGKDYPTIEEDSDRDYFMSGEEAKAYGLVDHIMTKKA

SEQ ID NO: 78131 - protein, 464 aa, Zea mays
  misc_feature (150)..(150): Xaa can be any naturally occurring amino acid
  misc_feature (230)..(230): Xaa can be any naturally occurring amino acid
MERRHGFFAALREEVARGLSPARARRKPDATDLAAALSFTGVAGAGEMLAPLMEGPDPEPSDDGDGSGRRGAARGRKEGWGHWVRVQFARAPSSAVALRSDIRMLLGVMAAPLAPVRVCAAEPLPHLSVKDTPIETSSAQYILQQYLAAXSGGHKLLASLRSTYAMGKVRMVATEFETAGRLTKNRSAGRGGEPGRFVLWQMAPEMWYIELAVRGSKVHAGCNGKLVWRXPPWLGAHSAKGPVLPLRRALQGLDPLTAASMFARARCIGERKVNGEDCFILKLSTDPEILKARSEGHAEIIRHVTFGYFSQRTGLLVHIEDSHLTRIQSGAGGDAVYWETTISSSMEDYRPVDGIVVAHSGRSAVTLFRFGEVAMSHTKTRMEEVWSIEEVAFNVPGLSMDCFIPPTDIKSGSVGEAMELAHGERSRAGPPPPPPGCRAKVPALGKAEEGKVAWGGGTVLENQN

SEQ ID NO: 78132 - protein, 232 aa, Alkaliphilus metalliredigens QYMF
MKLISKSKALKVSCILLLVGALLSITACTNATPIDIDDNEDVENVELVGDAEEVENFEGQAKPLVTIEMETGGIIEIELYPEVAPNTVKNFVSLIENGHYDGLIFHRVIPGFMIQGGDPNGNGSGGPGYAIEGEFLSNQFENNLLHERGVISMARSQDPNSAGSQFFIMTEKASHLDGDYAGFGQVVTGMDVVDEIVHSKTGTQDKPVEDQKMQRVTVDTFDVNYEAPKIIQ

SEQ ID NO: 78133 - protein, 440 aa, Azoarcus sp. EbN1
MKITVVGTGYVGLVSGACLADVGNDVLCLDVDPAKIRILKGGGIPIHEPGLLEIVRRNVEAGRLFFTTDVERAARHGTIQFIAVGTPPDEDGSADLKYVVAAARNIGKHMDGYRVIVNKSTVPVGTGDCVREAIVAELAAREVDFPFSVVSNPEFLKEGAAVDDFMRPDRIIVGADDERAIDLMRELYGPFQRNREKMLMMDVRSAELTKYAANAMLATRISFMNELANLAETLGADIELVRQGIGSDPRIGWHFLYAGCGYGGSCFPKDVKALINTGHERGHDLLILNAVEVANEVQKLRLVDKVVARFGEDLSGCHFGLWGLAFKPNTDDMRDAPSRIIVAELLRRGATLVAYDPVAMDEARRIFGDEPRLAYAERPMEVLEGADALIIVTEWKEFRSPDFIRIKQTLRHAVVFDGRNMYEPSVMARVGLEYHGIGRR

SEQ ID NO: 78134 - protein, 459 aa, Escherichia coli K12
MNRLPSSASALACSAHALNLIEKRTLDHEEMKALNREVIEYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMRTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 78135 - protein, 125 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 78136 - protein, 346 aa, Acholeplasma multilocale
MGNKTTNDINIFGLSASKELTTAVCDYLNIEQKNIKTVRFADGEILVEALDSVRGKEIYIVQSTCSPVNENLMELLIAIDAFKRGSAEKINVVIPYFGYARQDRKAKGRQPITARLVADLIEKAGADRVITVDIHSAQSMGFFDIPMDNFQTSQTLADEIVDTIIENKLDRKNCILVSPDHGGLTRVHKVAEYTSQMTNGIAVIAKRRPEPNKAEVEFVLGDIEGKTCFIVDDMIDTGGTIINAAKALKENGAKGVYIFACHGLFNGPAKQRMDEAIAEGIVEGVVVTDTIEIPAEKQFKGLKVISVKHLIGDMIKASVLHESLTEVYFNKKNAILSKVEEFVKNN

SEQ ID NO: 78137 - protein, 133 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 78138 - protein, 144 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 78139 - protein, 140 aa, Brassica napus
  misc_feature (23)..(23): Xaa can be any naturally occurring amino acid
  misc_feature (25)..(26): Xaa can be any naturally occurring amino acid
  misc_feature (29)..(29): Xaa can be any naturally occurring amino acid
  misc_feature (36)..(36): Xaa can be any naturally occurring amino acid
  misc_feature (45)..(45): Xaa can be any naturally occurring amino acid
RLTPGSEMPNLELNLWDFNTKQXEXXLGXTLAGKPXAPKLEMVCXASQDMSENFLFCPMVNNDREPSGFWSLLSPDENRVHAPVESCPLSLSFSPVQQHTSVGPPPQSTTGFTMGSSMQPNMLDRPWMAVSAPFQQTHYL

SEQ ID NO: 78140 - protein, 436 aa, Zea mays
MPPSLFTPRFRFSSAPVPEPLLGLIDLGASRDLSGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 78141 - protein, 249 aa, Pyrococcus abyssi GE5
MMEKPEGLKLIDENGRRIDGRKKYELRPIKMEVGVLKNANGSAYIEWGKNKIIAAVYGPRELHPKHLQRPDRAILRVRYNMAPFSVEERKKPGPDRRSIEISKVIKGALEPALILEMFPRTAIDVFIEVLQADAGTRVAGITAASLALADAGIPMRDLVAACAAGKIEGEIVLDLNKEEDNYGEADVPVAIMPLKNDITLLQMDGYLTKDEFIEAVKLAIKGAKAVYQKQREALKEKYLKIAQEVEGSE

SEQ ID NO: 78142 - protein, 274 aa, Pyrococcus abyssi GE5
MSDNEIVAGIMRDHIINLLKEGKRIDDRGFEDYRPIEIEVGVIEKAEGSALVKLGSTQVLVGIKTSLGEPFPDTPNMGVMTTNVELVPLASPTFEPGPPDERAIELARVIDRGIRESKALNLEKMVIVPGKIVRVVFIDVHVLDHDGNLMDAIGIAAIAALLNARVPKVRYNEETGEVETLDETEPLPVEKIPVPVTFAKIGNILVVDPSLDEELVMDGKITITTDETGHISAVQKSEGGAFKLEEVMYAVETAFKKAEEIRKLILEAVEKAKQ

SEQ ID NO: 78143 - protein, 307 aa, Pseudomonas putida
MTGMPQVLALGEAMIEFNQSTKGAPNYLQGFGGDVSNFLIAASRQGASSGFVSAVGNDHFGQLLLDLWRAENVDTSTVRVDANAPTGVYFVSHGESGHRFDYLRAGSAASRYAVSDLPLDAIAAAQVVHLSGISLAIGVPACDASLAAIDHAKRHGVKVSFDTNLRLKLWPLARARAVMLEAIRATDICLPSWDDVTELTGLADKDAIVDFLLALGPKVVALKLGKEGAYVATPAERRVVAGRVVKAVDATGAGDCFGGAFIARIVAGDDPFAAARYANVAAALSTQGFGAVAPIPDRATVEKALAE

SEQ ID NO: 78144 - protein, 521 aa, Vigna radiata
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETTEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIGVASKLLS

SEQ ID NO: 78145 - protein, 411 aa, Pseudomonas aeruginosa UCBPP-PA14
MSQNFSFRQAAVIGAGTMGRGIVMCLANAGLDVQWLDSNPQMLNQALGAVADTYAHNVRQGRIGEEEAAARRARITPVQHLAAMREADLVIEAVYENLELKQSIFRELDAALKPSAVLASNTSYLDIDAIAAVTARPGQVLGLHFFSPAHIMRLLEIVRGAQTAPAVLEAALALGERMGKVSVVAGNCHGFIGNRMLEPYATEARLMLLEGALPYQVDRALQAFGFAMGPFRMYDVVGIDLEWRARELAGVGQDQPAVQVDNRLCELGRFGQKSGAGYYRYAPGSRQAEHDTEVDALVLRVAETLGYPRRDFVDEEILERCLLALVNEGAKILDEGIAARSADIDTVYLNGYGFPAAEGGPMAWADRLGAAELLQRLRFLEQRHGVRWKPASLVERLAAEGGAFADLQEAR

SEQ ID NO: 78146 - protein, 521 aa, Vigna radiata
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAEATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIGVASKLLS

SEQ ID NO: 78147 - protein, 521 aa, Trifolium pratense
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPIGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVDEGEVSGVFLDTLLEFAEDETTEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIGVASKLLS

SEQ ID NO: 78148 - protein, 354 aa, Nocardioides sp. JS614
MQALRLRAWKSDPVLEDVAVPEPGPDEVLVQVGGAGACHSDLHLMHEFEPGTLPWSPPFTLGHENAGWVHTVGTGVTGLEPGQPVAVVGAWGCGVCDRCRAGVETYCERPDLAPVPSGGGGLGLDGGMAEYLLVRGARHVVPLPEGLDPVTAAPLTDAGLTPYHAVRRSLAKLAPGATALVIGVGGLGHLGVQVLRAVTAARVIAVDPRSSALSLASKVGADATLTPGPATAAEVRELTHGVGADVVLDFVGSDDTLALAAQAVRQLGDLTVVGIAGGSLPFSFFGVPYECSVQTTYWGNRTELVEVLDLAARGLLTAHTTTFELAQAPEVYAELARGEIDGRAVVVPNRAYRP

SEQ ID NO: 78149 - protein, 399 aa, Arabidopsis thaliana
MASEGVSLPLIHDLKKGDCSGRLKCVDHACDSIVHPLHPIHSLRLLTKPGRDCDLCKREIKGLGYHCETCGFDVDLYCAMYPPPEECELHFHVDCVWHPTELKHPLEVNHPYHALHPLKLLTARFPDYSDGKCRLCGSKIDDRLFYHCSSCNFTLGLCCVLRPPQPSLLNLKAHDHQLTLLPRLDSFTCNACGLKGDRSPYICFQCGFMIHQDCLGPPRLININRHDHRVVRTSVLGVVNSVCGVCRQKVDWTCGGFSCQRCPDYVAHSKCATREDVWNGEELEGVPEEIEDIEPYVVIDDNTIQHFSHKEHYLRLHDNGLLCDDNKRCRPCTHPICLQSFYGCMDCDFILHKNCAGFLRMKWHVLHNERLTLVTTRVKTTELVYIQSVVSCVAFFLSS

SEQ ID NO: 78150 - protein, 521 aa, Pisum sativum
MLLELALGLFVLALFLHLRPTPSAKSKALRHLPNPPSPKPRLPFIGHLHLLKDKLLHYALIDLSKKHGPLFSLSFGSMPTVVASTPELFKLFLQAHEATSFSTRFQTSAVRRLTYDNSVAMVPFGPYWKFVRKLIMNDLLNATTVNELRPLRTQQIRKFLRVMAQSAEAQKPLDVTEELLKWTNSTISMMMLGEAEEIRDIAREVLKIFGEYSLTDFIWPLKYLKVGKYEKRIDDILNKFDPVVERVIKKRREIVRRRKNGEVVEGEASGVFLDTLLEFAEDETMEIKITKEQIKGLVVDFFSAGTDSTAVATEWALAELINNPRVLQKAREEVYSVVGKDRLVDEVDTQNLPYIRAIVKETFRMHPPLPVVKRKCTEECEINGYVIPEGALVLFNVWQVGKDPKYWDRPSEFRPERFLETGAEGEAGPLDLRGQHFQLLPFGSGRRMCPGVNLATSGMATLLASLIQCFDLQVLGPQGQILKGDDAKVSMEERAGLTVPRAHSLVCVPLARIGVASKLLS

SEQ ID NO: 78151 - protein, 139 aa, Bacillus thuringiensis serovar konkukian str. 97-27
MTRVRDVMSTHIVQCTPLDNVYEAAVKMKEESIGLIPVVENEQVVGLVTDRDLVVRGIAEKHPGSNKITNVMTTNIISVSPDDSIEKATELMAQHQIRRLPVVESDQLVGMLALGDLAIRESADDQAGFALSEISEHTE

SEQ ID NO: 78152 - protein, 407 aa, Geobacillus stearothermophilus
MGIIVQKFGGTSVGSIERIQHVANRVIEEVQKGNDVVVVVSAMGKTTDELVNLAKQISNHPSKREMDMLLSTGEQVSIALLAMSLHEKGYKAVSLTGWQAGITTEEMHGNARIMNIDTTRIRRCLDEGAIVIVAGFQGVTETGEITTLGRGGSDTTAVALAAALKAEKCDIYTDVTGVFTTDPRYVKTARKIKEISYDEMLELANLGAGVLHPRAVEFAKNYEVPLEVRSSMENERGTMVKEEVSMEQHLIVRGIAFEDQVTRVTVVGIEKYLQSVATIFTALANRGINVDIIIQNATNSETASVSFSIRTEDLPETLQVLQALEGADVHYESGLAKVSIVGSGMISNPGVAARVFEVLADQGIEIKMVSISEIKISTVIDEKYMVSAVEELHEAFGLAEEAAAVRS

SEQ ID NO: 78153 - protein, 482 aa, Hordeum vulgare
MAATVAVDNLNPKVLKCEYAVRGEIVIHAQRLQEQLKTQPGSLPFDEILYCNIGNPQSLGQQPVTFFREVLALCDHPDLLQREEIKTLFSADSISRAKQILAMIPGRATGAYSHSQGIKGLRDAIASGIASRDGFPANADDIFLTDGASPGVHLMMQLLIRNEKDGILVPIPQYPLYSASIALHGGALVPYYLNESTGWGLETSDVKKQLEDARSRGINVRALVVINPGNPTGQVLAEENQYDIVKFCKNEGLVLLADEVYQENIYVDNKKFHSFKKIVRSLGYGEEDLPLVSYQSVSKGYYGECGKRGGYFEITGFSAPVREQIYKIASVNLCSNITGQILASLVMNPPKASDESYASYKAEKDGILASLARRAKALEHAFNKLEGITCNEAEGAMYVFPQICLPQKAIEAAKAANKAPDAFYALRLLESTGIVVVPGSGFGQVPGTWHFRCTILPQEDKIPAVISRFTVFHEAFMSEYRD

SEQ ID NO: 78154 - protein, 468 aa, Escherichia coli
MSKQQIGVVGMAVMGRNLALNIESRGYTVSIFNRSREKTEEVIAENPEKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAESYSLLKGGLNLSNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPIPTFSAAVTYYDSYRAAVLPANLIQAQRDYFGAHTYKRIDKEGVFHTEWLD

SEQ ID NO: 78155 - protein, 396 aa, Zea mays
MPLTRVAADAFGVLTIALFALFAALGLFCIFQSVYFRCRIRRGPSFLPLGYFNGPWVTRIALILITIWWGVGEIVRLSFLKKKLFSSLTWQRNICDVYILSNLGFAEPGIFFAFAFLLHGSLQKRELGTLNQRWNWKTMAYLLVFCIPVFSVQAILVFVGPKFVREENHDLGRRKIAKYFIRTYTPVGDTSVCTYPLFGTLFLGLVDAFLMSYVSYVGLRVLSLVINKSLRRRVYLLMLSVLCFLPIRVLLLGFSVLLKPGHVAFEGIIFLSFLMMLSCTTVGILLLVYYPVADSLALRDIGQRDIAEMVPYDDYYYEGTSLVANQSFREIERNSDTSTKPGSISFRTMIREDQLQQDGTDEIGFSSRSGVHIGSPSGSSPSAAVPMLPLKEIPRY

SEQ ID NO: 78156 - protein, 1060 aa, Arabidopsis thaliana
MASSPLLATSLPQNQLSTTATARFRLPPPEKLAVLIDKSQSVDEVLQIHAAILRHNLLLHPRYPVLNLKLHRAYASHGKIRHSLALFHQTIDPDLFLFTAAINTASINGLKDQAFLLYVQLLSSEINPNEFTFSSLLKSCSTKSGKLIHTHVLKFGLGIDPYVATGLVDVYAKGGDVVSAQKVFDRMPERSLVSSTAMITCYAKQGNVEAARALFDSMCERDIVSWNVMIDGYAQHGFPNDALMLFQKLLAEGKPKPDEITVVAALSACSQIGALETGRWIHVFVKSSRIRLNVKVCTGLIDMYSKCGSLEEAVLVFNDTPRKDIVAWNAMIAGYAMHGYSQDALRLFNEMQGITGLQPTDITFIGTLQACAHAGLVNEGIRIFESMGQEYGIKPKIEHYGCLVSLLGRAGQLKRAYETIKNMNMDADSVLWSSVLGSCKLHGDFVLGKEIAEYLIGLNIKNSGIYVLLSNIYASVGDYEGVAKVRNLMKEKGIVKEPGISTIEIENKVHEFRAGDREHSKSKEIYTMLRKISERIKSHGYVPNTNTVLQDLEETEKEQSLQVHSERLAIAYGLISTKPGSPLKIFKNLRPNLPPSPAWSLPVIGHLRLLKPPIHRTFLSLSQSLNNAPIFSLRLGNRLVFVNSSHSIAEECFTKNDVVLANRPNFILAKHVAYDYTTMIAASYGDHWRNLRRIGSVEIFSNHRLNSFLSIRKDEIRRLVFRLSRNFSQEFVKVDMKSMLSDLTFNNILRMVAGKRYYGDGVEDDPEAKRVRQLIADVVACAGAGNAVDYLPVLRLVSDYETRVKKLAGRLDEFLQGLVDEKREAKEKGNTMIDHLLTLQESQPDYFTDRIIKGNMLALILAGTDTSAVTLEWALSNVLNHPDVLNKARDEIDRKIGLDRLMDESDISNLPYLQNIVSETLRLYPAAPMLLPHVASEDCKVAGYDMPRGTILLTNVWAIHRDPQLWDDPMSFKPERFEKEGEAQKLMPFGLGRRACPGSGLAHRLINLTLGSLIQCLEWEKIGEEVDMSEGKGVTMPKAKPLEAMCRARPSVVKIFNESV

SEQ ID NO: 78157 - protein, 309 aa, Salmonella enterica subsp. enterica serovar Paratyphi A str.
MKTAGNLIVLGSINADHILNLESFPTPGETVTGSHYQVAFGGKGANQAVAAGRSGANIAFIACTGDDDIGDSIRKQLVSDRIDIAPVSVIKGESTGVALIFVNGEGENVIGIHAGANAALSPALVDAQRERIAQADALLMQLESPLESVLAAAKIAHQHHTTVALNPAPARELPDELLALVDIITPNETEAEKLTGVRVENDDDAAKAAQVLHDKGIRTVLITLGSRGVWASVNGEGRRVPGFSVEAVDTIAAGDTFNGAFITAILEETPLPEAIRFAHAAAAIAVTRKGAQPSVPWREEIEAFLHQQG

SEQ ID NO: 78158 - protein, 201 aa, Burkholderia vietnamiensis G4
MRNILRLRPGQMALRSAVLPGAKQVVVIDHVPERLEMARQGGAVTIDFDEESVVECLNELTGGKGPEKCIDAVGMESHATRSIDALYDRVKQAVMLETDRPHVLREMIYVCRPAGILSISGVYGGLLDKIQFGAAMNKGPTFRMGQTHVNRRSADLLSRIERGQIDPSFVITHSVPLEQGPGMYETFRDKRDGCIKVVMKP

SEQ ID NO: 78159 - protein, 354 aa, Azoarcus sp. EbN1
MSDELLNLRKNIDRLDEEILVRLAERARHAQRVGEIKQGNVYRPEREAQVLRRLGAANPGPLPDLAVQRIFREIMSACLALERPLRVAYLGPAGTFSESASRKHFGSAPNFVPTSTIEEVFRAVEAGNVDYGVVPVENSTEGVVGGTLDLLLENPLQICGEVKLRIHQHLLSKAAGIGALKRLYSHAQSLAQCHEWLNRKLPSLSRVPVASNAEAARLASEDAESCAIAGEAAADLYGLGVLAANIEDDPNNTTCFLVIAHHDADRSGQDKTSLVCSAPNRPGAVHALLEPLAKHGVSMSKLQSRPARGGLWEYVFYMDIEGHRDDPEVAAALKELNERAGFVKVLGSYPGAVI

SEQ ID NO: 78160 - protein, 275 aa, Klebsiella pneumoniae subsp. pneumoniae MGH 78578
MTHPTVIKLHDGNLMPQLGLGVWKAGNEEVVSAIHKALEVGYRSFDTAAAYQNETGVGNALHSAGVNRDELFITTKLWNDDQKRPHEALKESLSKLKLDYVDLYLIHWPVPAIGHYVEAWQALIELQQQGLTKSIGVCNFQVPHLQKLIDETGVAPVINQIELHPLMQQRQLHAWNATHKIQTESWSPLAQGGEGVFDQKVIHQLADKYGKTPAQIVIRWHLDSGLVVIPKSVTPSRIAENFDVWDFRLDKDELGAIAKLDQGKRLGPDPDQFGG

SEQ ID NO: 78161 - protein, 461 aa, Glycine max
MLRLWISYLQLLELFVSSLVHMLYGFYIFSSAVAGDLSQVLNEYFHKANNNVNVEVKEEISKLNNANDLPPIVLVHGIFGFGKGRLGALSYFAGAEKKDERVLVPDLGSLTSIYDRARELFYYLKGGQVDYGEEHSKACGHSQFGRIYEQGHYPEWDEDHPIHFVGHSAGAQVIRVLQQMLADKAFNGYENTSENWVLSVTSLSGAFNGTTRAYADGMLPEDGRTLKPICLLQLCRIGVIIYDWFDISWLKNYYNFGFDHYNMSWRKMGIWGLVDCLLGNAGPFASGDWILPDLTIQGSIRLNYHIRTFPNTYYFSYATKRTTKIMGVKVPSSILGIHPLLFIRVLQMCQWRFPPDVPPPYKGYRDEDWQDNDGALNTISMTHPRLPIEHPNCLVEKESDCQPLQPGIWYYKYVEGDHILFIINRERAGVQFDVIYDSIFQRCRKHVFRKKLPTMPNEINH

SEQ ID NO: 78162 - protein, 501 aa, Streptococcus pneumoniae TIGR4
MNKRVKIVATLGPAVEIRGGKKFGEDGYWGEKLDVEASAKNIAKLIEAGANTFRFNFSHGDHQEQGERMATVKLAEKIAGKKVGFLLDTKGPEIRTELFEGEAKEYSYKTGEKIRVATKQGIKSTREVIALNVAGALDIYDDVEVGRQVLVDDGKLGLRVVAKDDATREFEVEVENDGIIAKQKGVNIPNTKIPFPALAERDNDDIRFGLEQGINFIAISFVRTAKDVNEVRAICEETGNGHVQLFAKIENQQGIDNLDEIIEAADGIMIARGDMGIEVPFEMVPVYQKMIIKKVNAAGKVVITATNMLETMTEKPRATRSEVSDVFNAVIDGTDATMLSGESANGKYPLESVTTMATIDKNAQALLNEYGRLDSDSFERNSKTEVMASAVKDATSSMDIKLVVTLTKTGHTARLISKYRPNADILALTFDELTERGLMLNWGVIPMLTDAPSSTDDMFEIAERKAVEAGLVESGDDIVIVAGVPVGEAVRTNTMRIRTVR

SEQ ID NO: 78163 - protein, 128 aa, Salmonella enterica
FGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHP

SEQ ID NO: 78164 - protein, 385 aa, Solanum lycopersicum
MANEEAEKKKNTSSSEAKQPLKTAKKKTLGWMEWLRGWFYLVYEMLFQRILASHLQNPMPLPPINDVTCIVTGSTSGIGREIARQLAEAGAHVVMAVRSTNRAQELIRKWQEEWSGKGLPLNIEVMELDLLSLDSVARFAEAWNARMAPVHVLINNAGIFSIGEPQKFSKDGYEEHMQVNHLAPAMLSILLLPSLIRGSPSRIVNVNSTMHYVGFVDPEDMNVVSGKRKYTSVVGYGGSKLAQIMFSSILHKRLPAESGISVVCNTPGIVLTNVARDLPQFLQVGYRLIPYFIFNAEEGSRSTLFAATDPQISEYCEMLKADDWPVCAYISHDCRPTNASEEAHNIETSYKVWEKTLELVGLPSDAVERLIEGEEIKCRYGNSQE

SEQ ID NO: 78165 - protein, 248 aa, Oryza sativa Japonica Group
MGGGGGGGQAAPWGGVQEYYAKPSSFGRHQGRPWEQGMNNLVNYRQSGGPPMPAKEKVGGHHGSPSVLRDHDHGMDRRSSDESGHDQKVGPERKEGVPPKHAQSEADTKRAKQQYAQRSRVRKLQYIAELERKVQALQSEGIDVSAEMEFLSQQNIMLDLENKALKQRLESLAQEQLIKRFQQEMFEREIGRLRSLYQQQQQQQKQPQPTTTLSRSNSRDLDSQFANLSLKHKDPNSGPLRTQSSSIL

SEQ ID NO: 78166 - protein, 385 aa, Solanum bulbocastanum
MANEEAEKKKNTTSSEAKQPLKTAKKKALGWMEWLRGWFYLVYEMLFQRILASHLQNPMPLPPINDVTCIVTGSTSGIGREIARQLAEAGAHVVMAVRSTNRAQELIRKWQEEWSGKGLPLNIEVMELDLLSLDSVARFAEAWNSRMAPVHVLINNAGIFSIGEPQKFSKDGYEEHMQVNHLAPAMLSILLLPSLIRGSPSRIINVNSTMHYVGFVDPEDMNVVSGKRKYTSVVGYGGSKLAQIMFSSVLQKRLPAESGISVVCNTPGIVLTNVARDLPQFLQVGYRLIPYFIFNAEEGSRSTLFAATDPQISEYCEMLKADDWPVCAYISHDCRPTNASEEAHNIETSYKVWEKTLELVGLPSDAVERLIEGEEIKCRYGNSQE

SEQ ID NO: 78167 - protein, 194 aa, Pseudoalteromonas tunicata D2
MKYKIYFLDNFDSFSYNLVDEFAQLGAELVIYRNNLSAEFIFAQMQQETVPVILVLSPGPGAPSEAGCLMALIELCKGKFPILGICLGQQALTQSYGGVIGHAGETVHGKSSVISLADHPVFNGFGDSMPVARYHSLMATYVPDCLSIIAHYQDIPMAIYHAQDKVIGYQFHPESILTPDGSVLLRQSLEFLSQ

SEQ ID NO: 78168 - protein, 201 aa, Arabidopsis thaliana
MRSKSLLPFFDSAYQGFASGSLDTDAQSVRTFVADGGECLIAQSYAKNMGLYGERVGALSIVCKSADVASKVESQVKLVVRPMYSSPPIHGASIVATILKSSDMYNNWTIELKEMADRIKSMRQQLFEAIQARGTPGDWSHIIKQIGMFTFTGLNKEQVEFMTKEFHIYMTSDGRISMAGLSSKTVPHLADAMHAAVTRLG

SEQ ID NO: 78169 - protein, 559 aa, Apium graveolens
MGSSGVSWKLADHPKLPKGKVVAMIVLDGWGEAHDNQYNCISVAETPTMDSLKNGAPDRWRLVRAHGTAVGLPTEDDMGNSEVGHNALGAGRIFAQGAKLCDLALESGKIYDGEGFNYIKESFESGTLHLIGLLSDGGVHSRIDQVLLLVKGASERGAKRIRVHALTDGRDVLDGSSVAFVETLQNYLSELREQGIDAQIASGGGRMYVTMDRYENDWDVVKRGWDAQVLGEAPYKFKSALEAVKTLRAEPKANDQYLPPFVIVDESGKAVGPIVDGDAVVTFNFRADRMVMAAKAFEYEDFDKFDRVRVPKIRYAGMLQYDGELKLPNHYLVSPPEIDRTSGEYLTHNGVRTFACSETVKFGHVTFFWNGNRSGYFDSEMEEYVEVPSDSGITFNVQPKMKALEIAEKARDAILSGKFHQVRVNLPNSDMVGHTGDIAATVVACKAADEAVKMILDTIEQVGGIYVVTADHGNAEDMVKRNKKGEPALDKDGKIQILTSHTLEPVPIAIGGPGLLPGVRYRKDVPSGGLANVAATVMNLHGFVAPDDYETTLIEVVDN

SEQ ID NO: 78170 - protein, 253 aa, Legionella pneumophila str. Paris
MLVKTPEEIKKMRVAGHLAASVLEMIEPYVIAGASTKELEQVCRQYIIEDLKAIPSTLNHYGFPACICTSINHVVCHGIPSEKKLKNGDIINIDVTVQKDGYIGDTSKMFLVGNIKPFAKKLVEVTQECLYKAISIVRPGTHLGDIGNIIQTHAEQHGYSVVREFGGHGIGKSMWEDPHIMHFGKPNTGLRLQAGMTFTIEPMLNLGRKEVKTLGDGWTVVTKDHKLSAQWEHTILVTDNGHEILTLRADEHL

SEQ ID NO: 78171 - protein, 570 aa, Apium graveolens
MATGGDQDVYGEDCAAEDQLVTPWTISVASGYTLLRDPHHNKGLAFTEKERDAHYLRGLLPPAIISQQQQEKKLMQNLRSYEVPLHRYMAMMELQERNERLFYKLLIDNVEELLPVVYTPTVGEACQKYGSIFRRPQGLYISLKEKGKILEVLKNWPEKNIQVIVVTDGERILGLGDLGCQGMGIPVGKLALYTALGGVRPSACLPITIDVGTNNESLLNNEFYIGLKQRRATGKEYADLLQEFMTAVKQNYGEKVLVQFEDFANHNAFELLSKYSTTHLVFNDDIQGTASVVLSGIVSSLKLIGGMLADHTFLFLGAGEAGTGIAELIALEMSKQTKIHLEETRKKIWLVDSKGLIVSHRKESLQHFKKPWAHEHEPCTTLIDAVKAIKPTVLIGTSGQGKTFTKEVVEAMASFNKKPLIMALSNPTSQAECTAEEAYNWSEGRAVFASGSPFDPVKYNNQLYIPGQANNAYIFPGLGLGLVMSGAIRMHDEMLLAASEALACQVTQEHYDKGMTFPPFSNIRTISANIAAKVAAKAYDLGLATRLPRPEDLVKFAESCMYSPNYRIYR

SEQ ID NO: 78172 - protein, 500 aa, Lupinus albus
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVARVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVLLDTLLEFAEDETMEIKITKDHIKGLVVDFFSAGTDSTAVATEWALAELINNPKVLERAREEVYSVVGKDRLVDEVDTQNLPYIRAIVKETFRMHPPLPVVKRKCTEECEINGYVIPEGALILFNVWQVGRDPKYWDRPSEFRPERFLETEAEGEARPLDLRGQHFQLLPFGSGRRMCPGVILATSGMATLLASLIQCFDLQVLGPQGQILKGGDAKVSMEERAGLTVPRAHSLVCVPLARIG

SEQ ID NO: 78173 - protein, 472 aa, Rhodococcus sp. RHA1
MSETATPVPAQMHRGLQNRHIRMIGLGSAIGTGLFLVSGSTIQTAGPAVLLAYVLAGAVIFLIMRMLGEMAVHSPVAGSFSEYAREHCGPLVGFIAGWNWWMTCIVVSMLELTAVGTFMDFWFPGIPHWVTAAVALVLITGVNLIHVSAFGEFEFWFTLIKVAAVVAMIVFGVAIVFGAGHYDTAALSNLWNSGGFAPHGITGILLSLVAVTFTFGGIESLGTTAGEAKDPARSIPKAVNGVIVRILIFYVGAIGVMLMIWPWARVGVDGSPFVLMLDGLGVGGAATLLNIVVLVAALSVYNTMVYSNARVLHGMAAKKQAPALLAKTNHRGVPVTGIVINSAITAIVVLLNYLFPGQLLMILVAIILSAEIITWSTIAISHLRFRRTVGAGVFRSPLYPYTNYLVLAYLAGVVVLMTQLPDFRAGAIALPLWLAGLLAAALLYRRIRRNRDHASADTAAEAGRPLIDHTPT

SEQ ID NO: 78174 - protein, 465 aa, marine gamma proteobacterium HTCC2080
MSSGKVVQVIGAVIDVEFPRDNVPQVYDALSVSEKGLTLEVQQQLGDGVVRAIAMGSSEGISRGLSVENTGAPISVPVGIETLGRIMDVLGNPIDEKGPIGEQQRSAIHRAAPAYDELAASEEVLETGIKVIDLVCPFAKGGKVGLFGGAGVGKTVNMMELINNIATEHSGLSVFAGVGERTREGNDFYYEMQESGVVNIENMDQSKVAMVYGQMNEPPGNRLRVALTGLTMAEKFRDEGRDVLLFVDNIYRYTLAGTEVSALLGRMPSAVGYQPTLAEEMGVLQERITSTKTGSITSIQAVYVPADDLTDPSPATTFAHLDSTVVLSRDIAAKGIYPAVDPLDSTSRQLDPLVIGTEHYDVARGVQSVLQRYKELKDIIAILGMDELSEEDKLTVSRARKIERFLSQPFHVAEIFTGSPGIYVSLKDTIAGFKGILAGEYDHLPEQAFYMVGSIEQAVERAEKL

SEQ ID NO: 78175 - protein, 499 aa, Trifolium repens
SHLRPTPSAISKALRHLPNPPSPRPRLPFIGHLHLLKDKLLHYAPIDLSKKHGPLFSLSFGSMPTVVASTPELFKLFLQTHEATSFNTRFQTSAIRHLTYDNSVAMVPFGPYWKFVRKLIMNDLLNATTVNKLRPLRTQQIRKFLRVMAQSAEAQKPLDVTEELLKWTNSTISMMMLGEAEEIRDIAREVLKIFGEYSLTDFIWPLKYLKVGKYEKRIDDILNKFDPVVERVIKKRREIVRRRKNGEVVEGEASGVFLDTLLEFAEDETMEIKITKEQIKGLVVDFFSAGTDSTAVVTEWALAELINNPRVLQKAREEVYSVVGKDRLVDEVDTQNLPYIRAIVKETFRMHPPLPVVKRKCTEECEINGYVIPEGALVLFNVWQVGRDPKYWDRPSESRPERFLETGAEGEAGPLDLRGQHFQLLPFGSGRRMCPGVSLATSGMATLLASLIQCFDLQVLGPQGQILKGDDAKVSMEERAGLTVPRAHSLVCVPLARIG

SEQ ID NO: 78176 - protein, 135 aa, Nitrosomonas europaea ATCC 19718
FQGHMKTVKHLLQEKGHTVVAIGPDDSVFNAMQKMAADNIGALLVMKDEKLVGILTERDFSRKSYLLDKPVKDTQVKEIMTRQVAYVDLNNTNEDCMALITEMRVRHLPVLDDGKVIGLLSIGDLVKDAISQHQF

SEQ ID NO: 78177 - protein, 451 aa, Vibrio parahaemolyticus
MKMSSTLSHELLSERLSDALASLDSIPVARVTGRLIKVNGLMLQAVGCRFKLEQRCLVETAEGDMIEAQVVGFDHTVAYLMPIRRLGGLFAGAKVIPLDGDSTVQLSSQWMGRVVNGLGEPLDDGMPLKGGDRVSLEPKPINPLKRRPVDTPLNVGVRAINGLLTVGKGQRIGLMAGSGVGKSVLMGMITKNTEADVIVVGLIGERGREVREFIERNLTPEAREKAIIIAAPADESPLMRLRATLLCHRVAEYFRDQGKDVLLLMDSLTRYAMAQREIALSLGEPPASRGYPPSVFSVLPQLLERAGNSENPHGSLTAIYTVLAEGDDQQDPVVDSARAILDGHVVLSRQLAEQGHYPAIDINASISRCMSTCTQPAHSTIANNFRQMYSNYLQVKELLPLGGYQPGQDPELDQSVSMYPHLRSYLQQSANEAVDYTTSLTELAQMFQGAQ

SEQ ID NO: 78178 - protein, 500 aa, Trifolium repens
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDNSVAMVPFGPYWKFVRKLIMNDLLNATTVNKLRPLRTQQIRKFLRVMAQSAEAQKPLDVTEELLKWTNSTISMMMLGEAEEIRDIAREVLKIFGEYSLTDFIWPLKYLKVGKYEKRIDDILNKFDPVVERVIKKRREIVRRRKNGEVVEGEASGVFLDTLLEFAEDETMEIKITKEQIKGLVVDFFSAGTDSTAVATEWALAELINNPKVLQKAREEAYSVVGKDRLVDEVDTQNLPYIRAIVKETFRMHPPLPVVKRKCTEECGINGYVIPEGALVLFNVWQVGRDPKYWDRPSEFRPERFLETGAEGEAGPLDLRGQHFQLLPFGSGRRMCPGVNLATSGMATLLASLIQCFDLQVLGPQGQILKGDDAKVSMEERAGLTVPRAHSLVCVPLARIG

SEQ ID NO: 78179 - protein, 891 aa, Leptospira interrogans serovar Copenhageni str. Fiocruz L1-130
MDSDLGFLGLRKARESFMEDKNKTIKETLQGSADAGKRKKLIIKKKGDDPSTPSPAASPKKETVAESAPSSKPPVMPLPLPGDSGQSPIVRPAPSSHSPAKREESPGKQDAGRPPRDKDTRQGGGSSYPPSRSPFQKEDSNIIVSRPIQRTGPSRPNSGGGYQGNRGPGQGGGGYQGNRGPGQGGGGYQGNRGPGQGGGGYQGNRGPGQGGGGYQGNRGPGQGGGGYQGNRGPRSGGTGTRPMPITSAEVELSQSRGSSVTSKKKGHDKEKSTSDRDFSGAENTKFFKQKFKKTKVVGVSGVSVPKEITLLENVQVGELAKKMNLKPGDVIGKLMKMGMMVTINNIIDAETAALLADEYGCKVKVVSLYEETIIEEEKDNQEDYINRPPVVTIMGHVDHGKTKLLDTIRRSSVIDTESGGITQHIGAYQVRTARGLITFLDTPGHEAFTSMRARGAKVTDIVVLVVAADDGVMPQTLEAISHAKAAEVPILVAINKIDLPAANPEKIMQELANHGLQSEEWGGETMYAKISARENIGIDKLLEMILLQAEVMDLKANPKRRAKGTIIEAKLDPGRGSVATVLIQNGTLRVGDPFVAGVFSGRVRAMYNDLGQLIQEAGPAFPAQVTGIDGVPDAGAPFDAMADEKEARNISQHRIEFERIGNAGAATGTSSKVTLENMNEFIKQGALKELKVIIKADVRGSAEAIKESLEKLSTPEVKLNVIQSGAGAIVDMDVMLASASNALIIGFHVRANPKTIALAEKEGVQIKYYNIIYQVVDEIKLAMEGLLEPEKIEEVIGTAEIREIFKVSKIGNIAGCMVLSGKIQKSANIRVIGDGVTKFEGKLKSLKRVKDDVNDVVAGFECGIQVDGYNDFKVGDTIEAYNVTVIKRKLE

SEQ ID NO: 78180 - protein, 499 aa, Beta vulgaris
LHLRPTPTAKSKALRHLPNPPSPKPRLPFIGHLHLLKDKLLHYALIDLSKKHGPLFSHYFGSMPTVVASTPELFKLFLQTNEATSFNTRFQTSAIRRLTYDSSVAMVPFGPYWKFVRKLIMNDLLNATTVNKLRPLRTQQIRKFLRAMAQGAEARKPLDLTEELLKWANSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHTKGLVVDFFSAGTDSTAVATEWALAELINNPKVLEKAREEVYSVVGKDRLVDEVDTQNLPYIRAIVKETFRMHPPLPVVKRKCTEECEINGYVIPEGALIPFNVWQVGRDPKYWDRPSEFRPERFLETGAEGEARPLDLRGQHFQLLPFGSGRRMCPGVNLATSGTATLLASLIQCFDLQVLGPQGQILKGGDAKVSMEERAGLTVPRAHSLVCVPLARIG

SEQ ID NO: 78181 - protein, 483 aa, Pseudoalteromonas tunicata D2
MKFSNTYNQLDAVFFQPVAPTPVRQPELLLWNTSLANELNIAPELQNNSALLAQYFSGNQLPVGAEPIAQAYAGHQFGHFNPQLGDGRAHLLGELINNNGQRVDIALKGSGPTAFSRQGDGRCALGPAVREFIMSEAMAALGVPTTRCLAVVKTGELVFREQAKMGAVVTRIATSHLRVGTFQYFSAQGNLDALASLTEYAINRHYSEITSIGSQRIIDFLQAVIYKQITLVVAWSRVGFIHGVMNTDNTAISGETIDFGPCAMMNHYHLGTVFSSIDRNSRYAFGNQGRIAQWNMARLAEALLPLINEDQAQAVALVEPLIMKFSEQYQAAFYQMMANKLGCTDSNDAVKALVDQLLILMQEQALDYTNTFIALQLSLDDDTHANKLKTQLGDWYQAWRDYLVSSSTATDSASALMTRTNPLVIPRNHNVEAVLAQFEQQQTTDINEFLTILRDPYHALDSTAKYQLPPSDGDSHYRTFCGT

SEQ ID NO: 78182 - protein, 500 aa, Beta vulgaris
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEDVEGEVSGVFLDTLLEFAEDETMEIKITKDHIKGLVVDFFSAGTDSTAVATEWALAELINNPKVLEKAREEVYSVVGKDRLVDEVDTQNLPYIRAIVKETFRMHPPLPVVKRKCIEECEINGYVIPEGALILFNVWQVGRDPKYWDRPSEFRPERFLETGAEGEARLLDLRGQHFQLLPFGSGRRMCPGVNLATSGMATLLASLIQCFDLQVLGPQGQILKGGDAKVSMEERAGLTVPRAHSLVCVPLARIG

SEQ ID NO: 78183 - protein, 224 aa, Bacillus cereus E33L
MTVQTNLTTVNEAIKQSCARAGRSLQDIKLVAVTKTVGIEKTNEVIEAGIIDLGENRNEGFLQKYEHFGSKVNWHFIGSLQTRKVKEIINEIDYLHSLDRLSLAKEIQKRANKKVKCFIQVKTSSEESKQGLAIEETVTFIQSLQELDKIEVVGLMTMAPFTEEEEEIRRCFKELRMLQKEVQGLELLHAPCKELSMGMSNDYTIAIEEGATYIRLGTILVGKA

SEQ ID NO: 78184 - protein, 155 aa, Escherichia coli
MFDSYERKKGIMQRIIFYFKTKLRGCREYYYSLKYYHQFKIPISNHLTIGIKTLGENKTTLPHPVGIVIGKNVNIGKKCIVYQNVTIGVSNNKFEDYPVIGNNVTIYAGAIIIGKVIIGDNAIIGAGCIVTKDVPEGKIAIGSPMKIMDKKHNNY

SEQ ID NO: 78185 - protein, 388 aa, Escherichia coli
MKITISGTGYVGLSNGILIAQNHEVVALDIVQAKVDMLNKRQSPIVDKEIEEYLATKDLNFRATTDKYEAYKNADYVIIATPTDYDPKTNYFNTSSVEAVIRDVTEINPNAVMIIKSTIPVGFTESIKERFGIENVIFSPEFLREGKALYDNLHPSRIVIGEQSDRAERFAALLQEGAIKQDIPTLFTDSTEAEAIKLFANTYLAMRVAYFNELDSYAESLGLNSRQIIEGVCLDPRIGNHYNNPSFGYGGYCLPKDTKQLLANYQSVPNNLISAIVDANRTRKDFIADSILARKPKVVGVYRLIMKSGSDNFRASSIQGIMKRIKAKGVPVIVYEPAMKEDDFFRSRVVRDLDAFKQEADVIISNRMSADLADVADKVYTRDLFGND

SEQ ID NO: 78186 - protein, 193 aa, Triticum aestivum
  misc_feature (133)..(133): Xaa can be any naturally occurring amino acid
  misc_feature (169)..(169): Xaa can be any naturally occurring amino acid
  misc_feature (174)..(174): Xaa can be any naturally occurring amino acid
MAAPSSLASSRLAAAAPAPQHHHHQNHQLRLGCSRRRAQRLVAMAGSGKFFVGGNWKCNGTKVSISKLVSDLNAATLESDVDVVVAPPFIYIDQVKSSLTDRIEVSAQNTWIGKGGAFTGEISAEQLVDIGCXWVILGHSERRLVIGEDDQFYWGRKLLMPWSPNLKVXACIGXLLEKREAGENFSMFCFKQK

SEQ ID NO: 78187 - protein, 334 aa, Escherichia coli
MKFLVTGAAGFIGFYVSKRLLAAGHQVVGIDNLNDYYDVNLKQARLDLLKHDNFSFYKIDLADREKMATLFADERFDRVINLAAQAGVRYSLENPNAYADANLIGFLNVLEGCRHNNVQHLLYASSSSVYGMNRKMPFSTDDSVDHPVSLYAATKKANELMAHTYSHLYGLPTTGLRFFTVYGPWGRPDMALFKFTKAMLEGKSIDVYNFGKMKRDFTYIDDIAEAIIRLQDVIPEKDPQWTVETGSPATSSAPYRIYNIGNSSPVELMDYINALEEALGIEANKNMMPLQPGDVLETSADTKALYDVIGFKPETSVKEGVKNFVEWYRNFYKV

SEQ ID NO: 78188 - protein, 215 aa, Triticum aestivum
  misc_feature (118)..(118): Xaa can be any naturally occurring amino acid
  misc_feature (132)..(132): Xaa can be any naturally occurring amino acid
PSQLSIDQNAQGLARYAIICQENGLVPIVEPEILVDGPHDIDRCAYVTEIVLAACYKALNDQHVLLEGTLLKPNMVTPGSDSKKVAPEVIAEYTVRTLQRTVPAAVPAIVFLSGGQSXEEEATLNLNAMNNXPDQEPWELSFSFGRASSKTPQGWSGKTENTRKARRLLVRCKAIRGTSALQGKHLAKAPPKAHRTQYDYLRLRWLRYIQCIVVL

SEQ ID NO: 78189 - protein, 436 aa, Actinobacillus pleuropneumoniae serovar 1 str. 4074
MAKIVKVIGREIIDSRGNPTVEAEVHLEGGFVGLAAAPSGASTGSREALELRDGDKSRFLGKGVLKAVSAVNNEIAQAILGKDGSAQAEIDQIMIDLDGTDNKSKFGANAILAVSLATAKAAAASKGLPLYAYIAELNGTPGVYSMPLPMMNIINGGEHADNNVDIQEFMIQPVGASTLKEALRIGAEVFHNLAKVLKSKGLNTAVGDEGGFAPNLASNADALACIKEAVEKAGYVLGKDVTLAMDCASSEFYNKENGLYEMKGEGKSFTSQEFTHYLEGLCNEYPIKSIEDGQDESDWEGFAYQTKVLGGKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALAAAGTPAPFNGLKEVKGQA

SEQ ID NO: 78190 - protein, 538 aa, Acidovorax sp. JS42
MQHDKILILDFGSQVTQLIARRVRETHVYCEVHPCDVSSDWVRQFAADGKLKGVILSGSHASVYEVDDRAPDAVFELGVPVLGICYGMQTMAAQLGGKVEGSHSREFGYAEVRAHGHTALLKGIEDFSTPEGHGMLKVWMSHGDKVTELPPGFKLMCSTGSCPIAGMADETRRFYAVQFHPEVTHTVQGAALLNRFVREICGAQADWIMRDHIEEAVQKIREQVGDEEVILGLSGGVDSSVAAALIHRAIGDQLTCVFVDHGLLRLNEGDMVMDMFAGKLHAKVVRVDASDLFLGELAGVSEPEQKRKIIGRLFVDVFKAEAEKLKASGQGHKGATFLAQGTIYPDVIESGGAKSKKAVTIKSHHNVGGLPEQLGLKLLEPLRDLFKDEVRELGVALGLPREMVYRHPFPGPGLGVRILGEVKKEYADLLRRADAIFIEELRNFTDEATGKTWYDLTSQAFTVFLPVKSVGVMGDGRTYDYVVALRAVQTSDFMTADWAELPYALLKKVSSRIINEVRGINRVTYDVSSKPPATIEWE

SEQ ID NO: 78191 - protein, 318 aa, Zea mays
  misc_feature (67)..(67): Xaa can be any naturally occurring amino acid
  misc_feature (195)..(195): Xaa can be any naturally occurring amino acid
  misc_feature (229)..(229): Xaa can be any naturally occurring amino acid
LSKKVIDLDELRMLAAQGVPDAAGVRATVWKLLLGYLPNDRSLWEQELAKKRGQYAAFKDEFLTNPXVERAQQVPTEGHHNVSAEHVDNGFLHRSEVTREEHPLSLGKTSAWNQFFEYSEIMEQIDRDVKRTHPDMQFFCGDSSFAKSNQESLKNVLLIFAKLNAGIRYVQGMNEVLAPLFFVFRSDPDDKNAVXEFAEADSFFCFVELLSGFRDNFCQKLDNSAVGIXEVNPQFYAFRWITLLLTQEFNFADTIHIWDILLSDPGGPQETLLRICCAMLILVRKRLLAGDFTSNLKLLQNYPPTNISHLLYVANKLH

SEQ ID NO: 78192 - protein, 775 aa, Cryptococcus neoformans var. neoformans JEC21
MSASASGSSWTEPTKAQAPPKDADLKQAWAFLSVGVDHIMTRLSFGMSYSYYILLYTAIYNYCTQPGKTGLPSFSPQRGGASLQGADLHRSLHNWLSAHCKSMREEAEKLPDQELLKYYARQWDRYTRGALYVNKLFNYLNKHWVKREKDEGRKDVYQVYTLALVSWKNNFFDHFTDNKGTSRLTQALLRQIQQQRNGEEVDSGLLKKVIDSYVSLGLDEADAQRQNLDTYRKHFQTQFLEATDTYYRAESSAFVGSNSVADYMKKAEARLQEEADRVNLYLHDNTRNDLKTRCEKVLIEEHQAIMWDEFQTLLDSDRVDDLARMYGLLSRVLNGLDPLREKFGQHVRRAGRAAVEKVLPAPGAVNEAGKAESLDPKAYVEALLEVHGKYTSMVEGPFRGEMGFNRALDQACGDFCNSNAACTVSTKSPELLASYCDLLLRKSNKDSDAESLEASLSKAMIIFNFIDDKDVFHKFYQKKLAQRLVGSLSASDDAESSMITKLKELSGFEYTNKLSKMFTDVNLSKDLMERFNEREREKGIASDIDFQPLVLGSNSWPLHPQQTDFAIPREIQALYDRFNAFHGEVHQGRTLNWLWHISKNELRTTYLNQKYILMTSAYQMAILTQFNVSDTLSYKDIEAGTKLSPTVLKPQLGLLVKLKILLNTNEEYSLNTGFKSKKIRVNLNQTIKSEARAEQKEVIAAVDEDRKFVYQATIVRLMKGRKTMQHQALIQEVTAQISSKFTPKIPEIKKAIEYLIDKEYLERAPDSNNTYNYLA

SEQ ID NO: 78193 - protein, 187 aa, Brassica napus
  misc_feature (146)..(146): Xaa can be any naturally occurring amino acid
MASPSKRREMDMMKLMMSDYKVDTVNDDLHMFYVTFHGPTDSLYEGGVWKIKVELPDAYPYKSPSVGFVNKIYHPNVDESSGAVCLDVINQTWSPMFDLINVFESFLPQLLLYPNPSDPFNGEAASLLMRDRPAYELKVKEYSTRXAKPEDIGAPEEISSDDDDDDSMSERGSDSDDNDEVAGKADP

SEQ ID NO: 78194 - protein, 592 aa, Vitis vinifera
  misc_feature (3)..(495): Xaa can be any naturally occurring amino acid
MPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAGSLVSGVQIAISASNTGGAWDNAKKYIEAGASEHARTLGPKGSDPHKAAVIGDTIGDPLKDTSGPSLNILIKLMAVESLVFAPFFATHGGLLFKIF

SEQ ID NO: 78195 - protein, 471 aa, Lentisphaera araneosa HTCC2155
MHSINTVIMSGGSGSRLWPMSRSTHPKQFLPLCGEFTMLQQTALRLDGLEQEGRILVVANQNHRFLVAEQLREIGVKSPQIILEPCARNTAPAVALAALQVHKQEPEALMLVLAADHLIQDEEAFRQAVRDAAPCAAEGHILTFGIVPDHPATGYGYIQAGEQFVSSIRQVDNFVEKPNLEKAEAYLSEGNFLWNSGMFLIRADIYLSELKKYRPDILEACEKSFENTSDDMDFVRPGVEEFAACPKDSIDYAIMEKSQVVKVIPLDAGWSDVGSWTELANQHSEDTYENSCVGDTLTIDSERNFIRANKKLIATVGVSDLLIVDTDDALLVAHKSKAQDVKKIVEELKEQSRPEADINSKVYRPWGWYNTIDQGPQFKVKRISVNPGAKLSLQKHHHRAEHWVVVTGTAIVTNGDKEILLSENQSTYIPIGVQHRLENPGKIDLEIIEVQSGTYLEEDDIVRLDDNYGRA

SEQ ID NO: 78196 - protein, 128 aa, Zea mays
SGRVGTIMPIALTGLLIFMFFLLIATANAIIVSALMSLAAAGGFLAIFFACLVAVYIGAVGVAIFAISAIVISSVVGVMITTGWVGFFWMIWFTARKSMDLTKHSISMTSSAVQSYSASRQVKQKHVD

SEQ ID NO: 78197 - protein, 258 aa, Escherichia coli K12
MMNPLIIKLGGVLLDSEEALERLFSALVNYRESHQRPLVIVHGGGCVVDELMKGLNLPVKKKNGLRVTPADQIDIITGALAGTANKTLLAWAKKHQIAAVGLFLGDGDSVKVTQLDEELGHVGLAQPGSPKLINSLLENGYLPVVSSIGVTDEGQLMNVNADQAATALAATLGADLILLSDVSGILDGKGQRIAEMTAAKAEQLIEQGIITDGMIVKVNAALDAARTLGRPVDIASWRHAEQLPALFNGMPMGTRILA

SEQ ID NO: 78198 - protein, 260 aa, Triticum aestivum
  misc_feature (203)..(203): Xaa can be any naturally occurring amino acid
  misc_feature (225)..(225): Xaa can be any naturally occurring amino acid
  misc_feature (236)..(237): Xaa can be any naturally occurring amino acid
  misc_feature (242)..(242): Xaa can be any naturally occurring amino acid
  misc_feature (250)..(250): Xaa can be any naturally occurring amino acid
YNKFVQKSRLVPVRNSRDIVDPRVRDDQGEGYLVDKVLDKTGMKGTGKWTVQQAAELSVAAPTIEASLDSRFLSGLKDERVAASKIFQGDYSSGETVDKAQLIEDVRKALYASKICSYAQGMNIIKAKSTEKGWGLNLGELARIWKGGCIIRASFLDRIKKAYDRNGELANLLIDPEFAQEIMDRQAAWRRVVCLAIKHGVSXPGMSASLGYYLTPTGKDSAPCXLRQGQRDYFAXXTYQRXDMPGSFHXEWYKIAHSKI

SEQ ID NO: 78199 - protein, 143 aa, Chlamydomonas reinhardtii
LIYSVHAEQSSTIHLHRTLNMVKDLGCKAGVVLNPGTSLSTIEEVLDVVDLILIMSVNPGFGGQKFIESQVAKIRNLKRMCNEKGVNPWIEVDGGVTPENAYKVNSMTGANALVAGSAVFKAKSYRDAIHGIKVSKAPANVMA

SEQ ID NO: 78200 - protein, 257 aa, Pseudoalteromonas tunicata D2
MSKVIIKTAAEIELMRLSGQLLAKVFAKLDGFMAEGITTMAINDFVERYIVDELNARPASKGQYGYQYSLNTSVNDVVCHGIPNQVPLQQGDIVNVDITLEKNGFIADSSKMYLIGQCSVAAERLCDMTYQAMWQGIKKVKAGATLGDIGFAIASFAHQNGYSVVKEYCGHGIGAQMHEAPQVLHYGRMNTGLVLEPGMTFTIEPMINQGKAKIKNLKDGWTVVTADKKLSAQWEHTILVTDTGYEVLTLRAEETLA

SEQ ID NO: 78201 - protein, 334 aa, Xylella fastidiosa 9a5c
MAIKVGINGFGRIGRNILRSAVQNFGSNIDIVAINDLLEPDYLAYMLQYDSVHGRFKGEIAIEGTALILNGKKIRLTAERDPGNLQWADAGAEIVIESTGLFLTQESAGKHLAAGAKKVIISAPSKDETPMFVYGVNHNSYNGEPIVSNASCTTNCLAPLAKVINDKWGITRGLMTTVHAATATQKTVDGPSNKDWRGGRGILENIIPSSTGAAKAVGKVIPSLNGKFTGMSFRVPTSDVSVVDLTVQLNTPATYKEICTEVKQQSEGPLRGILGYTEDKVVATDFRGETCTCVFDADAGIALDPTFIKLIAWYDNEWGYSNKCLEIAKVIAAK

SEQ ID NO: 78202 - protein, 170 aa, Zea mays
MEHKETGCQSREGPILCVNNCGFFGSAATMNMCSKCHKEMAMKQEQAKLAASSFDSIVNGGDAAKEHLAAGSTAVAVAHVEAKTLITAQPADIAGPSEGAMDNPKGPSRCSTCRKRVGLTGFNCRCGNLYCATHRYSDKHECKFDYRAAAMDAIAKANPRGEGRRSLTRF

SEQ ID NO: 78203 - protein, 800 aa, Yarrowia lipolytica CLIB122
MPPTKTQTHPDIQPVTEDRRSLTVKSLDDRYVLLKNIGKGSFGHVSLARVRSKAAMENEDMRAGSMVAIKTMKKKLAAIDDYNLLREVEFIREVRPHRFLVNVHDMFVDSVNHHFHMSMEVMEMNLYNLMKAQEKVPFQPHAVRSMLWQIICGIDHIHRHNFFHRDIKPENILVSRYLPYHNENSSSPHSGFRIKIADFGLSRHIEDRDPYTAYVSTRWYRAPEILLRCEYYSAPVDIWAFGAMAAEVANLKPLFPGTNELDQFSLQVALLGTPGQNSLGGRWSRHPELCSKLNINIDAQTGQSSNSIMCNPEHASLTDVVLMCLTWDPDARCSARDIMYHRYFAQESSIEVPRTLKRSPLRITKQAAMNPHGDPPILMDPSLRHNNSNANNSAIVPTLASSLKQNQGLQMNKSHLSGVNGSTKRNSLSGAAAAAAMSMSLSLASKNSSVNSGGAGFLAGAAPAKKKFGHWANIFKRDSDVASSELERVGPNKENVPSIVPTQTPNRGAGGVGIVPKIPLPQLPPLETIAASIESLSIEARSTNTTLTERMTSGPPTGGTSDSEWSTTNASISESVGHDSGAGSSGAVDKGSTGTTNFEVEALMESTEARVTVKTLPQTPDSASSYDQMPPPPLPLPKVRVTAKPLNAIKPESPTQVQVSLSPQPCIKPPSPASSHYEPPACLDEHSDSQLTAYERSVRDSVLLMSFTLPPSSQESCTSLEGASESPSVNDSPLVDQFGGSSSDIRIETTSFLTPDLDKGNVWVRSEELECPVYPGLQTNSFRDRKIGAGAISSNNIEVE

SEQ ID NO: 78204 - protein, 163 aa, Actinobacillus pleuropneumoniae serovar 1 str. 4074
MRRTLSVLLENESGALSRVVGLFSQRGFNIESLTVAPTDDETLSRMTIVAQGDENVLEQIEKQLHKLIDVFKVSNLSPTEHIEREVLLLKVRATGSSRDELKRMVDIFRGQIVDITPKLYTVQLAGTSEKLNAFIEAVKQETTIVEIVRSGVISLSRGDKNCL

SEQ ID NO: 78205 - protein, 93 aa, Oryza sativa
MSKTDQKACLIVIDGWGIPSADSPKDGDAITNAKTPVMDALYKDSKGYTELEASSLAVGLPEGLMGNSEVGHLNIGAGRVVWQDVVRIDQTIK

SEQ ID NO: 78206 - protein, 561 aa, Thermosynechococcus elongatus BP-1
MLSNLVNRVHFRYWRGDLFGGLTAAIVALPMALAFGVTSGAGATAGLYCVIFLGFFAALFGGTPTLISNPTGPMTVVITAVITRLTSEYPEQGLYMAFTVVMLAGCFQILFGLLRLGKYITLMPYTVISGFMSGIGLIMILLQIGPLLGHSSKGGVLGAVQNLPEWIQTLNPAALTLGLFTLGLIYFTPQNIRRLVPPQLLALVLGTILSMVFFADAGLARIGTIPTGLPEFVPPTFTLPALKTMIVDGAMLGMLGCIDSLLTSVIADSITRTQHDSNKELIGQGIGNLLSGLFGGLPGAGATMGTVVNIQAGGRTCLSGMIHAVILLMVVLWAAPLTEPIPNAVLAGILIKVGIDIIDWNFLKRAHLLSLRAAFIMYGVMLLTVFVDLIVAVGVGVFIANMLTIKRLADLQSEEVKAITHADDQTPLTPEEKELFGEAKGQLLLLHLGGPMSFGSAWAISQRQAIMADYRVLILDVSSVPLLGVTATLAIESLIQEAQKHGLGIFLVNGSADKVQQRLQRFRILDRLPAEHVVSDRRQALEKAIQLLRQPKESLELTTGS

SEQ ID NO: 78207 - protein, 348 aa, Vitis vinifera
MWAIVRRKVASGSSAASVLGQSLSKIRPAAASVPRGYTTTAKEALLLGGGSKIIRNVGHYKYLGSLVSSKPVREVTSFLQIDSPIQVQHRPFSSDKGDLVDAVVPFMGESISDGTLAKFLKKPGDHVEVDEPIAQIETDKVTIDVASPEAGVVQKFVAKEGDVVEPGTKIAVISKSGEGVTHVAPSEKTPSKASPEPSPTEKEAVDKPKPKSETPPPKEKPKAPAPPPPRPSATEPVLPPKERERRVPMTRLRKRVATRLKDSQNTFAMLTTFNEVDMTNLMKLRSDYKDAFLEKHGVKLGLMSGFIKAAVSGLQNQPIINAVIDGDDIIYRDYIDISIAVGTPKVCS

SEQ ID NO: 78208 - protein, 365 aa, Synechococcus elongatus PCC 7942
MTRSYRITLLPGDGIGPEIMAVTVDILRAIGRQFDLNFEFEEALIGGSAIDATGEPLPEATLATCRNSDAVLLAAIGGYKWDSLPRSQRPETGLLGLRAGLGLFANLRPAAILPQLVDASSLKREVIEGVDLMVVRELTGGIYFGEPKGCFADEQGRQRAFNTMVYREDEIDRIGRVAFDIARKRGKRLCSVDKANVLEVSQLWRDRMTLLGSDYADVELSHLYVDNAAMQLVRWPKQFDTIVTGNLFGDILSDIAAMLTGSIGMLPSASLGAEGPGVFEPVHGSAPDIAGQDKANPLAQVLSAAMMLRYGLDEPEAAARIEAAVNQVLDQGYRTGDLYSEGMTLVGCKGMGDALLAALESPVSA

SEQ ID NO: 78209 - protein, 230 aa, Vitis vinifera
MLSTIATGLAIDAYGPISDNAGGIAEMAGMSHRIRERTDALDAAGNTTAAIGKGFAIGSAALVSLALFGAFVSRASISTVDVLTPKVFIGLLVGAMLPYWFSAMTMKSVGSAALKMVEEVRRQFNTIPGLMEGLAKPDYATCVKISTDASIKEMIPPGALVMLTPLIVGTFFGVETLSGVLAGSLVSGVQQSLLLTLAVHGIMPRSTLRLVLPSMQGRLAQRGLIHTRQL

SEQ ID NO: 78210 - protein, 330 aa, Escherichia coli K12
MPEKTDVHWSGRFSVAPMLDWTDRHCRYFLRLLSRNTLLYTEMVTTGAIIHGKGDYLAYSEEEHPVALQLGGSDPAALAQCAKLAEARGYDEINLNVGCPSDRVQNGMFGACLMGNAQLVADCVKAMRDVVSIPVTVKTRIGIDDQDSYEFLCDFINTVSGKGECEMFIIHARKAWLSGLSPKENREIPPLDYPRVYQLKRDFPHLTMSINGGIKSLEEAKAHLQHMDGVMVGREAYQNPGILAAVDREIFGSSDTDADPVAVVRAMYPYIERELSQGTYLGHITRHMLGLFQGIPGARQWRRYLSENAHKAGADINVLEHALKLVADKR

SEQ ID NO: 78211 - protein, 202 aa, Shewanella sp. MR-7
MHNASDIQSALVPMVIEQTAKGERSFDIYSRLLKERIIFLVGQVEEHMANLIVAQLLFLESESPDKDIFLYINSPGGSVTAGMAIYDTMQFIKPNVSTVCIGQAASMGAFLLAGGEKGKRFCLPNSRVMIHQPLGGFQGQASDIAIHAQEILGIKHKLNLMLAEHTGQPLEVIERDTDRDNFMSATQAVDYGLVDAVMTKRG

SEQ ID NO: 78212 - protein, 333 aa, Zea mays
  misc_feature (163)..(163): Xaa can be any naturally occurring amino acid
  misc_feature (197)..(197): Xaa can be any naturally occurring amino acid
MMGGFLSRVLLLAFGYAYPAYECYKTVELNKPEIAQLIFWCQYWILVALLTVLERFGDFTISWLPFYSEAKLMFFVYLWYPKTKGTTYVYGTFFKPYISQHENEIDRNLLELRARATDTVVLYFQKAASAGQSTFFDVLKYVAAQSPSQKSRQRLHQDSQQPXQQQQPQVQVQQAQPQKQAAPVMRRASSIAARQAXAMAQQSQETKPVSSSPKIKRQTSARSGSVASTKPPVAASALKPGGSPKKGEVKPAADPVQTPTTGADSPKPEPSAPSLPGAEGVDKMAIDEASGDAPEGAEELDPALEEETPMEETIRVTRAKLRRRTATEDPAGN

SEQ ID NO: 78213 - protein, 767 aa, Vitis vinifera
MGSTILSDLATEIVVPVCAVIGIVFSLIQWFLVSRIKVSPDRHSSSSNNGKGAGYGDYLIEEEEGLNDHNVVVKCAEIQSAISEGATSFLFTEYQYVGVFMVAFAILIFLFLGSVNGFSTKSQVCTYNPQEMCKPALATAIFSTVSFMLGAVTSVISGFLGMKIATYANARTTLEARKGVGKAFIVAFRSGAVMGFLLAANGLLVLYIAINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHDFTAMCYPLLVSSMGILVCLITTLFATDFFEIKAVKEIEPALKKQLIISTVLMTVGVAIVSWIALPSSFTIFNFGSQKVVKNWQLFLCVGVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRASISTVDVLTPKVFIGLLVGAMLPYWFSAMTMKSVGSAALKMVEEVRRQFNTIPGLMEGLAKPDYATCVKISTDASIKEMIPPGALVMLTPLIVGTFFGVETLSGVLAGSLVSGVQIAISASNTGGAWDNAKKYIEAGASEHARTLGPKGSDPHKAAVIGDTIGDPLKDTSGPSLNILIKLMAVESLVFAPFFATHGGLLFKIF

SEQ ID NO: 78214 - protein, 477 aa, Arabidopsis thaliana
MTMSENSRNLEAGLLLRKNQNDINECRITAVVLFSTFVSVCGSFCFGCAAGYSSVAQTGIINDLGLSVAQYSMFGSIMTFGGMIGAIFSGKVADLMGRKGTMWFAQIFCIFGWVAVALAKDSMWLDIGRLSTGFAVGLLSYVIPVYIAEITPKHVRGAFVFANQLMQSCGLSLFYVIGNFVHWRNLALIGLIPCALQVVTLFFIPESPRLLGKWGHEKECRASLQSLRGDDADISEEANTIKETMILFDEGPKSRVMDLFQRRYAPSVVIGVGLMLLQQLSGSSGLMYYVGSVFDKGGFPSSIGSMILAVIMIPKALLGLILVEKMGRRPLLLMNDLYLQASTGGMCFFSLLLSFSFCFRSYGMLDELTPIFTCIGVVGFISSFAVGMGGLPWIIMSEIFPMNVKVSAGTLVTLANWSFGWIVAFAYNFMLEWNASGTFLIFFTICGAGIVFIYAMVPETKGRTLEDIQASLTDFLQ

SEQ ID NO: 78215 - protein, 110 aa, Arabidopsis thaliana
MGIKILLILGLLTLAVVAESANATWTLTKSCVNGQGCIGEDGELDYLMDSETNRRQLAARRSYISYGALRKNNVPCSRRDRSYYDCKKRKRANPYRRGCSVITHCYRQTS

SEQ ID NO: 78216 - protein, 366 aa, Zea mays
  misc_feature (40)..(40): Xaa can be any naturally occurring amino acid
  misc_feature (95)..(95): Xaa can be any naturally occurring amino acid
  misc_feature (107)..(107): Xaa can be any naturally occurring amino acid
  misc_feature (125)..(125): Xaa can be any naturally occurring amino acid
  misc_feature (140)..(140): Xaa can be any naturally occurring amino acid
MAAVDLTPRTPKKAYGGDGGAYYEWSPADLPMLAVASIGXAKLSLAAGGLSLPSYSDSAKVAYVLQGVGTCGLVLPEATKEKVVAVKEGDALALXPFGAVTWWGQRXPAAQADLTVLFLGDTSKXAHKRGQFTNFQLTGXAGIFTGLSTEFVSRAWDLPEPDAARLVSSQPASGIVKLPASAAALPAPSPQDRAGVVFNCLEAPLDVDIPGGGRVVVLNTANLPLVREVGLGADLVRIDAHSMCSPGFSCDSAYQVTYIVRGSGRVQVVGPDGRRVLETRIEGGSLFIVPRFHVVSKIADASGMEWFSIITTPNPVFSHLAGKTSVWKAISPEVLQASFNTTPEMEKLFRSKRLDSEIFFAPPSSN

SEQ ID NO: 78217 - protein, 141 aa, Xylella fastidiosa 9a5c
MVLERTLSIIKPDAVAKNVIGDIYSRFEKAGLKVVAAKYKQLSRREAEGFYAVHRDRPFFNALVEFMISGPVMIQVLESENAVARHRELLGATNPKDAALGTIRADFAESIEANAAHGSDSVENAAIEVAYFFAATEIILR

SEQ ID NO: 78218 - protein, 337 aa, Escherichia coli K12
MNVLICQQPKELVWKQREIPIPGDNEALIKIKSVGICGTDIHAWGGNQPFFSYPRVLGHEICGEIVGLGKNIADLKNGQQVAVIPYVACQQCPACKSGRTNCCEKISVIGVHQDGGFSEYLSVPVANILPADGIDPQAAALIEPFAISAHAVRRAAIAPGEQVLVVGAGPIGLGAAAIAKADGAQVVVADTSPARREHVATRLELPLLDPSAEDFDAQLRAQFGGSLAQKVIDATGNQHAMNNTVNLIRHGGTVVFVGLFKGELQFSDPEFHKKETTMMGSRNATPEDFAKVGRLMAEGKITADMMLTHRYPFATLAETYERDVINNRELIKGVITF

SEQ ID NO: 78219 - protein, 135 aa, Oryza sativa Japonica Group
MAEKEEGKVAAEGGAEAEADEEVEVKFRLFDGSDIGPLRCNAVATTVAALKDRVVADWPKDKTIVPKTANDVKLISGGKILENDKNIAQCRAPFGDLPSTAITMHVVVQPSSAKSKPDKKTNKLPKTTRCSCTIL

SEQ ID NO: 78220 - protein, 238 aa, Prunus tomentosa
AHYKSEADVGNAIAEAIQSGLVKREELFITSKASNHGHVVEACKSSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNIERGTPVIPKSSKVERLKENLEILNFKLEKEDI

SEQ ID NO: 78221 - protein, 460 aa, Zea mays
MLPYFDPEYENFNQRINPPRVCIDNTTCSDCTLVKVDSMNKNGILLEVLQVLSDLDLHIFKAYITSDGGWFMDVFHVVDKQGQKITDDKTIKYIEKALGPESNLLGAKGSNSAGRSVGLHSIGDHTAIELKGPDRRGLLSEIFAVLADLQCNVLAAEVWTHRMRVACVVYVNDVATGQAIDDPDRVARVEDRLRHVLRGYGGGGGAGDDDDGSGAHANFAAASSTPHHVDRRLHQLMHADVDAVHGDGAHAAAGGEGDRPAVTVEHCEEKSYSVVNVKCKDRSKLLFDIVCTLTDMEYVVFHAAVSSEANYGIQELYIRRKDGKTLLKDEAEKVIRCLEAAISRRVSEGFTLEVCGRDRVGLLSDVTRVLREHGLTVSRADVTTAGGQATNVFYVRNPSGQPVDMKTVEGLRGQFGQTAMLNVKSVGVPAAVAKAAEPSSGSMVRSSFFSFGSLFAKLRA

SEQ ID NO: 78222 - protein, 282 aa, Arabidopsis thaliana
DYRVEILSESLPFIQKFRGKTIVVKYGGAAMTSPELKSSVVSDLVLLACVGLRPILVHGGGPDINRYLKQLNIPAEFRDGLRVTDATTMEIVSMVLVGKVNKNLVSLINAAGATAVGLSGHDGRLLTARPVPNSAQLGFVGEVARVDPSVLRPLVDYGYIPVIASVAADDSGQAYNINADTVAGELAAALGAEKLILLTDVAGILENKEDPSSLIKEIDIKGVKKMIEDGKVAGGMIPKVKCCIRSLAQGVKTASIIDGRRQHSLLHEIMSDEGAGTMITGR

SEQ ID NO: 78223 - protein, 252 aa, Prunus padus
AHYKSEADVGNAIAEAIQSGLVKREELFITSKASNHGHVVEACKNSLKKLQLDYLDLYLVHYPLATKHNGVGTTASLLDENKVLDIDVTVSLETTWHDMEKTVSLGLVRSIGLSNYELFLTRDCLSYAKIKPQVSQFETHPYFQRESLVRFCKKHGVIPMAHTPLGGATANVKAFGSISPLEDPVLLGLAKKYQKSVAQIALRWNIERGTPVIPKSSKVERLKENLEVLNFKLEKEDIELIDTIDKKSRTTL

SEQ ID NO: 78224 - protein, 252 aa, Prunus caroliniana
AHYKSEADVGNALAEAFETGLVKREELFIISKASNHGHVVEACKDSLKKLQLDYLDLYLVHYPLATKHSGVGTTASLLDKNKVLDIDVTVSLESTWHDMEKTVSLGLVRSIGLSNYELFLTRDCLSYAKIKPQVSQFETHPYFQRETLVRFCRKHGVCPMAHTPLGGATANVKAFGSMSPLEDPVLHGLAKKYKKSVAQIALRWNIERDTPVIPKSSKVERLKENLEVLNFKLEKEDIELINTIDKKSRTTL

SEQ ID NO: 78225 - protein, 1434 aa, Gibberella zeae PH-1
MIHQPLPNLISHIHHGRIQQIAMKLSRLTLYMTLTAGCRGAYVQFQDCSEAHDSSSLIPESFRASVERGRDTFDWKFDFIAGLTNRNSCEVDLSNIVPRFSIVDHGNDTPYISGQIVNVSCLTSQRIGSRSKFTIITSFNRSTLLETYKTTFELTNSNNTALSCIKAVLTPAVPGPIRILGLWFPIITFALACVAACWPVRRGPGPNSSKNSLVARAIDVLAYIQFIFFSGSMSLKYPGFFQPLVGLSGWSTLMLPAGVVESRSPYARQGVNDGIYEHNGTITGAPGLELLTQMTGSAVKPQSWMNTFVLSLFVFVSLYIFSFIIHRLGNTNSNARSASANLESSFRTPYWAVSTVGFLPGGTGHSGKILVAYIALCGHVIVLVCIFLIPTLFDLSKLAFGREPAVLSDIESDMQSTTADTLFGGNNELVKFSSSKSSVSNKTLWDMILSRETKMFGDKTVSRIQPEVLSLFMRKVQGEDEHTNVCEISRGFNGSSNTLVGSTQSDEEIKSAVDVSPDALASYLVCKGNLALPTAPTYQDLDRPINEYFISTSHNTYLLGRQVATRSKLEGYIEALSKGCRSVEIDCWDGLNGQPVVKHGYSLTTSVSFRSVINAIKEYAFVSSDMPLWLSLEVHCCSSQRDIMAQVMIEVFGSSLITEPLQGCLDTLPSPSQLRGKILIKAKMPQDMNTKDSDKEGRDTVKLDQTHNDAGSMPEKGDESAAVTNQLQRKGLQEDALQKLAIYGAGKRLPHPDAIDSHRNFIYSMSETKLSKRISKEKPLGLIGTQHMVRVYPDPNRVDSSNFNPIKCWQHGVQMAALNYQTPDFNMRLNDAMFTGSLGYVIKAQPEPKQIRIAVDVLLVGGIHGLGADSPVYVELELILPDMPSQRVRTTAVSTHGAGTVFDQNLDISIGTKYPHLAFLHWSIKSLSNSRPMSTQSGIAKVSNLKKGYRILPLGVTEETGGFIFCTVTKTTVAVTEFTRDCREARSDLTSINGELSQLQLVLELLRDDTAVSDDQILPESLQEQILSIIDNCSAVVSKINLVLDNHSGKVGVLKWATFGKSEVAGLRMSLEAHRGSLNLALELVSVSLSKAIKSDTAAIRTDVHDIKQDTSQIPQIMDELNRLRVIVAGGDVPAATIGQNYILQQYLDDLTSYAETVCNDVEWETDSSVHALSRSSSPSGPRIESSAPSAPVIQLETSADAGSQVASLPNTDTQVCNEGDKTYLQPTKIVSTLDTSKTTSQAKKKIVLVGDSACGKTALCRRFLEGTFLATEFQTIFETYAAHIDGVDLSLWDTSGMDDNDRLRPLSYPDADAVLICFSFDYPDSLENVVEKWIGEVMYFLPGVPCILVGLKKDLHYDEKTIKELRKYDQQPVTWDQVNDTAKRINAFRYVECSAKTGDGVKEVFDILVGPFFPAVKKRSNALKSMFKRWSSK

SEQ ID NO: 78226 - protein, 436 aa, Azotobacter vinelandii
MRISIFGLGYVGAVCAGCLSGRGHEVVGVDISAAKIDMINQGKSPIVEPGLGELLAEGVKTGRLRGTTNVTEAVLATELSMLCVGTPSKLNGDLELDYIEEVCRQMGSALRDKTERHTVVVRSTVLPGTVHNVVIPILEEFSGKKAGVDFGVAVNPEFLRESTAIKDYNFPPMTVIGELDKASGRRLASIYAELDAPIVRKGIAVAEMIKYTCNVWHATKVTFANEIGNIAKAAGVDGREVMEVVCMDNKLNLSQYYMRPGLAFGGSCLPKDVSALSYRAHLWDIEAPLISSLMRSNAAQVQKAYDMIDKHGSRKVALLGLSFKAGTDDLRESPQLELAEMLIGKGFKLSIFDSNVEYARDHGANGHYIKNEIPHVSALLQSDLDKVVAEADVIVLGNADPRFEKLAKDVPAGKKVIDLVGFMPQRTAGAAEGICW

SEQ ID NO: 78227 - protein, 373 aa, Triticum aestivum
  misc_feature (367)..(367): Xaa can be any naturally occurring amino acid
HASAHASADAWADAWVVEKSTVPVKTAEAIEKILTHNSNGINFQILSNPEFLAEGTAIQDLFNPDRVLIAGRGTPEGQKAVQTLTAVYAHWVPEDQILTTNLWSAELSKLAANAFLAQRISSVNAMSALCEATGANVSEVSYAVGKDSRIGPKFLNASVGWGGACFQKDILNLVYICECNGLPEVANYWKQVIKINDYQKSRFVNRVVSSMFHTVANKKIAVLGFAFKKDTGDTRETPAIDVCKGLLGDKAKISIYDPQVTEDQIQRDLAMNKFDWDHPVHLQPMSPTTTKQVSVTWDAYEATKDAHGICIMTEWDEFKTLDYKKIYDSMQKPAFVFDGPHVVDSEKLREIGFIVYSMGQPLDGWLXDMPAVA

SEQ ID NO: 78228 - protein, 237 aa, Triticum aestivum
MSKLFHSACKAARSLIASSSAPASSLLADGRNAALATLANLGRNSTLPAAYAHHLHTNASSHGYAWIAAIPAAAYMLQDQDVHAAEMERTFIAIKPDGVQRGLISEIVSRFERKGYKLVAIKLVVPSKQFAEKHYHDLKERPFFSGLCDFLSSGPVLAMVWEGEGVIKYGRKLIGATDPSKSEPGTIRGDLAVVVGRNIIHGSDGPETAKDEIALWFQPKELVSYTSNEEKWIYGVN

SEQ ID NO: 78229 - protein, 223 aa, Prunus caroliniana
  misc_feature (61)..(61): Xaa can be any naturally occurring amino acid
  misc_feature (188)..(188): Xaa can be any naturally occurring amino acid
GLVKREELFITSKASNHGHVVEACKNSLKKLQLDYLDLYLVHYPLATKHSGVGTTASLLDXNKVLDIDVTVSLETTWHDMEKTVSLGLVRSIGLSNYELFLTRDCLSYAKIKPQVSQFETHPYFQRESLVKFCKKHGVTPMAHTPLGGATANVKSFGSISPLEDPVLLGLAKKYKKSVAQIALRWNIXRDTPVIPKSSKVERLKENLEVLNFKLGKEDIELIN

SEQ ID NO: 78230 - protein, 429 aa, Aspergillus nidulans FGSC A4
MESISPVYSAATKSDKRYSPPWADLSIIGIAGSSGSGKTSVAMEIVKSLDLPWVVILVMDSFYKSLNPEQHAKAHRNEFDFDSPDSIDFDVLVQCLRDLKQGIVELLDVKAVELSDGSQIVLRDVKERGRDIDGIIKQWFNYVKPSYKKFVEPQRSVSDIIIPRGIENKTAIGMVVQHIQRMLEEKSERHSATLQELRRITFEEQLSQNVIMMPQTPQSIGMNTILQNPETEQVDFVFYFDRLAALLIEKYILISDSSHSHGMADSRYRALDYTSYAPKEVETPQHNMYSGLKQEGIVSAVAILRGGSCLETALKRTIPDCVTGRVLIRTNETKEEPQLHYLKLPPGIEQHSNVMLLDSQMSSGGAALMAVRVLIDHGVPEDRIIFVTCAAVQSGVKRLAAVYPHVKLIVGRIEEESEPRWMEHRYFGC

SEQ ID NO: 78231 - protein, 177 aa, Polytomella sp. Pringsheim 198.80
MSSRLYVGNLSWNAKEEDLRTYFGKFGEVEEASIALDRESGRSRGFGFVTLPADVAKDAIEKTNGAEFMGRNIKVNEASPPGERPPRTNNYGGGYGDFNGNGGGRDYGRGGYGRGNGGYGGRNAGYGGRGNFGGQGGYGDNRFGNDNFGGSYGGRGGYRGPRGPSAEENNSNNYGGY

SEQ ID NO: 78232 - protein, 202 aa, Erythrobacter sp. NAP1
MLTLPNILTLSRIFAVPLLGFLLWWPDWQLGYLIGFALYCVIAITDFFDGYLARAQGTVSKLGIFLDPIADKIMVAAVILILTAQGFLRGPYVGDMHVIAGLVILIREITVSGLREFLGGIQVSVPVTKLAKWKTTFQLVALGALILGGAVHGQPCQSPGAACASVEETWIHVVGLASLWAAAVLTCITGWDYLRVGLKHME

SEQ ID NO: 78233 - protein, 251 aa, Prunus laurocerasus
AHYKSEADVGNAIAEAIQRGLVKREELFITSKASNHGHVVEACKNSLKKLRLDYLDLYLVHYPLATKHSGVGTTASLLDENKVLDIDVTVSLESTWHDMEKTVSLGLVRSIGLSNYELFLTRDCLSYAKIKPQVSQFETHPYFQRETLVRFCRKHGVCPMAHTPLGGATANVKAFGSISPLEDPVLRALAKKYKKSVAQIALRWNLDRNTPVIPKSSKIERLKENLEVLNFKLEKEDIELINSIDKNPGPL

SEQ ID NO: 78234 - protein, 217 aa, Klebsiella pneumoniae subsp. pneumoniae MGH 78578
MNQTLLSSFGTAFERVEHALDALREGRGVMVLDDEDRENEGDMIFAAETMTVEQMALTIRHGSGIVCLCLTEERRKQLDLPMMVENNTSAYGTGFTVTIEAAEGVTTGVSAADRVTTVRAAIADGAKPSDLNRPGHVFPLRAQPGGVLTRGGHTEATIDLVTLAGFKPAGVLCELTNDDGTMARAPECIKFAQQHNMAVVTIEDLVAYRREHERKAS

SEQ ID NO: 78235 - protein, 522 aa, Candida intermedia
MGLEDNRMVKRFVNVGEKKAGSTAMAIIVGLFAASGGVLFGYDTGTISGVMTMDYVLARYPSNKHSFTADESSLIVSILSVGTFFGALCAPFLNDTLGRRWCLILSALIVFNIGAILQVISTAIPLLCAGRVIAGFGVGLISATIPLYQSETAPKWIRGAIVSCYQWAITIGLFLASCVNKGTEHMTNSGSYRIPLAIQCLWGLILGIGMIFLPETPRFWISKGNQEKAAESLARLRKLPIDHPDSLEELRDITAAYEFETVYGKSSWSQVFSHKNHQLKRLFTGVAIQAFQQLTGVNFIFYYGTTFFKRAGVNGFTISLATNIVNVGSTIPGILLMEVLGRRNMLMGGATGMSLSQLIVAIVGVATSENNKSSQSVLVAFSCIFIAFFAATWGPCAWVVVGELFPLRTRAKSVSLCTASNWLWNWGIAYATPYMVDEDKGNLGSNVFFIWGGFNLACVFFAWYFIYETKGLSLEQVDELYEHVSKAWKSKGFVPSKHSFREQVDQQMDSKTEAIMSEEASV

SEQ ID NO: 78236 - protein, 400 aa, Oryza sativa
  misc_feature (229)..(229): Xaa can be any naturally occurring amino acid
MASFLSCRTPSIAIPVDSDASPRKNTPETVTSPLVNGEKSIFRDQVRGYSALGSPLRREVGNRSITRSFCIDNTDLEDGKAEKDRDRPSHFLSLPKIQNQALLSGLAYCISSCSMILVNKYILSGYGFSAGIFLMLYQNIVSVTIVSTLSLSGVIPTEPLTWKLIKVWLPVNIIFVGMLITSMFSLKYINVAMLTILKNVANVLTASGETYFFKKQHDRQVWISLTLMXIAGGITDLSFNAIGYTWQILNCFLTASYSLTLRHVMDSAKQATKSGNLNELSMVLLNNILSVPLGIILVLGFNEVEYLFETPLLRMPMFWIVITASGVLGLAISFTSMWFLHQSSATTYSLVGSLNKIPLSIAGILLFKVRTSMENSFSILFGLLAGVFFARAKLLNNSQS

SEQ ID NO: 78237 - protein, 106 aa, Zea mays
DLATMEWEEAVAWSRPRYRCFTGLCEAASQGGAIPAAAAGGNNKVKVFGGDGKVWFAGKRVRGKLAMWEEDEMGSSGKWDWVDGLPGYGDGVYRGFVFDGGFTAIP

SEQ ID NO: 78238 - protein, 420 aa, Salmonella enterica subsp. enterica serovar Paratyphi A str.
MSFTTISVIGLGYIGLPTAAAFASRQKQVIGVDINQHAVDTINRGEIHIVEPALGNVVKMAVEGGFLRATTTPVEADAYLIAVPTPFKGDHDPDMAYVEAAAKSIAPVLKKGALVILESTSPVGATEQMAGWLAGMRPDLTFPQQAGEQADVNIAYCPERVLPGQVMVELIKNDRVIGGMTPVCSARASALYKIFLEGECVVTNSRTAEMCKLTENSFRDVNIAFANELSLICAEQGINVWELIRLANRHPRVNILQPGPGVGGHCIAVDPWFIVAQNPQQARLIRTAREVNDSKPHWVVDQVKAAVADCLAATDKRASEVKIACFGLAFKPNIDDLRESPAMGIAQSIARWHSGETLVVEPNIRQLPKKLDGLCTLAKLDAALAAADVLVMLVDHDEFKAIPGDAVHQRYVVDTKGVWR

SEQ ID NO: 78239 - protein, 442 aa, Ralstonia solanacearum GMI1000
MFRLPALPRIPTAPFCPSEVRGCVAIPPDLPLWKKLLRFAGPGLLVSVGYMDPGNWATDIEAGSRYGYSLLFVVLLSSLAAMVLQCLSARLGIVTGKDLARLSRERYRPGAVRVQWLLAELSIVACDLAEVLGCALAFHLLLGVPILGGVALTALDTLIVLGLKGKNFRQLEAIVLGLILTIGLCYFVELALIRPHWPSVAGALVPSWQALSAREPLYLAIGILGATVMPHNLYLHSSIVQTRVVSETEPARREAVGLSRLDTIVSLSLALLVNGAILVLAAAAFHANGHQDVADIQDAHRLLEPIVGTAVAGVLFGIALLAAGQSSTFTGTIAGQILMEGFLELRIPCWQRRLATRALALIPAFVGVAMLGDHAIGRLLVISQVVLGFQLPFAMFPLIRMTGDRALMGTFANGRLTSAVAWCLFAVISVANLWLVWQVLAG

SEQ ID NO: 78240 - protein, 232 aa, Rhodococcus sp. RHA1
MATTHGSRASLEKDPHEVASMFDGVAKRYDLTNTILSFGQDRSWRKATRSALALKPGERVLDLAAGTGVSTVELGRSGAWCVATDFSKGMLQAGSGRHVPMVAGDAMHLPYADAVFDAATISFGLRNVSDFDAGLREIARVTKPGGRLVVSEFSTPVFGPFRTVYMEYLMRALPRVARAVSSNPDAYVYLAESIRAWPTQQELALRIEAAGWRNVQWRNLTGGVVALHRATR

SEQ ID NO: 78241 - protein, 315 aa, Glycine max
MEAPSNLEISVDVPPYLRVHKDGTQVVPAGLDSDTDVVSKDILIVPETGVTARLYRPNSTPKTAKLPLLLYFHGGAFCISSASDPLYHTSLNNLVAEANVVALSVNYRLAPEHPLPTAYQDSWSAIQWAASNAKHHQEDWIRDNVDFDRVFLAGDSAGANMGHYTALKLNNNVPTNDDFDFKVAGLIMVNPYFWGKEAIGVEITDPERKKMVDKWWSFVCPSDKGNDDPLINPFVEEAPGIEGVAGDRVLVTVAEKDILRERGELYHKRLSNCGWKGIAEFYETPGEDHVFHIFNPDCDKAKSLIKRIADFINEH

SEQ ID NO: 78242 - protein, 438 aa, Oryza sativa
  misc_feature (137)..(137): Xaa can be any naturally occurring amino acid
MMAAAKRPYCKPPPPTTTTTAITSSSGQNHKRLRPSLPAAAAMDGGMEEEAVAPPPPTTMTTTTPPQPLLPGLPDHLAQLCLSPLPPRLLHAVCRPWRRLMYAPSFPPFLSLYALLDDADADAGVSFAAYDPLAGTXGDALPSPPMPSPPPMLWHPSFLARRLPLQSVAAAGRLVLVSGSTQSLHPALSRPLVFDPAAPTPRWQLGPRIPLSPRRWCAAGAARGRVFVAGGVGAGYDPAVARSGATWDPAASPPPAAAWEPIPPLRDGRFSRDAAEAVCSGGKVCMVNLRTPGAKEGAVFDLRAGRWEDMPPGMLAGWKGPAAASPPDDGETMYVVDEERGALTAYDWGPDRWRTVAESDRLKGAAEMTVAGGKACVVAPGGGKVLIVDVTPPPPPPPAARRESWAAPPPPPRMWEVAAPGGKRVVSLHVLPRMTRPE

SEQ ID NO: 78243 - protein, 607 aa, Arabidopsis thaliana
MMWKNIAGLSKAAAAARTHGSRRCFSTAIPGPCIVHKRGADILHDPWFNKDTGFPLTERDRLGIRGLLPPRVMTCVQQCDRFIESFRSLENNTKGEPENVVALAKWRMLNRLHDRNETLYYRVLIDNIKDFAPIIYTPTVGLVCQNYSGLYRRPRGMYFSAKDKGEMMSMIYNWPAPQVDMIVITDGSRILGLGDLGVQGIGIPIGKLDMYVAAAGINPQRVLPIMLDVGTNNEKLLQNDLYLGVRQPRLEGEEYLEIIDEFMEAAFTRWPKAVVQFEDFQAKWAFGTLERYRKKFCMFNDDVQGTAGVALAGLLGTVRAQGRPISDFVNQKIVVVGAGSAGLGVTKMAVQAVARMAGISESEATKNFYLIDKDGLVTTERTKLDPGAVLFAKNPAEIREGASIVEVVKKVRPHVLLGLSGVGGIFNEEVLKAMRESDSCKPAIFAMSNPTLNAECTAADAFKHAGGNIVFASGSPFENVELENGKVGHVNQANNMYLFPGIGLGTLLSGARIVTDGMLQAASECLASYMTDEEVQKGILYPSINNIRHITAEVGAAVLRAAVTDDIAEGHGDVGPKDLSHMSKEDTVNYITRNMWFPVYSPLVHEK

SEQ ID NO: 78244 - protein, 433 aa, Lentisphaera araneosa HTCC2155
MNKNIAIIGLGYVGLPLAIEFGKKVTTLGFDINQARIKELNKGHDATLEVEEHEFTEAHKLTFTYDVEELKNAQIYIVTVPTPIDEHKRPDLSPLEKASQTVASVIKKGDIVIYESTVYPGATEEVCIPIIEKLSGLKYISTETLEANSQALKTENDVFYAGYSPERINPGDKTHRLPNIKKVTSGSTPEIGQEIDKLYQNIITAGTHLAPSIKVAEAAKVIENTQRDLNIALVNELALIFEKIGIDTLDVLEAAGTKWNFLPFRPGLVGGHCIGVDPYYLTHKAQQVGYQPEIILAGRRLNDGMGAYVANTVIKLMIAKGQTIAGAKVLVKGITFKENCPDIRNSRVIDVIEELQSFHVKVSVHDPWANAQEVKDEYAVDLVQELDSDYDAVILAVAHKEFKDLDIKSITHDNSVIYDIKCVLDPTQIDGRL

SEQ ID NO: 78245 - protein, 333 aa, Sulfolobus solfataricus P2
MSNSSIDIGVPSLPPPFSIGTISIPTFSRQHLFLKIILHYNLVERYSRQLIVLGLGIQQRLNELKILIAGCGALGTAVAELLARLGVKELTIVDADVVDITNLHRVHLFDENDVGKPKAEVCAKKISLINSSIKINYIIDILDEENVERLISDKDYVFDALDSLYYKLLLNDAIVKLGKILIYGGINGEYGSAKLIDPSQTSCLSCFIDYSDQDEIGNSCDVIGTTPLIVELTATLQVNLMLNHLRGNPDYSLFYIDSRELKIERINIEKNSQCKTCVLNEYPFLYQKISKPKCGIFRTNMKIPELDEPKVFKNLGNVTLCYPSIGCFEKRGR

SEQ ID NO: 78246 - protein, 284 aa, Arabidopsis thaliana
SPDYRVEILSESLPFIQKFRGKTIVVKYGGAAMTSPELKSSVVSDLVLLACVGLRPILVHGGGPDINRYLKQLNIPAEFRDGLRVTDATTMEIVSMVLVGKVNKNLVSLINAAGATAVGLSGHDGRLLTARPVPNSAQLGFVGEVARVDPSVLRPLVDYGYIPVIASVAADDSGQAYNINADTVAGELAAALGAEKLILLTDVAGILENKEDPSSLIKEIDIKGVKKMIEDGKVAGGMIPKVKCCIRSLAQGVKTASIIDGRRQHSLLHEIMSDEGAGTMITGR

SEQ ID NO: 78247 - protein, 313 aa, Sulfolobus solfataricus P2
MMQGNIYSMRETFGRLLADLGDKNKDLVVITADVGDSTRALYFREKFKDRYFNVGIAEQDMVNFAAGLAAVGKKPAIVNFGMFLMRAWEQIRNSIARMNLDVKMFVTHTGYSDHGDGSSHQVLEDIALMRVLPNMKVVVPADPKDIERSLPVIINEERGPLYYRIGREYSPPITIGQEYEFKIGKAYVIKDGSDLAIIGAGVVLWDALKAAEELEKLGISVAVINLFSIKPIDENTIEYYARKAGKIITIEEHSIYGGIGSAVAEVTARRYPVPIRFVGATTFGRSARSQRDLLDYYNINYKTIIREAIDLLK

SEQ ID NO: 78248 - protein, 408 aa, Escherichia coli
GSMIFSVDKVRADFPVLSREVNGLPLAYLDSAASAQKPSQVIDAEAEFYRHGYAAVHRGIHTLSAQATEKMENVRKRASLFINARSAEELVFVRGTTEGINLVANSWGNSNVRAGDNIIISQMEHHANIVPWQMLCARVGAELRVIPLNPDGTLQLETLPTLFDEKTRLLAITHVSNVLGTENPLAEMITLAHQHGAKVLVDGAQAVMHHPVDVQALDCDFYVFSGHKLYGPTGIGILYVKEALLQEMPPWEGGGSMIATVSLSEGTTWTKAPWRFEAGTPNTGGIIGLGAALEYVSALGLNNIAEYEQNLMHYALSQLESVPDLTLYGPQNRLGVIAFNLGKHHAYDVGSFLDNYGIAVRTGHHCAMPLMAYYNVPAMCRASLAMYNTHEEVDRLVTGLQRIHRLLG

SEQ ID NO: 78249 - protein, 447 aa, Klebsiella aerogenes
MDQTCTLEGFLTRVQQRDPHQTEFAQAVREVMTTLWPFLEENPRYRQLALLERLVEPERVIQFRVVWVDDRNQVQVNRAWRVQFNSAIGPYKGGMRFHPSVNLSILKFLGFEQTFKNALTTLPMGGGKGGSDFDPKGKSDGEVMRFCQALMTELYRHLGPDTDVPAGDIGVGGREVGFMAGMMRKLSNNSACVFTGKGLSFGGSLIRPEATGYGLIYFTEAMLKRHGLGFEGARVAVSGSGNVAQYAIEKAMELGARVVTASDSNGTVVDEAGFTKKKLARLIDIKERAHGRVADYAREFGLTYLEGQQPWSVPVDIALPCATQNELDVDAARQLIANGVKAVAEGANMPTTIAATDLFLEAGVLFAPGKAANAGGVATSGLEMAQNAARMGWKAEKVDARLHHIMLDIHHACVQYGGEAKQTNYVRGANIAGFVKVADAMLAQGVI

SEQ ID NO: 78250 - protein, 254 aa, Oemleria cerasiformis
SEADVGQAFAEAFKTGLVKREELFITSKANHGHVVEACKNSLKKLQLDYLDLYLVHYPLATKHSGVGTTASLLDENKVLDIDVTVSLEETWRGMEKAVSLGLTRSIGLSNYELFLTRDCLSYAKIKPAVSQFETHPYFQRESLVRFCQKHGVVATAHTPLGGATANTKYFGSISPLGDPVLHDVAKKYQKSVAQICLRWNIERNTPVIPKSSKVERLKENLQVLEFKLEKEDIELINGIDKKSRSTLPSLSWGL

SEQ ID NO: 78251 - protein, 264 aa, Sorbus aucuparia
AHYKSEADVGEALTEAFKTGLVKREELFITTKIWNSDHGHVVEACKNSLEKLQLDYLDLYLVHYPMPTRHNAIGKTASLLGEDKVLDIDVTVSLQQTWEGMEKAVSLGLVRSIGLSNYDLFLTRDCLAYSKIKPAVSQFETHPYFQRDSLIKFCIKHGVLPTAHTPLGGAAANKDMFGSVSPLDDPVLNDVAKKYGKSVAQICLRWGIQRKTAVIPKSSKIQRLKENLEVLEFQLSDEDMQLIYSIDRKYRTSLPSKTWGLDVS

SEQ ID NO: 78252 - protein, 355 aa, Lupinus albus
MNSFPLTVSALCCVVIVFITALPFSSDAQLSTLFYDKKCPNLHAIVRNVTSNASKSDPRIGASLVRLHFHDCFVQGCDASILLNNTATIVSEQQAFPNNNSIRGLDVVNQIKTAVENACPGVVSCADILTLAAEISVVLGNGPDWKVPLGRRDSLTANRTLANQNLPAPSSTLDQLKSAFAVQNLTTSDLVALSGAHSFGRAHCNFFVNRLYNFSNSGSPDPSLNTTYLQTLRTICPNGGAGTNLTNFDPTTPDTFDKNYYSNLQVHKGLLQSDQELFSTTGADTISTVNSFSTNQTLFFEAFKVSMIKMGNISVLTGNQGEIRKHCNFVIDNSTGLLATMASQESSEDGMVSSY

SEQ ID NO: 78253 - protein, 265 aa, Kageneckia oblonga
AHYKSEADVGEALAEAFKSGLVKREELFITTKIWNSDHRYVAEACKNSLEKLQLQYLDLYLVHYPLPTRHNAIGKTASLLGEDKVLDIDVTIPLQQTWEGMEKTVALGLVRSIGLSNYDLFLTRDCLAYSKIKPAVSQFETHPYFQRDSLVKFCMKHGVLPTAHTPLGGAAANKDMFGSVSPLDDPVLNDVAKKYGKSVAQICLRWGIQRKTAVIPKSSKIQRLKENLEVLEFQLSDEDMQLIYSIDKKYRTSLPSKTWGLDVYA

SEQ ID NO: 78254 - protein, 796 aa, Glycine max
  misc_feature (665)..(665): Xaa can be any naturally occurring amino acid
MAFSISLFLLVLLFSFQSSSSSLLSLNKGSSLSVEKHAEDVIVSPNQMFCAGFFQVGENAFSFAIWFNDPHTHNNNHTVVWMANRETPVNGRLSKLSLLNSGNMVLVGAGQITTWSSNTASDAPVKLHLQDDGNLVLLDLHGTILWQSFDTPTDTLLPGQLLTRYTQLVSSRSQTNHSPGFYKMLFDDDNVLRLIYDGPDVSSTYWPPPWLLSWQAGRFNYNSSRVAVLNSIGNFTSSDNYDFSTDDHGTVMPRRLKLDSDGNARVYSRNEALKKWYVSWQFIFDACTSHGICGANSTCSYDPKRGRRCSCLPGYRVKNHSDWSYGCEPMFDLTCSRNESIFLEIQGVELYGYDHNFVQNSTYINCVNLCLQDCNCKGFQYRYDGNQIFSCFTKSQLLNGRRSPSFNGAIYLRLPITNNFSKEESVSADDHVCSVKLRKDYVRKPENRLVRFFLWLATAVGALEVIFFFLIWGFLIWNLKTSSADQQGYHLAAVGFRKYSYLELKKATKGFSQEIGRGAGGIVYKGILSDQRHVAIKRLYDAKQGEGEFLAEVSIIGRLNHMNLIEMWGYCAEGKHRLLVYEYMENGSLAQNLSSNTLDWSKRYSIALGTARVLAYLHEECLEWILHCDIKPQNILLDASYQPKVADFGLSKLLNRNNLNNSSFXMIRGTRGYMAPEWVLNLAITSKVDVYSYGIVLLEMITGKSPTTTGVQNIDGEEPYNGRLVTWVREKRSATSWLEHIIDPAIKTNYDECKMNLLATVALDCVEEDKDVRPTMSHVVEMLQSHESDPRNIINA

SEQ ID NO: 78255 - protein, 265 aa, Vauquelinia californica
AHYKSEADVGEALAEAFKTGLVKREELFITTKIWNSDHGHVVEACKNSLEKLQLDYLDLYLVHYPMPTRHNAIGKTASLLGEDKVLDIDVTISLHTTWEGMKKAVSLGLVRSIGLSNYDLFLTRDCLAYSKIKPAVSQFETHPYFQRDSLVKFCMKHGVLPTAHTPLGGAAANKDMFGSVSPLDDPVLNDVAKKYGKSVAQICLRWGIQRKTAVIPKSSKIQRLKENLEVLKFQLSDEDMQLIHGIDRKYRTSLPSKTWGLDVYA

SEQ ID NO: 78256 - protein, 78 aa, Erythrobacter sp. NAP1
MSDTADRVQKIVVEHLGVEGDKVTQDASFIDDLGADSLDIVELVMAFEEEFGVEIPDDAAEKISTVGDATKFIEENKG

SEQ ID NO: 78257 - protein, 431 aa, Prochlorococcus marinus str. MIT 9313
MIDSLDLVIDTIVAREVLDSRGNPTVEAEVLLEAGAIGRAIVPSGASTGAHEAHELRDGDSRYLGKGVTKAVNHIEDRIAPALCGISSLDQASVDGTMQELDGSDNKSSLGANAILAVSMATARAAANGLGLPLYRYLGGPMASLLPVPLMNVINGGAHAANNLDFQEFMLVPHGASSFRESLRMGAEVFHTLKGLLSAQGLSTAVGDEGGFAPNLANNDAAGDLLIQAIEKAGYSPGKDISLALDVASTEFYQDGCYAFGGGRYTSTEMVNELEKLVDRYPIISIEDGLAEDDWQGWALLTKKLGKRIQLIGDDIFVTSTKRLQQGIDQNVANSILIKVNQIGSLTETLQAIDLAGRSGYTSVISHRSGETEDTTIADLAVATRAGQIKTGSLSRSERVAKYNQLLRIEDELGSQAVYAGATGQGPRGRS

SEQ ID NO: 78258 - protein, 231 aa, Oryza sativa Indica Group
MATEIEAYYDDGSGTYLLSFDEDFLDATLTKSGGKVESWLGETYRIHRSCGHPLVVGLDVEWRPAAPVPGPVAVLQLCVDRRCLVFQILHADYVPDALSRFLADPRFTFVGVGVRDDAARLRVGYGLEVPRAVDLRALAADTLGRPDLRRAGLRALVREVMGVQMDKPHHVRVSAWDKRNLSEDQFKYACTRRVRVPGRSAGGSTPATATAHDDVVSFVVGWTGLLTFCHI

SEQ ID NO: 78259 - protein, 265 aa, Amelanchier alnifolia
AHYKSEADVGEALAEAFNTGLVKREELFITTKIWNSDHGHVVEACKNSLEKLQLDYLDLYLVHYPMPTRHNAIGKTASLLGEDKVLDIDVTISLQQTWEGMEKAVTLGLVRNMGLSNYDLFLTRDCLAYSKIKPAVSQFETHPYFQRDSLVKFCIKHGVLPTAHTPLGGAAANKDMFGSVSPLDDPVLNDVAKKYGKSVAQICLRWGIQRKTAVIPKSSKIQRLKENLEVLEFQLSNEDMQLINGIDRKYRTSLPSKTWGLDVYA

SEQ ID NO: 78260 - protein, 503 aa, Hordeum vulgare subsp. vulgare
MVAPAKIPQRQLFIDGEWRAPALGRPLPVINPTTEVSIGEIPAGTSEDVDAAVAAARAALKRNRGRDWSRAPGAVRAKYLRAIAAKMIERKSDLARLEALDCGKLLDEAAWDMDDVAGCLEFFAGHAEALDKRQNAAVALPENFKCHLKKEPIGVVALITPWNYPLLMAVWKVAPALAAGCTAVLKPSELASVTCLELGDVCREVGLPSGVLNIVTGLGNEAGAPLSSHPDVDKVAFTGSYATGQKIMVAAAPTVKPVTLELGGKSPIVVFDDVDIDKAVERTLFGCFWTNGQICSATSRLLIHKNIAKEFVDRMVAWSKNIKVSDPLEEGCRLGPVVSEGQYEKIKKFVANAKTEGATILTGGVRPKHLEKGFFIEPTIITDINTSMEIWREEVFGPVLCVKEFSTEEEAIELANDTHYGLAGAVISGDSERCQRLAEEIEAGCIWVNCSQPCFCQAPWGGNKRSGFGRELGVGGIDNYLSIKQVTGYTSDAPWGWYKAPAN

SEQ ID NO: 78261 - protein, 544 aa, Aspergillus nidulans FGSC A4
MPRHLAWYDQDGEPTIHNPFKKFRRSPRRTNSIQLESRLTQFSSAGAVRPEEEIRRNREIREGLGGPAHSDSFPPGTGTTVDSVARPESMEKAEPEPSMSSGDPINVSTRASPAGESEGIPRKRTRFLRLSEPSNEEGKEISEDELRDKQKFTPVGQFKATVLNSWINILILAAPVGIALNYVDVDPVAVFVVNFIAIIPLAAMLSFATEEIALRTGETIGGLLNASFGNAVELIVAIIALVHNEVLIVQTSLIGSMLSNLLLVLGMCFLFGGINRLEQHFNPVVAQTAASLLSLSVGALIIPTAFNAWSDADKSKTAPLSRGTSVILLVVYGCYLYFQLSTHVEMYNAPSQKSEKIRQKVSEGDASRGIAQIGHMSAALAGANNEPVQDPDDEPEEPQLHIYVAIATLCISTALVGVCAEFMVDSIDALTDRGGISKTFVGLILLPIVGNAAEHATAVTVAIKDKMDLSIGVAVGSSMQIAMLVLPFIVVLGWIMGKDDMVILLFVSVLLVNYLIADGKSHWLEGVLLMMMYIIISVAAWFYG

SEQ ID NO: 78262 - protein, 326 aa, Zea mays
MEEAVQLCLAAKSNDLKKVQTLITSGADVSHFDGDGLTPLMHAAKTGNAEIISALLEAGAPWNALSPSNLSAGDFAMEAGHQEAFDLLLKTGIQSELILGTIARKETKNEYSNQEYLQDRVTFSEDKIMDNESKGVMMSWEKPLMEAHAKAICTNGGSILNVGFGMGLVDTAIQQYNPTKHTIIEAHPDVYKRMIESGWGEKENVRIVFGRWQDVLGELDECGYDGIFFDTYGEYYEDLWEFHQNLPKLLKSDGIYSYFNGFCGSNAFFHVVYCNLVTLEIESLGFSTQLIPLPVKDCLGDEVWEGVKQKYWQLDTYYLPVCQFSE

SEQ ID NO: 78263 - protein, 611 aa, Candida glabrata
MENKEHHHHHHHHHHHHSNGSYVSNKVSSLADGSRVGNYQIVKTLGEGSFGKVKLAYHVTTGQKVALKSINKKVLAKSDMQGRIDREISYLRLLRHPHIIKLYDVIKSKDEIIMVIEYAGNELFDYIVQRNKMSEQEARRFFQQIISAVEYCHRHKIVHRDLKPENLLLDEHLNVKIADFGLSNIMTDGNFLKTSCGSPNYAAPEVISGKLYAGPEVDVWSCGVILYVMLCRRLPFDDESIPVLFKNISNGVYTLPKFLSPGASDLIKRMLIVNPLNRISIHEIMQDEWFKVDLAEYLVPQDLKQQEQFNKKSGNEENVEEIDDEMVVTLSKTMGYDKDEIYEALESSEDTPAYNEIRNAYILIKDNKSLIKDMKQDNNVTQELDTFLSQSPPTFQQNGDGMKASEDQKKKHSGRRLASSVTQQRTFHQPPFMDQSKEEDSTISIPTSLPQIHRANMLAQGLPAASKISPLVTKKSKTRWHFGIRSRSYPLDVMGHIYIALKNLGAEWANPSEEDLWTIRVRWKYDSDESRLIEDGVKKIPNLMKIVIQLFQIETNNYLVDFKFDGWESTYGDSTISTNMSEDEMSTFSAYPFLHLTTKLIMELAVNSQGN

SEQ ID NO: 78264 - protein, 130 aa, Vitis vinifera
MVTPGSAGPKVSSEVIAEYTVAALRRTVPPAVPGIVFLSGGQSEEEATLNLNAMNKLEVLKPWTLSFSFGRALQQSTLKTWGGKTENVGKAQGAFLGRCKANSEATLGKYEGGTGGGLASESLYVKGYKY

SEQ ID NO: 78265 - protein, 356 aa, Vitis vinifera
  misc_feature (119)..(119): Xaa can be any naturally occurring amino acid
  misc_feature (148)..(148): Xaa can be any naturally occurring amino acid
  misc_feature (159)..(159): Xaa can be any naturally occurring amino acid
  misc_feature (315)..(315): Xaa can be any naturally occurring amino acid
MASSIPSSSFGTPPSILSIQELAKQPMATVPQIFLLEDQERPVLLENASLPDIPTIDMKRLIMSETTDFELDKLHSACKEWGFFQLVNHGVSSSLVENLKHEIVEFYKLPLEEKMKYKXPGDAEGYGPSIRSEDQKLDWADRFYMITXPIHRRKPHLLXQLPPSLRDNLELYISESQKLAMRLLGLMARAIKLDKREMEELFDDGRQEVRMTYYPPCPQSEMVMGIAPHSDPTGITILLQVNEVDGLQIKKDGVWIPVNLLQDALVVNVGDILEIVSNGMYTSIEHRATVNSTKERISIAMFFSPKFSAEIGPAXGLITPQNPPVFKRIGMEKYYQDFFSRKLDGKSNLEHMKIKK

SEQ ID NO: 78266 - protein, 189 aa, marine gamma proteobacterium HTCC2080
MRTVSYRAEDNIRNWRGTQPRIGARVMVDPSAVVLGDITLGDDVSIWGNCSIRADMHRISIGDNTNIQDNSVLHITHAGDFNPDGYPLIIGNQVTVGHRAVLHGCTLGNRVLVGMGAIVMDGAVVEDEVMIAGGALVTPGKQLESGWLYGGSPAKPMRKITEKERGFLSYSAENYARLKQQYLDDTVSV

SEQ ID NO: 78267 - protein, 431 aa, Pyrococcus abyssi GE5
MKAIDVIERYSKIIAPANRMHYFPLVPVRAENAKIWDIEGKEYIDFLSNAAVQNVGHNNPRVVKAIKEQVEKLTHASYIYSYPVEPLLLAEKLAEIAPVDDPKISFGLTGADANDGAIKYARAYTKRQAILSYMKSFYGSTYGAMSLTGLDFQVRAMVGELSEIHYIPYPNCYRCPFGKEPGSCKMECVEYLKEKFEGEVYAEGVAALFAEPIQGDSGIVVPPKDYFRKVVKILREHGILFVVDEVQSGMGRTGKWFAIEHFGVRPDIITVGKSLGGGLPISATIGRREIIDSLPPLSHAFTLSGNPTASRAALAVIEEIEEKNLLRRAEKLGNHAMKRLKKMMDEHELIGDVRGIGLMIGVELVKDRETKERAIEETQKVIERAFELGLIVTHFNGNVLRIEPPLTIEEETLDEGLDILERAISEVEEEK

SEQ ID NO: 78268 - protein, 280 aa, Glycine max
MAATSSLCSSTLQSQINGFFLHKTSLSHTPSLTFSRRKISTTVKATSRVDKFSKSDIIVSPSILSANFSKLGEQVKAVELAGCDWIHVDVMDGRFVPNITIGPLVVDALRPVTDLPLDVHLMIVEPEQRVPDFIKAGADIVSVHCEQSSTIHLHRTVNQVKSLGAKAGVVLNPGTPLSAIEYILDVVDLVLIMSVNPGFGGQSFIESQVKKISDLRRLCAEKGVNPWIEVDGGVGPANAYKVIEAGANALVAGSAVFGAKDYAEAIRGIKTSKRPEVVAV

SEQ ID NO: 78269 - protein, 288 aa, Zea mays
MSKGDVVIETAAEAEATAKAPYWDPPPAPLLDTSELKKWSLYRALIAEFMATLIFLYVSVATVIGYKSQSQAEACTGVGFLGVAWSFGATIFILVYCTGGISGGHINPAVTFGLFVGRKLSLVRTLLYIAAQCLGAVCGVGIVKAIMKHPYNSLGGGANEVATGYSVGGALAAEIVGTFILVYTVFSATDPKRTARDSFIPVLVPLPIGFAVFVVHLATIPITGTGINPARSLGAAVLYNQHDAWKDHWIFWVGPLIGATVAALYHKLVLRGEAVKALGSFRSTSATV

SEQ ID NO: 78270 - protein, 333 aa, Rhodococcus sp. RHA1
MPLRIAIIATGGTIASTTSEGGVVANQTAATLLEGTGIAGVEIETIDLMTIGSYQMTLGHLRQISDQVADLLAREHERVDGIVITHGTDTMEETAILLDLVHDDPRPLVLTGAQHPRDAVAGDGPRNLADAVRVAASPDARELGVLIAFAGRILPARGTRKMHTTALAAFDSMVGGSVGNVSGGAVSIISAPRRPKPLPRPTLAFDDTRVDLVEMYPGGDAALIHAAVAAGAKGVIVAGTGIGNANPAVVAAARDLLPRGVFLVLSTRVPEGPVAGVYGNGGGADLVAAGVPAASGLPATQLRILLALWLSQRVDASEQVNSLIDIYADNKED

SEQ ID NO: 78271 - protein, 265 aa, Amelanchier alnifolia
AHYKSEADVGEALAEAFNTGLVKREELFITTKIWNSDHGHVVEACKNSLEKLQLDYLDLYLVHYPMPTRHNAIGKTASLLGEDKVLDIDVTNFLQQTWEGMEKAATLGLIRNIGLSNYDLFLIRDCLAYSKIKPAVSQFETHPYFQRDSLVKFCIKHGVLPTAHTPLGGAAANKDMFGSVSPLDDPVLNDVAKKYGKSVAQICLRWGIQRKTAVIPKSSKIQRLKENLEVLEFQLSNEDMQLINGIDRKYRTSLPSKTWGLDVYA

SEQ ID NO: 78272 - protein, 150 aa, Vitis vinifera
MQDLSTGWLHCDPGPLFKPEYFDLSGWVPRWFPWKEVSILPVQWHALCVGLFASIIAPFGGFFASGFKRAFKIKDFGDSIPGHGGITDRMDCQMVMAVFAYTYHQSFVMAQSCSVEMILEQILMNLTFEEQQDLYVKLGQMFRERQFRQS

SEQ ID NO: 78273 - protein, 265 aa, Gillenia stipulata
AHYKSEADVGEVLAEAFKTGLVKREELFITTKIWNSDHGHVVEACKNSLEKLQLDYLDLYLVHYPMPTKHNGVGKTASLLGEDKVLDIDVTISLQQTWEGMEKTVSLGLVRSIGLSNYELFLTRDCLAYSKIKPAVSQFETHPYFQRDSLVKFCLKHGVLPTAHTPLGGAAANKDMFGSVSPLDDPVLNDVANKYGKSVAQICLRWGIQRKTAVIPKSSKIQRLKENLEVLEFQLSEEDMQLIYSIDRKYRISLPSKTWGLDVYA

SEQ ID NO: 78274 - protein, 523 aa, Polytomella sp. Pringsheim 198.80
MIRKALMNARAKLPFARFARSASTSAPVVDIASETIQFARNLPNKLFINNKWVDAKSGKTMGVEDPRNGEEILRVAEGDSADVDLAVKAARKAFDEGAWPRMTGKERGRLIYKLADALEANAEAFARLETLDNGKPLNISRIADVPLSVDHFRYYAGWADKIHGKTIPVDGPHMAYTLHEPLGVVGAIIPWNFPLLMAAWKLGPALAAGNTIVLKPAEQTPLSALLIAKLAAEVGFPEGVINVVTGFGPTVGGPLASHKLVDKTAFTGSTEVGKIVARLAAEQIKPCTLELGGKSPIIVCPDVDVDRAVADAHMALFFNHGQCCAAGSRVYVHEKIYDEFVEKATKAAANHSVGDPFSGQYDQGPQVDNAQFSKILSYVEHGKAEGAKLNVGGCRVGNKGYYVAPTVFSNVTDNMKIAREEIFGPVQSILKYSTFDEVIRRANASDYGLASGVFSKDLDTVNTLVRGLHAGTVWVNCYNLFDSAVPFGGFKTSGIGREKGEYALSNYTKVKAVYMPLVNPAWR

SEQ ID NO: 78275 - protein, 196 aa, Brassica rapa
MARLLFRLLGESNSPSPVQDPSTAAVTSDLVVTLAALLCAMVCVLGLIAVSRCVWLRRLAAGNRTHAGSQGGSVQSPPPPVAAANKGLKKKVLQSLPKLTFSPDSPSSEKFTECAICLTEFSNGDELRVLPQCGHGFHVSCIDTWLGSHSSCPSCRQILVVARCHKCGGLPGSSSSEPEIEIRIKQGADVPNSYLP

SEQ ID NO: 78276 - protein, 453 aa, Bradyrhizobium sp. BTAi1
MFVERQAQRSTMHSRHLNEQLVRVLKTIGYDVGFQKGQGQYLYDRDGARYLDLLSGFGVFAIGRNHPTLRDALKSVLDSDLPNLVQLDVSTLAGVLAERLLEYVPYLDKVFFANSGAETVEAAIKFARGATGRPGIVYCGHSYHGLTYGALSLTDDSNFRTGFEPLLPGCTAVPFNDLAALEQALSSREIAAFIVEPIQGKGVNMPSDEFLPGAAALCKKYGTIFIADEIQTGMGRTGRFLAVEHWNVEPDMVLLSKALSGGHVPVGALLTRKHIFDKIFNRMDRAVVHGSTFAKNDLAMAAGIATLEVIKAEKLIEAAAKRGAELRLALTRMVPGYELLKEVRGKGLMIGVEFGPPKSLRLKASWNVLESANKGLFCQLITVPLFKDHKILTQVAGHGLHTIKLLPSLTITEEDCSWIERAFDDVIAQSHKVPGAIWSLGKTLVDNAIRKSA

SEQ ID NO: 78277 - protein, 227 aa, Spiraea cantoniensis
HGHEVEACKNSLQKLQLDYLDLYLVHYPLATRHRVGTTASLLDENKVLDIDVTVSLESTWRGMEKAVELGLVRSIGLSNYELFLTRDCLSYAKIKPAVSQFETHPYYQRESLVRFCQKHGICATAHTPLGGGTANTKYFGSTSPLGDPVLNEVAKKYKKSVAQICLRWNIDRCTAVIPKSSKVERLKENLQVLDFKLEKEDIELIBTIVRKRRTTLPSLSWGLDVYA

SEQ ID NO: 78278 - protein, 219 aa, Holodiscus microphyllus
WNSDHGHVVEACKNSLKKLQLDYLDLYLVHYPLATKHSVGNTASLLDENKVLDIDVTVSLESTWHAMEKAVKLGLVRSIGLSNYELFLTRDCLSYAKIKPAVSQFETHPYYQRDSLVKFCQKHGVCATAHTPLGGATANTKYFGSVSPLGDPVLNEVAKKYQKSVAQICLRWGIERKTAVIPKSSKPERLKENLQVLEFKLEREDIELINSIDRKYRTS

SEQ ID NO: 78279 - protein, 443 aa, Erythrobacter sp. NAP1
MAEAFDFVAIGSGTAAQVAVHQMANAGKRCAVIDYRPYGGTCALRGCDPKKMMVSGEEALAAYRRMKGKGIKGSVSIDWADLQAFKRSFTDPVPEKQEARYERKGVATFHGAARFAGPDRIVIGDRELSFSHALIATGAEPRPLGIEGEELLIHSDAFLEHKTLPDRIVFVGGGYIAAEFAHLAARAGAKVTIFQRGRILKAFDPDTVDWLMPSFDDLGIEIVDAEVDRVTKKGNVLTVHAGDRRIEGSLVVHAAGRIPAIGSLDLEAGDVACDAGRLALTAQLRSQSNPKVFAAGDAAANGPPLTPVSSNDAKVVVENILDDTGRTPNYRGVPSALFTEPPAARVGMLESEAREAGLDFTVHAGSHPGWFSARRLNEEIYGHKLLVENGTGRILGAHLVGPDADELVNIFGLAMRHGLNADDIKSTMFAYPTAASDAGYMLG

SEQ ID NO: 78280 - protein, 372 aa, Glycine max
  misc_feature (298)..(298): Xaa can be any naturally occurring amino acid
MAGVNPNGVADFAAVPTHGGQFIQYNIFGNLFEVTTKYRPPIMPIGRGAYGIVCSLLNTETNELVAVKKIANAFDNHMDAKRTLREIKLLRHLDHENVIGLRDVIPPPLRREFNDVYIATELMDTDLHHIIRSNQNLSEEHCQYFLYQILRGLKYIHSANVIHRDLKPSNLLLNSNCDLKIIDFGLARPTLESDFMTEYVVTRWYRAPELLLNSSDYTSAIDVWSVGCIFMELMNKKPLFPGKDHVHQMRLLTELLGTPTEADLGLVKNEDARRYIRQLPQYPRQPLAQVFPHVHPAXAIDLVDKMLTVDPTKRITVEEALAHPYLEKLHDVADEPICMEPFSFDFEQQQLDEEQIKEMIYREALALNPEYA

SEQ ID NO: 78281 - protein, 500 aa, Leymus chinensis
MAAANSDKGFEVPELDIKFTKLFINGQFVDAASGKTFETRDPRTGEVIAMIAEGDKADIDLAVKAAREAFDNGPWPRMSGCARARIMHKFADLVDQHVEKLAALDTVDAGKLFQMGKLMDIPGGANLLRYYAGAADKIHGETLKMARPLHGYTLKEPVGVVGHIVPWNYPTTMFFFKVSPALAAGCTMVVKPAEQTPLSALFYAHLAKEAGIPDGVLNVVPGFGPTAGAAIASHMDIDKISFTGSTEVGRLVMQAAAMSNLKPVSLELGGKSPIIVFDDADVDMAVNLVNMATYTNKGEICVAGTRIYVQEGIYDAFVKKSVELAKKSVVGDPFNPNVHQGPQVDKDQYEKVLKYINVGKSEGATLLTGGKPCGDKGYYIEPTIFTDVKDDMSIAQEEIFGPVMALMKFKTVEEVIRKANNTRYGLAAGVVTKNIDTMNTVSRSVRAGVIWVNCYFAFDPDAPFGGCKMSGFGKDMGTDALDKYLHTKTVVTPLYNTPWL

SEQ ID NO: 78282 - protein, 446 aa, Zea mays
MASRVASGLLRRRAVATLGLLRSHTHVRNYSSQLSALIPATSQCSNLTRRRYYLPNPSLYQVWSRSFASDSGDKFEAVVPFMGESVTDGTLANFLKKPGDRVEADEPIAQIETDKVTIDVASPEAGVIEKLIASEGDTVTPGTKVAIISKSAQPAETHVAPSEEATSKGSSPPKVEEKSRVEEKAPKVEPPKMQAPKPTAPLKTSPSEPQLPPKERERRVPMPRLRKRIANRLKDSQNTFAMLSTFNEVDMTNLMKLRSDYKDEFVTKHGVKLGLMSCFVKAAVSALQNQPIVNAVIDGDDIIYRDYVDVSVAVGTSKGLVVPVIRDADTMNFADIEKGINNLAKKATEGALSIDDMAGGTFTISNGGVYGSLLSTPIINPPQSSILGMHSIVQRPVVVNGDILARPMMYLALTYDHRLIDGREAVFFLRRIKDVVEDPRRLLLDI

SEQ ID NO: 78283 - protein, 305 aa, Synechocystis sp. PCC 6803
MPRIFPWKLWRKSRPAWPRFLGTHPMNLLSQLFAPPSPVPSPTPKAKKRSRRGVQIKTPAEIAIMRQAGAIAAQVLKEIAATVQPGMTTGDLDQLAEERIRSLGATPSFKGYHGFPASICACVNNEVVHGIPRRRKKIRSGDLLKVDTGAYFQGYHGDSCITIAVGKVSPQAQRLMEVAEGALYAGIEQVKPGNYLMDIAGAIEDYVKPTGYTIVEEFTGHGVGQALHEDPHVFNVRCRDLPNVKLKPGMTLAIEPIVNAGSRFTRTLGDRWTVVTVDNALSAQFEHTVLVTATGYELLTDRRLV

SEQ ID NO: 78284 - protein, 351 aa, Gibberella zeae
MRLLSLLSVVTLAVASPLSVEEYAKALDERAVSVSTTDFGNFKFYIQHGAAAYCNSEAPAGAKVTCSGNGCPTVQSNGATIVASFTGSKTGIGGYVATDPTRKEIVVSFRGSINIRNWLTNLDFDQDDCSLTSGCGVHSGFQNAWNEISAAATAAVAKARKANPSFKVVSVGHSLGGAVATLAGANLRVGGTPLDIYTYGSPRVGNTQLAAFVSNQAGGEFRVTNAKDPVPRLPPLIFGYRHTSPEYWLSGSGGDKIDYTINDVKVCEGAANLQCNGGTLGLDIDAHLHYFQATDACSAGGISWRRYRSAKRESISERATMTDAELEKKLNSYVEMDKEYIKTHARPLIIV

SEQ ID NO: 78285 - protein, 87 aa, Triticum aestivum
  misc_feature (64)..(64): Xaa can be any naturally occurring amino acid
MGQHGFLSSLRSHLRSPSPESHIQARRGYHVELGAREKALLEEDVALKRFKSYKNSVKRVSKIXNALTLVVLAACSYKVVALATSTQ

SEQ ID NO: 78286 - protein, 443 aa, Zea mays
MYGPPSRGGGGAGTAGEQPRVYQVWRGSNEFFLQGRFIFGPDVRSLFLTIFLILAPMVVFCIFVARHLINDFPDHWGVSVMVIVIVFTVYDLTLLLLTSGRDPGIVPRNTHPPETDAIEMNNDAGNGQTPQQLRLPRTKDVIVNGVIVKVKYCDTCMLYRPPRCSHCSICNNCVERFDHHCPWVGQCIGLRNYRFFYMFVFSTTLLCLYVFGFCWVYIIKIRDAEQSSIWKAMLKTPASIVLIIYCFICVWFVGGLSVFHFYLMSTNQTTYENFRYRYDRRANPYNIGILNNFMEIFCTAVPPSKNNFRARVPVEQGLQQSRAPARGFMSLNMDKPVGDFELSRKPVSWDEPRSAADIRDLEVGLGGLLDEKEGRIAHASPDLSRDALPELVEGRAGMHSRRSSWGHRSGTSESVDSIAVQMGTGDSHWGSISSAHGTTSGAH

SEQ ID NO: 78287 - protein, 199 aa, Haemophilus parasuis
EEGDIIIDGGNSNYPDTNRRVKALAEKGIRFIGSGVSGGEEGARHGPSIMPGGNEEAWQYVKPIFQAISAKTDKGEPCCDWVGKEGAGHFVKMVHNGIEYGDMQLICEAYQFLKDGLGLSYDEMQAIFAEWKNTELDSYLIDITTDILGYKDTDGTPLVEKILDTAGQKGTGKWTGINALDFGIPLTLITESVFARCVS

SEQ ID NO: 78288 - protein, 212 aa, Brassica napus
MEAMKETVDLSLREMRETFASGRTRSVKWRKTQLKAIIEMVKDNEEKMCDVLFQDLGKHSTEAFRDELGFVMRSAATALNSLDKWVVPRKSNLPLLFYPATGKVISEPYGTVLVLSSWNFPISLSLDPMIGAISAGNTVLLQASELSPNASALLAKTIPSYLDNKAIKVIEGGPDVATILLPHQWDKIFFTGSPRIGKIIMAAAAEHLTPVT

SEQ ID NO: 78289 - protein, 128 aa, Pyrococcus abyssi GE5
MEGWMMAKPSYVKFEVPKELAEKALQAVEIARDTGKIRKGTNETTKAVERGQAKLVIIAEDVDPEEIVAHLPPLCEEKEIPYIYVPSKKELGAAAGIEVAAASVAIIEPGKARDLVEEIAMKVRELMK

SEQ ID NO: 78290 - protein, 180 aa, Vitis vinifera
MSTPAATPATYTSIPISGADVISRSFHNLSAAVSSRRPWPDFVAADVFHRPDSLTVAGERVRKNASYFRINYGILILGCAMISLVGTPISLMVWVLTLGMWLIFYFFREDPLFVGGRQVSDRLVLLCLVLASVMAVWFTGVLENLVVGVGIGLLVCCVHGVFRNPLEDDEAGLRESALTH

SEQ ID NO: 78291 - protein, 199 aa, Haemophilus parasuis
EEGDIIIDGGNSNYPDTNRRVKALTEKGIRFIGSGVSGGEEGARHGPSIMPGGNEEAWQYVKPIFQAISAKTDKGEPCCDWVGKEGAGHFVKMVHNGIEYGDMQLICEAYQFLKDGLGLSYDEMQAIFSEWKKTELDSYLIDITTDILGYKDTDGTPLVEKILDTAGQKGTGKWTGINALDFGIPLTLITESVFARCVS

SEQ ID NO: 78292 - protein, 248 aa, Saccharomyces cerevisiae
  misc_feature (168)..(168): Xaa can be any naturally occurring amino acid
MARTFFVGGNFKLNGSKQSIKEIVERLNTASIPENVEVVICPPATYLDYSVSLVKKPQVTVGAQNAYLKASGAFTGENSVDQIKDVGAKYVILGHSERRSYFHEDDKFIADKTKFALGQGVGVILCIGETLEEKKAGKTLDVVERQLNAVLEEVKDFTNVVVAYEPVXAIGTGLAATPEDAQDIHASIRKFLASKLGDKAASELRILYGGSANGSNAVTFKDKADVDGFLVGGASLKPEFVDIINSRN

SEQ ID NO: 78293 - protein, 644 aa, Zea mays
MDQYEVLEQIGKGAFGSALLVRHKLERKKYVLKKIRLARQTDRTRRSAHQEMQLIANVRNPFIVEHKDSWVDKGCYVCIVIGYCEGGDMAEAIKRANDTHFSEEKLCQWLVQLLMALDYLHAHHILHRDVKCSNIFLTRDQNIRLGDFGLAKILTADDLASSIVGTPSYMCPELLADIPYGTKSDIWSLGCCMYEMAALKPAFRAFDMQNLINKITKSIVSPLPTRYSGAFRRLVRSMLRRSPEHRPSAAELLKHPHLEPYVLQLHLKSHLSRSIVPVHQSPSEKRMTFAAEPVCRSKGRRNSLGSERMIAAFSKPSPDRSSVSSIRSVKDEYTATQSVRELSVDDSMVEVASKPVASRTSDVMRTPKATPWKMMTTLRNRLEAPQASYDHTEFSRTPVDKRNSRVARRASLPLPVFETPKQRSSMSVLEQLESPDVSVNSPRIDRIAEFPLASCEDPLFSTVKPPTPASASASATPPFVDRSITKDKCTAQTLRSAARDGGNGRSEDGGGLSSGRTTTTAASSGGTSGSLQPKGRFDTTSYQQRAEALEGLLEFSAQLLQQERYEELGVLLRPFGPDEMVSPRETAIWLTKSFKEAMATGLQRWPPCTGMDGSGIQDRPSALQAVDGRMASPVLACVGQVGRL

SEQ ID NO: 78294 - protein, 571 aa, Vitis vinifera
MAQVVATRAIQSSILCPSSGSVHERFEKLKPSGFAAKVLAREERRSRRLAWRGGPIAAAKRSVGAETEVVPVTPEDAKGEEQYHLLRGIQQLGETSVGMWSKPTVRRKTKIVCTIGPSTNTREMIWKLAEAGMNVARLNMSHGDHASHQKSIMHNPKIMSLQSCLIPRQGPEVRSGDLPQPIMLKSGQEFTFTIQRGVGTADCVSVNYDDFVNDVEMGDMLLVDGGMMSLMVKSKTGDSVKCEVVDGGELKSRRHLNVRGKSATLPSITEKDWDDIKFGVDNKVDFYAVSFVKDAKVVHELKNYLKSCNADIHVIVKIESADSIPNLHSIITASDGVIILVGDLGAELPIEEVPLLQEEIIRICRSMGKAVIVATNMLESMIVHPTPTRAEVSDIAIAVREGADAVMLSGETAHGKFPLKAVKVMHTVSLRTEATLVGSPMPPNLGQAFKNHMSEMFAFHATMMSNTLSTSIVVFTRTGFMAILLSHYRPSGTIFAFTNEERVQQRLAVYQGVCPIYMQFSDDAEETFANALTLLQKQGMVKEGEEVALVQSGRQPIWRFQSTHNIQVRKV

SEQ ID NO: 78295 - protein, 154 aa, Sorbaria sorbifolia
SIGLSNYELFLTRDCLSYAKIKPAVSQFETHPYYQRETIVRFCQKHGVVPVAHTPLGGATANTKYFGSVSPLGDPVLNELAKKYQKSVAQICLRWNIERNTPVVPKSTKVERLKENFQALDFKLEKEDIDLINTIDRKSRTTLPSLSWGLDVYA

SEQ ID NO: 78296 - protein, 764 aa, Glycine max
MVVFLLIVLFSSNTKAEKETIHDHANKKTYIIHMDETTMPLTFTDHLSWFDASLKSASPSAEILYTYKHVAHGFSARLTPKDVDTLAKQPGILSVIPELKYKLHTTRTPNFLGLDKATTLLPASEQQSQVVIGLLDTGVWPELKSLDDTGLGPVPSTWKGQCEIGNNMNSSNCNRKLVGARFFSKGYEAALGPIDTTTESKSARDDDGHGSHTLTTAAGSVVPEASLFGLASGTARGMATQARVAVYKVCWLGGCFTSDIAAGIDKAIEDGVNVLSMSIGGSLMEYYRDIIAIGSFTAMSHGILVSTSAGNGGPSQGSLSNVAPWITTVGAGTIDRDFPAYITLGTGKTYTGASLYSGKPLSDSPLPLVYAGNASNSSVGYLCLQDSLIPEKVSGKIVICERGGNPRVEKGLVVKLAGGAGMILANSEAYGEELVADSHLLPAASLGQKSSEILKNYVSSSPNPTAKIAFLGTHLQVQPSPVVAAFSSRGPNALTPKILKPDLIAPGVNILAGWTGAVGPTGLTVDTRHVSFNIISGTSMSCPHVSGLAAILKGAHPQWSPAAIRSALMTTAYTSYKNGETIQDISTGQPGTPFDYGAGHVDPVAALDPGLVYDANVDDYLGFFCALNYSSFQIKLAARRDYTCDPKKDYRVEDFNYPSFAVPMDTASGIGGGSDTLKTVKYSRVLTNVGAPGTYKASVMSLGDSNVKIVVEPNTLSFTELYEKKDYTVSFTYTSMPSGTTSFARLEWTDGKHKVGSPIAFSWT

SEQ ID NO: 78297 - protein, 638 aa, Pseudomonas aeruginosa UCBPP-PA14
MIRLLNLTLQRGPQRLLEAVELTLHAGQKAGLIGANGAGKSSLFALLRGQLGQDAGDCLLPADWRIAHMRQEVDTLDRLAVDYVLDGDSRLREIQAALAAAEAAHDGSALARLHTELDNADGYTADARARKLLAGLGFSSEQMERRVGDFSGGWRMRLNLAQALMCPSDLLLLDEPTNHLDLDAILWLEEWLKGYPGTLVLISHDRDFLDAVVDHVVHLENRKLTLYRGGYSAFERTRAERLAQQQQAYEKQQAQRAHMESFIARFKAKATKARQAQSRIKALERLEELAPAHVDSPFNFSFRESDKISRPLLDLGEGRLGYGDKAVLEKVKLQLVPGARIGLLGPNGAGKSTLIKTLAGDLPELGGRLLRGENLAIGYFAQHQLDSLDPQASPLLHLQRIAPGEREQTLKDFLGGFDFRGVRVDEPVLNFSGGEKARLALALIAWQKPNLLLLDEPTNHLDLEMRLALTLALQEFSGAVLVVSHDRHLLKSTTDEFLLVADGRVVPFDGDLDDYARWLVDYRARKAPQAETAPGAPSERTDKRAQRQAAAALRQQLAPHKREADKLERELGGLHEKLAAIEARLGDSALYDVSRKDELRELLSEQSSLKVREGELEERWLEALETLEALQKELEASE

SEQ ID NO: 78298 - protein, 506 aa, Frankia sp. EAN1pec
MERTPMERTPMERTPMERTLSNFVGGKQAPSLDGRTMPVLNPATGEVLAHAPSSGPADVDAAVRAAGEAFEGWRDSTPSERSRALLRLADAVEERAAEIADVECANTGKPRQLTLDEEIAPSADQIRFFAGAARLLEGRSAGEYLAGHTSYVRREPIGVCAQVTPWNYPLMMAVWKIAPALAAGNTVVLKPAETTPASSLLLAEIAAEILPPGVLNVVCGDRDTGRALVAHPGPAMISVTGSVRAGMEVARGAADSLKRVHLELGGKAPVIVFDDVDPAVVAAEIAGAAYFNAGQDCTAATRVLAGPGIAGELADALAEAARATTTGPPAAGGQTGGQTGGAAAGGGEADYGPLNSAGQLGRVSGFVERAPEHARLLAGGTPLDRPGYFYPATVIAGLRQDDELIQQEVFGPVVTVQEFSAEDEAVAWANGVEYGLASSVWTRDHSRAMRVARRLDFGCVWVNTHISIVAEMPHGGFKKSGYGKDLSVYGLEDYTRIKHVMHNIEF

SEQ ID NO: 78299 - protein, 149 aa, Chamaebatiaria millefolium
NYELFLTRDCLSYAKIKPAVSQFETHPYYQRETIVRFCQKHGVCPVAHTPLGGATANTKYFGSVSPLGDPVLNEVAKKYQKSVAQICLRWNIERNTAVVPKSTKVERLKENFQVLDFKLEKEDIDLINTIDRKSRTTLPSLSWGLDVYA

SEQ ID NO: 78300 - protein, 149 aa, Exochorda racemosa
NYELFLTRDCLSYAKIKPAVSQFETHPYYQRESLVRFCQKHGVVAAAHTPLGGATANTKYFGSTSPLGDPVLHDVAKKYQKSVAQICLRWNIERNTPVIPKSSKVERMKENLQVLDFNLEKEDIELINGIDRKSRTTLPSLSWGLDVYA

SEQ ID NO: 78301 - protein, 496 aa, Leptospira interrogans serovar Copenhageni str. Fiocruz L1-130
MNYTRGALSMPTLQESPVKLPNSNQPPSVNKTEIERVFNLQKKHFHKVMKLTTAGQRIQRLKKLKEAIFKYSPEIEKAVHSDFRKSEREVDITEIMPSISEINDAIKHVRRWMKPVDVKTPMTLFGSKSQIIYEPRGVVLIIGPWNYPFYLTFAPLAAAIAAGNTVLIKPSEFTPVTSNLIQKIISEVFPKEEVAVFEGDYQVSGALMELPLDHIFFTGSTHVGKIVMTAAAKHLTTVTLELGGKSPAIIDKSADIKKAAKKLIWGKVLNAGQTCVAPDYLLIPNELIKPFVEEAKTVIKEFYGNSLKENSDFCRIVNDRNFNRVSGYIHEAVEKGAKIEMGGDTDASQNYIEPTLLSNVPENSNIMEDEIFGPVLPMIPYTNLDEAIEKINSKPKPLALYIFGKKDRSIKKILKETSSGGVAVNDVILHLANPNLPFGGINHSGHGSYHGYFGFKAFSHERSVLRQAALSSIDLMYPPYTNFVKRLVSFTKKFLV

SEQ ID NO: 78302 - protein, 529 aa, Yarrowia lipolytica CLIB122
MRSDSVSKPRSAETSPLLDPYRVSDVTELDLGAGYNTATNEPISDKAQLHTLSLSSTALLILNKMIGTGVFSTPSGIYQLTGSVGISLVLWVLGGVLAFTGLSVYLDFGLRIPKSGGEKNYLERVYRKPRFLSTVIFGTEIVMTGFSAGNAYAFGKYILYAVGLEDPSDGAVRSVACLAVTFACLLHATAPRLSTRLSNILGVFKVLVLVLIVFSGALAVLNFVDIPDKPHNFSNLWEIDHTVSPGLSGSPYALAIALLRVAYSYKGWENANYVLGHVKNPSYTLPRAGTAAISIVTVLYFLCNLAYFAVIPKTDIANSGVIVAGEFFTRVYGHSLAARALPFFVSLSNIGNVLAVSYAHGIVNYEVAKDHILPFTSFWTSLKPFGTPAAAFLLHWLITVVVLVLPPAGEVYEIIIDMYTYPGTIINIFVAAGLLYLHANPLENWSRDKYSSPMIVTLVFLVLQLFMTFFPMIPPPQHNGQLPYYAVPLLGWLVVLFGFVYFAVWRKTERPNLLAAKVKQEEMGELEEQ

SEQ ID NO: 78303 - protein, 374 aa, Oryza sativa Japonica Group
MRPPAPATTAGAGGKVTPNLAMDAEGTRLLNLTVLQRLDPAVEDILITAAHVTLYDFNIELNQWSRKDVEGSLFVVKRNKQPRFQFIVMNRRNTDNLVEDLLSDFEFELQPPYLLYRNAAQEVNGIWFYNQQDCDAVAGVFGRILNAYAKVPPKPKVPSTKSEFEELEAVPTSAAIDGPLEPSSSSTVLVSNAPDESLTDYFSGAVNVGNVSITPMVGRTHQPIESVASSHVPLIIPSAAPTHQMGVPSGAASAPPLPVIDTNVHSSHSTNLVTPAFFAPPSSSSASLVAPASSFMPTASPFHPTSADAHRPAYGHGTPLLQPLPPPTPPASLTPVHNDEPVISRDKVKDALLRLVQNDEFINLLYQELQNAHA

SEQ ID NO: 78304 - protein, 323 aa, Debaryomyces hansenii CBS767
MTASQNAIKLLHGNSHPELAKLISKKLGIGLAKVGAFQYTNKETAVAVGESVRDEDVYIIQTGCGEGEINDFLMELLIIINACKTASARRITAVIPNFPYARQDKKDKSRAPITAKLIANLLQTAGCNHVITLDLHASQIQGFFRVPVDNLYAEPSVLRHIKDNYGKEDLIIVSPDAGGAKRVASIADKLDVNFALIHKERQKANEVSKMVLVGDVTNKSCLLIDDMADTCGTLVKAADVLLKNGAKKVVAIITHGIFSSNAIEKLNNSNLDKIICTNSMPLENKLSQCPKLEIIDISATLAEAIRRLHNGESVSYLFNNAPA

SEQ ID NO: 78305 - protein, 89 aa, Zea mays
IINNACATQAILSVLLNSPGITLSDELKKLKEFAKDLPPELKGLAIVNCESIRMINNSLARSEVSEEQKRPSNGDDVYHFISYVPVDAV

SEQ ID NO: 78306 - protein, 216 aa, Azoarcus sp. EbN1
MEMTTPTRLCLVRHGETAWNAERRLQGHLDVPLNEIGHIQAEATAASLAGHRFTALYCSDLRRAQQTAAAAGRTLGFEATLEPELRERHYGVFQGLTYDEARERFPQDYARFHARDPDFAFCGDGESLRAFAARVHRALERIVVRHAGRQALVVTHGGVLDIAHRLAAGKALDAPRDFTIPNAALNWIEFDGRRWHLLAWADQAHLAAARDELPNT

SEQ ID NO: 78307 - protein, 232 aa, Brassica napus
MSSMSRSRSPSRDRSRSRSPRDRRMRSERSSYRDAPYRRGEREPRRAFSQTNLCNNCKRPGHFARDCPNVSVCNNCGLPGHIAAECTAESRCWNCREPGHVAGNCSNEGICHSCGKTGHRARDCTNPVSRAGDLRLCNNCFKPGHLAADCTNDKACKNCRTSGHIARDCQNDPVCNICSISGHVARNCPKGDSSYSDRDRGSRVRGGGMQRDGFGRMGRDGGMHRDGLSPGG

SEQ ID NO: 78308 - protein, 513 aa, Symbiobacterium thermophilum IAM 14863
MSQQRDLIVVVDFGGQYSHLIARRVREAQVYCEIWPFTAPVQRYREAGVKGIIFSGGPASVEQADAPRIDPAIYELGIPILGICYGMQLMALQLGGEVRRGQQGEYGRATLRLADAEHPLLRGLGRESLVWMSHFDSVTRVPSGFRVLGATENTAVAVMGDDARRLYGVQFHPEVVHTAQGREILRNFLFNIAGCRGDWTTESFITRQVEEIRRQVGSGRVLCALSGGVDSSVAAVLVHKAVGDQLTCIFVDHGLMRKGEPEQVVRTFRDHFHIHLVHVDASERFLSKLRGVTDPEQKRKIIGNEFIRLFEDEARKLGQIDFLVQGTVYPDVIESGTETARVIKSHHNVGGLPEDMRFQLIEPFRQLFKDEVRAVGRALGVPEEIVGRHPFPGPGLGVRVLGEVTPEKLEILREADRIFVEEIRKAGLYDELWQAFTVLPDVRSVGVMGDERTYAYPVVLRAVTSEDAMTADFYRLPWDLLERIASRIVNEVPHVNRVVYDVTSKPPGTIEWE

SEQ ID NO: 78309 - protein, 303 aa, Oryza sativa Japonica Group
MEKYEKLEKVGEGTYGKVYKAQDRATGQLVALKKTRLEMDEEGIPPTALREISILRLLSQSLYVVRLLSVEQATKNGKPVLYLVFEFLDTDLKKFVDAYRKGPNPRPLPTNVIKSFLYQLCKGVAHCHGHGVLHRDLKPQNLLVDKEKGILKIADLGLGRAFTVPMKSYTHEIVTLWYRAPEVLLGSTHYSTGVDIWSVGCIFGMMVRRQALFPGDSELQQLLHIFRLLGTPTEEQWPGVTDLRDWHEFPQWKPQILERQVPSLEPEGVDLLSKMLQYNPANRISAKAAMEHPYFDSLDKSQF

SEQ ID NO: 78310 - protein, 322 aa, Pseudoalteromonas tunicata D2
MSKIFNDNSLTIGNTPLVKLNRVTTGNVFAKIEARNPSFSVKCRIGASMIWEAEKSGQLTKDKEIIEPTSGNTGIALAFVAASRGYKLTLTMPSTMSLERRKLLKALGANLVLTEGPKGMKGAIEKAQEIQQAEPNKFVLLQQFENPANPKIHFETTGPEIFEATDGNIDFFVAGVGTGGTITGVSRYLKLEKGLAVKAIAVEPVDSPVISQKLAGQEIKPGPHKIQGIGAGFIPGNLDLEMLDGVEQVSNEEAIATAHRLMKEEGILAGISSGAAVAAAIRIAEKPENAGKNIVVILPSSAERYLSSPLFSEEFSDQELVQ

SEQ ID NO: 78311 - protein, 631 aa, Cryptococcus neoformans var. neoformans B-3501A
MLESISCLPARLQPYFIWLSALTLGEIWLTIYNPPNRVNLSIAFIIISFKLPTWARKYNSWKNERKVVRFGYPVPKEASKQWEGRVIENPNLLSHLEDESLLPPETGLSGRKREHITCYDPSTGYHLNTLPLHTAEEVSLQISKANSAFFAWSRTTFAQRRHFLRNVRGWVLRDMDYIVQVACRDTGKTNVDAVFGEILTSLSKIDWLLKHGEKTLSPQKRAGNLLLAHKVSKVHYHPLGTVLALVSWNYSFHNLLSPIIAALFAGNTIVVKCSEHVAWSSMWFIGGIKECLKICGLDPEVVQLVICLPGGAEKVTRNPIFKHITFIGSEPVGKKVAAAAAEIMVPTCIELGGKDPAFILPGTDLDFFASTWMRGAFQSAGQNCIGIELFLVHRSQYSRFLEILTPRVQALRPGHDVGSLISHAPISKLQSLLASSISSGARLLAGGHPYVHPLYPQGAYFEPTLIADVTMDMAVAKEELFAPVMTVVPYDDVNEAVEWLNKGKFGLGGGVYGKDKKECRRVAEKLECGMVAINDFGVFYLNQAMPFGGVKASGHGRFGGEEGLRSLCSVKAITEDRFFSWIRTTIPRPVDFPLPEDGTAWQFLKGLVGLAYAPTTPGRVSGLVNLVKAST

SEQ ID NO: 78312 - protein, 135 aa, Triticum aestivum
SKNLISHCHTVTLLLLILHCFYQFTSFGSQAKMSTVNRADLDQRLAAANRCSREAAIAGAKAAAVATVAAAVPTLASVRILPWAKAHLNPTGQALIISTVAGMAYFIVADKTIVSMARKNSYEDAPDHLKNTSFN

SEQ ID NO: 78313 - protein, 603 aa, Vitis vinifera
MVGVGLEGLPTTLINEIIVKLDTETLCSVACVSRALRFAVSEALPLSSSLDLSAFSPDAQTLNHLPGGCLLVLGFLFYFDHTICFLRNMTTRKSAFFQSILCKTCVTVTLFFLLYFVRLLTLELSYWDLPEVFNRNLVQMLTGCSYLESLCLKIRGAEFDATFFRSIQHFLPKTVKILKLQPVLEQDVIRFIHELRVNRNILDTAEFGIPFSPASPGFKLQSLSLVLDIISDELISSITDSLPFLIELHLEDRPSKEPSPFHDLTNSGLQSLRFCRHLTDISLIRSRHNLPVYFKRINDMGMFLLSEGCRLLESVRLGGFCRVSDAGFASILHSCWHLKKFEVRNALLLSDLAFHDLTGAPCSLVEVKLSSCNLITSETVHKMASSRRLEVLDLFGCKSIADSSLSSITCLNKLTTLNLGGADVTDRGLSVLSQGYSPISHLCLRGCKRVTDKGVSLLFHGCGVISKTLTALDLGHMPGISDKAILTIAAVGTGITELCIRYCFYVTDSSVEALATKRRLQDGRKPLRKLDLFHCTGLSVKSLESLKRPFFQALKWIGLGRTCLSGKANEILNERPWLTLCLDGCEMGCHDGWHFHRPETRDH

SEQ ID NO: 78314 - protein, 371 aa, Ipomoea nil
MVSTITATVPSRVERLASSGIERIPKEYIRPEEERRSIGDIFEEEKIAGGPQVPTVDLKGINSEDLEVREKCREELRKAAVDWGVMHLVNHGISEELTGRVKAAGEGFFGQPIEEKEKYANDQAAGNVQGYGSKLANNASGQLEWEDYFFHCIFPEDKTDLSIWPKTPSDYIDATKEYAKQLRALATKVLAVLSLGLGLEEGRLEKEVGGMEELLLQMKINYYPKCPQPELALGVEAHTDVSALTFILHNMVPGLQLFYGGKWVTAKCVPNSIIMHVGDTVEILSNGKYKSILHRGVVNREKVRVSWAVFCEPPKDKILLQPLPETVSEAEPPRFPPRTFAQHIKHKLFRQSDQEAADTPKPDNDDHHQSN

SEQ ID NO: 78315 - protein, 249 aa, Azoarcus sp. EbN1
MYKIVLLRHGESTWNKDNRFTGWTDVDLTEKGVEEARGAGHLLKREGYTFDLAYTSVLKRANKTLNIVLEELDSLWLPVEHSWRLNERHYGDLQGLNKAETAAKFGDDQVLVWRRSYDTPPPPLPEGDERLTSGDPRYASLPRAQFPRTECLKDTVARFVPYWETVIVPNILAGRRILIAAHGNSLRALIKYLDNISDSEIVGLNIPTAQPLVYELDANLRPIRSYYLADADTIRAAEAAVAGQGKAKG

SEQ ID NO: 78316 - protein, 392 aa, Mycoplasma arthritidis
MKDDACLLKKGSIVTIKTDENSYKNLVGDDKVITVSYRMDKDMHVGAKVLLDDGKLVTIVKEIKPEIILVEVQNDHVLKTNKRVNIPGIDFSMPFMSPKDREDIIWGAKYGVDFIAASFVNSAKNVHEIREILKQANAEHIQICSKIESQTGIDNIDEIIEASDSIMIARGDLGLEIPYYEVPYWEKKIIAKCRKANKEVIVATQMLDSMEKTPLPTRAEISDVYWATELGASATMTSGETASGQYPVEAIKTMATINHRAEQEYFNEIATSCNCQCQPKCELGHVAKELKEKTKTGDFPYTIAISEDGKLLKKIAKYKPNTTVIALVSDPKIETAFGITFGIFCEKNGAKAIEKVIKDPKYLNEILASHFDIKKGQKFLVIKDGLISENSL

SEQ ID NO: 78317 - protein, 247 aa, Oryza sativa
LGWVLQPPVCKWLTPNEDGVSMAALALMNQDKVLMESWYYLKDAVLDGGIPFNKAYGMTAFEYHGTDARFNRVFNEGMKNHSVIITKKLLDLYTGFDAASTVVDVGGGVGATVAAVVSRHPHIRGINYDLPHVISEAPPFPGVEHVGGDMFASVPRGGDAILMKWILHDALPEHGKVVVVECVLPESSDATAREQGVFHVDMIMLAHNPGGKERYEREFRELARAAGFTGFKATYIYANAWAIEFTK

SEQ ID NO: 78318 - protein, 336 aa, Candida albicans SC5314
MTDIAPPSAATPNDYILSLSPEQIEHDQKIGIKAIRLFLQSKTSYDVLPVSYRLIVLDTSLLVKKSLNILLQNNIVSAPLWNNQTSRFAGLLTSSDFINVIQYYLQFPEKFELVDQLTLGGLREIEKAIGVDQIETASIHPFKSLYEACVKMLESKARRIPLIDEDEKTKREIVVSVLTQYRILKFVALNCKETKMLLKPLKNLSGLGDVKKLSTCTMDTPVIEVIHLLTENSVSSIPIVDGQGKLINVYEAVDILALVKGGMYTDLDLSVGDALLRRSEEFEGVHTCTLNDRLSTIMDTIRKSRLHRLFVVDDEGKLVSVITLSDILNYILFGED

SEQ ID NO: 78319 - protein, 251 aa, Pseudoalteromonas tunicata D2
MEQKQNTTTHFGYKTVDAEQKASLVADVFHSVAAKYDVMNDLMSMGIHRLWKRQTIASSGVRKGHKVLDLAGGTGDLTAKFSQIIGETGQVILGDINDSMLKVGREKLRNLGLVGNIEYVQMNAEALPFPDNTFDIITIAFGLRNVTDKSKALASMHRVLKPGGRLLVLEFSKPNSEALAKIYDFYSFNILPTMGKVIANDSESYQYLAESIRMHPDQETLKEMMNEVGFEQTTYQNLTGGIVALHRGFKF

SEQ ID NO: 78320 - protein, 401 aa, Prochlorococcus marinus str. MIT 9313
MAKRSLSNLSAADLRSKRVLVRVDFNVPLNENGAITDDTRIRAALPTINDLIDKGARVILSAHFGRPKGQINEGMRLTPVAKRLSELLGKNVTKTESCVGSDAEAKVNAMADGDVVLLENVRFFSEEEKNDANFAQKLAALADAYVNDAFGAAHRAHASTEGVTKFLNPSVAGHLMEKELQYLQGAIDDPKRPLAAIVGGSKVSSKIGVLEALIDKCDKVLIGGGMIFTFYKARGLSVGKSLVEEDKLELAKELEAKAKAKGVQLLLPTDVVLADDFAPAANSQTVSIDAIPDGWMGLDIGPDSINLFQDALADCQTVIWNGPMGVFEFDKFAAGTNAIATTLADLSGKGCCTIIGGGDSVAAVEKAGLAEKMSHISTGGGASLELLEGKVLPGVAALDDA

SEQ ID NO: 78321 - protein, 335 aa, Microcystis aeruginosa PCC 7806
MPAADYKDYYAVLGVGKTASAEEIKKAFRKLAVKYHPDRNPNNKSAEERFKEISEAYEVLSDSEKRQKYDQFGQYWQQAERSNWPGGNGGVDFGSDGFDFSQYSTFDDFINELLGRMGRSGGTRPSSHSYGTPGRGFGDFSNFNDFAGARTPPQSVTSGVSTAKLRLTFAEALRGVQKRVNLAGEMIDIKIPPGTKTGNRLRVRGKGLIDPLSKQRGDLFLDVELEPHPFFTFEGDNLTCEVPITPDEAVLGTAIEVPTPDGLVTVKVPAGIRSGQSLRLRGKGWIDNKGQRGDQLVKIVIDTPKELTAIERELYEKIKSQRTTDPRRHLRQVQI

SEQ ID NO: 78322 - protein, 411 aa, Vitis vinifera
MGNKKVVLETRQNRRALSVISENVVRGGVSKRGLLEKQAICEKRIHAPVQRRPVTRRFAAQLASRQHSNIQEPKKPELLSIWTPGQSEDCEIEDMEEHKAAPDHPVPMLVEQTETKIDEMNQVEEVEMEDIDGEPIMDIDGPDARNPLAVAEYVEELYAYYRRMESSSCVSPDYMAQQFDINHKMRAILIDWLIEVHDKFELMEETLFLTVNLVDRFLAQQTVARKKLQLVGLVAMLLACKYEEVSVPVVADLIIISDKAYTRKEFLEMERLMLNTLQFNMSVPTPYVFMKRFLKAAQSDKKMELLSFFLMDVCLVEYEMLKFPPSLLAAASIYTAQCTLYGFKQWDKTCEHYTSYTEDQLLECSRLIVNLHQNVGSGKLTAAQRKYCTSKLGYTSKCEPAHFLLGTQQQQ

SEQ ID NO: 78323 - protein, 346 aa, Neisseria meningitidis Z2491
MQAVVVNKNVAGDVEVVEREVRPLEYGEALVEVEYCGVCHTDLHVAAGDYGEKPGRVLGHEGIGLVKEVADGVKHLKVGDRVSIAWLFQSCGSCEYCNTGRETLCRSVLNAGYTADGGMATHCIVSADYAVKVPEGLDPAQASSITCAGVTTYKAIKVSSVRPGQWIAIYGAGGLGNLGVQYAKKVFGAHVVAIDINDDKLAFAKETGADLVVNAAKEDAAKVIQEKTGGAHAAVVTAVSAAAFNSAVNCVRAGGRVVAIGLPPESMDLSIPRLVLDGIEVVGSLVGTRKDLEEAFQFGAEGLVVPKVQLRALDEAPAIFQEMREGKITGRMVIDMKKECGCGHHR

SEQ ID NO: 78324 - protein, 426 aa, Physcomitrella patens subsp. patens
MGKEEEDAWVVMKTARAPSNIAVIKYWGKRDEKLILPINSSISVTLDPEHLSATTTVAASPAFERDRLWLNGKEVSVEGERYRNCLREMRARATDVVIESSGKVITKEVWSTLHIHIASENNFPTAAGLASSAAGFACLVYSLAQLMNVKEKYEGELTAIARLGSGSACRSLYGGFVKWNMGKEADGKDSIATQLAEQSHWEDLVIIIAVVSSRQKETSSTSGMQESVKTSPLLKYRAEEMVPKRIGQMEKAIKSMDFAEFARITCADSNQFHATCLDTSPPIFYLNDSSRRLIGLVERWNRHAGEPQVAYTFDAGPNAVMFAKNKEVAVQLLKRLLYQFPPSAEADLSRYVLGDQSVLKSAGVTSLEDIDSLSAPAEFAGVINLPRIPGEIDYLICTSAGKGASVLDGQIASLLDPATGLLVKNE

SEQ ID NO: 78325 - protein, 375 aa, Vitis vinifera
MAPRTLPILKQLLSKSSSYNTNFIGSRFAPKRSVTYMPRPGDGAPRPVTLIPGDGIGPLVTGAVEQVMDAMHAPVYFERYEVHGDMKKVPEEVLESIRKNKVCLKGGLATPMGGGVSSLNVQLRKELDLYASLVNCFNLPGLPTRHQNVDIVVIRENTEGEYSGLEHEVVPGVVESLKVITKFCSERIAKYAFEYAYLNNRKKVTAVHKANIMKLADGLFLESCREVATKYPGIKYSEIIVDNCCMQLVSKPEQFDVMVTPNLYGNLVANTAAGIAGGTGVMPGGNVGADHAVFEQGASAGNVGHQKLVEQKKANPVALLLSSAMMLRHLQFPSFADRLETAVKRVISEGKYRTKDLGGDSSTQEIVDAVIATLD

SEQ ID NO: 78326 - protein, 338 aa, Yarrowia lipolytica CLIB122
MIPIWLDCDPGHDDAVAILLAAKLPAFNLLGISTVFGNAPLEKTTVNAMAVLKAIGQDSEIKVYPGAERIQSRGGGGDGGSHDQSNQSHSPSSCSRGHYETAPSTFAPSIHGESGLDGTSLLPEITCTIEPHVDSTLVAMANAIRNNPGTCLVATGSLTNVSALFDRFPDVKNLVETVSIMGGGFGMGNWTPYAEFNIWCDAESASQVLGDPIVAAKVVLCPLNVTHTAIATEEVLSQIKSVGGNVSQMFFELMTFFKETYESEFGFKDGPPVHDPLSVAVLLNGIVTKERRVTVDVTVGGEQRGMLTEQVGGHLTVVEEVDLNKFWALVVTCLEACK

SEQ ID NO: 78327 - protein, 441 aa, Vitis vinifera
MGLTFQPTYSSWAHQLSSILKQGYGRLFRTSLVGRPVAVAADPEVNHFILQEEGKSVEMFYLDSIVKLFGKDGASTHATGHVHKYLRTLVMNYFGFESLRDKLLPKVEAVARKSLDTWSSQPSVELNYAISQVMFEFISMELFSYDPSASTESMSDAFINFLKGLVSIPLNIPGTTFHKCLKNQKKVMKMLREIVEERCASPERRHGDVLDYFLEEMKSKTFITKDFIVYIMFGLLFATFESIPTMFTLVFKLIMEHPLVWQELKDEHEAILRNSQTSNSTITWEDYKSMTFTFDVINEALRMGNISLGSFRRAVEDVRINGYTIPAGWIILVVPSALHMDPETYPDPLVFNPWRWKEDGGSKIRVKNFTPFGRGIRSCPGAELSKLVAATFIHAAVTKYRFTKIKGGRVVRNPMLKFKDGFYVKVSEMVTEGGGSAAEDA

SEQ ID NO: 78328 - protein, 493 aa, Prochlorococcus marinus str. MIT 9313
MTNLLLGLNFEPQIESLGSDYWDVVDAARFPRTELRFRNNDLLRQLGIDPGAVKDHHLEQAYGCFEARTPLLALRYHGYQFGTYNPLLGDGRGFLYGQLRDRFGQLQDLGTKGSGTTPWSRGGDGRLTLKGGVREIIASEALHRLGVTTSRTLCLVETGEKLWRSDEPSPTRSSVMVRIARTHLRFGTCERLLHLRNAQGLERLLRHVVDVYYPLIAAAHPVQDGNAAGAIEAQLLAFYAELVERVARLAAEWMAAGFTHGVLNTDNMSLLGESFDYGPFAFLDQWEPGFTAAYFDQTGLYAYGRQPGICHNNLRLLQEPLAMLLPRQPLEQSLETFAPIYQSHYRACMQRRLGLPSSFDHNGNIEGGDDAVHKTLALLAAWPVGYGAFFAGLATQISTKGLPEEPEALLPVVLDGAEPARKAWLDWRDRWWTQQREAVSAEPDEAQAINARLQRWNLVKTPIRSVIEEFWQAIDQHDDWQPLQAWLKASCVD

SEQ ID NO: 78329 - protein, 206 aa, Listeria monocytogenes
GEIQINIEESIRGCHVYVIQSTSNPVNQNLMELLIMIDALKRASAATINIVMPYYGYARQDRKARSREPITAKLVANLIETAGATRMITLDMHAPQIQGFFDIPIDHLNAVRLLSDYFSERHLGDDLVVVSPDHGGVTRARKMADRLKAPIAIIDKRRPRPNVAEVMNIVGNVEGKVCIIIDDIIDTAGTITLAAKALREAGATKV

SEQ ID NO: 78330 - protein, 386 aa, Symbiobacterium thermophilum IAM 14863
MDRLAKRDYYEILGVPRNATEAEIKKAFRNLARKYHPDANKDDPDAAEKFKEINEAYQVLSDPEKRARYDQFGHAAEQMGGAGGNPFEGFGGFGDFGGFSDIFEMFFGGAGRQRNPRGPVRGADLEYELELTLKEAAFGCTKELRVPRVEDCDTCHGSGARPGTQPVTCPKCGGTGQVQMTQHTVFGRFVNVMTCDRCRGEGKIVESPCPTCRGRGRVQKTQRVEVKVPGGVETGTRLRMPGYGEAGERGGPPGDLFIVMRVRPDRRFRREGDDLFTTTEISFIQAALGTEIEVETLDGPELIKIPEGTQPGDTIRLKGKGTHRLRGSGRGDLHVVISVKTPGRLSERERELLLEVAALRGERVAGMTENKEKSFLKKMKDALGGR

SEQ ID NO: 78331 - protein, 141 aa, Oryza sativa Indica Group
MKHQYNANGGGANMVASGYSTGTALGAEIIGTFVLVYTVFSATDPKRNARDSHVPVLAPLPIGFAVFMVHLATIPITGTGINPARSIGAAVIYNQKKAWDDHWIFWAGPFIGALAAAAYHQYILRAAAIKALGSFRSNPSN

SEQ ID NO: 78332 - protein, 498 aa, Aspergillus awamori
MMVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASRNAIRNYAISKDTGFVTYKNWPIYKDDTTIPMRKGTDGSQIVTILSNKGASGDSYTLSLSGAGYTAGQQLTEVIGCTTVTVGSDGNVPVPMAGGLPRVLYPTEKLAGSKICYG

SEQ ID NO: 78333 - protein, 539 aa, Mycobacterium avium 104
MPRTAHTSVVLLDGSAQLPRETLGNKGYGLNIMRRNGLPVPPAFCITTEICAQWLDDPGTTIDGLSETLTQMIHCLEEQTSRTFGRGPRPLLVSVRSGAALSMPGMMDTVLNLGMNDTVEQALAQTFSARFAMDTRARFADMYRRIVLDGDASAAVPDDPFLQLLGAIEAVFASWNSPRAVAYRKHHGRDDLGGTAVVVQAMVFGNMESNSGTGVLFSRNPITGADEPFGEWLSSGQGEDVVSGTFDARPISVLAEEQPHVYDELVAAARTLERLGSDVQDIEYTVEEGKLWLLQTRAAKRSAQAAVRLALKLRDEGLIDDMETLRRVTPAHIETLLMPSLQPETRLAAPLLAKGLPACPGVVSGRAVTDVYDAIDAAEDGQDVILVRRSTSPDDVQGMIAALGIVTGIGGTTSHAAVVSRELGRPSVVGCGADVTDALAGKLITVDGTEGEVREGILELTAWSEDDSSDLAELTRIALAVSPLRAHTTGDYPPLDAGSDDAVRAALAAGHTDVLSSTPLITMLTAVRLAGTDTRELSR

SEQ ID NO: 78334 - protein, 328 aa, Azoarcus sp. EbN1
MRIAVFGAGAWGTALALAFSARHDVVLWGRDAGHIDTLAATRHNERYLPGVPFPEELALTADFAAAARAADLHLVVTPLAGLRAAVGELNTLQPDTPLIWACKGLEAGTGKLPHEIVAEELGPAARCGVLTGPSFAAEVARAMPTAVTLAATDPAFARRWVPALHQPRLRIYANSDLVGAEIGGAIKNVLAIAAGVSDGMGFGLNARAALITRGLAEIARLAEALGGRPETLMGLAGMGDLILTCTGDLSRNRRVGLALAQGKTLAEILGELGHVAEGVSTAREVVKLAARHDVEMPLCEAVDTLLHDARLGPREVVEQLLSREPRRE

SEQ ID NO: 78335 - protein, 149 aa, Triticum aestivum
LAWSRPRFDPCKEMAYIPLDEDMKVKGKAAIDVVCNPLGKSGGALIQQFMILSFGSLANSTPYLGGILLVIVIAWLGAVRSLDSQFSPLAKQDLEREQKLKAEAVETTAQVVGTGNGSLQENVASTNGTVIKQSQEPEITAPEKSGKQS

SEQ ID NO: 78336 - protein, 310 aa, Vitis vinifera
MASSSSSGLTFKLHPLVIVNISDHYTRVKSQTQPPHLTAAAASPPPPPPRVFGCVIGVQRGRTVEIFNSFELLYDPSTHSLDRSFLEKKQELYKKVFPNFYILGWYSTGSDAQESDMHIHKALMDINESPVYVLLNPSINHAQKDLPVTIYESELHVIDGIPQLIFVRANYTIETVEAERISVDHVAHLKPSDGGSAATQLAAHLTGIHSAIKMLNSRIRVLHHYLLAMQKGDIPCENSLLRQVSSLLRRLPAIESGKFQDDFLMEYNDTLLISYLAMFTNCSSTMNELVDKFNTAYDRHSRRGGRTAFI

SEQ ID NO: 78337 - protein, 406 aa, Pseudoalteromonas tunicata D2
MPIIKKSNKLEGVCYDIRGPVLKQARRMEDEGQKVLKLNIGNPAAFGFDMPEDMHKDIIRNLSSAQGYCDAKGLYSARVAIYQHYQQKNFFNLDVDNIYIGNGVSELIQLSTQALLNDGDEVLIPAPDYPLWTAAVRLASGTPVHYLCDEQQDWFPDINDIRSKITSKTKAIVLINPNNPTGAVYDVAMIQDLIGVAREHKLLIFSDEIYEKILYDGVTFTSVGSLCDDLPIITFNGLAKTYRAAGLRMGWMVLSGKLASMHDYIQGLDMLASMRLCANVPAQYAIQQALGGVQSIDDLIRPTGRLYQQRDIVYQGLNAIDGISCVKPKGALYAFAKFDRAKFNVHDDEKLIYDLLMQEKILLVHGRAFNWPEPDHFRLVFLPHQDQLKPALAQMARFFDNYKQDR

SEQ ID NO: 78338 - protein, 324 aa, Dendrobium cv. 'Sonia'
MESRSFPVINMELLEGSQRSDAMAVLRDACENWGFFELLNHGISHDLMNRVETVNKEHYRRFREQRFKEFAAKTLDSGENVVADNLDWESTFFLRHLPTSNISQIPDLDEDCRSTMKEFALELEKLAERLLDLLCEDLGLEKGYLKRVFCGGSDGLPTFGTKVSNYPPCPKPELIKGLRAHTDAGGIILLFQDDKVSGLQLLKDGEWVDVPPMRHSIVVNIGDQLEVITNGRYKSVMHRVVAQTNGNRMSIASFYNPGSDAVIFPAPELVEKEAEEKKKEVYPKFVFEDYMKLYVRQKFEAKEPRFEAMKTMDTVISSQLIPTA

SEQ ID NO: 78339 - protein, 851 aa, Brassica napus
MKGVRNIYDHHSYTFLLVFVVMILFHPALSIYINTLSSTESLTISNNRTLVSPGDVFELGFFKTTSSSRWYLGIWYKQLPEKTYVWVANRDNPLPNSIGTLKISNMNLVLLDHSNKSVWSTNLTRRNERTPVMAELLANGNFVMRDSNNNDASEFLWQSFDYPTDTLLPEMKLGYNLKKGLNRFLISWRSSDDPSSGDYSYKLEPRRLPEFYLLQGDVREHRSGPWNGIRFSGILEDQKLSYMEYNFTETSEEVAYTFRMTNNSFYSRLTLSSTGYFERLTWAPSSVIWNVFWSSPANPQCDMYRMCGPYSYCDVNTSPSCNCIQGFDPRNLQQWALRISLRGCKRRTLLSCNGDGFTRMKNMKLPETTMAIVDRSIGEKECKKRCLTDCNCTAFANADIRNGGTGCVIWTGNLADMRNYVADGQDLYVRLAAADLVKKSNANGKIISLIVGVSVLLLLIMFCLWKRKQNREKSSAASIANRQRNQNLPMNGIVLSSKRQLSGENKIEELELPLIELEAIVKATENFSNSNKIGQGGFGIVYKGILLDGQEIAVKRLSKTSVQGVDEFMNEVTLIARLQHVNLVQILGCCIDADEKMLIYEYLENLSLDSYLFGKTRRSKLNWKERFDITNGVARGLLYLHQDSRFRIIHRDLKVSNILLDRNMVPKISDFGMARIFERDETEANTMKVVGTYGYMSPEYAMGGIFSEKSDVFSFGVMVLEIITGKRNRGFDEDNLLSCAWRNWKEGRALEIVDPVIVNSFSPLSSPFQLQEVLKCIQIGLLCVQELAENRPTMSSVVWMLGNEATEIPQPKSPGCVRRSPYELDPSSSRQRDDDESWTVNQYTCSVIDAR

SEQ ID NO: 78340 - protein, 855 aa, Brassica napus
MKGVQNIYHHSYTFSFLLVFLFLNLFHPALSIYVNTLSSSESLTISSNRTLVSHGGVFELGFFKPLGRSRWYLGIWYKKVSQKTYAWVANRDSPLSNSIGTLKISGNNLVLLGQSNNTVWSTNLTRENVRSPVIAELLPNGNFVMRYSSNKDSSGFLWQSFDFPTDTLLPEMKLGYDFKTGRNRFLTSWRSYDDPSSGKFTYELDIQRGLPEFILINRFLNQRVVMQRSGPWNGIEFNGIPEVQGLNYMVYNYTENSEEIAYTFHMTNQSIYSRLTVTDYALNRYTRIPPSWGWSMFWSLPTDVCDSLYFCGSYSYCDLNTSPYCNCIRGFVPKNRQRWDLRDGSHGCVRRTQMSCSGDGFLRLNNMKLPDTKTATVDRTTDVKKCEEKCLSDCNCTSFATADVRNGGLGCVFWTGDLVEIRKQAVVGQDLYVRLNAADLASGEKRDRTKKIIGWSIGVTVMLILSVIVFCFWRRRQKQAKADATPIVGNQVLMNEVVLPRKKINFSGEDEVENLELSLEFEAVVTATEHFSDFNKVGKGGFGVVYKGRLVDGQEIAVKRLSEMSAQGTDEFMNEVRLIAKLQHNNLVRLLGCCVYEGEKILIYEYLENLSLDSHLFDETRSCMLNWQMRFDIINGIARGLLYLHQDSRFRIIHRDLKASNVLLDKDMTPKISDFGMARIFGRDETEADTRKVVGTYGYMSPEYAMNGTFSMKSDVFSFGVLLLEIISGKRNKGFCDSDSNLNLLGCVWRNWKEGQGLEIVDRVIIDSSSPTFRPREILRCLQIGLLCVQERVEDRPMMSSVVLMLGSETALIPQPKQPGYCVSQSSLETYSSWSKLRDDENWTVNQITMSIIDA

SEQ ID NO: 78341 - protein, 839 aa, Ustilago maydis
MPNLPLPSRSPLLGSRKALRDPSPAPPTPTRTSSASPFPPSSSSSLASFSAAASSTSIPGPSTPLHSPTRLAASGKELSEQYELLEKIGAGSFGTVYKAMHKQSRQIVAIKQVDLEDSDDDISEIQQEIAHLAQCDSQWVTRYYGSFVKGYKLWIIMEYLAGGSCLDLLKAGSFSEAHIAIICRELLLGLEYLHNEGKIHRDIKAANVLLSASGKVKLADFGVAAQLSNNKSRRNTFVGTPFWMAPEVIRQAGYDYKADIWSLGITAIEMAKGEPPLAEYHPMRVLFLIPKAKSPTLQGNFSSAFKDFVDLCLIKDPKHRPSTKELLSHRFIKYAKKTLLLTELIEKHQEYKSRGATRGGAIVRDHLRGLNPSESTIGGATVMSEWQFDTMRSSMSTYDDPHPANAAEHHSHLDAHLHVWPNSGRAPPATMDERAGYNTVRGARPAGHLMDALDSAMHTPVRNNTLRAHRAARAGDHDDISDLSAEAFSSSDALNHSSSTPATSTASGPTTPAEKVPDSVHVDALTASFQGIKASDDAAANRYLAAGLGKNAAAASSTSHLSPPSVSALAASTVNVSTAAATLASAEPGSTATLHIRCARDGKASPSHSKNNSAASSSRSTETRPRQSSWNERNNFNGTVLKEADVANGLETLRPVRRLDATGSAQASQQYMASLRSGSAPSGLDKSGEPLAADPGSPQRALRHSRSALASSSSTAQPHATAGENLVRDVILPVMDRAKQQELDAAEVEALNMISKGFQDLSMLNSRLAYSTIVDLLLSINDNEQARENLSTTFRQKLSRPQVTKLQPMPPAEEASRSPIADLLYGRWLEGLRTRWMGY

SEQ ID NO: 78342 - protein, 133 aa, Brassica napus
  misc_feature (7)..(7): Xaa can be any naturally occurring amino acid
  misc_feature (9)..(10): Xaa can be any naturally occurring amino acid
  misc_feature (12)..(12): Xaa can be any naturally occurring amino acid
  misc_feature (16)..(18): Xaa can be any naturally occurring amino acid
  misc_feature (21)..(22): Xaa can be any naturally occurring amino acid
  misc_feature (29)..(29): Xaa can be any naturally occurring amino acid
  misc_feature (34)..(38): Xaa can be any naturally occurring amino acid
  misc_feature (45)..(49): Xaa can be any naturally occurring amino acid
  misc_feature (51)..(52): Xaa can be any naturally occurring amino acid
  misc_feature (54)..(54): Xaa can be any naturally occurring amino acid
  misc_feature (58)..(60): Xaa can be any naturally occurring amino acid
  misc_feature (62)..(63): Xaa can be any naturally occurring amino acid
  misc_feature (65)..(65): Xaa can be any naturally occurring amino acid
  misc_feature (82)..(82): Xaa can be any naturally occurring amino acid
  misc_feature (85)..(87): Xaa can be any naturally occurring amino acid
  misc_feature (91)..(91): Xaa can be any naturally occurring amino acid
  misc_feature (101)..(101): Xaa can be any naturally occurring amino acid
  misc_feature (103)..(103): Xaa can be any naturally occurring amino acid
  misc_feature (112)..(112): Xaa can be any naturally occurring amino acid
  misc_feature (116)..(116): Xaa can be any naturally occurring amino acid
  misc_feature (119)..(123): Xaa can be any naturally occurring amino acid
  misc_feature (127)..(127): Xaa can be any naturally occurring amino acid
  misc_feature (132)..(132): Xaa can be any naturally occurring amino acid
MASSMLXSXXGXTSPXXXTMXXPFSGLKXSAAFXXXXXGNNDITXXXXXGXXVXCMKXXXPXXKXKFETLSYLPDLTEVELXKEXXXLLRXKWIPCVEFEXAXMDLRTVSTXAHPXTMXXXXXPCGXFPCSXA

SEQ ID NO: 78343 - protein, 323 aa, Acidobacteria bacterium Ellin345
MKIANDVTELIGKTPLVFLHKVIGGSQALIAAKLEGFNPCASVKDRIGVSMIEEAEKAGRITPGKTVLIEPTSGNTGIGLAFVAAVKGYRLIIVMPDTMSQERRVLLRAFGAELILTPGAKGMKGAIAKAEQLAKEIPDSLILQQFRNPANPKIHFETTGPEIWNDTDGKVDILISGVGTGGTITGVSEYIKPKKASFKAIAVEPTESPVLSGGAPGPHKIQGLGAGFIPEVLDTKTIDEVVQVNSEESVAMARRLAKEEGLLVGISSGAAVVAAVKVGSRPENAGKLIVVVLPSYGERYLSSILFQNLRDEVAAQQAVEVPV

SEQ ID NO: 78344 - protein, 258 aa, Acidobacteria bacterium Ellin345
MGFWQGVREDIQAIFEHDPAATSMLAVLLCYPGLHARTFHRFNHWLWIKRFRLLARWLSQVVRFFTGIEIHPGAVLGRRVFIDHGMGVVIGETAFVGDDVTLYQGVTLGGTGKEKGKRHPTLRSGVFVGNNANILGNITIGENSRVGAGSVVLRDVPPNSTVVGVPAHIIYQDGKRVLITDPKDVKDPLSDVIIALAGEVRELKERLGFSEPASASGDHAVQHLQSVRTLADEDSERDEYRFTQRPFDEQFTEIASGI

SEQ ID NO: 78345 - protein, 135 aa, Brassica napus
  misc_feature (2)..(2): Xaa can be any naturally occurring amino acid
  misc_feature (12)..(12): Xaa can be any naturally occurring amino acid
  misc_feature (26)..(28): Xaa can be any naturally occurring amino acid
  misc_feature (33)..(33): Xaa can be any naturally occurring amino acid
  misc_feature (43)..(43): Xaa can be any naturally occurring amino acid
  misc_feature (45)..(45): Xaa can be any naturally occurring amino acid
  misc_feature (49)..(50): Xaa can be any naturally occurring amino acid
  misc_feature (55)..(55): Xaa can be any naturally occurring amino acid
  misc_feature (58)..(60): Xaa can be any naturally occurring amino acid
  misc_feature (62)..(62): Xaa can be any naturally occurring amino acid
  misc_feature (64)..(64): Xaa can be any naturally occurring amino acid
  misc_feature (67)..(67): Xaa can be any naturally occurring amino acid
  misc_feature (71)..(73): Xaa can be any naturally occurring amino acid
  misc_feature (79)..(80): Xaa can be any naturally occurring amino acid
  misc_feature (82)..(83): Xaa can be any naturally occurring amino acid
  misc_feature (85)..(85): Xaa can be any naturally occurring amino acid
  misc_feature (93)..(93): Xaa can be any naturally occurring amino acid
  misc_feature (99)..(100): Xaa can be any naturally occurring amino acid
  misc_feature (104)..(104): Xaa can be any naturally occurring amino acid
  misc_feature (107)..(109): Xaa can be any naturally occurring amino acid
  misc_feature (122)..(122): Xaa can be any naturally occurring amino acid
  misc_feature (125)..(125): Xaa can be any naturally occurring amino acid
  misc_feature (130)..(130): Xaa can be any naturally occurring amino acid
  misc_feature (133)..(134): Xaa can be any naturally occurring amino acid
MXSSMLSSAAVXTSPAQATMVAPFTXXXSSAAXPVTRKANNDXTXIASXXGRVSXMKXXXPXAXKKXETLXXXPDLTEXXLXXEXDYLLRNKXIPCVEXXLEHXLVXXXHGSTPGYYDGRDXTMXKLPLXFGXXD

SEQ ID NO: 78346 - protein, 354 aa, Vitis vinifera
MDAQKLTSLGGSLPVPCVQELAKKTLTTVPPRYLRPEQDPPFLSDSSTTCSSIHAPVIDFNRLVSGDSMDSELDKLHYACKEWGFFQLTNHGVISTLVEKVKVEVQEFFNLPMEEKKKFWQQPEDLQGFGQAFVVSEEQKLDWADMFYMITLPTYLRKPHLFPKLPISLRDSLEIYAVELRNLAMTILGFIAKALKMEANDMKELFEEGHQAMRMNYYPPCPQPDQVIGLTPHSDAVGLTILLQVNEMEGLQIRKDGMWVPIKPLPGAFIVNIGDILEIVTNGAYRSIEHRATVNSIKERLSVATFYSPKLNEDMLTIPLGSGGHVVFSHDASNQGLGCVLMQHGKVIAYVFIQ

SEQ ID NO: 78347 - protein, 177 aa, Glycine max
  misc_feature (157)..(157): Xaa can be any naturally occurring amino acid
MGDKEEESAMPRDAKIVKSLLKSMGVEDYEPRVIHKFLELWYRYVVDVLTDAQVYSEHAGKPAIDCDDVKLAIQSKVNFSFSQPPPREVLLELAHNRNKIPLPKTIAGPCIPLPPDQDTLISPNFQFAIPNKRPAPPLEETEDEEATIPNPSQEQKXNTPPNPHQRVSFPLPKRQKD

SEQ ID NO: 78348 - protein, 299 aa, Glycine max
LLDHFKHSGPNGQHVCMVFEYLGDNLLTLIKYSDYRGLPIAMVKEICFHILAGLDYLHQQLSIIHTDLKPENILLLSTIDPSKDPRKSGAPLILPNSKDKMAMESAGMKDTKMLNGDLVKNHKKKIKRKAKQAAHGCVEKEASEGVEGNAETSGAVESSPNASSAREQTSSSAGTSQLSDADGTKLKEQGNKRGSRSMRQKLLASVDLKCKLVDFGNACWTYKQFTNDIQTRQYRCPEVILGSKYSTSADLWSFACICFELATGDVLFDPHSGDNFDRDEMFKVLFKFRDSCWFSCAAT

SEQ ID NO: 78349 - protein, 297 aa, Sulfolobus solfataricus P2
MSNPLHVFSNEQELLEGMWPTPLLKLRIGNDTWAKLEFYNPFSRSVKDRTAWFLFRQALLKNATHIVEATSGNTGIALASLSSIFGMRFTMFLPVVAPKVYKVFVKLLGGNVIEAGNSTNDVIPLVKKFAEMTNALNLDQFNNPINVIAHYETTAREIDEQLSSIGKKPSRIIATMGTGGHIAGIAKYFKEKYGNDVEIIGVQPSENSRIPGIKRQNGSNSLLRDVKIDRVVDVSLEEAIDGTISVARTSGILIGISAGATVAAYKKISDVSSTTVLIFPDDAFKYVDILEQTLKEI

SEQ ID NO: 78350 - protein, 959 aa, Oryza sativa
MLRAVAGVRGLAADDPFGVELMHVLIDDTDIDDNVRRLENTVPGAWATVESCDVAELLLASLDAASSFQLARRRDGVAVLVASDQSASRFPSTRACLLLDHGHGPEQLHLHQPAAATGGARRLHGLPRAVDAQHLELHGLLLPVVLVTVVFLVFQLGGADGGKAAVRACVGCCRRRRRPAHHWLAAVARMCMRCHALAAYVGAAAGGAERARLSPPLPNALVAPPPRGGGGSGALADAIRSVLWGPPYEPLPALYITDALRASMKIIQSFQDVPEDYDHWAPGSRRLQNRLYQRHRAAVPPATPPHGVAESRDYRACCYAPPPAAPRTAPPPATVITASRRQCDHSNIGHSYSTRVFYVFLLLLCYQSRHFLPPRPRRRPRPRREAPAAEPPTPTYTRDVVRRVDAILRGHPWSAARPLLLSLPGLAWDSHTVARVLKAHPPLHKAFLFFRLAAGAGGGFRHDRFTYTSMLHLLGEAGRVPAMMRLLAEMLRAGVDPDAATFTTVMHWLAHAGDVDAAMRVWEEMRARKGKCRPTLVSYTACVKILFDAGRPAEAREVFQEMVAEGLRPSCKTYTVLIEHLANVGEVFDQMPTMLFVTSTFCTALSLCTQYLSEVLHSLSHLCSTSCEEKIEQLLAFWNTLYIGKFEATMEIMDKMQEAGVEPDKALCNILVQKCSRAGETSVMTRILQYMKENFIVLRRPIFLEALEALKANGESDNLLREVNPHLAFEGIECDPAFTDLGYITVRSTILYLLASRNWSAVEHMINEMTPKNIKVESHILSDIIQASCANCRPSCGLAVLRYSLRIGNELDRSAYGSLLGHYIRNGSFDLVFEIVEILIKSGCNLGTYLSSILIIKLACAGHSSTAVRIFGLLTTDKNVVTYTALMSAYFQDGKVDKALQLFLQMSANGVSACPAESFQHLLLPEHDDIDTQMSLNYGVHLGSPLCNTNALSEIAYTE

SEQ ID NO: 78351 - protein, 498 aa, Callitriche heterophylla
  misc_feature (1)..(15): Xaa can be any naturally occurring amino acid
XXXXXXXXXXXXXXXEKKNLGRIVQIIGPVLDVAFPPGKMPNIYNAVIVKGRDTAGQPINVTCEVQQLLGNNRVRAVAMSATDGLTRGMEVINTGAPLSVPVGGATLGRIFNVLGEPVDNLGPVDTSTTFPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKETLQRYKELQDIIAILGLDELSEEDRLTVARARKIERFLSQPFFVAEVFTGSPGKYVGLAETIRGFQLILSGELDGLPEQAFYLVGTIDEVTAKAINLEMESNLKK

SEQ ID NO: 78352 - protein, 464 aa, Frankia sp. EAN1pec
MPAAPRTPDLRRGPGNVQPRPVSDTVRRTEPPWLVRGAPFVTATTDHTTLDSSLAAPTDGPVSPAAPVTSPGFDGPSPRPSDDDPAFALHRGGKIGIGLTAPLNNREDLSLAYTPGVARVCTAIAETPALADEYTWRSNTVIVVTDGTAVLGLGDIGPAAALPVMEGKAALFKHFGGVDAVPICLDCTDVEEIVDTVARLAPGFGGVNLEDISAPRCFAIESMLQDRVDIPVFHDDQHGTAIVALAALENAARLTGRTLGDLRAVVSGAGAAGVAVTRILLAAGIGDIAVGDSRGMIYPGRDGLTTVKAALAAETNKAGLRGSINEALAGADVYLGLSAGKVPEEAVATMAPEAIVFAMANPDPEIDPEIAHKYARIVATGRSDYPNQINNVLAFPGVFRGALDVRASRVTEGMKLAAARALADVIADELADDNIIPSVFDERVAPAVSTAVAAAARADGVARR

SEQ ID NO: 78353 - protein, 331 aa, Bradyrhizobium sp. ORS278
MSTKGAILIAGGAGYIGAHCSKAVAEAGFTPVVYDNLTTGHRGFVQWGPLMVGDIADSIKIASTIRQYDVKAVMHFAAWSAVGESVADPQKYYLNNVAGTLGLLQGMREAGCTRLVFSSTGAVYGNAGREPIPESAAGPTVNPYGRSKYMIEQILADYRAAYGFSATALRYFNACGADASGTIGELRDPETHLIPRALMAILGHVPDFAIFGTDYETPDGTAVRDYIHVDDLAAAHIAALGRLLEGGAGGAYNLGTGSGYSVREIVDAIRNETGEQVPLVYRERRAGDPPILVADPTRAEQELGFKARRSDLGHVIRSAWAWHQKAHPRIV

SEQ ID NO: 78354 - protein, 122 aa, Bradyrhizobium sp. BTAi1
MTDRIFIKGVLIHARHGVMEHESEVGQRFVIDLELDTDLSASSRSDRLADTVSYSDVVETATAAFKDTNYRLLERAAGAVADAILATFARIRAVKVTVHKPHAPIAAIFEDVGVVLTRSRHP

SEQ ID NO: 78355 - protein, 348 aa, Vitis vinifera
MDALRKQASKFREQVAKQQQAVIKQFGGTGYESSDVMVIDEVEMQRHQQLEKLYRSTRAGKDFQKDIVRAGEAFTAIGYKQIETGTKLSEDCCRYGAENINDNILARAASIYGDGLKHIAKEQEDLNKLLSSQILDPLRAMVTGAPLEDARHLAQRYSRMRHEAETQAAEVSRRQARLREAPNPENAARLNIAEAKMKELKANMAVLGKEAAAALAAVEAQQQRLSFQRLVAMVEGERTYHQRIATIFGEVESEMVSEKQRKESAPPAIPSESHSEKTMYFLAEAMHAFSAASEKELSLNVGDYVVVRKVSHTGWSEGECKGKAGWFPSEYVAKRQRLPTSNVAAEVY

SEQ ID NO: 78356 - protein, 223 aa, Arabidopsis lyrata subsp. petraea
FDRVSIQQWIDSGNRTCPITKLPLSENPSLIPNHALSSSISNFAHVSPKEPSRPRTQQEHSQSQSQALISTLVSRSSSNASKLESLSRLVRLTKRDSLIRRKVTESGAVRAALDCVDSCNQVLQEKSLSLLLNLSLGDDNKVGLVADGVIRRIVAVLRVGSPDCKAIAATLLTSLAVVEVNKATIGSYPDAISALVYLLRVGNDRERKESATALYALCSFMDN

SEQ ID NO: 78357 - protein, 223 aa, Arabidopsis lyrata subsp. petraea
FDRVSIQQWIDSGNQTCPITKLPLSENPSLIPNHALRSLISNFAHVSPKESSRPRTQQEHSQSQSQALISTLVSRSSSNASKLESLSRLVRLTKRDSLIRRKVTESGAVRAALDCVDSCNQVLQEKSLSLLLNLSLEDDNKVGLVADGVIRRIVAVLRVGSPDCKAIAATLLTSLAVVEVNKATIGSYPDAISALVYLLRVGNDRERKESATALYALCSFMDN

SEQ ID NO: 78358 - protein, 172 aa, Triticum aestivum
  misc_feature (80)..(80): Xaa can be any naturally occurring amino acid
MEQTFIMIKPDGVQRGLIGDIISRFEKKGFYLKGMKFMNVERSFAQQHYADLSDKPFFPGLVEYIISGPVVAMVWEGKDXVLTGRRIIGATRPWEAPPVHSWGLPVESARCHPWNDPWRTGRRVLSGSRSVHNGRQLPGSQAYHLLDPCCSGTNLLYNRCPLKNYPVLQFIR

SEQ ID NO: 78359 - protein, 223 aa, Arabidopsis lyrata subsp. petraea
FDRVSIQQWIDSGNRTCPITKLPLSENPSLIPNHALRSLISNFAHVSPKESSRPRTQQEHSQSQSQALISTLVSRSSSNASKLESLSRLVRLTKRDSLIRRKVTESGAVRAALDCVDSCNQVLQEKSLSLLLNLSLEDDNKVGLVADGVIRRIVAVLRVGSPDCKAIAATLLTSLAVVEVNKATIGSYPDAISALVYLLRVGNDRERKESATALYALCSFMDN

SEQ ID NO: 78360 - protein, 764 aa, Vitis vinifera
MAILSDLGTEILVPACAIVGIVFSVVQWILVSRVKLSPERHSLSNSSKNGTAEYLIEEEEGLNDHSVVQKCAEIQNAISEGATSFLYTEYQYVGIFMVAFAILIFVFLGSVAGFSTKSQPCLYNKGEMCKPALANAIFSTISFLLGGLTSLLSGFLGMKIATYANARTTLEARKGVGKAFITAFRSGAVMGFLLAANGLLVLYIAINLFEIYYGDDWEGLYEAITGYGLGGSSMALFGRVGGGIYTKAADVGADLVGKVERGIPEDDPRNPAVIADNVGDNVGDIAGMGADLFGSYAESSCAALVVASISSFGINHEMTAMFYPLIISSIGILVCLITTLFATDFFEIKAVKEIEPALKKQLIISTILMTAGIAFVSWIALPSSFTIFNFGSQKVVKNWQLFLCVGVGLWAGLIIGFVTEYYTSNTYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNTIPGLMEGTAKPDYATCVKISTDASIKEMIPPGALVMLTPLIVGTLLGVETLAGVLAGSLVSGVQIAISASNTGGAWDNAKKYIEAGASEHAKALGPKGSDPHKAAVIGDTIGDPLKDTSGPSLNILIKLMAVESLVFAPFFAAHGGLLFKIWK

SEQ ID NO: 78361 - protein, 223 aa, Arabidopsis lyrata subsp. petraea
FDRVSIQQWIDSGNRTCPITKLPLSENPSLIPNHALRSLISNFAHVSPKESSRPRTQQEHSQSQSQALISTLVSRSSSNASKLESLSRLVRLTKRDSLIRRKVTESGAVRAALDCVDSCNQVLQEKSLSLLLNLSLEDDNKVGLVADGVIRRIVAVLRVGSPDCKAIAATLLTSLAVVEVNKATIGSYPDAISALVSLLRVGNDRERKESATALYALCSFMDN

SEQ ID NO: 78362 - protein, 504 aa, Arabidopsis thaliana
MIYDLMMIANSIIFHMRSGSRMILKRTYNTSDAGSIFLCSTSSNNSKRCRTFISFDVLEYLIREAKEIFDSERVASGWVEAGTGKSRLRDFFSSLLTSLGGALLQITEEDQQQGSDIMASSRVSDLPHQRGIAGEIKPKNVAGHGRQNRKVLGDIGNLVTGRDVATGKDVAKKAKQPQQQTKAEVIVISPDENEKCKPHFSRRTHIRGTKTFTATLRARSKAASGLKDAVIDIDAVDANNELAAVEYVEDIFKFYRTVEEEGGIKDYIGSQPEINEKMRSILIDWLVDVHRKFELMPETLYLTINLVDRFLSLTMVHRRELQLLGLGAMLIACKYEEIWAPEVNDFVCISDNAYNRKQVLAMEKSILGQVEWYITVPTPYVFLARYVKAAVPCDAEMEKLVFYLAELGLMQYPIVVLNRPSMLAASAVYAARQILKKTPFWTETLKHHTGYSEDEIMEHAKMLMKLRDSASESKLIAVFKKYSVSENAEVALLPSLDDFSVSCA

SEQ ID NO: 78363 - protein, 338 aa, Oceanicola granulosus HTCC2516
MPTITEPKLIAGNANRPLANAVARRMSMHRGMNVGLVDARVERFNDAEIFVEVYENVRGEDMFIIQPTSRPANDNLMELLIIADALRRSSAARTTAVIPYFGYARQDRRTKARTPISAKLIANLIAQSGIERVLTMDLHAAQIQGFFDIPVDNLYASPIFALDIRHHFGDLDDVMVVSPDVGGVARARELAQRIAAPLAIVDKRREKAGEVAEMTVIGEVTGKRCIIVDDICDTAGTLCKAAEVLIENGATEVHAYTTHGVLSGPAIDRVSTSVLKSLVITDSIEATPETKGCPNIRIVPTAPMFAQAIINIWNGTSVSSLFDHETLTPIYEGLYSGG

SEQ ID NO: 78364 - protein, 1296 aa, Debaryomyces hansenii CBS767
MDPLVNYEYPVPPQEYQQKRYQNPNQVPEITNKEQVVPQSALPATPRMLRSVSGNQKNSGSDSYSQEDQPAEENDRSMTPQQLDKYQQYVSSANYQMDASHSKNSSLNQPQHSKRGTSASHSRTPSVNRQPQPPPTPPTWNSQFPNQPNQQQPVTSPQRKQELLPPAAISSPSSKPPTVGNAASANKTRPMPQQHPGQNNEHGHHHHSHHHNQQQQALQQQQQQQFHRKSIGDWDFIKTIGAGSMGKVKLAQHNSTSEICAVKIVPRAAKLFQRAHANDPPILNAQAAAQRQKEFEKEVTRDKRTIREGALGRLLFHPFICRLYEMVPMTNHYYMLFEYVEGGQMLDYIVSHGSLKEKNARKFARGIALALEYCHSNNVVHRDLKIENIMINSKGDIKIIDFGLSNLYSPKSLLKTYCGSLYFAAPELLSAKPYTGPEVDVWSFGVVLYVLVCGKVPFDDQSVSILHEKIKRGNVEYPSFLSKECVSLLSRMLVVDPTKRASLFEVVQHPWMNRGYEAPQSCYLPKRKPLELPLDPEIVKSIASFDIGTVQSVTEEMTSILTSVEYQMSCENWYKITEKGRKYASAPNAHILPDPTGGFHPLISIYYLVHEMKMRKKAKEHSAKAQLEQANSKQASQQGNLQAPRQDETLQYEPEQQKREERLPGLSFPEQAHTSASPATFQKSSPSPPRDQKEESIPEQQPHSPRESMANTDTLDPNGGKPGGFNSLFRRLSSKKYKNSPSSPNRNQTSPDASDHNIAPPPIPRVSIVPDSQEHIPSPSSNKSHKNDPMVRRGVSMKVTAKEKSSSSKVDLHSSTSNTPKPQPEVSTQPTKTSHNRSSSTSTNNAVNKYRGYVPEQYLPPLPNINPNTNTLVPPASGSNSPLKVAPGAEGRKLHPTARAKSVGGHVRKESYGRSNRAQKQPHPTLPNALASQNSDEIIDEGSTRDDGFFDDVTLDEVDYQEIPQLTEEQIIDQFNHAKQNSMPSIEYPKTLFLKGFFSVQTTSTKPLPVIRYNIINVLSKLGVKFQEVKGGFVCAHAPSLQIKPAQPDDISTNTSTMIDSQQEEKKSEETSEEQRLYGDAFKSTSSSIERNSDIPTRIKTPEQNPGESQMKSPTRQASLHLNTQNLSPPSANSGKTHRPSNSVGGHRRKFSIGNSLLGSYRKKNGSQIMMPPNTPATAKLNKLLYGMDGDELEDEDEDETSKQFTEDDSVDSLNGLMIGGGSDMLISSTLEHKAKHQHSPSSGNSHLAKRSPLKFEIHIVKVPLVGLYGVQFKKLLGNTWNYKTLAGQILNELNL

SEQ ID NO: 78365 - protein, 355 aa, Triticum aestivum
  misc_feature (13)..(13): Xaa can be any naturally occurring amino acid
  misc_feature (207)..(207): Xaa can be any naturally occurring amino acid
  misc_feature (261)..(261): Xaa can be any naturally occurring amino acid
VCVIKNSATLAGXSLFTLHCSQIHIDMPTLSDEDKDVMKKWGAPNKIDFLSLSYTRHAEDVRQAREFLSKLGDLSQTLIFAKIENVEGLNHFDEILEEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFXKRTVKYVGGPMTHLESIASSAVRAAIKVKASVIICFTSSGRAARLIAKYRPTMXPVLSVVIPRLKTNQLKWSFTGAFEARQSLIVRGLFPMLADPRHPAESTSTTNESVLKVALDHGKASGVIKSHDRVVVCQKVGDSSVVKIIELDD

SEQ ID NO: 78366 - protein, 415 aa, Neisseria meningitidis Z2491
MQLTAVGLNHQTAPLSIREKLAFAAACLPEAVRNLARSNAATEAVILSTCNRTELYCVGDSEEIIRWLADYHSLPIEEISPYLYTLGMQETVRHAFRVACGLDSMVLGEPQILGQIKDAVRVAQEQESMGKKLNALFQKTFSVAKEVRTDTAVGENSVSMASASVKLAEQIFPDIGDLNVLFIGAGEMIELVATYFAAKSPRLMTVANRTLARAQELCDKLGVNAEPCLLSDLPAILHEYDVVVSSTASQLPIVGKGMVERALKQRQSMPLFMLDLAVPRDIEAEVGDLNDAYLYTVDDMVNIVQSGKEARQKAAAAAETLVSEKVAEFVRQQQGRQSVPLIRALRDEGEKARKQVLENAMKQLAKGATAEEVLERLSIQLTNKLLHSPTQTLNKAGEEDKDLVHAVAQIYHLDK

SEQ ID NO: 78367 - protein, 421 aa, Rhodospirillum rubrum ATCC 11170
MSQSVRVTRLPGGLTVATDFVPSVESLTLGAWVATGTRHEAPAVNGVSHLLEHMAFKGTRKRSARQIAEEIEAVGGHLNAYTSRENTAYYARVLREDEDVALDILGDILQHSTFDPTELGREREVVVQEIYQAIDTPDDIIFDHFQETAFPDQALGRPVLGTEKVVRGLTREIVDGYMRAHYAPERTVVAAAGRIDHDAFVAKVTEHFSALPGRGIPAEEPGRYAGGVFREERDLEQVHIVLGFEGICHGDDDYYAASVLSTLHGGGMSSRLFQEIRENRGLAYSIYSFSSSYQDTGLYAIYAGTSEKEAAELIPVLCDETARLADSLTEVEVARARAQLKASILMALESTSSRCEQMARQIQVYGRPIGIDEVVAKLDGVTIDQVAACARRIFTRPPTLAAIGPLAGVEDYDKIVARLKP

SEQ ID NO: 78368 - protein, 280 aa, unidentified eubacterium SCB49
MKEYFKLNNNINIPAIGFGTWQTPDGQTAINAIKTAIDAGYKHIDAAAIYKNEKGVGLGIKEANIDRKDLFVTSKVWNEQRGYENTLKAFDNTINDLQLDYLDLYLIHWPAAAHQFENWKQLNNDTWSAMEKLYKDGKIKALGVSNFMEHHLTPLLQHATIKPTVNQIEYHPGYMQQDCVQFCNDNNIQVEGWSPLGRGDVFDNEVLKQLAHKYNKTVAQLSIRWAIQNNVIPLPKSVTPNRIIENFEVSDFNISESDMALINKIDTIANSGLRPDSVSF

SEQ ID NO: 78369 - protein, 430 aa, unidentified eubacterium SCB49
MSKKISLKDAISIGIGGMVGGGIFAVLGLAVSLAKGGTPLAFLFAGIIALLTAYSYAKLSKKYPENGGTVKFIEQQFGSGIFAGGINNLLWVSYIVMLALYASAFGSYGAELISITGEKQIDVRIFQTSIISLALLINYLSVKLVSTIESTAVVIKLIILIGFIAVGFYGLTVHPENINQLAPKNWEKSILLLSGGMVIFVAYEGFELIANSISDLKDREKNTEKAYFGAVGFVVVLYILIAIVTVGALPFDEILNAKDYVLAKAAEPTLGQIGFTIITVTALISTFSAINATVLGSGRVNYNIAEDGELPMFFCHKFWGKPIGLLITAILSIILVNLFNLQSISTAGSAGFLLIFTIVNFIGFKKHQELHSNKHIHLLATILCFIAFLTLIFQQLTENKTGVFTALGIIFLSFLFELIYKKTTQKTPRK

SEQ ID NO: 78370 - protein, 492 aa, Synechococcus elongatus PCC 7942
MPSTNPFLTLPYEPAFASLGSEFSDPVEAATFPAHQLRFRNDRLLPILGLDPATVTDEHFIEAFGRFQGRSPLLAMRYHGYQFGIYNPDLGDGRGFLYGQVRGRNGWLYDFGTKGSGRTPYSRGGDGKLTLKGGVREVLASEFLQRLGVRTGRCLSLIETGEELWRGDEPSPTRSSVMVRFNRTHIRFGTFERLHYFKRADLVRQLLDHVIATYYSHLLGDPEADAKFYAELTERTADLAAQWMAAGFCHAVLNTDNLSIVGESFDYGPWAFLDRFDPKFTAAYFDHSGRYRYENQPGICQLNLELLQVPLGMVMSAADLEAGIAGFGDRYQATYSRLMLRRLGFEADQLHSAIADDLIITTLQLLLRAPIGYNEFFARLRAQFQPSWRSDLSAILPDWITTDLEALPEAQWQGWRDRYHQLLTHLPESQLPLIQQQLAQANPEIAPIRPVVESVWDPIAIDDNWEPLEALLNRWRHDGDGAADGVVVPNAN

SEQ ID NO: 78371 - protein, 223 aa, Arabidopsis lyrata subsp. petraea
FDRVSIQQWIDSGNRTCPITKLPLSENPTLIPNHALRSLISNFAHVSPKETSRPRTQQEHSHSQSQALISTLISRSSSNASKLESLSRLVRLTKRDSLIRRKVTESGAVRAALDCVDSGNQVLQEKSLSLLLNLSLEDDNKVGLVADGVIRRIVAVLRVGSPDCKAIAATLLTSLAVVEVNKATIGSYPDAISALVYLLRVGNDRERKESATALYALCSFMDN

SEQ ID NO: 78372 - protein, 465 aa, Zea mays
MEVSSVEFGHAAAASKCFDDDGRLKRTGTMWTASAHIITAVIGSGVLSLAWAIAQLGWVAGPTVMLLFSFVTYYTSALLADCYRSGDACTGKRNYTYMDAVNANLSGVKVWFCGFLQYANIVGVAIGYTIAASISMLAIQRANCFHVEGHGDPCNISSTPYMIIFGVVQIFFSQIPDFDQISWLSILAAVMSFTYSTIGLGLGIAQVVSNKGVQGSLTGISVGAAFGDIAFAYSYSLILIEIQDTIRAPPPSESKVMRRATVVSVAVTTFFYMLCGCMGYAAFGDNAPGNLLTGFGFYEPFWLLDVANAAIAVHLVGAYQVYCQPLFAFVEKWARQRWPKSRYITGEVDVPLPLGTAAGRCYKLSLFRLTWRTAFVVATTVVSMLLPFFNDVVGLLGALGFWPLTVYFPVEMYIVQKKVPRWSTRWVCLQLLSVACLVITVASAAGSVAGIVSDLKVYKPFVTTS

SEQ ID NO: 78373 - protein, 223 aa, Arabidopsis lyrata subsp. petraea
FDRVSIQQWIDSGNRTCPITKLPLSENPSLIPNHALRSLISNFAHVSPKESSRPRTQQEHPQSQSQALISTLISRSSSNASKLESLSRLVRLTKRDSLIRRKVTESGAVRAALDCVDSGNQVLQEKSLSLLLNLSLEDDNKVGLVADGVIRRIVAVLRVGSPDCKAIAATLLTSLAVVEVNKATIGSYPDAISALVYLLRVGNDRERKESATALYALCSFMDN

SEQ ID NO: 78374 - protein, 622 aa, Vitis vinifera
MALGAISTCGGAKGSTLPNHAIRTANLSHSSSFMPSGNVGALQFRLKVKKSVFRYQIFPLFMKEKGSLTPRTLVFAAQKESDESESGSSQSCIEDQMHMAPEYNDGSRDPDVEVASITLSEADLSQSAVQLGNQGNLLDKLKAVHLHILAMEQWNASRIKLCHRNYMASATNLIHYLALKCLDVEQLKEDLSSVGLLNLETINPCVIANLTAGIQMLENLKSYPLNIKENAWEFIIDTMRKKASSNMKILLGPLADERTAHIMVTVGQEVTENETLITDILKSGATIIRINCAHGNPSIWSEIIRRVRRSSQMLEKPCRILMDLAGPKLRTGNMKAGPCFVRLRVGDLLIISLDSSIEQDELTQPTVDAYRVTCPSSFLFDSVKPGEPIAFDDGKIWGVIQGTSASEIIVSITHASPRGTKLGAEKSINIPESNIRFEGLTTKDLMDLEFVAAHADMVGISFIRDVRDIVVLRAELEKRKLHNLGIVLKIETSSGFDKLPLLLLEAMKSPNPLGVMIARGDLAVECGWERLGDIQEEILSICSAAHVPVIWATQVLESLVKSGVPTRAELTDVANGRRASCIMLNKGKHIVDAVSTLDIILQGKSTKMKAELKPLVLSSHLF

SEQ ID NO: 78375 - protein, 223 aa, Arabidopsis lyrata subsp. petraea
FDRVSIQQWIDSGNRTCPITKLPLSENPSLIPNHALRSLISNFAHVSPKESSRPRTQQEHSQSQSQALISTLISRSSSNASKLESLSRLVRLTKRDSLIRRKVTESGAVRAALDCVDSGNQVLQEKSLSLLLNLSLEDDNKVGLVADGVIRRIVAVLRVGSPDCKAIAATLLTSLAVVEVNKATIGSYPDAISALVSLLRVGNDRERKESATALYALCSFPDN

SEQ ID NO: 78376 - protein, 355 aa, Zea mays
  misc_feature (153)..(153): Xaa can be any naturally occurring amino acid
MTLQTLALCSPQPPPRIPSSFLLRTRRLPPPFPHGGPSRLLFHSTFASVSPAPAPAPGRDHLNSKEQGPPPAPLPPPPPEELASEDESYYHEHLLEVAQENQSRVVPVKAFFLCTSIDLRSLQSQNSFNVIPPTSRATNYVVLRYYDVKGDPXDGYLKIVEKHASGLLPEMRKDDYAVVEKPTLETWMQGGLDYIVLRDLSIDGIRTIGSVLGQSIALDYYIRQVDGMVAEFTDINRGMEKTGTFTMERKKLFQLVGKANSNLADVILKLGLFERSDIAWKNANYAQIWEYLRDEYELTQRFGNLDFKLKFVEHNIRFLQEILQNRKSDFLEWLIIILISVEILISVYNIIQEQM

SEQ ID NO: 78377 - protein, 288 aa, Gluconobacter oxydans 621H
MSDTVSPADLSRFLDRQRAAFLRDGPPVLKQRRADLRRLKAEVLKRRTDIVRALKADFGQRSERESAIVELIPLIQSINYMIRHLACWMRPERRHVSAYFQFGRAWIIRQPVGVVGIIAPWNYPVSLALVPLATAIAAGNRAMLKPSEFTPVTSAVIGEIVRAVFPSEQVSVVTGDGEVGAAFSALPFDHLFFTGSTAVGRKVAEAAARNLTPVTLELGGKSPVVIEPGFSREWVADRLVFGKLTNGGQTCIAPDYVLVHENDRDAFAAAYQAAVKKQHPGGYAGSSD

SEQ ID NO: 78378 - protein, 133 aa, Triticum aestivum
  misc_feature (36)..(36): Xaa can be any naturally occurring amino acid
  misc_feature (40)..(40): Xaa can be any naturally occurring amino acid
  misc_feature (43)..(44): Xaa can be any naturally occurring amino acid
  misc_feature (46)..(46): Xaa can be any naturally occurring amino acid
  misc_feature (50)..(50): Xaa can be any naturally occurring amino acid
  misc_feature (76)..(76): Xaa can be any naturally occurring amino acid
  misc_feature (87)..(88): Xaa can be any naturally occurring amino acid
  misc_feature (92)..(92): Xaa can be any naturally occurring amino acid
  misc_feature (102)..(102): Xaa can be any naturally occurring amino acid
  misc_feature (104)..(104): Xaa can be any naturally occurring amino acid
  misc_feature (107)..(107): Xaa can be any naturally occurring amino acid
  misc_feature (111)..(111): Xaa can be any naturally occurring amino acid
  misc_feature (115)..(115): Xaa can be any naturally occurring amino acid
  misc_feature (120)..(121): Xaa can be any naturally occurring amino acid
  misc_feature (123)..(123): Xaa can be any naturally occurring amino acid
  misc_feature (126)..(131): Xaa can be any naturally occurring amino acid
PSSSLVTEISSSAQQQWPRETFIMIKPDGVQRGLIXEVIXRFXXKXFYLXGLKLQNVEKSVAEQQYSDLSSKPFFXGLVEYIVSGPXXRLWXWSGLRAVCLXLXRKXIGGXNPLXSEPGXXRXDFXXXXXXNL

SEQ ID NO: 78379 - protein, 324 aa, Triticum aestivum
  misc_feature (114)..(114): Xaa can be any naturally occurring amino acid
  misc_feature (138)..(138): Xaa can be any naturally occurring amino acid
  misc_feature (169)..(169): Xaa can be any naturally occurring amino acid
  misc_feature (193)..(193): Xaa can be any naturally occurring amino acid
  misc_feature (226)..(226): Xaa can be any naturally occurring amino acid
MAKEVSEEPEHAAPAHKDYSDPPPAPLFDMGELRMWSFYRALIAEFVATLLFLYITVATVIGYKVQSAADPCGGVGVLGIAWAFGGMIFVLVYCTAGISGGHINPAVTFGLLLXARKVSLLRAVMYIVAQCAGGIVGXGIVKGIMKDAYQANGGGANMVASGFSRGTAXLGAEIVGTFVLVYTVFSATDPKRXARDSHGPRAGPRSPSGFAVFMVHLATIPITGTXGINPARSLGAAVIYNKKAAWDNHWIFWVGPLVGALAAAAYHQYILRAAGIKALGSFRRQREQLSPAAHYLMHGSPTRATSVLGECMLLSCRQCLSVLQ

SEQ ID NO: 78380 - protein, 259 aa, Lactobacillus reuteri
MRKPFIIANWKMNKNVHESVAFVKAIKEKLPANKEIGIAAQAVSLYNMKKVAGSSNLQIIAQNASAELEGPYTGEISMRSLADAGVTYVMLGHLERRRLFNENNDSINQKVLAALNAGIIPIICTDEEMVQTEVNGQIHYVFRQLKSVLKGVPANKLSQIVISYEPSWAVGSTHQANPDIAEEGCLAIRQSLVEMYGNEIGEQVRILYGGSVNPENIGQIMSKPNVDGALIGRASLEIESFLQMINYIELASKQKSQVI

SEQ ID NO: 78381 - protein, 376 aa, Zea mays
MAISCFNGGAGWPEPVVRVQAVSDTCGDTIPERYVKPLSERPRLSPASDGSGPNIPVVDLSMLDVDATSSAVAAACREWGFFQAVNHGVRPELLRGARAAWRGFFRQPAEVRERYANSPATYEGYGSRLGTAKGGPLDWGDYYFLHLLPASLKSHEKWPSLPSSLRGATEEYGEEVLQLCRRVMRLLSSGLGLEAGRLQAAFGGEGGEGACLRVNFYPQCPQPELTLGVAGHSDPGGMTMLLVDDHVKGLQVRSPDGQWIVVEPVPDAFIVNVGDQIQVLSNAAYKSVEHRVTVSAAEDRLSMAFFYNPRSDLPIAPMAELVGPDRPALYPEMTFDEYRVFIRQRGLAGKAQLESLQVKAAAGGGGCSAAAASSTS

SEQ ID NO: 78382 - protein, 103 aa, Arabidopsis thaliana
MAEKSQIPDNNNNTSSSAKKPTPEIGSGSGKRYYNPPESVNPDQATLREQWKFAIRQYSKWYSHAWGTAILAGGFFFGLGWIIKGSNPLPSLQSSSKPRNEEK

SEQ ID NO: 78383 - protein, 491 aa, Vitis vinifera
MGKSVLVLVLTLVVLSGGVSSASATASPAKIVTGFVSDAVPVVMKWLWSLKATTKTAISSRSMMKFESGYTVETVFDGSKLGIEPYSIEVLGSGELLILDSANSNLYKISSSLSQYTRPKLVTGSAEGYSGHVDGRLREARMNHPKGLTVDDRGNIYVADTLNMAIRKISDAGVTTIAGGKLGRGGGHVDGPSEDAKFSNDFDVVYIGSSCSLLVIDRGNQAIREIQLHFDDCAYQYGSGFPLGIAVLIAAGFFGYMLALLQRRVGTIVSSENDQANPSIAHSTYQKPLKSVRPPLIPTEDEMEKQEEGFFGSLGKLFVYAGACIAEIFGGMIPGLKKKPHSYQYQNQQNYQQPQKHSNAWPLQESFVIPDEDEPPSIDTRTPTPRKTYPFMSKDAEKMHQIRQSRAFVSGWDGDFQQQQKQHHHRHYSSTPHTYYEQNCEKTNEIVFGAVQEQQVRREPVDIKPVNYGDPIYDHHNIRSRIHSKGYTQGY

SEQ ID NO: 78384 - protein, 491 aa, Herminiimonas arsenicoxydans
MTKNLRQEWLSNIRGDLLAGAVVALALIPEAIAFSIIAGVDPKVGLYASFCIAVVIAVVGGRPGMISAATGAMALVMVTLVKDHGLQYLLAATILTGVLQIFAGILKLGVLMRFVSKSVVTGFVNALAILIFMAQLPELIGVNWMVYPMVAAGLAIIYLLPYVTKAVPSPLVCIVVLTGFSMWMGLDIRTVGDMGQLPDSLPIFLLPQIPLNWETLAIIFPYSVTLAVVGLLESMMTATIVDEMTDTLSNKSRECSGQGIANIASGFLGGMAGCAMIGQSVINIKSGGRGRLSTLFAGALLLVMVVFLGPWVGQIPMAALVAVMIMVSIGTFSWRSLSNLVTHPKSSSVVMVATVVVVVFTHDLAKGVLVGVLLSGIFFAQKVGQLLSVQVSSTGERSRLYTVSGQVFFASADKFNASFDYSEDVTDVVIDVSHAHFWDITSVSTLDKVVMKFRRLGANVEVIGLNQASSTMIERFGLHDKIDGVEDIIGH

SEQ ID NO: 78385 - protein, 148 aa, Zea mays
LGPSRPAGVGAQRRASRPGRALAIHAPRVHTDTGRHTAQSPSRLAVVLTVLHTPVPILFRCRHPLRRPPRPAAATRPVSIAMTTSRRLADRKISRFEKNITKRGSVPETAKKANDYPVGPILLGFFVFVVVGSSLFQIIKTASNAGLF

SEQ ID NO: 78386 - protein, 235 aa, Zea mays
MDPEKQLQQDGGSVEADIERLPVDLLAHILSLLSPFRDLSMAEGVSRRWRWAVERSLASRRRLSFAGQRTGDDTAARLVRAAVNLRDLDICWGCRITDDGLIKISSADCVGNLTSISLWGLAGITDKGVVRLVSRAYSLQHLNIGGTFITDESLYAVANSCANLKSIILWSCRHVTEGGLVALVNKCRRLECINVGGMRVPPESLVGLLSISPALEIRSTARILNLNLNAGVQVS

SEQ ID NO: 78387 - protein, 325 aa, Sesamum indicum
MAEENVGIAKDVTELIGKTPLVYLNNIVDGCVGRVAAKLESMEPCSSVKDRIGYSMITDAEAQGLITPGQSVLIEPTSGNTGIGLAFMAAAKGYKLIITMPSSMSLERRIILRAFGAELVLTDPAKGMKGAVQKAEEIRDKTPNSYILQQFENPANPKIHYETTGPELWKGANGKIDAFVSGIGTGGTITGAGKFLKEHNPNIKLYGVEPVESPILSGGKPGPHKIQGIGAGFIPGVLDVNLIDEVIQVSSDEAIETAKLLALKEGLLVGISSGAAAAAAIRIAKRPENAGKLIVVIFPSFGERYLSSVLFESVRREAESMTVEP

SEQ ID NO: 78388 - protein, 223 aa, Arabidopsis lyrata subsp. petraea
FDRVSIQQWIDSGNRTCPITKLPLSENPSLIPNHALRSLISNFAHVSPKESSRPRTQQEHSQSQSQALISTLVSRSSSNASKLESLSRLVRLTKRDSLIRRKVTESGSVRAALDCVDSGNHVLQEKSLSLLLNLSLEDDNKVGLVADGVIRRIVAVLRVGSPDCKAIAATLLTSLAVVEVNKATIGSYPDAISALVSLLRVGNDRERKESATALYALCSFPDN

SEQ ID NO: 78389 - protein, 223 aa, Arabidopsis lyrata subsp. petraea
FDRVSIQPWIDSGNRTCPITKLPLSENPSLIPNHALRSLISNFAHVSPKETSRPRTQQEHSHSQSQALISTLVSRSSSNASKLESLSRLVRLTKRDSLIRRKVTESGAVRAALDCVDSGNQVLQEKSLSLLLNLSLEDDNKVGLVADGVIRRIVAVLRVGSPDCKAIAATLLTSLAVVEVNKATIGSYPDAISALVYLLRVGNDRERKESATALYALCSFPDN

SEQ ID NO: 78390 - protein, 322 aa, Candida tenuis
MSASIPDIKLSSGHLMPSIGFGCWKLANATAGEQVYQAIKAGYRLFDGAEDYGNEKEVGDGVKRAIDEGLVKREEIFLTSKLWNNYHDPKNVETALNKTLADLKVDYVDLFLIHFPIAFKFVPIEEKYPPGFYCGDGNNFVYEDVPILETWKALEKLVAAGKIKSIGVSNFPGALLLDLLRGATIKPAVLQVEHHPYLQQPKLIEFAQKAGVTITAYSSFGPQSFVEMNQGRALNTPTLFAHDTIKAIAAKYNKTPAEVLLRWAAQRGIAVIPRSNLPERLVQNRSFNTFDLTKEDFEEIAKLDIGLRFNDPWDWDNIPIFV

SEQ ID NO: 78391 - protein, 218 aa, Zea mays
MILFPLPTTEKPVQANIKQARPSFSSPLTLDASPPLLPHPSIAPSLRSALPQPHPCAPADSRRPLLEGTMEQTFIMIKPDGVQRGLIGDIISRFEKKGFYLKGMKFMNVERSFAQQHYADLSDKPFFPGLVEYIISGPVVAMVWEGKDVVLTGRRIIGATRPWEAAPGTIRGDYAVEVGRNVIHGSDSVENGKKEIALWFPEGVAQWKSNLHPWIYEA

SEQ ID NO: 78392 - protein, 191 aa, Synechococcus sp. CC9605
MTGTPKSSPLGTAQQWVLVLIAVVLAIGLVILRGGIQSESPMEQLARRSLDPQTALTNGRPTLIEFYADWCQVCREMAPSMLDLEKRSRDRLDVVLVNVDNPRWQDLVDRYDVNGIPQLNLFNAEGEAKGRSIGLRSVEELQLLTTALIEDQPLPALPGVGNISRLETPFSANNALAGASSPANAGPRSHG

SEQ ID NO: 78393 - protein, 374 aa, Frankia sp. EAN1pec
MTTMSSMPVSSDPAGSSAPERASRAWRGIIEEYRDRLPVTADTPVITLREGGTPLLHADHLSELTGCDVHLKVEGANPTGSFKDRGMTVAISRAVGEGSQAVICASTGNTSASAAAYAARAGLTCAVLVPSGKIALGKLAQALVHGARLLQVEGSFDDCLRVARELADTFPVTLVNSVNPHRLEGQKTAAFEIVEALGHAPDVHCLPVGNAGNITAYWRGYVEEDTRIRSGRPRMFGFQAAGAAPIVRGEVVTSPQTIATAIRIGNPASWDFATDARDASGGLIDAVNDRQILAAYRLLARREGVFVEPSSAASVAGLLATYADGRLSPGQRVVCTVTGNGLKDPDWAISGAAKPETIPPTVAGAARALGLQRS

SEQ ID NO: 78394 - protein, 381 aa, Aspergillus oryzae
MRVTGCFLVPVVVLYRKEGNKLFFPRSIRRSAKYPRIVSMQTLGASGGCHTGAVLLRDLYGPWKRTGKPEIFIPRDSWLNHAFTFKSAGITPHFLPYFNAETASLDFPALSTAIRSLPAQSVVVLQTNAQNPTGCDPSPTQWRELASIFSERGHLAFFDAAYPGLASGDIDTDLECVRLFAEQEIPMVFVATYGKCFGLYCERVGILSIITPDQEVRDRMETQMRLLVRAESGAMPDFGSTIIETILSDERLEQQWRDEVRDMAKDLQHRRRTLRTELERLGTPGDWRHITDQNGFFSYIRLSAEQITGLRIKHHVYLQDSGRISIAGLNSSNIGYVARSIDDVIRTDRMSLPLLVSQLLPPLVSNLQSPFDCQKHCSYTT

SEQ ID NO: 78395 - protein, 337 aa, Acidobacteria bacterium Ellin345
MSRIAVIGAGAWGTALAIVLGRRGGHAVRLWAYEQEVVASILARRTNDLFLPEASIPATVTVTDSLTDALNGAEIVLSVMPSHHVRRLFTQMLPHLSDDMVFVSATKGVEDQTYLRMTEVIEEVVTPRFSPRLVAVSGPTFAKEVAKGDPTAITAASSDEDLARTVQHEFSDPRFRVYTNRDVVGVELGGALKNVIAIAAGICDGLELGHNSVAALVTRGLAEITRLSLACGGHIETMAGLAGLGDLVLTCTGGLSRNRTVGVELGKGRKLADIIAGMRGMVAEGVLTTNAAIGLANKHGVEMPITQQMHAILHQGKSPSDAIRELMSRPSTTEVWL

SEQ ID NO: 78396 - protein, 646 aa, Chlamydomonas reinhardtii
MQTQLRAPCVSHKTRINGVPCSPKVVPRVARVPSGSAPEAPVASPEPTAAQRNVVAQVAKMIHAQTTTNKKGALVSELPAWQALKEHVNEIEKTHLRDLLHDEARCMSLIKECEGIYGDFTRQRVTQKTLELLFELAEQSNLRGKINAMFNGEHINSTEDRAVLHIATRAHRNQKIFVDGKDVVPDVWEVLDKIKAFSDKVRNGEWLGVTGKPLKNVVAIGIGGSFLGPLFVHTALRTEPVAMRCSRDRSLRFLANVDPIDVARALDGLDPEETLVVVVSKTFTTAETMLNARTVRSWLTSRLGPDSVAKHMVAVSTNLKLVKEFGIDPENAFGFWDWVGGRYSVCSAVGMLPLSLQYGFDLMQEFLAGANNIDEHFKNQPYQDNLPVLMGLTSLWNVSFLGHGAKAILPYCQALSKLAPHIQQVDMESNGKGVDINGVRLPFETGEIDFGEPGTNGQHSFYQLIHQGRVVPCEFIGIVRSQQSVYLKGEVVSNHDELMCNFFAQADALAYGKTPEQLRSDNVPDYLIPHRVFTGNRPSMSIMLPSCTAYTVGQLLAIYEHRIAVQGFIWNINSFDQWGVELGKVLASKVRTVMNSARTRDRKILPQDGFNYSTTRMINKYLEGKTQVLYPEGHDTFPIDMLRGGH

SEQ ID NO: 78397 - protein, 614 aa, Flavobacteria bacterium BBFL7
MLELAGIIILGILAQWMAWRFKIPAILPLIIIGLLVGPIASLYTEDATKLIEPIWNGQQGLFPGESLFYFVSLAISIILFEGGLTLKKEEILNTGPVIGKLISVAVIITFAGAGVAAHYIFGLSWEIALLFSALIIVTGPTVITPILRNIPLKKDVSSILKWEGILIDPIGALFAVLVFEFISANAGGEFTLVALEEFGKIVLFGFSFGFSFAHALAFSIKKKLIPHYLLNVFTLAAVLGVFVLSDSFAHESGLLAVVVMGMVMGNINLPNLKELLYFKESLSVLLISILFILLAANINMEDLYLIYRWETAVLFAIVAFIIRPLGVFASSINSGLKINEKLFISWVGPRGIVAAGIASLFGSKLVTQGVDGAEYITPLVFMIVLGTVLLNATTARLFAKIVGVFLKQSDGIMIVGASKFSRIIASYLKEHGRSVVLVDTNTNNVRIAKDKGLDAVAADIYSDAITDDIEFNNIGFLMALTGNSQINDYALERFTARFGENGAYRLVHSTEVSNPDENPTRGLFSSTDDYVNMMEVARYYGEIHEITIKSQEHYEGLIEITKTDENIIPLFIRKKNEIDIIPSTSLDMEVEEDSKLVYLGKKIVVQASGDIVME

SEQ ID NO: 78398 - protein, 464 aa, Actinomadura madurae
MSIDELDARGGTPRAAGRVPPGPPRRATPNLLRMLATDRLGMMQAALRHGDAVRVGLGPKALYLFNRPEHAKHVLADNSGNYHKGIGLVQARRALGDGLLTSEGDLWREQRRVVQPAFQHKRIAGLADAVVEEAGALVARLRARAGGPPVDVVGEMTALTLGVLGRTLLDADLTAHTSLGRAFETVQDQAMFEMVSQGMVPMWLPLPGQLRFRRARRELDRIVRALVAERLREGGGAEDALSRLIESARREPDGRVGRRRLRDELVTLLLAGHETTASTLGWTFHLLDRHPLVRARVRAEARAVFGDGTPTLDDLSALSYTTMVVQEVMRMYPPVWILTRVAQRDDEVGGYRVPAGADVLVCPYTLHRNPDFWEWPDVFDPDRFGPGRSEGRPRYAYIPFGAGPRFCVGNHLGMMEAVFVTAMVARDLRLTGVPGRDAVPEPMLSLRVRGGLPMTVHDDAGAGA

SEQ ID NO: 78399 - protein, 348 aa, Kitasatospora griseola
MYTDTAETLESAVDAGRNHTLRAAGIAAPALRATIDTLGSRIRPIVGYHFGWLDLAGQPTDQGSGKMIRAALTVLAAEACGGDVQRAVCGAVAVELVHNFSLLHDDVMDGDLERRGRPTVWATLGVPAAILAGDVLLARGCAILEGDSEHRTWATELLTETIATLAEGQMADVAFEHRTTISLEEALAVSEAKTAALLSCACELGAGLSGGGAEARERLAKFGWHLGMAFQLVDDVLGIWGDPAATGKPAGSDLRNRKKSIPVAAAMNGTGAAAEELAAIYRGAEPLTDDMADRAAKLIESAGGRAWTEAEIDRHRRGAAAQLEALGLTEEQRRPLLALADYVAFRNH

SEQ ID NO: 78400 - protein, 369 aa, Nitrosomonas europaea ATCC 19718
MTISSTEEILADFRNGKMVILIDEEDRENEGDLVLAADFVTPEAINFMARYGRGLICLTLTEERCHQLKLPMMVADNHSPLGTNFTVSIEAATGVTTGISAADRACTVQAAVKADARPEDLVQPGHIFPLKAQKGGVLARAGHTEAGCDLGRLAGLTEAAVICEILKENGEMARLPDLIEFAGKHTLKIGTIADLIHHRNLTESLVSRFAERPLHTAHGEFRLIAYHDKIAGVTHIALVKGTWNTGEEVLVRVHEPLSVIDLLEADDHSHSWSIHDAMAVIAQAGKGVVVLLHRKNDASVLTDRILRARPRQPDKPVPDLRQHGIGAQILKDLGVSKMRLLATPRRMPSMTGFSLEVAGYLEPGNRIRK

SEQ ID NO: 78401 - protein, 300 aa, Kitasatospora griseola
MTLDIFPTTTRVQLAPGAGQDTVAFNGEPATGEAERRITAFLRLVRERSGRTERARVETENTVPTGAGLASSASGFAALAVAAAAAYGLGLDARGLSRLARRGSGSASRSIFDGFAVWHAGHAGGTPEEADLGSYAEPVPAVDLEPALVVAVVSAAPKAVSSREAMRRTVDTSPLYEPWAVSSRADLADIGAALARGNLPAVGEIAERNALGMHATMLAARPAVRYLSPASLAVLDGVLQLRRDGVPAYATMDAGPNVKVLCPRSDAERVAEALRAAAPVGAVHIAGPGRGARLVAEECR

SEQ ID NO: 78402 - protein, 258 aa, Sinorhizobium meliloti 1021
MAQGKGSGEGRIALVTGGGTGVGRGIAQALSAEGYSVVITGRRPDVLDAAAGEIGGRTGNIVRAVVCDVGDPDQVAALFAAVRAEFARLDLLVNNAGSNVPPVPLEEVTFEQWNGIVAANLTGAFLCTQHAFRMMKAQTPRGGRIINNGSISAQTPRPNSAPYTATKHAITGLTKSTALDGRMHDIACGQIDIGNAATDMTARMSTGVLQANGEVAAEPTIPIEHIAEAVVYMASLPLSANVLTMTVMATRMPLVGRG

SEQ ID NO: 78403 - protein, 164 aa, Nitrosomonas europaea ATCC 19718
MSYYDNILEIDSNLDGNGLCIGIVMSRFNIDVSEGLLGACTAELTRLGVQEADIVLTTVPGALEIPVALQKLAESDRFDALIALGAVIRGETYHFEVVANESARGLAAVGREYNIPIANGILTTDDEDQATARMAEKGGETARVAIEMANLVLTLDEMDQSAPT

SEQ ID NO: 78404 - protein, 515 aa, Aspergillus fumigatus
MVPMLWLTAYMAVAVLTAILLNVVYQLFFRLWNRTEPPMVFHWVPFLGSTISYGIDPYKFFFACREKYGDIFTFILLGQKTTVYLGVQGNEFILNGKLKDVNAEEVYSPLTTPVFGSDVVYDCPNSKLMEQKKFIKYGLTQSALESHVPLIEKEVLDYLRDSPNFQGSSGRMDISAAMAEITIFTAARALQGQEVRSKLTAEFADLYHDLDKGFTPINFMLPWAPLPHNKKRDAAHARMRSIYVDIINQRRLDGDKDSQKSDMIWNLMNCTYKNGQQVPDKEIAHMMITLLMAGQHSSSSISAWIMLRLASQPKVLEELYQEQLANLGPAGPDGSLPPLQYKDLDKLPFHQHVIRETLRIHSSIHSIMRKVKSPLPVPGTPYMIPPGRVLLASPGVTALSDEHFPNAGCWDPHRWENQATKEQENDEVVDYGYGAVSKGTSSPYLPFGAGRHRCIGEKFAYVNLGVILATIVRHLRLFNVDGKKGVPETDYSSLFSGPMKPSIIGWEKRSKNTSK

SEQ ID NO: 78405 - protein, 1486 aa, Cryptococcus neoformans var. neoformans B-3501A
MSNPTSPTDPPDAGPPAPAIASSSKTGRRSVRLFAPDEEDSSDEDGLIGVPAETTFNDDEVPPSNTRSASYPGPPAHTSPTSKISSIVSSASAAQPKLARSITYVAPSAISSRPAYPLHPAGPETLHASYETWRKTRYTLESFSRAKADGKNAAQRGRSYTDPDVGYFSPDAGDDGWGSDDEDELRSPGWGISHHNMDSGGKTDGSPQLPIKPADVTEDEGQERLDWQGMLESVLNSDVLKVEEQRIYNSMPTDSFREEIGKTLWWQIRAKLRGRTEAEEKKRVQERRARVVDPVLEEINEFKYDPKNNPEGEEDSDADPQDATSTAAPQSKALNQVNTILAKLHAVKGLYPNLAAMRADKSLYTDENFRKRADALTSWSIIVSSLQTQLKLLQKWTGSDELDITKPNTTHEKALVGKYKYHHSIDSKGTPGRDAADDSSFLDRVIKEDNLQRTFERRAFVDMINLVRNAKETVINYLPQFQEQNLPDFQYEIVRLIGFPGRLIIEAVKVRLDAASRLLDPNPMVVEDFIENLRLSISLAVLIRKQYDEIMAPDAEGRWKIPHCLPTEYNDVLLDALRTFFKLLHWRLRGVGKASYYKETEVLEEEAPFLYEAAEAIVGGDMVVAEQYCALSNKLLIRSANYLDQQLRVPIHSHSRDKERGGDKERDGSSSSQRDRNRDGSLAGPPKHMKVEELFSWYSKLLDSARMRHRKTQRFCRKLTQRFDNSAEYSIEETDVDMLVETLQDTGHFLVYTGKFEANGTYIVADGSLWGQPDDVRHLLKRVFSVTIPGSRVRPRQTTSQVSGGGGVLANGQVAAAQPDPADPYPEADDFDDEALAAYILLISPRQNFVWSGAVMTLDVDYIDYELADNRVRLIADGPTKRLALCKHYFTQALIHPDTGETIDLPCVVEAQAHLPTIQKQLVKIAKSSYRLSECIVQSAPLVRNAFRGKPGSQELVENWYSFATEHGTRVLVHIEPSAWDRFNRLLMRLAISWISFISQECNPTDRKTFRWTVAALTYAFNMTRGSNILALDRSEFSLLRRYVGVCVSLLVSHFDILGARSSMEAKKEADRIEAMRRLQRLQENLDDEFLPRTPTESGGQPRIDRSIRLTVEERLRLIAELEARRSELAPAPVGQVLDEEVSEDRALVFLAASKSNISMRWQQGAYIGGGASGSVYLGYSLQDNTVFAVKILPTVDLQSSPALYESIKRESDVMSLLSHPNVVGFLGLEVHRNRVCLFQEYCEGGSLAGMLEYGKIDDEEVVGAFTIQLLRGLEYLHTNRIEHRDLKPENILIGANSVLKLADFGTAKIIKSNKTLARTRGGAHAKMEGLEGTPMYMAPEMIKNQRTGKLGACDIWGLGCIVLQMITGRKPWSFLDFDNEWAIMFHLGATKEPPPLPDPNEMSDQGIEFIDQCLSLDPEARPVASELLQDEWLVPMLEQMAELEQEYPDVLAMGQSDSLVPPPENASLTSNAPTLQDDITPPPLE

SEQ ID NO: 78406 - protein, 244 aa, Candida albicans SC5314
MSEPINKPEDEEMDVEFNDVDDQIVPDELPEQAQKQDDQQPQQSQSQTAETKIDTGDSAKPQNDATSSTAHPTGTANGTPPASVIPELPDLTRKDKSLKEVLDLMDGDFAPIIPDAVTDYYLAKNGFETSDIKIKRLLALATQKFISDIAQDAYEYSRIRSASAVYNSSNPQVRAKLLLQGQQYANQQTLTGNANNNGEGDQQQSSQSHSNAGNQQGKIVLTMEDLSNALSEYGMNTSRPDFYR

SEQ ID NO: 78407 - protein, 318 aa, Arabidopsis thaliana
MDTEMETEQIYQVDVGNLLAFNPNHRFSSAPSSRGELVKEILTEGTKLVQEIANKLFNFPSTETNDGPIVQLPPPTTKLPREKHIPRPKPPTKWEEFALKKGIQKRKKEKVVWDEQTNQFKRRHGYDRVNDDNDVPIIEAKESDEPGVDPFAKRLDDKKKRVGKQEKNRLQNLKAAEKAGALPSHVQLAATSLPISGTKAQPKKIGKDELGDVAGLAATSTASGGKFDKKLPGEKPPKKQGKHHKYLPVVSGRGDVNAEKEQTNNVLSKIFSKHSHEILNVGKAINMYNVKKEKKKSGRSDKLKPKKDITKKPANKAK

SEQ ID NO: 78408 - protein, 284 aa, Aspergillus oryzae
MPSLQESKLAFIGGGNMASAIIGGLVNKGVQKQNIWVSEPWDVNREKMAALGVQTTTANVEAAKDADLVIIAVKPQVTKGVCEELGAAWSQRTTLPVVVSIAAGITLDSLVQWLRTSDGRNAHVVRVMPNTPALVGEGASGLYASKDVTSEEKELVNAVLGSVSKATEWVDKEELLDVVTGLSGSGPAYFFAMVEHLVASATALGLSEEQATRLAAQTCLGAGKMLVESSDSPSQLRKNVTSPNGTTYAALQTFESLGFKETVDKAVNSATSRAAELGNTLGKQ

SEQ ID NO: 78409 - protein, 408 aa, Streptococcus pyogenes MGAS8232
MLDAKDIKQDFQILNQQVNDEPLVYLDNAATTQKPALVLEALQSYYQEDNANVHRGVHTLAERATHKYEASRQQVADFIHAKSSKEVLFTRGTTTSLNWVARFAEQVLTPEDEVLISIMEHHANIIPWQQACQKTGARLVYVYLKDGQLDMDDLTNKLTTKTRFVSLVHVSNVLGCINPIKEIAKLAHAKGAYLVVDGAQSVPHLAIDVQDLDCDFFAFSAHKMLGPTGLGVLYGKEELLNQVEPLEFGGEMIDFVYEQEATWKELPWKFEAGTPHIAGAIGLSAAISYLQRLGMADIHAHEAELIAYVLPKLEAIEGLTIYGPSQSSARSGLISFNLDDLHPHDLATALDYEGVAVRAGHHCAQPLLSYLGVPATVRASFYIYNTKADCDRLVEAILKAKEFFNGTL

SEQ ID NO: 78410 - protein, 183 aa, Brassica napus
MAKTGFFDSDPTAIAKAKELKLEMKKLLSNIEEEDGLSVQTIDQLQEALSAFRQATTMRKMEKSSSLEMLETAVSFPDEFRCPLSNELMRDPVVLASGQTYDKLFIQRWLSSGNRTCPKTEQVLPHTALTPNVLIRDMISKWCKTVGLETNNLYESKKAVTRSDREVFNSLLCKVSSSSNVQD

SEQ ID NO: 78411 - protein, 224 aa, Acidobacteria bacterium Ellin345
MAAYNLIVTDPHVIKMAEADFPTRWGRFRIYGFEGTFEEVPDSASANDLARDGVIERRKESAVALVMGDIHSQPPLVRIHSQCLTGDVFGSQRCDCRQQLELALQMISDAGNGVLIYEEQEGRGIGLMAKLQAYELQDKGLDTVEANEQLGLKADYRQYTLPVEIMKALGITRLRLLSNNPEKVKAVEDAGIEVVERVSAEVEAYPTSKAYLQTKKDKMGHIFG

SEQ ID NO: 78412 - protein, 245 aa, Glycine max
  misc_feature (230)..(230): Xaa can be any naturally occurring amino acid
MAVIPCHCYRTVGSDKPYLSGQSLRRRAPFPAVSVSFRRRISCVASSAIAHKVGLKDFLHLDDFDKDTILKMLDRALEVKALLKSGDRSFRPFEGKTMAMIFTKPSMRTRVSFETGFTLLGGHAIYLGPDDIQMGKREETRDIARVLSRYNDIIMARVFAHKDILDLAKYATVPVINGLTDYNHPCQIMADALTMVEHIGRFEVEKARKAGISKIEITNDPKEAVKGADXVYSDVWASMGQKEES

SEQ ID NO: 78413 - protein, 500 aa, Actinomadura madurae
MSVATESNEKTFASLNPATEEVVAEYPIHDESAVAAAIDRAREASRWWGELGRRERRLRLLNVKGALARNLNRMAEIIHQETGKPVADAQLETIMAISHLDWAARNAQKVLGPRTVFPGMMAINQKCTLEYQPLGVVGVIGPWNYPIFTPIGSIAYALAAGNAVVFKPSEFTPGVGAYLAELVAGVVPEHPILQVVTGYGATGAALASSPHIGKLAFTGSAGTAKKVMAACAENLTPIVAECGGKDACIVDADADLDAAADAALWGAMSNAGQTCIGVERIYVVDRAYDAFLGKLTDKARELRPGFDREAAYGPITMPGQLEIIERHIKDAIDRGGKAVVGGPESVRKPYVEPVVLTDVPDDSSAVCEETFGPTITVHRVASLDEAVEKANRTAYGLAGTIFSGNKARAMEAARTMRSGMTSINAFAAFAQVAALPFGGVGESGFGRIHGADGLREFARPKAITRQRFTTMNLTSFARSDKEMARVLGLINMLHGKHYKR

SEQ ID NO: 78414 - protein, 378 aa, Schizosaccharomyces pombe 972h-
MSFEGKTITCKAAVAWGAKEPLSIEDIQVAPPKAHEVRVKVDWSAVCHTDAYTLSGVDPEGAFPIVLGHEGAGIVESIGEGVINVRPGDHVILLYTPECKECKFCRSGKTNLCSKIRETQGRGLMPDGTSRFSCRDKTLLHYMGCSSFSQYTVVADISLVAISHSAPLRSICLLGCGVTTGFGAVTHSAKVESGSTVAVVGCGCVGLAAMQGAVAAGASRIIAIDINADKEVYAKKFGATDFIDSSKVKDLVQYVIDVTDGGVDYAFDCTGNVTVMQQELQFCHKGWGKLCVIGVAAAGKTLDFRPFLVVTGRQVLGSAFGGVKGRSELPNFVDEYMQGHFKVDEYITNEEPLKNINKAFDHMHEGKCIRCVVDMNKP

SEQ ID NO: 78415 - protein, 584 aa, Acidobacteria bacterium Ellin345
MAKLVADLLIERLIHWGVDTVFGLPGDGVDGLFEALRTHQEKLRFIQVRHEEAAAFAACGYAKYTGRLGVCIATSGPGGIHLLNGLYDAKCDGQPVLAITGHTFHDLIGTSYQQDVDLDKLYMDVAAYNQRIMGPGHVESALDEAVRTALSRRTVAHLTIPKDIQEWRASNFHRSPANVPDHSGAIFEPAYPQPPQELLRRAADILNQGRKVAILVGQGCLAARAEVEQVAELLAAPVAKALLGKAVLPDRSPYTTGGLGLLGTAPSQDAMEECDTLLIVGTSFPYLEFYPKPGKAKCVQIDIDATRIGLRHPADVGLVGDSRTALRALVPLLKRREDRSFLETAQKRMESWNELMKERGTRTDLPMKPQVVTHTLNQLLRDDAIVSTDSGTITTWTARYIEMRGTMQFSVSGTLATMANGLPYSIGASVAHPGRQVVCIIGDGGLTMLMGEPATLVKYKLPVKIVVIKNNVLGQIKWEQMVLDANPQFGVELQPIDFAKVAEACGVAGFKLENPADAERVLRSALEHDGPALVEATVDANEPPLPGNVSLKQALHFAEALASGQKDAAEIIKTVVENKVREVI

SEQ ID NO: 78416 - protein, 184 aa, Schizosaccharomyces pombe 972h-
MGNSLFKGFSKPFSRLFSNKEMRILMLGLDAAGKTTILYKLKLNQSVVTIPTVGFNVETVTYKNIKFNVWDVGGQDKIRPLWRHYFTGTKGLIFVVDSADSNRISEARQELHRIISDREMRDCLLLVLANKQDLPGALSPAQITDVLQLDKLKDRLWNVQPTCALTGDGLLEGLAWLSQNAKLK

SEQ ID NO: 78417 - protein, 416 aa, Vibrio parahaemolyticus RIMD 2210633
MTDKTQQATFADLGLIPTLVERLEALEYNQPTPIQSHAIPHVLDGRDMIGGANTGSGKTAAFSLPILQKILQQGESNDRRGNFVSHLILVPTRELASQVAYNVKSYSYHLRDKIKTVAVFGGVSVNPQMLALRGGCDIIVATPGRLLDLVSSNAIKLDQVKTLVLDEADRMLSLGFTEELNKILALLPEKKQTLLFSATFPEKVTALAQHLLNDPVEVQLQSAEASTLVQRVFSVNKGEKTAVLAHLIKQHQWRQTLIFVNAKNACNHLAQKLSKRGITAEVFHGDKGQGARTRVLDGFKSGEIQVLIATDIAARGLDIEKLPVVINFDLPRSPADYMHRIGRSGRAGEVGLGLSLIDYDDYHHFKVIEKKNKFQLEREQVEGFEVEDDQSEAYFLPMKPRAKPAGTGKKKKKRNQ

SEQ ID NO: 78418 - protein, 356 aa, Herminiimonas arsenicoxydans
MNPSFNIAIIPGDGIGKEVIPEGLRVLDAAAKRFGIHLEYKHIEWASCDYYAQTGKMMPDDWKQQLQGCDAIYFGAVGWPATVPDHVSLWGSLLKFRREFDQYVNLRPVRLFEGVPCPLANRKPGDIDFYVVRENTEGEYTAIGGIMYEGTERELVLQQSAFSRRGTDRILKYAFELAQSRARRRLTVATKSNGIAISMPWWDSRADEMAKNYPDITVDKQHIDILAARFVLQPDRFDVVVASNLFGDILSDLGPACTGTMGLAPSANLNPERLFPSLFEPVHGSAPDIYGQNIANPIAMIWSGALMLDFLGQRAAHDAILEAIKQVLAHGPRTPDLGGNAGTADIGMAIAAAVAG

SEQ ID NO: 78419 - protein, 715 aa, Oryza sativa Japonica Group
MEPKLAFPQDSPPLAILCAAKVAGVSLTLDPKLASGSAPTLHLGSGDFIHGVNTILRYIARVASVTSFYGQDAIQAAYVDQWLDYAPVILSGSEFEAACSFLDGYLASRTFLVSYGLSIADIVVWSNLAGTGQRWESLRRSKKYQNLVRWFNSIADYSDTLDEVVSAYVGKRGIGKSPAPSLKEKLPDSKQNISIPEVDLPGAKVGEVCVRFAPEPSGYLHIGHAKAGLLNKYFAERYKGRLIVRFDDTNPSKESNEFVENVLKDVETLGIKYDIVTYTSDYFPQLMEMAENLIKQGKAYVDDTPKEQMRSERMDGVESKCRNNTVQDNLSLWKEMINGTERGMQCCVRGKLDMQDPNKSLRDPVYYRCNTDPHHRIGSKYKVYPTYDFACPFVDALEGVTHALRSSEYHDRNAQYYRILQEMGLRRVEIYEFSRLNMVYTVLSKRKLLWFVQNKKVEDWTDPRFPTVQGIVRRGLKVEALVQFILEQGASKNLNLMEWDKLWTINKKIIDPVCGRHTAVLKDQRVLFTLTNGPEEPFIRVLPRHKKYEGAGKKATTFTNKIWLESADASVISIGEEVTLMDWGNAIIKEIKTQNGIITELLGELHLEGSVKMTKLKLTWLPDIEDLVSLSLVEFDYLIKKKKLEEDDNFLDNLNPCTCQEFPALGDANMRNLKQGEIIQLERKGYYRCDAPFIRSSKPIVLFAIPDGRQKSATK

SEQ ID NO: 78420 - protein, 218 aa, Agrobacterium tumefaciens str. C58
MSLRINDIAPDFTAETTQGPVRFHDWIGDGWAVLFSHPKNFTPVCTTELGAMGGLQPEFEKRGVKIIGISVDPVESHEKWKADIRTATGFNVDYPLIGDKDLKVAKLYDMLPAGAGDSSEGRTPADNATVRSVFVIGPDKKIKLVLTYPMTTGRNFDEILRAIDSIQLTSKHQVATPANWKQGEDVIITAAVSNEDAIARFGSYDTVLPYLRKTKQPG

SEQ ID NO: 78421 - protein, 356 aa, Arabidopsis thaliana
MELDLTPKLPKKVYGGDGGSYSAWCPEELPMLKQGNIGAAKLALEKNGFAVPRYSDSSKVAYVLQGSGTAGIVLPEKEEKVIAVKQGDSIALPFGVVTWWFNNEDPELVILFLGETHKGHKAGQFTEFYLTGTNGIFTGFSTEFVGRAWDLDENTVKKLVGSQTGNGIVKLDAGFKMPQPKEENRAGFVLNCLEAPLDVDIKDGGRVVVLNTKNLPLVGEVGFGADLVRIDAHSMCSPGFSCDSALQVTYIVGGSGRVQVVGADGKRVLETHIKAGSLFIVPRFFVVSKIADADGMSWFSIVTTPDPIFTHLAGNTSVWKSLSPEVLQAAFKVAPEVEKSFRSTRTSSAIFFPPSN

SEQ ID NO: 78422 - protein, 369 aa, Mycoplasma pulmonis UAB CTIP
MMSLKAGIVGLPNVGKSSLFSAITKKSVESANYAFTTIEPNIASVELIDKRLQKLAKLANSKKIIYATFDFVDIAGLVAGASKGEGLGNKFLANIREVDAIIHVVRCFENNDVLHVGGKIDPVFDAETINLELILADLQSVENILNRIKKRALSSNDATVKKEYELLNKIKEALSNQKLAISINLNQEEKDLIKSHQLLTMKPQIFVANIGLNDLDNLDKNQNYQKLLKFAQEQNFMTIPICIKIETELSSIENEEEKNEMMQAMNIEDSSINILARKAFELLDLETFFTVGKVEARAWVYKKNSLAPQCAGIIHSDFEKKFIKAEVISYKDFIEAGSEQNAKENGKMRLEGKNYLMQDGDICHFKFGK

SEQ ID NO: 78423 - protein, 629 aa, Arabidopsis thaliana
MITRSFFCFLGFLCLLCSSVHGLLSPKGVNFEVQALMDIKASLHDPHGVLDNWDRDAVDPCSWTMVTCSSENFVIGLGTPSQNLSGTLSPSITNLTNLRIVLLQNNNITGKIPAEIGRLTRLETLDLSDNFFHGEIPFSVGYLQSLQYLRLNNNSLSGVFPLSLSNMTQLAFLDLSYNNLSGPVPRFAAKTFSIVGNPLICPTGTEPDCNGTTLIPMSMNLNQTGVPLYAGGSRNHKMAIAVGSSVGTVSLIFIAVGLFLWWRQRHNQNTFFDVKDGNHHEEVSLGNLRRFGFRELQIATNNFSSKNLLGKGGYGNVYKGILGDSTVIAVKRLKDGGALGGEIQFQTEVEMISLAVHRNLLRLYGFCITQTEKLLVYPYMSNGSVASRMKAKPVLDWSIRKRIAIGAARGLVYLHEQCDPKIIHRDVKAANILLDDYCEAVVGDFGLAKLLDHQDSHVTTAVRGTVGHIAPEYLSTGQSSEKTDVFGFGILLLELVTGQRAFEFGKAANQKGVMLDWVKKIHQEKKLELLVDKELLKKKSYDEIELDEMVRVALLCTQYLPGHRPKMSEVVRMLEGDGLAEKWEASQRSDSVSKCSNRINELMSSSDRYSDLTDDSSLLVQAMELSGPR

SEQ ID NO: 78424 - protein, 660 aa, Oryza sativa
  misc_feature (179)..(179): Xaa can be any naturally occurring amino acid
  misc_feature (202)..(202): Xaa can be any naturally occurring amino acid
  misc_feature (211)..(211): Xaa can be any naturally occurring amino acid
MGSGSAANGGGGGAGAARVPMPAAKPFLETLGGNMKETFLPDDPFRVVRRERGCGRRAAAALRYVFPFMEWAPSYTLGTLKSDLIAGITIASLAIPQGISYAKLANLPPVLGLYSSFVPPLVYAMMGSSRDLAVGTVAVASLLIGSMLSEEVSAAEDPALYLHVALTATFFAGVFQALXLGVLRLGFIVDFLSHATIVGFMXGGAATVVCXLQQLKGMFGLDHFTTATDLVSVMSSVFSQTHLWRWESVVMGCGFLFFLLITRFFSKRRPRFFWVSAAAPLASVIIGSLLVYLTHAENHGIQVIGYLKKGLNPPSATSLNFSSPYMMLALKTGIITGVIALAEGIAVGRSFAMFKNYHIDGNKEMIAFGTMNIVGSLTSCYLTTGPFSRSAVNYNAGCKTAMSNVIMSVAVMITLLFLTPLFHYTPLVVLSAIIMSAMLGLIDYPAAVHLWQVDKVDFCVCLGAYLGVVFGSVEIGLVVAVGISILRVLLFVARPRTTVLGNIPNTMIYRRMDQYTAAQRVPGVLVLRVDSPIYFTNASYLRERIARWIDDEEDQCKEKGEMGIQYVVLDMGAVGSIDTSGTSMLDELRKTLDRRGLQIVLANPGSEIMKKLDSSKVLEAIGHEWIFPTVGEAVAECDFVMHSQKPGMVMGSGAPHENLV

SEQ ID NO: 78425 - protein, 412 aa, Candida albicans SC5314
MSSSSSSLGVPHENPIRHRSSSVGRIDVGDTSASLSTMPTTRSSRRRSIARLKELQDNSTTDSAIVHKLYVGFRELTYRHTWIIPLIVLLMAFGTYYLSSPSGKVHQVLEDMIIPSYHIPGTDQYGKGGNDFKFVGFYAIFFTFLREFMMCCVLRPISVWFGIKKEAKQKRFLEQTYAMFYYGITGPFGLWIMRRLPLWYFNTTQFYINYPHKTHDIYFKIYYLGQAAFWVQQSVVLILQLEKPRKDFKELVLHHIITIALIWCSYRFHFTWMGLAVYITMDISDFFLALSKTLNYLESPITGPFFVIFIGVWIYLRHYINLQILWSVLTEFRTVGDFELNWITQQYKCWISQPITFFLIFALQLVNFYWLVLIFRILYRYVFTGVSKDERSDDEDEDEDSEDSADEKKKEQ

SEQ ID NO: 78426 - protein, 216 aa, Chlamydomonas reinhardtii
MAASYWDSHCSRNLVSKEQLENSHAEDRLLGLTREHIQQLNVFFCTSIAELAKQLKLRQRVAATAMVYFRRTYLCNNFCRMDPRLVYVASLYLACKAEESLVQAKHLVGHAKSYRKWPYDVKDLLDMEMVLLEDLDFNLIVFSPYRDLVTYLADSGVETPCAQRAWGALNDSYRSDVNLLYPPHVVALGCLCLAAGSCNVDLAPWLGKLNVDLGQV

SEQ ID NO: 78427 - protein, 282 aa, Leccinum variicolor
  misc_feature (136)..(153): Xaa can be any naturally occurring amino acid
AVNDPFIDLDYMVYMFKYDSVHGRFKGDVHAKDGKLYINGKAITVYAERNPSDIKWGSVGAEYIVESTGVFTTIEKAAAHLKGGAKKVIISAPSADAPMFVCGVNLDKYDSKYTVISNASCTTNCLAPLAKVINDXXXXXXXXXXXXXXXXXXQKTVDGPSAKDWRGGRAVNGNIIPSSTGAAKAVGKVIPALNGKLTGLAFRVPTNDVSVVDLVVRLEKSASYDDIKAAFKEASESPELKGIIDYTDEAVVSTDFTGNPASSIFDASGGIMLNPNFVKLIA

SEQ ID NO: 78428 - protein, 593 aa, Zea mays
MDTAIGSVPAASDAARHPAPSASAPRDATLGRHLARRLAEVGARDVFTVPGDFNLTLLDELEAEPGGVRLVGCCNELNAAYAADGYARARAGGVGACAVTFTVGGLSAINGVAGAFSENLPVVCIVGGPNSNDYGSNRILHHTIGLPDFTQELRCFQNVTCYQAVVNNLEDAHEQIDTAISTAIKESKPVYISISCNLPSIPHPTFSRHPVPFFLSPRLSNQMNLEAAVEAAAAFLNKAVKPVLVGGPKMRVSKACEALAELADACGYPVAVMPSAKGLVPEHHSRFIGTYWGAVSTPFCAEIVESADAYLFAGPVFNDYSSVGYSLLLKKEKAIIVQPERVVVGHGPAFGCVLMKDFLHALATRLKKNTAAYENYRRIYVPLGEPLPSEPGEPLRVNVLFKHIQAMLSGDTAVIAETGDSWFNCQKLKLPEGCGYEFQMQYGSIGWSVGATLGYAQAAKDKRVIACIGDGSFQVTAQEVSTMLRWGHNSIIFLINNGGYTIEVEIHDGPYNVIKNWNYTGLVEAFHNGEGACYTAKVRTEEELTEALEAALGPKKDCLCFIEVIVHKDDTSKELLEWGSRVSAANSRPPNPQ

SEQ ID NO: 78429 - protein, 430 aa, Vibrio parahaemolyticus RIMD 2210633
MSFSSQGFAPEVVKALAECGYEKLTPIQQKAIPMARKGHDIFATAQTGTGKTAAFSLPMIQQLLDSGRTASRKTARALILAPTRELAEQIADNIKAYTKYTDLSVVAVFGGRKMSSQVSALENGVDILVATPGRLEEHIEQGNVSVANLEFLVFDEADRILDMGFIHAVRKIMLDVDTDPQIMMFSATTSSQLNLLAKDILRKPKRIEVERANTTAHTVAHVLYPVDQERKTELLSELIGRKNWQQVLVFVNYKETANDVVKELKLDGIKAVVCHGDRAQSARRRALEEFKTGKVRVMVATDVAARGLDIEDLPHVVNYDMPFLAEDYVHRIGRTGRAGKQGHAVSFVNRDEELTVVQVENLIQQRIRRIELAGYEPKQRESYIEKLNSKPAFKNRQGRRNNPNQSATDQGSAERRLAMVKRLKARRGTN

SEQ ID NO: 78430 - protein, 583 aa, Oryza sativa Japonica Group
MSSKSPLQSMPGQAAKPKGTGEQGGDAEVVSEERTPSDQHQGSPASTLDKELSGLSSESGILDDSLVAEEEDSGELKEIQNLDCNGNQEKKTSQKSSTSDSFASAKVSDGTNSLRKTSGSAKTSDRANFTESGKSSMCRASTSSDISDESSRSSMSSATTKPHKGNDSRWEAIQTVKTKDGILGLNHFRLLKKLGSGDIGSVYLSELSGTRSYFAMKVMDKASLASRKKLLRSQTELEILQSLDHPFLPTLYTHFETDKFSCLVMEFCPGGDLHTLRQRQPGKHFSEQAAKFYVAEVLLALEYLHMLGIIYRDLKPENVLVREDGHIMLSDFDLSLRCSVSPTVIKSANPGLDALQRNNAAYCVQPACIEPSCIQPSCVAPTTCFGPRFFKSKSKSKSKKEKSKPEAANQASLFPELIAEPTDARSMSFVGTHEYLAPEIIKGEGHGSAVDWWTFGIFLYELLFGKTPFKGSGNRATLFNVVGQPLRFPESPIVSFSARDMIRGLLVKDPQHRLGYKRGATEIKQHPFFEGVNWALIRCASPPDIPKPVELDCRPKQVPSTNGKVAPASNQKGSDNYLEFEFF

SEQ ID NO: 78431 - protein, 409 aa, Thermotoga maritima
  misc_feature (1)..(1): Xaa can be any naturally occurring amino acid
  misc_feature (13)..(13): Xaa can be any naturally occurring amino acid
  misc_feature (37)..(37): Xaa can be any naturally occurring amino acid
  misc_feature (157)..(157): Xaa can be any naturally occurring amino acid
  misc_feature (196)..(196): Xaa can be any naturally occurring amino acid
  misc_feature (244)..(244): Xaa can be any naturally occurring amino acid
  misc_feature (268)..(268): Xaa can be any naturally occurring amino acid
  misc_feature (347)..(347): Xaa can be any naturally occurring amino acid
  misc_feature (353)..(353): Xaa can be any naturally occurring amino acid
  misc_feature (359)..(359): Xaa can be any naturally occurring amino acid
  misc_feature (396)..(396): Xaa can be any naturally occurring amino acid
  misc_feature (401)..(401): Xaa can be any naturally occurring amino acid
XGSDKIHHHHHHXDVFSDRVLLTEESPIRKLVPFAEXAKKRGVRIHHLNIGQPDLKTPEVFFERIYENKPEVVYYSHSAGIWELREAFASYYKRRQRVDVKPENVLVTNGGSEAILFSFAVIANPGDEILVLEPFYANYNAFAKIAGVKLIPVTRRXEEGFAIPQNLESFINERTKGIVLSNPCNPTGVVYGKDEXRYLVEIAERHGLFLIVDEVYSEIVFRGEFASALSIESDKVVVIDSVSXKFSACGARVGCLITRNEELISHAXKLAQGRLAPPLLEQIGSVGLLNLDDSFFDFVRETYRERVETVLKKLEEHGLKRFTKPSGAFYITAELPVEDAEEFARWXLTDFNXDGETTXVAPLRGFYLTPGLGKKEIRIACVLEKDLLSRAIDVLXEGLKXFCSSRISC

SEQ ID NO: 78432 - protein, 351 aa, Arabidopsis thaliana
MDAFRRQASKLRDQVAKQQLAVIKQFSGTGYESSDVMVIDELEMQRHHQLDKLYRSTRSAKEFQRDIVKAAEAFTTIGLRHIEAGTKLSEDCCRYGNENSQNIDENILAKAAAIYGDARKHVDKEQEDFNKLLASQVLDPLRAMVAGSPLEDARHLAQRYSRMRQEAETHATEVSRRQARVREAPIPENVAKLQLAEAKMQELKANMAVLGKEATAALAAVESQQHRLTFQRLVAMVEGEKNYHLRIAAILSDIEADMVTEKQHKESAPPAIPTENGSEKTSYFLAEVIHPFSAASEKELDLDKGDYIVVRKVSQTGWAEGECKGKAGWFPMAYIEKRQRLPTTNFAAEVY

SEQ ID NO: 78433 - protein, 508 aa, Arabidopsis thaliana
  misc_feature (32)..(32): Xaa can be any naturally occurring amino acid
  misc_feature (69)..(69): Xaa can be any naturally occurring amino acid
  misc_feature (78)..(78): Xaa can be any naturally occurring amino acid
  misc_feature (108)..(108): Xaa can be any naturally occurring amino acid
  misc_feature (135)..(135): Xaa can be any naturally occurring amino acid
MYRTAASRARALKGVLTRSLRPARYASSSAVXAETSSSTPAYLSWLSGGSRAALTSLDMPLQGVSLPPXPLADKVEPXSKLQITTLPNGLKIASETTPNPAASIGLYXVDCGSIYEAPYFHGATHLLERMAFKSXTLNRTHFRLVREIEAIGGNTSASASREQMSYTIDALKTYVPEMVEVLIDSVRNPAFLDWEVNEELRKMKVEIAELAKNPMGFLLEAIHSAGYSGPLASPLYAPESALDRLNGELLEEFMTENFTAARMVLAASGVEHEELLKVAEPLTSDLPNVPPQLAPKSQYVGGDFRQHTGGEATHFAVAFEVPGWNNEKEAVTATVLQMLMGGGGSFSAGGPGKGMHSWLYRRVLNEYQEVQSCTAFTSIFNDTGLFGIYGCSSPQFAAKAIELAAKELKDVAGGKVNQAHLDRAKAATKSAVLMNLESRMIAAEDIGRQILTYGERKPVDQFLKSVDQLTLKDIADFTSKVISKPLTMGSFGDVLAVPSYDTISSKFR

SEQ ID NO: 78434 - protein, 510 aa, Petunia x hybrida
MAGGFAAGSGGGDYEGKVTTFGIMTCLVAATGGLLFGYDIGISGGVTSMDEFLLKFFPNVYHKEKALKAGGNQYCKFDDHLLQLFTSSLYLAALVASFAASITTKAFGRKISMLIGGLIFLVGAVLNGAAMNLAALIIGRLLLGVGIGYANQSVPVYLSEMAPPKLRGALNVCFQMAVTLGIFVANMVNYGTSSMKKNGWRVSLVLAAVPAIIMTVGAVFLPDTPNSLIDRGQKEKAKAMLQKIRGTNNVDNEFEDLIIASDMSKLVTDPWGNIMKPRYRPQLTIAVLIPFFQQLTGINVIMFYAPVLFKTLGFGDEAALMTAVITGLVNVFATLISIFTVDRFGRRFLFLAGGLLMLICQAAVGSVIGSVFGTDGLGTFSKGLGNVTVGLICLYVAAFAWSWGPLGWLVPSEVFPMEIRSAGQSITVSVNMFFTFVIGQLFLTMLCEMKFGLFFFFAGFVVLMTLFIFFFLPETKGIPIEEVNRIWKNHWFWKSYVPNDDDDHHSKNQV

SEQ ID NO: 78435 - protein, 469 aa, Xylella fastidiosa Temecula1
MSLENVEKLVKDKKIEFVDLRFVDMRGVQQHVTFPVNILEQSLFKDGKMFDGSSIAGWKGINESDMVLLPDASTAYLDPFYADPTLVMTCDILDPATMQSYVRDPRGIAKRAEIYLNSLGIADQAFFGPEPEFFIFDSVRFANDMGHAFFQIASEEAAWNTGAEFEGGNSGYRPTVKGGYFPVPPTDSLHDLRAEMVKTLEQVGIETEVHHHEVATAGQCEIGTKFDSLVKKADQLMTMKYILKNVAYRNGKTVTFMPKPIVGDNGSGMHVHQSLSKGGVNLFSGDDHAGLSQLALYYIGGIFKHAHAINAFSNSGTNSYKRLVPGFEAPVMLAYSARNRSASCRIPWVSSPKARRIEMRFPDPLQSGYLTFTALMMAGLDGIKNKIHPGPPNDKDLYHLPPEEEKLIPQVCSSLDQALEALDKDRDFLKAGSVMSDDFINGYIALKMQEVTQFRAATHPLEYQMYYAN

SEQ ID NO: 78436 - protein, 167 aa, Neisseria meningitidis
MFEPLWNNKYIESVQLTIAEQLGVEERGEFYDITGALRDMMQNHLMQMLCMTAMEAPASLDADAVRDEKVKVIKSLKPLTVESVNENVVRGQYTAARGMNGYLEEINVPQDSFTETYVAIKAEIENERWKGVPFYLRTGKRMAGKVAEIVLNFKDLNSHIFEGSRTA

SEQ ID NO: 78437 - protein, 729 aa, Enterobacter cloacae
MLYKGDTLYLNWLEDGIAELVFDAPGSVNKLDTATVASLGQALDVLEKQPELKGMLLRSNKAAFIVGADITEFLSLFLVPEEQLSQWLHFANSVFNRLEDLPVPTISAVNGYALGGGCECVLATDYRLATPDLRIGLPETRLGIMPGFGGSVRMPRMLGADSAMEIIAAGKDVGAEQAQKIGLVDGVVKPEKLVEGALAILRQAINGDLDWKAKRQPKLEPLKLSKIEATMSFTIAKGMVMQTAGKHYPAPITAVKTIEAAARLGRDEALKLENQSFVPLAHTNEARALVGIFLNDQFVKGKARQLTKNVETPKHAAVLGAGIMGGGIAYQSAWKGVPVVMKDISEKSLTLGMTEAAKLLNKQLERGKIDGLKLAGVISTIQPVLEYSGFDRVDVVVEAVVENPKVKKAVLAETEDKVRPETVLASNTSTIPISELASVLKRPENFCGMHFFNPVHRMPLVEVIRGEKTSDETIAKVVAWASKMGKTPIVVNDCPGFFVNRVLFPYFAGFSQLLRDGADFRKIDKVMEKQFGWPMGPAYLLDVVGIDTAHHAQAVMAAGFPQRMQKDYRDAIDALFDANRFGQKNGLGFWRYKENSKGKPKKEEDAVVDGLLADVSQPKRDFTDDEIIARMMIPMINEVVRCLEEGIIASPAEADMALVYGLGFPPFHGGAFRWLDTLGSARYLDMAQQYQHLGPLYEVPEGLRNKARHNEPYYPAVEPARPVGELKTA

SEQ ID NO: 78438 - protein, 393 aa, Mycoplasma pulmonis UAB CTIP
MNTSLFLERINMIDWNKIRKSFPFLKQGIIYFDSAANSLKPENVIDSVINYYRNFGLSNKNYGITPALKVEEEKQKTREILTNFLGIKMNEIFFTSGTPDSLDRISKMLLDVLEDGDEILLSELNHPSNVLPWIELKKYRKIEVKFSSNLYNDINEKTKVISYSQESNNFDFNEDLAKIYKKAKEYKSWVINDAAQAIAHQKVSFDFCDAFAFSSNKFYGPTGMGVLAVKNELLNFIKPVFVDKKSSIKINLDGYFVLQDSGEKFGSRSSNIAGLIQLKESFIFIQKVGIENIFNRIKELSNYLYTKLNEVENIEIFNKRGSSLYMFNIKGKKAEDIIDYLATKKIILRSAVFCCNLSPKCKGTKALARISLGMYNTFEEIDKFIEELKNIDL

SEQ ID NO: 78439 - protein, 202 aa, Opitutaceae bacterium TAV2
MLNLPNLLTLSRVPLTFIVVALMYQSWHGAATLAFVLFLGAGISDWLDGHIARKQGIVSNFGKFMDALTDKIFVIGLMVAFVAIYHNPIWIVLALITLCREFMVSGMRMLASSKGVVVAADRGGKAKTVTQLIAIGFLLAAPVISIDIARLGHWDLTEFAAWVHKVGMAGFVIGTILTVWSGYRYFRNNWALIADEPVKSSS

SEQ ID NO: 78440 - protein, 387 aa, Mycoplasma pulmonis UAB CTIP
MPNWKKIRAQFPMTKQNIIYFDSAAASFKHKNVIQSGNDYYKNYGISNRSSDSLIGLKVEEKIRQTREIIADFLNANNDEIIFTSGTTDSINKVSKMLLDVLEDGDEILLSTLNHSSNVLPWIELKKYRKIEVKFSSNLYSDINEKTKIVSYSQESNNFDFEEDLNKIYKRAKEYGALVINDAAQAIAHQKVSFDFCDVIAFSANKLFGPTGVGILAVKKEILDTLKPTHLGGGSVVKINFDGSFVLQNGVEKFESGTLNIAGIIQLKEAFIFIQKVGIENIFNRIKELSNYLYTKLNEIENIEIFNKKGSSLYLFNIKNINAQDIVHYLGTKNIILRSGVFCSYLSTIDKNVKSSARVSLGIYNSFEEIDKLVDELKNGGDFLDWI

SEQ ID NO: 78441 - protein, 319 aa, Oryza sativa
  misc_feature (137)..(137): Xaa can be any naturally occurring amino acid
MLRSTHPPPSSPSSSSSGGGGGGGSSASSSSEKTMVGGGGGGGGGSGSAAPSGAKLLQILNVRVVGSGERVVVLSHGFGTDQSAWSRVLPYLTRDHRVVLYDLVCAGSVNPDHFDFRRYDNLDAYVDDLLAILDALXRIPRCAFVGHSVSAMIGILASIRRPDLFAKLVLIGASPRFLNDSDYHGGFELEEIQQVFDAMGANYSAWATGYAPLAVGADVPAAVQEFSRTLFNMRPDISLHVCQTVFKTDLRGVLGMVRAPCVVVQTTRDVSVPASVAAYLKAHLGGRTTVEFLQTEGHLPHLSAPSLLAQVLRRALARY

SEQ ID NO: 78442 - protein, 582 aa, Cryptococcus neoformans var. neoformans JEC21
MEQPAGYRTPRPQKHSVYDPTQPRSKNQVLISHGRAPWYGPDGKNIEAYVVGIAGGSASGKTSVARAILSALNYIPTVLILSQDSFYNAHSPEEVELAFKNDLDLDHPDAIDMTLFAQCIKDLKQGKATEIPVYSFHHHQRMSEKKYIYGASVIIVEGIMALQSAELRELYDLKVFVNCDSDLMLARRIKRDVKERGRDVEGILDQYLRFVKSSYDTFVQPSSRYADIIVPGSSNQLAIELLVSHIKRQLESRSLRFRRVLADIGENRGSSTPSVEKFDKQIVLLEQSNQLRGIMTILRDRTTCREEFIFHIDRLSTIIVEKALTLIPCEPKVVKTPNKNVYKGVSQTKNLVGVSILRSGLPFSQGLRRVIRDVPIGGILIQSDPKTGEPLLLKSDLPHCLRSRKTNGDVRCLLLDSQMGTGAAAMMAIRVLLDHGISQNRIIFLTYLISRSASYSVLRAFPNIQIVTAAIDPGLDEVKISYMPGSLIIGEAAGEGDFAIRLVDQLGHEEDGKRDNVKDLLKTDEELAADGFKMNILKGTEELKFSRKHKRTYSSTGEKRAWVISPGEYAIVVVVKDHAHQQ

SEQ ID NO: 78443 - protein, 561 aa, Opitutaceae bacterium TAV2
MPKNPDQVSSLGLSARGARASLRGTALLGDSVLNKGTAFSERERDALGLRGLLPPRVFTLEQQEQRALNAMAKKPSAIEKYIYLTTLQSRNETLFYRLLTNHAEEMIPLVYTPTVGQACLEYGANFRRPRGLFISIKDRGRIAEILRHWPITDVRMIVVTDGERILGLGDLGVLGMGIPVGKLALYSACAGLHPSYCLPIALDAGIDNETLRNDPLYLGHPMKRVRGADYDAFLNEFVEAVKTVFPKTMIQWEDFGNTNAFRLLHENRSRVCSFNDDIQGTAAVALAGVISALNSTGGKLADQKLLFLGAGEAGTGIADLFVAAAREAGLSEEQARARCWFVDSQGLVVKTRPGRALAHHKLPYAHDAAHVATLAEAVEVVKPTILIGVSGQPKTFTEPIVRRMAELNKTPIIFALSNPTSQAEAVPADIYAWSSGRAIVATGSPFAPVELNGKKFVPGQGNNVYIFPGVGLGSLVCEATEVTDSMFLASARTLASLATKEDLAMGRVYPALSKIREVSLKIAVAVAEKAYEANVAALPRPENLEAAIAASMFTPEYYDYV

SEQ ID NO: 78444 - protein, 360 aa, Opitutaceae bacterium TAV2
MSDPLKPLRENIDSLDRQIVDLLNQRLAHASEIGRHKRSAGGEIYVPEREDAVLRKVVALNSGPIKDEALRAIYSEIMSAAIALEKPLKIAYLGPEATNTHQAALRKFGASVDYVALTTFADIFTSVEKGESDYGMIPIENSTEGSVRDALDQFVTSDLKVVAQTYLEISYCLITREPLENITRVLSKDQALAQCRLWLQSHLPHATFVDAPSTARAVQIAGAESGVAAVATELAATHYGVPVVARNIQDKAGNTTRFFVIGKKPTGPVGNGRDMTSLLISLGDASGQPGALLRLLSPFAQRGINLSKIESRPSRLRPWDYNFYLDVTGHFHDEPMKQAVAELRTFCPLVKWLGSYPTVN

SEQ ID NO: 78445 - protein, 494 aa, Yarrowia lipolytica CLIB122
MPKQEMVQLDGSEYMFGEHGGRGTTAPTFFKRLTSYGSKTHKHDDVKVVGASYSHADNMKKNKKKSSKDKEEDPSRRSGSYTDLDDDWDANVDNGLRNTQAVKCVENKVEGSERPDLIKRSSKDVYPSIRQISASNIKSQVFGILHDPSNSLNAVRGESDLSVNSTLSKSAPTDSIKLGKFKTVLAAPNVDIGELKKLAWSGIPLELRPLSWQLLLGYLPTNSDRRVDTLARKRQEYKDGVEHVFHKVALDQAMWHQIEIDVPRTNPHLKLYGFPATQRSLERILYLWAVRHPASGYVQGINDLVTPFFQTFLSAYIDEDVESCDPAQLPREVMDVVEADSFWCLSKLLEGIQDNYVHAQPGIQRQVAGLRDLTSRIDAKLAKHLESEQVEFMQFSFRWMNCLLMRELSVKNTIRMWDTYMAEGPNGFSEFHVYVCATFLVRWSAKLIHMEFQDIMIFLQSLPTKDWGEGEIELLLSEAFMWQSLFKNASAHLR

SEQ ID NO: 78446 - protein, 626 aa, Chlamydomonas reinhardtii
MGKGCGAALGKGKKKETTAAEAAAPAAAAAEPAAEPAAAPTPAPAPAAEAAPAVAAAAPAPAAPAEPAKMAHDYKLKAHPAIPAPEGPLLVCILDGFGENEYKDEFNAVHVAKTPTVDALRAVPHRFRSIKAHGKAVGLPSDADMGNSEVGHNALGSGQVVDQGARLVDLALETGRMFSDPGWKLISEAFPSHTVHFIGLLSDGGVHSRADQLHGCLRGAVERGAKRVRVHILTDGRDVPDGSSIRFVEELEAVLAELRGKGCDIAIASGGGRMQVTMDRYEADWSMVKRGWDAHVLGKAPHYFKDAKTAVTTLRGSEDAPVSDQYVAPFVIVDEADKPVGTIEDGDAVVLFNFRADRMVEISKAFEYEDGFTAFERERFPKGLRFVGMMQYDGDLKLPANFLVPPPLIEHVSGEYLCKNGLSTFACSETQKFGHVTFFWNGNRSGYLDAKQEQYLEIPSDKIEFNKAPDMKAREITAAGIEALKSGKYKVVRINYANPDMVGHTGDMAATVRACETVDGCVKELLEVVDSLNGRWIVTSDHGNADDMVQRDKKGKPLLGEDGKPLPLTSHTLAPVPFFIGGKGLPDGVVLRDDLPDAGLANVAATTFNLLGFEAPGIYKPSMVKA

SEQ ID NO: 78447 - protein, 479 aa, Oceanicola granulosus HTCC2516
MTNGTHTVEKIGGTTMSKVHELIDPLFIGDRDAAQIYNRVFVVSAFGGITNLLLEHKKSGKPGVYALFINDEDDHGWLDALNEVSAAMREAHAEVLEHKADIQLADDFVRDRMEGARSCLFDIQRICSYGHFRLSTQLMVIRELLSGLGEAHSAFVTALMLQRRGVAARFVDLTGWRDEAEKTLEQRIAAGLDEVDLTSELPIVTGYAQCTEGLMKEFDRGYSEVTFSRIAAQSQAREAIIHKEFHLSSADPKIVGADAVKKLGQTNYDVADQLSNMGMEAIHPSAAKTLRRAGVPLRVANAFDAGDPGTLIDDRPADKAAVEIVTGLPIVAIELFEQDMVGVKGYDAAILEAMRKNNVWIVSKSSNANTITHFVAAVSRDKVRRVVEELEALYPAATITDEALSLVSVIGRDLRGLRVLSRGLAALDEQEIDVIAAQQTSRRVDSQFVVARDAQSAAVKALHDEFFPVKAEATKLKAA

SEQ ID NO: 78448 - protein, 557 aa, Chlamydomonas reinhardtii
MAHDYKLKAHPAIPAPEGPLLVCILDGFGENEYKDEFNAVHVAKTPTVDALRAVPHRFRSIKAHGKAVGLPSDADMGNSEVGHNALGSGQVVDQGARLVDLALETGRMFSDPGWKLISEAFPSHTVHFIGLLSDGGVHSRADQLHGCLRGAVERGAKRVRVHILTDGRDVPDGSSIRFVEELEAVLAELRGKGCDIAIASGGGRMQVTMDRYEADWSMVKRGWDAHVLGKAPHYFKDAKTAVTTLRGSEDAPVSDQYVAPFVIVDEADKPVGTIEDGDAVVLFNFRADRMVEISKAFEYEDGFTAFERERFPKGLRFVGMMQYDGDLKLPANFLVPPPLIEHVSGEYLCKNGLSTFACSETQKFGHVTFFWNGNRSGYLDAKQEQYLEIPSDKIEFNKAPDMKAREITAAGIEALKSGKYKVVRINYANPDMVGHTGDMAATVRACETVDGCVKELLEVVDSLNGRWIVTSDHGNADDMVQRDKKGKPLLGEDGKPLPLTSHTLAPVPFFIGGKGLPDGVVLRDDLPDAGLANVAATTFNLLGFEAPGIYKPSMVKA

SEQ ID NO: 78449 - protein, 428 aa, Oceanicola granulosus HTCC2516
MTTHSSDKTVFTRRESEARSYCRSFDTVFTRAVGSELTDADGKTYIDFLAGCSSLNYGHNDPDMKAALIEHISNDGIAMGLDLHTGAKGAFLSAFEDKILAPRDMDHKVMFMGPTGANAVEAAMKLARKVTGRQNIISFTNGFHGVTIGALAATGNSYHRGAAGLTPTGITRLPFDGYMDGIDSADYLAKVLSDASSGVDAPAAIMFETVQGEGGLNAASREWVEKVGRIAREHGALLIIDDIQAGCGRTGSFFSFDGWDVQPDIVTMAKSASGFGLPFAMMLVRPKHDAFGPAEHNGTFRGNTHAFVTARVAIEKFWSDDTFKNEIARKSELLEGKLEELAAMVPGAYLKGRGMMRGVDVGSGELAGAICARAFENGLIVETSGPEDEVVKILAPLTTPDETFVKGLDILLDAARHVTAGNQQIAAE

SEQ ID NO: 78450 - protein, 186 aa, Silicibacter pomeroyi DSS-3
MSALHIKKGSSSHSAYNLRPTFSDVAERHTIALLVENEPGVLARVIGLFSGRGYNIESLTVAEVDHTGHLSRITIVTTGTPQVIEQIKAQLGRIVSVRDVHDLTVEGRSVERELAMLKVVGSGDKRVEALRLADIFRANVVDSTLSSFVFEITGAPEKIDAFADLMRPLGLAEIARTGVAALLRGD

SEQ ID NO: 78451 - protein, 461 aa, Actinomadura madurae
MTISSTRPVGAMSAAELEELDRRHLVHPHQRGAYPGRRVIVRGEGSTVWDAAGRELLDVTGGGNWVAQVGHGRRELADAAAAQMTELGYFTGFFEFANDKSIRLAERLAAMVPGDLDRAFLASGGSEAVDTAIKLARLHHHNRGETDRTWIIARQWGYHGATLGSGTATGFPQMQVGVGPTLPHVEKVTPPMPFHTEMYGGQDPTDFLVDELARTIERIGPGNIAAMIGEPMLGGGGVVAPPADYWPRVRALLAEHGILLIADEVITAFGRTGVWFDSARRGMDPDIVVLAKGLTSGYAPLGAVLMREGIAESVVGGDAYLHHGHTYSGHPVSCAVALTNLDLLEKERLPERSAAIGDRLRAGLAPALDVPAVGEIRVEGATVGIELVADPAARAPMGPEPVEAVLDELYDGHGLIVRNYGPTLVLAPPLVLTDAETDRATAAIVDVLRRLDAENARIAPR

SEQ ID NO: 78452 - protein, 195 aa, Geobacillus stearothermophilus
TRHGETKWNVERRMQGWQDSPLTEKGRQDAMRLGKRLEAVELAAIYTSTSGRALETAEIVRGGRLIPIYQDERLREIHLGDWEGKTHDEIRQMDPIAFDHFWNAPHLYAPQRGERFCDVQQRALEAVQSIVDRHEGETVLIVTHGVVLKTLMAAFKDTPLDHLWSPPYMYGTSVTIIEVDGGTFHVAVEGDVSHI

SEQ ID NO: 78453 - protein, 1180 aa, Flavobacteria bacterium BBFL7
MNNFQIIEHKLKRFIKKYYTNEIIRGVILFLAIGLLYFLFTVVIEHFLWLSSLGRTILFGLFIVVQVALLFKFVGIPIARLLKLFSGIDFRDASSIIGTHFPEVSDKLINVLQLHKNGGDDELTWASINQKSEELKPIPFSLAIDFKKNSAYLKYLAIPVLIIAALFFTGNNDVITESSKRVADFNNEYIPPAPFTFKLLNEDLNTLQKRDFKLNVEVAGRTIPENASINFNNQTYYLTQEAPGRFSFVFTNPLTDTPFYLKANEVRSENFELTVDDVPSINKFQLVMDYPSYTGKKDEVIKSTGNALVPQGTKITWKLETAATDHVDFKYTNAVESFEKDGNDFAFAKAILKPIKYAISTSNNHVKDFEELNFKIEVSKDEYPELTMEMKKDSIQNSVLYFRGQAADDYGIKKIQLVYFDSQDSSNKQIYELGKNRGTFDQFLFTFPGNLPLIGGIDYQFYFEVIDNDAVNNFKSSKSQVFGFKKSTKEEEEQQQLQDQKKSLEELEKSLQEQEKQQEELKEISQEQIEKKQRGFNDKKKLEQALKNQQDQEREMRQQMEKMRDNLEKSNPDKDPMKDALKERLQQSEEEIKKNEELLKELQEYQDKLSKEDLKEKIEKAQKNSKQQKRNLKQLLELTKMYYVTQKYEQMIDKLKDLSDKQEEQSKKQGEKNKKSEQDSLNQEYKDWEKELQELEKENNGLKKPMKLDFDPLNSPEIKEEQQQSSEDLDNSKTQDAKKKQKSAADKMKQQAQAMQAQLSSGKSEKLKEDADMLRQILDNLIVFSKEQENVLNGVKNLNRNSPNFGKKLKVQKDLEKAFKHVDDSLFALASRNPEVGIDINREVTDIYYYIDKSLVQLSDFEMNKGQISQQFTLNSANKLANLLSSAMDAMNNAMALPGKGEGEPGEGQSSGFQLPDIIKKQESLMKDGGDGKEGDDGKKPGDGEGKKPGEGQPGESGPPGQGGKDGQEGQSGEGGQSGEGGDSGQGGKDGNGSTGESGQGGNSGQGGQGSNGEGSNGDGSNSGNSSGDGSGDEQGGYKESEEESARIYEIYKKQQELRNQLEDMIRQEGLEGLVDEITDKMKAVERKLLDQGFNRDVQNQMMEIQHDLLKLKDAGLQQGKEDQREANTNFKDYNNTTKSDLPDASLYFNSKEILNRQVLPLQQEYKAKVKEYFKEDGGL

SEQ ID NO: 78454 - protein, 533 aa, Pleurotus ostreatus
MFPGARILATLTLALHLLHGTHAAIGPTGNMYIVNEDVSPDGFARSAVVARSVPATDPTPATVSIPGVLVQGNKGDNFQLNVVNQLSDTTMLKTTSIHWHGFFQAGSSWADGPAFVTQCPVASGDSFLYNFNVPDQAGTFWYHSHLSTQYCDGLRGPFVVYDPSDPHLSLYDIDNADTVITLEDWYHIVAPQNAAIPTPDSTLINGKGRYAGGPTSPLSIINVESNKRYRFRLVSMSCDPNFTFSIDGHSLLVIEADAVNIVPITVDSIQIFAGQRYSFVLTADQTVGNYWIRANPNLGSTGFDGGINSAILRYAGATEDDPTTTSSTSTPLLETNLVPLENPGAPGPAVPGGADININLAMAFDFTNFELTINGVPFIPPTAPVLLQILSGASSAASLLPSGSIYALEPNKVVEISMPALAVGGPHPFHLHGHTFDVIRSAGSTTYNFDTPARRDVVNTGTGANDNVTIRFVTDNPGPWFLHCHIDWHLEIGLAVVFAEDVTSISAPPAAWDDLCPIYDALSDNDKGGIVPS

SEQ ID NO: 78455 - protein, 325 aa, Schizosaccharomyces pombe 972h-
MSIKEFAKNAREAYFTLPNGDKIPSIGLGTWRSGKDETKNAVCAALKAGYRHIDTAHIYGNEKEIGEGIRESGVPRTDIWVTSKLWCNAHRAGLVPLALEKTLQDLNLEYIDAYLIHWPFALLSGPEELPRNEKGELIYEDVPIEETWQAMEELLETGKVRYIGISNFNNEYLDRVLKIAKVKPTIHQMELHPYLPQTEYLEKHKKLQIHVSAYSPLANQNDAYNSDISKLIEHKTLVDIANARGEGITPANIAISWAVKRGTSVLPKSVNESRIVSNFLYIPLTDKEMEAINNIGVVRRFSHGKFAPKPMFVGLQDGTPKQTHA

SEQ ID NO: 78456 - protein, 394 aa, Flavobacteria bacterium BBFL7
MKTINDINFKDKKALVRVDFNVPLNDDFEVTDTTRIHAAKDTIIKILEDEGSVILMSHLGRPKGNQEEFSLKHIVAAATDILGVQVKFVEDTIGDAAQQAAANLQPCEVLLLENLRFHSEETAGDSAFAKALSQLGNVYVNDAFGTAHRAHASTAIIAQYFEEKCFGHLMTREIESLNKVLETPDQPVVAILGGAKVSSKITVIENILDKVDDLIIAGGMAYTFIKAQGGKIGDSLCEDDKMGLALEILEKAKSKNTNIHLPVDAITADAFSEHATMDNAAIDEIPNGWMGLDIGEKSRSEFHTVLMQAKTILWNGPAGVFELEPFSHGTISLGKSVAASTAAGAFSLVGGGDSVAAVKQFGFDNQVSYVSTGGGAMLEMLEGKTLPGIAAILD

SEQ ID NO: 78457 - protein, 197 aa, Zea mays
  misc_feature (135)..(135): Xaa can be any naturally occurring amino acid
  misc_feature (169)..(169): Xaa can be any naturally occurring amino acid
MATVDATTPPETGGKQQAPSLPACRSFSGANLALRVLLFAVTLAGLVLLATAKQTVRVPVPQFPGLLLSRPAKFKDSPALIYLLVALVVTCFYSLLTALASLKLVSGSSPATRTLFLLVLLDVLYAAIMASATGXGGGVAWIGLKGNSHTNWNKICNIYGKFCRHIGSXSVFLGLVASIILVLLAILNAHFLYCRSR

SEQ ID NO: 78458 - protein, 548 aa, Zea mays
MDGLVAPSPSHSGATSGGGASHRKRKLPPSSLSDATGDEDDDTTAPSSPSTAPSSPSRPSSPSSSHSDDDDDDSLHTFNAARLDGAPSGGSASGRPPKPDSSSVSAAAAAAAAAVGGGPKPEPGSANAGDGKEDTKGLFTDNLQTSGAYSAREEGLKREEDSGRLKFLCYSNDGVDEHMIWLVGLKNIFARQLPNMPKEYIVRLVMDRTHKSMMVIRNNIVVGGITYRPYASQRFGEIAFCAITADEQVKGYGTRLMNHLKQHARDADGLTHFLTYADNNAVGYFVKQGFTKEITLDKERWQGYIKDYDGGILMECKIDPKLPYVDVATMIRRQRQELIFKRVEILENAQAQYQAPCRAALSYSRAALMHSRRPPVSCPAQPPANRNMESPARKDQGPSGTLLQPLLSPQDRAAAPAQRPKTAPAITQGERSWHSKKTDKARRYPWSQENLNEHPDAWPFKEPVDSRDVPDYYDIIKDPIDLRTMLRRVDSEQYYVTLEMFVADMKRMFSNARTYNSPDTIYYKCATRLENFFSGRITVLLAQLSTKS

SEQ ID NO: 78459 - protein, 339 aa, Brassica napus
RPTRPRTAEFHSLSQTLKKIGAAIPSVHQAESDPTSSKRSSPPGSSRSEFNKKASQIGLRIHETSQKTARLSKLAKESSIFNDRTLEIQELTVLIRNDITGLNMALSDLQTLQNMEIADGSYSHDKVGHYTAVCDDLKTRLMGATKHTRPVLTARSENMKAHENRKQLFSAKNAAVDNQNHAKAVPEPPPWSSSSTPSGSLQQQPLLPPVNSGAPSGSQLRRRSAIENAPSQQMEMSMLQQTVPRQENYSQNRAVALHSVESTITELSGIFTHLATMVTQQGELAIRIDDNMDESLVNVEGARSALLQHLTRISSNRWLMIKIFAVIILFLIVFLFFVA

SEQ ID NO: 78460 - protein, 446 aa, Methanococcus maripaludis S2
MKKALILLVLAVFLIGFTKIAYVDEESADGINSQKAIITLIILGTAAVLFFTEALPLPVTAMLVPVALSFPGIDILSSSRAFADFGNKWVVLFMAAFILGEAVFRTGFADKIGQLTVKAAGKSQLKLMLLVMLAIGTMSAFLSNTGTTAAFIPIVMGICVSASLKPGKLLIPMAYAASLGGTLTLIGTPPNGLVNDALEKSGIAPFGFFEFAKIGILIFIVGILYYGTIGHKLLPESKAKAKDFVSDTLKYRTNKMWIATLVFTFVVLMTATGTIPLVTAFMLGACMVVMTGCITMQEAFNSISWTTIFLFAGMLPLGSAMAATGAATMIANTVITYVHSPLALLAAAYILTALITEVMSNTATAALVMPLGIALADAFDVSAKPILMAIAVAASSCFLTPIATPPNMIILGPGGYSFKDYAKSGWPLEILCAVVAIAVIPMIWPF

SEQ ID NO: 78461 - protein, 338 aa, Triticum aestivum
MSVSNIGMMDGAYFVGRNEILAWINTTLQLGLAKVEEAASGAVACQLMDAAHPGAVPMHKVNFDAKNEYDMIQNYKVLQDVFNKLKITKHIEVNKLIKGRPLDNLEFMQWMKRYCDSVNGGFMTSYNASERRESSKGGKDTNRRTSGTSQAPAKSASATHKAQPPSHAAKRANGHASNAPQRCAKPPPAYDAQMTELKLLVDSAEKERDFYFSKLRDVEILCQSPEVEHLPIAKAIQKILYASEDDPSTVAEAQAEMVAQQNQMQQQPMLSPILEASEAPSITPKDSSEESLRQEAAAAHKRKSISDLEEFEMGSSSRMRLSDVSDVQLCGSPLMSFT

SEQ ID NO: 78462 - protein, 1042 aa, Populus tremula x Populus alba
MAGLVTGSSQTLHAKDELMPPTRQSATSKKCRVCGDEIGVKEDGEVFVACHVCGFPVCRPCYEYERSEGNQSCPQCNTRYKRHKGCPRVPGDNDDEDANFDDFDDEFQIKHHDHDESNQKNVFSHTEIEHYNEQEMHPIRPAFSSAGSVAGKDLEGDKEGYSNAEWQERVEKWKVRQEKRGLVSKDEGGNDQGEEDEYLMAEARQPLWRKIPIPSSRINPYRIVIVLRLIILCFFFRFRILTPASDAYALWLISVICEVWFGLSWILDQFPKWNPIERETYLDRLSMRFEREGEPNRLGPVDVFVSTVDPLKEPPIITANTVLSILSVDYPVDKVSCYVSDDGASMLLFDSLAETAEFARKWVPFCKKHNIEPRAPEFYFTQKIDYLKDKVHPNFVKERRAMKREYEEFKVRINALVSKAQKKPEEGWVMQDGTPWPGNITRDHPGMIQVYLGSEGALDVEGKELPRLVYVSREKRPGYNHHKKAGAMNALILVSAVLTNAPFMLNLDCDHYINNSKAVREAMCFLMDPQLGKKLCYVQFPQRFDGIDRHDRYANRNVVFFDINMKGLDGVQGPVYVGTGCVFNRQSLYGYDPPVSEKRPKMTCDCWPSWCCCCFGGSRKKSKKKGQRSLLGGLYPMKKKMMGKKYTRKASAPVFDLEEIEEGLEGYEELEKSSLMSQKSLEKRFGQSPVFIASTLMENGGVPEGTNSQSHIKEAIHVISCGYEEKTEWGKEVGWIYGSVTEDILTGFKMHCRGWRSVYCSPKRPAFKGSAPINLSDRLHQVLRWALGSIEIFLSHHCPLWYGYGGKLKLLERLAYINTIVYPFTSIPLLAYCTTPAVCLLTGKFIIPTLNNLASIWFPGPFHLNHSNICVGVGWSGVSIQDLGRNEQFWVIGGVSGHLFAVFQGFFKVLGGVDTNFTVTSKSADDAEFGELYLFKWTTLLIPPTTLIILNMVGVVAGVSARINNGYGSWGPLFGKLFFAFWVIVHLYPFLKGLMGKQNRTPTIVVLWSVLLASIFSLIWVRIDPFLPKQTGPILKQCGVEC

SEQ ID NO: 78463 - protein, 145 aa, Rhodobacter sphaeroides 2.4.1
MKALGREVTIVMVEDDEGHARLIEKNIRRAGVHNEVVPFVNGGDALDYILGSDRTGNEMADRYLLVLLDLNLPDMTGIDILEKIKTNPNVKHLPVVILTTTDDEREIKRCYDLGANVYITKPVEYESFANAIRQLGLFFSVIQVP

SEQ ID NO: 78464 - protein, 475 aa, Saccharomyces cerevisiae
MLSRATRTAAAKSLVKSKVARNVMAASFVKRHASTSLFKQANKVESLGSIYLSGKKISVAANPFSITSNRFKSTSIEVPPMAESLTEGSLKEYTKNVGDFIKEDELLATIETDKIDIEVNSPVSGTVTKLNFKPEDTVTVGEELAQVEPGEAPAEGSGESKPEPTEQAEHRKVSPQGKTQVRKRLQRKKLLQRKKPLQRKKLQNQKRTDQPKKTVSKAQEPPVASNSFTPFPRTETRVKMNRMRLRIAERLKESQNTAASLTTFNEVDMSALMEMRKLYKDEIIKKTGTKFGFMGLFSKACTLAAKDIPAVNGAIEGDQIVYRDYTDISVAVATPKGLVTPVVRNAESLSVLDIENEIVRLSHKARDGKLTLEDMTGGTFTISNGGVFGSLYGTPIINSPQTAVLGLHGVKERPVTVNGQIVSRPMMYLALTYDHRLLDGEKLLSFLKTVKELIEDPRKCCYGDLKFAAHTNLIS

SEQ ID NO: 78465 - protein, 106 aa, Synechococcus sp. CC9605
MVMAVESPSQKPGGAAVLDKAPEKVRKRSPRYKVLLHNDPVNSMEYVVATLQQVVPQLSEQDCMAVMLEAHNTGVGLVIVCDIEPAEFYCETLKSKGLTSSIEPEN

SEQ ID NO: 78466 - protein, 359 aa, Triticum aestivum
  misc_feature (111)..(111): Xaa can be any naturally occurring amino acid
  misc_feature (143)..(143): Xaa can be any naturally occurring amino acid
  misc_feature (172)..(172): Xaa can be any naturally occurring amino acid
MQGTRDMSAKGGKALVQSDAGKYVAWSGVDQPELAAEGLGCGLLLLRPLSFALPHYADCHKFGYVLRGSGVAGVLPVATGDASPAARERVVRLEAGDVIATRTGEVSWWYXDSDGDAGDLSIVFMGDTERAVSPGDMSYFFLXGGNSVLGGFDAGLLAGAMGLGVTKEQAAXVFRSQPAVLLTGLSKKLPGVRPREDDRKRLVVNAGQVAAGTLKTLTAADMAALGGLGISVVLGRLEPGAARAPWVLREGAAQLVYVARGSARVQVSSSAGGETLLLDEEVAAGSVFVVPRFAVTLISAGADGAQWVSLIKSARPAVEHLTGDGSMLGGLTAQVVQASLSVAPELLELLGVRSAEPSH

SEQ ID NO: 78467 - protein, 392 aa, Methanococcoides burtonii DSM 6242
MYDILSVRKDFPVLEEVIYLDSGATTQTPVQAVNSMNDYFFKYAANHGRGAHRLARQTTDHYEDARDIVAEFLNIGSDGTIFTKNATESINMVSLGLKWETGDHVVTTVVEHHSNLLPWMRLREQGVEVTVVGSDREGNVDPKDIDEAITDRTRLVSVNHVSNVFGSVRDVKKITQIAHRSEVLSLVDGSQSAGHMPVDIKNIECDFFITPGHKGLLGPQGTGVLCIKDPEILEPVYVGGGTVHAVTTESYELEPYPSKFEAGTPNIPGIIGLGRAVEYVKDIGVEAIEKHEKELAQDTATRLAEIVGVEVYGPKDRTGVVPFNVQGMNPHDVAMILDETRKICVRSGYHCAMPSVDLIGVEGTVRASFALYNTKEEVDSLIEGVEQITMLI

SEQ ID NO: 78468 - protein, 249 aa, Chlamydomonas reinhardtii
MGASGNMLLDTVVPGMGAVISILMYLSPLKAVLKAQREKHLGDLNPIPFSITIANCIAWLGYGLLKKDPFVCAPNAPGVLIGTYMSLTAHGLADEGAKERIRFVVCLAAAIFPFLGVYTSFFAPSAVVQQGVWGMAGNIVCLVYYAAPLSTMWDVIRTRNSSSILVPLTMMNTLNAALWTTYGVAVADPYIWAPNGIGLALSVMQIALRLVFPARAASALPSHAHHSGGSGASKYARLDEEVPLGGAGH

SEQ ID NO: 78469 - protein, 1063 aa, Saccharomyces cerevisiae
MDDYHVNTAFSMGRGNQQDDGNSERNSMHTQPSTMAPATLRMMGKSPQQQQQQNTPLMPPADIKYANNGNSHQAEQKERQVELEGKSRENAPKPNTTSQSRVSSSQGMPKQFHRKSLGDWEFVETVGAGSMGKVKLAKHRYTNEVCAVKIVNRATKAFLHKEQMLPPPKNEQDVLERQKKLEKEISRDKRTIREASLGQILYHPHICRLFEMCTLSNHFYMLFEYVSGGQLLDYIIQHGSIREHQARKFARGIASALIYLHANNIVHRDLKIENIMISDSSEIKIIDFGLSNIYDSRKQLHTFCGSLYFAAPELLKANPYTGPEVDVWSFGVVLFVLVCGKVPFDDENSSVLHEKIKQGKVEYPQHLSIEVISLLSKMLVVDPKRRATLKQVVEHHWMVRGFNGPPPSYLPKRVPLTIEMLDINVLKEMYRLEFIDDVEETRSVLVSIITDPHYGLLSRQYWTLAAKMNAESSDNGNAPNITESFEDPTRAYHPMISIYYLTSEMLDRKHAKIRNQQQRQSHENIEKLSEIPESVKQRDVEVNTTAMKSEPEATLATKDTSVPFTPKNSDGTEPPLHVLIPPRLAMPEQAHTSPTSRKSSDNQRREMEYALSPTPQGNDYQQFRVPSTTGDPSEKAKFGNIFRKLSQRRKKTIEQTSVNSNNSINKPVQKTHSRAVSDFVPGFAKPSYDSNYTMNEPVKTNDSRGGNKGDFPALPADRENMVEKQREKQIEEDIMKLHDINKQNNEVAKGSGREAYAAQKFEGSDDDENHPLPPLNVAKGRKLHPSARAKSVGHARRESLKYMRPPMPSSAYPQQELIDTGFLESSDDNKSDSLGNVTSQTNDSVSVHSVNAHINSPSVEKELTDEEILQEASRAPAGSMPSIDFPRSLFLKGFFSVQTTSSKPLPIVRYKIMFVLRKMINEFKEVKGGFVCMQRFSSNNVAAKREGTPRSIMPLSHHESIRRQGSNKYSPSSPLATNTHQRNSSITETYGDDKHSGTSLENIHQQGDGSEGMTTTEKEPIKFEIHIVKVRIVGLAGVHFKKISGNTWLYKELASSILKELKL

SEQ ID NO: 78470 - protein, 160 aa, Agrobacterium tumefaciens str. C58
MRISIFAVGRLKSGPEKDLAARYIERLAKTGPAIGLEFSRVIEVGESRASNAETRKREEAAMLEKHLADGAVLVLLDERGKALDSPAFASLFGDLRDSGKRDLVIAIGGADGLDSALYDKATAVLNLGKLTWPHQIVRILIAEQLYRAVTILSGHPYHRV

SEQ ID NO: 78471 - protein, 291 aa, Synechococcus sp. CC9605
MILSSPCSAASMPTRLAFLGPAGTYGEQAARVLIEQDALEDVQLVPCVGLRSVVEQLAGGECDAAVVPIENSVEGGVTATLDALWSHPELCIRRALVLPIQHALLGSGPLSRVTEVLSHPQALAQCSGWLAQHLPDALQLPTSSTAEAARMVAGSPFRAAIASQSAAREHGLDELAFPVNDVAGNRTRFLLLCRGQRSEHGDVASLAFSLHRNAPGALLEALACLAERGLNMSRIESRPSKRELGEYVFFVDVDLPPDPSTALQDLIAQLQPLCEHLAHFGAYPSSDLSGS

SEQ ID NO: 78472 - protein, 152 aa, Arachis hypogaea
MASSSDSWMKEYNEAVKLADDINGMISERSSLSTSGPEAQRHASAIRRKITILGIRLDSLQSLLSKVPGKSEKEMNRRRETLTTLRSKVNQMASTLNMSNFANRDSLFGPEIKPDAMSRNVGWITVDSLGLSRPIMKEPEGRPWKNWEGDCL

SEQ ID NO: 78473 - protein, 406 aa, Bacillus cereus ATCC 14579
MNIHEIRKQFPILDQKVNGKQLVYFDSAATSQKPIQVIETLERYYKEYNSNVHRGVHTLGTKATDAYEGAREKVRKFINAKSMEEIIFTRGTTTALNTVAASYGLENVKEGDEIVISYMEHHSNIIPWQQVAKKTGATLKYLPLQPDGTISLEDVRQTVTPNTKIVSIMQVSNVLGTINPVKEIGAIAHENGAIMVVDGAQSTPHMKVDVQDLNCDFYALSAHKMCGPTGIGVLYGKKELLNNMEPIEFGGEMIDFVDLQESTWKELPWKFEAGTPIIGNAIGLGAAIDFLEEIGLDNIEKHEHELAQYALERLSEVDGVTIYGPKHRAGLVTFNIEDVHPHDVATVLDVEGIAVRAGHHCAQPLMKWLKASSTARASFYLYNTKEEIDTFVESLIKTKEYFTNVI

SEQ ID NO: 78474 - protein, 838 aa, Brassica napus
TFLLVFVVMILFHPALSIYINTLSSTESLTISNNRTLVSPGDVFELGFFKTTSSSRWYLGIWYKQLPEKTYVWVANRDNPLPNSIGTLKISNMNLVLLDHSNKSVWSTNLTRRNERTPVMAELLANGNFVMRDSNNNDASEFLWQSFDYPTDTLLPEMKLGYNLKKGLNRFLISWRSSDDPSSGDYSYKLEPRRLPEFYLLQGDVREHRSGPWNGIRFSGILEDQKLSYMEYNFTETSEEVAYTFRMTNNSFYSRLTLSSTGYFERLTWAPSSVIWNVFWSSPANPQCDMYRMCGPYSYCDVNTSPSCNCIQGFDPRNLQQWALRISLRGCKRRTLLSCNGDGFTRMKNMKLPETTMAIVDRSIGEKECKKRCLTDCNCTAFANADIRNGGTGCVIWTGNLADMRNYVADGQDLYVRLAAADLVKKSNANGKIISLIVGVSVLLLLIMFCLWKRKQNREKSSAASIANRQRNQNLPMNGIVLSSKRQLSGENKIEELELPLIELEAIVKATENFSNSNKIGQGGFGIVYKGILLDGQEIAVKRLSKTSVQGVDEFMNEVTLIARLQHVNLVQILGCCIDADEKMLIYEYLENLSLDSYLFGKTRRSKLNWKERFDITNGVARGLLYLHQDSRFRIIHRDLKVSNILLDRNMVPKISDFGMARIFERDETEANTMKVVGTYGYMSPEYAMGGIFSEKSDVFSFGVMVLEIITGKRNRGFDEDNLLSCAWRNWKEGRALEIVDPVIVNSFSPLSSPFQLQEVLKCIQIGLLCVQELAENRPTMSSVVWMLGNEATEIPQPKSPGCVRRSPYELDPSSSRQRDDDESWTVNQYTCSVIDAR

SEQ ID NO: 78475 - protein, 363 aa, Anabaena variabilis ATCC 29413
MLRAGIVGLPNVGKSTLFNAVVANAKAEAANFPFCTIEPNVGVVAVPDERLNVLSQISGSAQIIPARVEFVDIAGLVKGASQGEGLGNQFLSHIREVDAIVHVVRCFENDDIIHVAGSVDPARDIEIISIELGLSDLAQIERRIERTRKQARTSKDAQFEITVLEKLAAALNEGKSVRQISLTEEEAEIIKGLGLLTNKPIIYAANVSEEELATGNEFVERVRQVAAQENAQVVVVSAQVEAELVELPEEDKADFLESLGVKEGGLKSLIRATYALLGLRTYFTSGQKETRAWTINAGMSAPQAAGVIHSDFERGFIRAETVAYNDLVANGSLIAAKEKGLVRSEGKEYIVQEGDVMLFRFNV

SEQ ID NO: 78476 - protein, 428 aa, Pseudomonas syringae pv. syringae B728a
MAKIVDIKGREVLDSRGNPTVEADVLLDNGIIGSACAPSGASTGSREALELRDGDKSRYMGKGVLKAVANINGPIRDLLLGKDPVDQKALDHAMIELDGTENKASLGANAILAVSLAAAKAAAQDQDLPLYAHIANLNGTPGVYSMPVPMMNIINGGEHADNNIDIQEFMIQPVGAKSFAEGLRWGTEIFHHLKAVLKARGLNTAVGDEGGFAPNLASNKEALDAIAEAVANAGYTLGTDVTLALDCAASEFYKNGKYKLSEEGEYSSAEFAEYLAELTRKHPIISIEDGLDESDWDGWKILTDKIGEKTQLVGDDLFVTNTKILKEGIDKKIANSILIKFNQIGTLTETLEAIQMAKAAGYTAIISHRSGETEDSTIADLAVGTSAGQIKTGSLCRSDRVSKYNQLLRIEEQLGSKAVYRGRAEFRG

SEQ ID NO: 78477 - protein, 176 aa, Rhizopus oryzae
MAAKNLPKVFFDVAVNGKPSGRLTFKLFSDTVPKTAENFRALCTGEKGTGVSGKPLHYKGSHFHRIIPGFMAQGGDFTMGNGRGGESIYGHKFNDENFTLKHTGKGVLSMANAGPNTNGSQFFITFDKTPWLDGNHTVFGQLVEGNQVLEILEQHGTQSGMPTAKVEIVDCGEIKN

SEQ ID NO: 78478 - protein, 389 aa, Silicibacter pomeroyi DSS-3
MAAHWEIAVKNSSRSAVDPFIVMDVMEAARRAEEAGRRIIHMEVGQPGTGAPRGAVEALAKSLETDALGYTVALGLPALRQRIARLYGEWYGVDLDPGRVVITPGSSGGFLLAFTALFDSGDRVGIGAPGYPSYRQILRALGLVPVDLPTAPENRLQPVPADFAGLDLAGLMVASPANPTGTMLDHAAMGALIEAAQAQGASFISDEIYHGIEYEAKAVTALELTDECYVINSFSKYFSMTGWRVGWMVVPEDQVRVVERIAQNMFICAPHASQVAALAALDCDAELQANLDVYKANRKLMLERLPKAGFTRIAPPDGAFYVYADVSDLTDDSRAFAAEILEKAGVAVTPGLDFDPERGAGTLRFSYARATADIEEGLDRLEAFMQARG

SEQ ID NO: 78479 - protein, 370 aa, Pseudomonas syringae pv. syringae B728a
MIKSRAAVAFEAKKPLEIVEVDVAMPKAGEVLLRVVASGVCHTDAYTLSGADPEGIFPSILGHEGGAIVEAVGEGVTSVVVGDHVIPLYTPECRQCKFCRSGKTNLCQAIRATQGKGLMPDGTTRFSYKGEPIFHYMGTSTFSEYTVLPEISVAKIDKQAPLEKVCLLGCGVTTGIGAVLNTAKVKPGDTVAIFGLGGIGLSALIGAVKAKAARIIAIDINPAKFEIAKQLGATDCVNPKDFDRPIQEVIVDMTDGGVDFSFECIGNVQLMRAALESCHKGWGESVIIGVAGAGQEIATRPFQLVTGRVWRGSAFGGVRGRTELPSYVDMAQTGEIPLDTFITHTMGLEGINKAFDLMHEGKSIRTVIHF

SEQ ID NO: 78480 - protein, 157 aa, Pseudomonas syringae pv. syringae B728a
MRIGHGYDVHRFAEGDFITLGGVRIAHGFGLLAHSDGDVLLHALSDALLGAAALGDIGKHFPDTDPQFKGADSRVLLRHVLTLIHGKGWKVGNVDATIVAQAPKMAPHIDAMRALIAEDLQVEPDQVNVKATTTEKLGFTGREEGIAVHAVALLLRA

SEQ ID NO: 78481 - protein, 585 aa, Schizosaccharomyces pombe 972h-
MNAYVRDSESVYSESYPPENFISNEPEKSKDKDNFNGEEVISYVGEVETVPAKEENVFRRFINGFKIEKNQQDSAGQGLKRRLKSRHIQMIGIGGAIGTGVWVGSSKSLYRGGAASVLIDYCIVGTMVFCTVYALGELAVAFPTRGSFVTHATRFIDESWGFALSWNYVFSFIVTIPLELTTGTMMIKYWTNLNSGIWVTVFIVFLFFINIFGVKGYGEMEFIMSTIKVVAMCGFIILGIIIDCGGVPTDHRGYMGTHIFRENAFRHKFKGFCAVFTSAAFSFSGTEYVGVAAAETENPAKAFPVAVRQTLFRIAIFYILSLFIVSLLISGADPRLTSYHGVDASPFVLAIKDANIKALPSILNAIILISVISSANAQLYAGSRAIHSLGCNGFAPKCFTLVDREGRPLVALLILFLFMFLGYLVETGQYDTVFDWMLSISGLGTLFCWGSICLAHIRYRAAMKHQNRSLKEVGFVSPFNVYASYYAFILVCLVLAAEFYVSIFPVGGKPDASAFFENYLSAPVILVFFICHKLYYKTKRITLSNMDLETDFAYKTPVEEEEEEEKSAGSLSIKQRMKKLSDMMC

SEQ ID NO: 78482 - protein, 416 aa, Bacillus sp. L2
MKCCRIMFVLLGLWFVFGLSVPGGRTEAASLRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLEAAAVASNVPYTSQVYDFKLDQWGLRRQPGESFDHYFERLKRSPVWTSTDTARYDLSVSGAEKLNQWVQASPNTYYLSFSTERTYRGALTGNHYPELGMNAFSAVVCAPFLGSYRNPTLGIDDRWLENDGIVNTVSMNGPKRGSSDRIVPYDGTLKKGVWNDMGTYNVDHLEIIGVDPNPSFDIRAFYLRLAEQLASLLP

SEQ ID NO: 78483 - protein, 447 aa, Actinomadura madurae
MPDNQPDPGTVAVVGLGYVGSCLAAALAERGLNVLGIDTDEQLIDEYNAGFCRFREDMLADGIARALAAGRLHLTTDHRAVSRAGVVLIAVGTPVHADGSLADGQLRAACGALGEHLRPGQLAVLKSTVPPGTTRELVRPLLEQGGLRAGRDFRLAFSPERLAEGTALTELRSFPIVVGGIDARSTAEAAEFWRRGLGVATVPQESLEAAELVKLADNWWIDLNIALANELARLCALYGADVLDVIEAANTVPKGNGHVNILLPGVGVGGSCLTKDPWMVWHAARLRGLELHTPRAGRAANSAMPEYTAQLIIDDLLECGKDPAESTVAVLGLAFKNDTGDLRATPTQGVIAALTKAGVRVRCHDPLVDADAAEDLLNVRPLPTVEETVRDADCLAVLAHHRAFDAIEYAALEPAGSCLILDGRDHFPKDKVAKLRELGYRYRGIGR

SEQ ID NO: 78484 - protein, 794 aa, Neisseria meningitidis Z2491
MADNYVIWFENLRMTDVERVGGKNASLGEMISQLTEKGVRVPGGFATTADAYRAFLAHNGLSERISAALAKLDVEDVAELARVGKEIRQWILDTPFPEQLDAEIEAAWNKMVADAGGADISVAVRSSATAEDLPDASFAGQQETFLNINGLENVKEAMRHVFASLYNDRAISYRVHKGFEHDIVALSAGVQRMVRSDSGASGVMFTLDTESGYDQVVFVTSSYGLGENVVQGAVNPDEFYVFKPTLKAGKPAILRKTMGSKHIKMIFTDKAEAGKSVTNVDVPEEDRNRFSITDEEITELAHYALTIEKHYGRPMDIEWGRDGLDGKLYILQARPETVKSQEEGSRNLRRFSINGEKTVLCEGRAIGQKVGQGKVRLIKDASEMDSVEAGDVLVTDMTDPDWEPVMKRASAIVTNRGGRTCHAAIIARELGIPAVVGCGNATELLKNGQEVTVSCAEGDTGFIYSGLLDVQITDVALDNMPKAPVKVMMNVGNPELAFSFANLPSEGIGLARMEFIINRQIGIHPKALLEFDKQDDELKAEITRRIAGYASPVDFYVDKIAEGVATLAASVYPRKTIVRMSDFKSNEYANLVGGNVYEPHEENPMLGFRGAARYVADNFKDCFALECKALKRVRDEMGLTNVEIMIPFVRTLGEAEAVVKALKENGLERGKNGLRLIMMCELPSNAVLAEQFLQYFDGFSIGSNDMTQLTLGLDRDSGLVSESFDERNPAVKVMLHLAISACRKQNKYVGICGQGPSDHPDFAKWLVEEGIESVSLNPDTVIETWLYLANELNK

SEQ ID NO: 78485 - protein, 459 aa, Bacillus halodurans C-125
MHILMIGLNYKTAPVEIREKFSFQDSELPQALHQLRQMKSILECTIVSTCNRTELYVVADQLHTGRHFTKTFLADWFKLPKDEFTPFLTIRENDHAIEHLFRVVTGLDSMILGETQILGQVRNSFFIAQEEQVTGSIFNHLFKQAITLAKRAHSETDIGQNAVSVSYAAVELGKKIFDDFKGKQVLILGAGKMGELTAKHLHSNGAEQVTVINRTREKAAELAKRFLGVDRPYNELTEAIVEADILISSTGATGYVVTSDMVSHALKKRKGRPLFMVDIAVPRDLDPALASHDDVYLYDIDDLQNIVQTNLEERRTEAEKIELLIEEELVEFKQWLNTLGVVPIITALRTKALTVQGETMESIERKLPNLTEREKKVLRKHTKSIVNQLLRDPITRIKELANAPEREEALDLFTKIFALEEELAEQEKQEKVKQAEQEWLAKKRPITCMEKQSHVMVKS

SEQ ID NO: 78486 - protein, 194 aa, Bacillus halodurans C-125
MKVTKAELDCVAVKPEQYPNSPLPEVALAGRSNVGKSSFINKMINRKKLARTSQRPGKTQTLNFYNINDILHFVDVPGYGFAKVSKKDREAWGRMIETYLQQRGQLKAVLQIIDIRHDPTKDDQLMYDWLKHFEIPVIIIATKCDKIPKGKWPKHVKNIASVLEKDGGDPIVIFSSETGVGKDEAWKAILHAIS

SEQ ID NO: 78487 - protein, 287 aa, Flavobacteria bacterium BBFL7
MKGIVLAGGSGTRLHPLTLSVSKQLMPIYDKPMIYYPISTLMSAGIQEILIISTPQDQPLFKNLLGDGSQLGCRFEYAVQENPNGLAEAFIIGADFIGEDSVALILGDNIFYGTGLEKALQDSIDPDGGVIFAYHVNDPQRYGVVDFDDKMRVTSIEEKPEEPRSNYAVPGIYFYDNEVVEIAKYIQPSHRGELEITDVNNVYLNRGRLKVNVLDQGTAWLDTGTFESLMQASQFVQVIEQRQGLKIGSIEEVAYRKRYIEKQQLKNLAQPLIKSGYGDYLMRLTEK

SEQ ID NO: 78488 - protein, 350 aa, Xylella fastidiosa Temecula1
MDIPDVGHTVVKQPNASNVNTVSVADVLAAQARLRRYLMPTPIHYAERFGVMLKLENLQRTGSYKVRGALNAMLVALERGDNRPVICASAGNHAQGVAWSAYRLGIQAITVMPHGAPATKVAGVSHWGATVRQHGQSYDEAYTFACELAEQNDYRFLSAFDDPDVIAGQGTVGIEITAHEPDVVIVPIGGGGLASGIALVLRSQGVRVIGAQVEGVDAMARAIRGDTREIAPVSTLADGVKVKIPGFITRHLCANLLDDVVIVREAELRETLVRLVLEEHLIAEGAGALALAAGRRVAGKRKCAVVSGGNIDAAVLAKLLSEVRPRPPRKPRRRSADRPNNCGNLPLPFN

SEQ ID NO: 78489 - protein, 435 aa, Saccharomyces cerevisiae
MTTNEEFIGTQIFGTVFEITNRYNDLNPVGMGAFGLVCSATDTLTSQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFAEMIEGKPLFPGKDHVHQFSIITDLLGSPPKDVINTICSENTLKFVTSLPHRDPIPFSERFKTVEPDAVDLLEKMLVFDPKKRITAADALAHPYSAPYHDPTDEPVADAKFDWHFNDADLPVDTWRVMMYSEILDFHKIGGSDGQIDISATFDDQVAAATAAAAQAQAQAQAQVQLNMAAHSHNGAGTTGNDHSDIAGGNKVSDHVAANDTITDYGNQAIQYANEFQQ

SEQ ID NO: 78490 - protein, 325 aa, Solanum lycopersicum
MSFLRFIFPLFFLISIFVASNAQLSATFYASTCPNVTEIVRGVMQQAQSTVVRAGAKIIRLHFHDCFVNGCDGSLLLDNAAGIESEKDAASNVGAGGFDIVDDIKTALENVCPGVVSCADILALASEIGVALVGGPTWQVLLGRRDSLTANRSGVDSDIPTPFESLDVMRPQFTNKGMDITDLVALSGAHTFGRARCGTFQQRLFNFSGSGSPDPTINSTYLPTLQATCPQGGNNGNTFENLDKTTPDNFDNDYYINLQNQEGLLQTDQELFSTSGSDTIAIVNRYASSQSQFFDDFASSMIKLGNIGVLTGTNGEIRTDCKRVN

SEQ ID NO: 78491 - protein, 404 aa, Lactococcus lactis subsp. lactis
  misc_feature (60)..(60): Xaa can be any naturally occurring amino acid
MRKFEKSHKLDNVSYDIRGPVLDEAQRMRANGEKILRLNTGNPAEFGFLAPDEVISDLIXHAVDSEGYSDSKGIFSARKAIMQYCQLKGFPNLDINDIFTGNGVSELIVMAMQGLLDTGDEVLIPMPDYPLWTASVSLAGGTAVHYFCDEQAGWFPDIDDIRSKITSNTKAIVLINPNNPTGALYSKDLLLEIVQVARENNLIIFSDEIYDRLVMDGAVHVPIASLAPDLFVVTMNGLSKSHRIAGFRVGWMVLSGEKSHVKGYIEGLNMLASMRLCSNVLAQSVVQTSLGGTQSVDKLLLPGGRVYEQREFIYKAINDIPGLSAVKPQAAFYIFPKIDREMYKIDNDEQFVLDFLKQEKILLVHGRGFNWKEPDHFRIVYLPRVDELAEIQEKMERFLWQYRK

SEQ ID NO: 78492 - protein, 197 aa, Crocosphaera watsonii WH 8501
MLGEMWSLRGRYKILHMTWFAFFLSFVVWFNLAPLATQVKADFGLEVSQIRTLAICNVALTVPARIIIGMLLDRYGPRITYTLLLMYAAIPCLIFATAQSFTQLVIGRLMLGIVGAGFVIGIRMVAEWFPPKEIGLAEGIYGGWGNFGSAAAAFTLPTIGGWFAFGALSPAGDPLQLEALHRWNGHYRSAVWDFILQ

SEQ ID NO: 78493 - protein, 363 aa, Bacillus halodurans C-125
MEKQIAVLPGDGIGPEVTDAAIEVLQAVADRFGHTFSYKKALLGGCAIDEVGTPLPEETLDVCRHADGILLGAVGGPKWDTLPGHLRPEKGLLGLRKGLNLFANLRPVTVYDSLADASTLKNDVIDGVDLLIVRELTGGLYFGEPRERRGEGETEEVVDTLLYTRGEMRRIIRKAFELAMVRNKHVTSVDKANVLESSRMWREVANEVAQEFPEVTLEHMLVDNAAMQLIRRPKQFDVLVTENLFGDILSDEASMVTGSLGMLPSASLTSDGPGLYEPIHGSAPDIAGKGVANPLATIASCAMMLKYSFGLHEEAKTIEDAIEAVLKQGYRTADIAKPGEESSSTKAITDAVVEAIQASVDIS

SEQ ID NO: 78494 - protein, 388 aa, Crocosphaera watsonii WH 8501
MAVGVTLDLLLLPLPCPPSAVGSPLAHFPPQVIPFNWRLCIAGTGIIAALYGILYYNNVQDYPPGKTYRKPKSARGIEVTTKRDFWFLMVMNAPLSGILMVLAWRLTKVGFYGVNTMYIVWACLIGLYLFQAYNCWVVNKDLMTGKKQYPAKDRYRFSQVAILELTYIVNFGSELAVVSMLPTFFEGTFTLTPAQAGMIASSYAFMNLMSRPGGGLISDKLGSRKNTMAVLTLCMGIGYLMMGTVSSSWWLPGAIILTMACSFFVQAGEGSTFAIVPLVKRRITGQVAGNVGAYGNVGAVAYLTIFSLLPEWLGGGKDPSAAIIAQANTAFFQIMGIMAVIVAFLCWFILKEPEGSFAEHHEGEEEDLGLSPVAVMESNTSLDSVSRG

SEQ ID NO: 78495 - protein, 181 aa, Crocosphaera watsonii WH 8501
MPDSLCSFPSYWPPPDLSQAAFVAPNAVVVGDVEIAEGVSIWYSAVVRADVEKIKIGAYSNIQDGAILHGDPGEVTCLEEYVTIGHRAVIHGAHIERACLIGIGAVILNGIRVGTGSLIGAGAVVNKNVPPRSLVVGVPARRARDLSETEADKMIEHAKRYQQLALVHANKGNNLGFTNES

SEQ ID NO: 78496 - protein, 344 aa, Desulfotalea psychrophila LSv54
MHRVSRQLLITLIFLLLFGGEGMANSNLKDGLYAQFNTSKGVIICSLEFEKTPLTVANFVGLAEGTKELGGGSGKKGARFYDGLTFHRVIPNFMIQGGCPLGTGTGGPGYNFPDEFDSTLTHDAPGVLSMANAGPGTNGSQFFITHVATPWLDGKHTVFGRVVEGQDVVDKIEGKDALESITIIRVGAKAEAFKSDQAAFDDLLGSIDSRQKEKELQSMEASLNQIKEQWPAAITTDSGLQYVVVEAGEGEATPNVGDVVTVHYTGKLLDGTKFDSSVDRGQPIDFPVGRGQVISGWDEALLSMTKGEKRVLIIPAKLGYGAAGRGPIPANATMVFDVELVDFK

SEQ ID NO: 78497 - protein, 536 aa, Xanthomonas axonopodis pv. citri str. 306
MSVIDSQLQVSGETFQHNAAAMRAVIDDLRRTLAQTARGGSDAARAKHTARGKLLARERIDALLDRGSALLEIAPLAAHGMYEDQVPCAGVVAGIGRVSGVECVIVANDATVKGGTYYPMTVKKHLRAQEIAQQNRLPCIYLVDSGGAFLPLQDEVFPDRDHFGRIFYNQANLSARGIPQIACVMGSCTAGGAYVPAMSDETVIVREQGTIFLGGPPLVKAATGEEVSAEDLGGADVHTRISGVADHFADNDLQALARVRAIIAQLNWRKPAASLALQAPLPPRYAADELYGVIPADTRKPFDVREVIARVVDDSRLDEFKPRYGSTLVTGFAHLHGYPVGIIANNGILFSESALKGAHFIELCTQRGIPLVFLQNITGFMVGRKYEHGGIAKDGAKLVMAVACAKVPKFTVVIGGSFGAGNYGMCGRAYSPNFLWMWPNARIGVMGGEQAASVLATVRRDGIEAKGGTWSGEDEETFKAPIRAQFEQQGHPYYASARLWDDGIIDPADTRRVLGLGLSAALNAPIEPTRFGVFRM

SEQ ID NO: 78498 - protein, 515 aa, Rubrobacter xylanophilus DSM 9941
MPAMETYGTPHAFAAAAGTPYAAEAAAEVYRSGGNAVDAAVAAAAAVGVTEPLMSSIGGGGFALVRTPRGEVEVVDFFDVMPGKGLPPSAFGAGGNPHTILLDYGAGVSSIVGGPSVAVPGSVRGWEELLRRHGRLGLEEVLAPAVRLAREGFRLCRTSALWFRVAREVLALTEETRQNFYKDGRVYEEGEEMRFPELADTLEAIGREGADLFYEGWLGQKISAYVREMGGLVTERDLAEYRPEIRRPLSVGYRDGEVHTNGPPSAGGATLAQMLLIVAGYDLPSLPEEEYVRVVAGAMRLALLDREESYADGPRNAEVVERLLGEEHIASQRRRLFGPHTTHLSCADAEGYAVAITASMGYGSGLVVPGTGIPLNNVLGEPELNPKGFHALAPGERPVSSMSPTIVCSAEEGVIALGSPGATRIPTAILQTILNVVDLGMPLEGAVLAPRFHAEDGLFAYEAGARAADLGPYERVLVYDEPSMYFGGVNAVRRTPQGTFEAAADPRRSGGAAYA

SEQ ID NO: 78499 - protein, 126 aa, Brassica napus
  misc_feature (14)..(14): Xaa can be any naturally occurring amino acid
  misc_feature (16)..(16): Xaa can be any naturally occurring amino acid
  misc_feature (19)..(20): Xaa can be any naturally occurring amino acid
  misc_feature (29)..(29): Xaa can be any naturally occurring amino acid
  misc_feature (32)..(32): Xaa can be any naturally occurring amino acid
  misc_feature (34)..(34): Xaa can be any naturally occurring amino acid
  misc_feature (46)..(47): Xaa can be any naturally occurring amino acid
  misc_feature (52)..(52): Xaa can be any naturally occurring amino acid
  misc_feature (58)..(58): Xaa can be any naturally occurring amino acid
  misc_feature (70)..(70): Xaa can be any naturally occurring amino acid
  misc_feature (87)..(88): Xaa can be any naturally occurring amino acid
  misc_feature (98)..(98): Xaa can be any naturally occurring amino acid
  misc_feature (101)..(101): Xaa can be any naturally occurring amino acid
  misc_feature (103)..(103): Xaa can be any naturally occurring amino acid
  misc_feature (108)..(108): Xaa can be any naturally occurring amino acid
  misc_feature (110)..(111): Xaa can be any naturally occurring amino acid
  misc_feature (116)..(116): Xaa can be any naturally occurring amino acid
KPDRTDSRNRKKFXTXTEXXSHYQKQGGXEPXEXSVKVIEDLQNAXXRVASXSKNASXKNKLLADARKIXAISGRLAVVDAKLETKXXYRREFRVRVXLRXGXLTAIXAXXPDVTXRGLVPPSFIV

SEQ ID NO: 78500 - protein, 472 aa, Azorhizobium caulinodans
MAETSYDVIVIGGGPGGYVAAIRAAQLGFKTAVVEKKHLGGICLNWGCIPTKALLRSAEIYHYMEHAKDYGLSAEKIGFDIGAVVKRSRGVSQQLNTGVGFLMKKNKIDVIWGSATLTAPGKIKVEAAPDAPKGALGGGDYLAKHIIVATGARPRALPGIEPDKKLIWTYFEAMVPDRMPKSLLVMGSGAIGIEFASFYKTMGADVTVVEVMPQILPVEDAEIAALARKRFEKQGMKILSGAKVTKLEKKADSLTVHVVNSKGAKQDFQVERMISAVGVVGNVDGLGLENLGVKIERGIIVTDGYGRTNVPGVYAIGDVAGAPMLAHKAEHEGVICVETIKGLHTHPMDKAKIPGCTYCQPQVASVGLTEAKAKEDGRDIRVGRFRFGGNGKAIALGEDQGLVKTIFDKKTGQLLGAHMVGAEVTELIQGFVVAMNLETTEEELMHTVFPHPTLSEMMKEAVLDAYGRVLNA

SEQ ID NO: 78501 - protein, 736 aa, Saccharomyces cerevisiae
MSQNIQIGTRKRSRANMNNSTTTGPANNTSSNKTFLDNFEETRTNKLLDEMFARQNSFLTDNLRNSLDLNQADNPLRPRQHQHQLFLDNENAIELDEEPRIINTTINNSNNHNSSRVDEDADDDIIFIKEQPIQFSSPLILPSSSSINNNNNIVTSNNPGCGTAATSNSTYITTPKKFKKQRTISLPQLPLSKLSYQSNYFNVPDQTNAIVPRVTQTENELLHLTGSCAKTLEGNKAVNLTIAHSTSPFSNPPAQIASLPQSNLKKQIGSSLRKFTSNGSSESASSNKSNFKTDKDGHYVYQENDIFGSGGRFVVKDLLGQGTFGKVLKCIDNKYEPNYVAVKVIRAVDRYREAAKTELRILQTILNNDPQGQFQCLLLRECFDYKNHICLVTDLYGRSIYDFMCSNGIAGSPALISGHCRQLIRSVCFLHDLGIIHTDLKPENILICDETHIAQKLPLKTVQSLSKRRREASKGKRKILKNPEIKIIDFGSAIFHYEYHPPVISTRHYRAPEIVLGLGWSFPCDIWSIACVLVELVIGESLYPIHENLEHMAMMQRINGTPFPTDIIDKMFYKSKHKLGNSPSDLNSTVIKHFDRKTLSLQWPEKNKRGDTITTEKSMKRVLQSCDRLDIYISKVLKQDYGDSLSINWNLPPEKNWSLINSKLAWKRQTHSSSSSTTDELDKETFLFWYWFIDLLRKMFEFDPTKRITAKDALDHEWFNLGILDDGIATYNNTQG

SEQ ID NO: 78502 - protein, 330 aa, Rhodobacter sphaeroides 2.4.1
MPDTILVTGGAGFIGSHTCKALARAGHRPVSFDNLSTGHADAVRFGPLVQGDVRDPNAVEAALRAHGAKAVIHFAASAYVGESMADPAKYYDNNVGGMIGLVQGCRAAGVSRIVFSSSCATYGTPDRLPIRETTPQRPINPYGRTKLIGEEILRDLGVEGMRHVALRYFNAAGADPEGELGERHDPETHLLPLALRAASGQGGPLSIFGTDYPTPDGTCIRDYIHVADLARAHVLALGRLMAGGESLAVNLGTGRGQSVREIVAAIERITGRAVPVRLEARRPGDPAELVADPALAASELGFRTQLSDIGSIVRHAAPWFGLEPAHVEAA

SEQ ID NO: 78503 - protein, 347 aa, Arabidopsis thaliana
  misc_feature (279)..(279): Xaa can be any naturally occurring amino acid
MATVTSNASPKSFSFTVSNPFKTLIPNKSPSLCYPTRNKNHHRLGFSIKATVSTPPSIATGNAPSPDYRVEILSESLPFIQKFRGKTIVVKYGGAAMTSPELKSSVVSDLVLLACVGLRPILVHGGGPDINRYLKQLNIPAEFRDGLRVTDATTMEIVSMVLVGKVNKNLVSLINAAGATAVGLSGHDGRLLTARPVPNSAQLGFVGEVARVDPSVLRPLVDYGYIPVIASVAADDSGQAYNINADTVAGELAAALGAEKLILLTDVAGILENKEDPSXLIKEIDIKGVKKMIEDGKVAGGMIPKVKCCIRSLAQGVKTASIIDGRRQHSLLHEIMSDEGAGTMITG

SEQ ID NO: 78504 - protein, 357 aa, Vitis vinifera
MASSIPSSSFGTPPSILSIQELAKQPMATVPQIFLLEDQERPVLRENAALPDIPTIDMKRLIMSETTDFELDKLHSACKEWGFFQLVNHGVSSSLVEDLKHEIVEFYKLPLEEKMKYKTPADAEGYGPSIIRSEDQKLDWGDRFYMLTNPIHRRKPHLLPQLPPSLRDNLELYISDSQKLAMRLLGLMAKAMKLDKREMEELFDDGKQAVRMTYYPPCPQSEMVMGIAPHSDATGITILLQVNEVDGLQIKKDGVWIPVNVLPDALVVNVGDILEIVSNGMYTSIEHRATVNSTKERISIAMFFSPKFSAEIGPAAGLITPQNLPVFKRIGMEKYYEDFFSRKLDGKSYLEHMKIKK

SEQ ID NO: 78505 - protein, 170 aa, Glycine max
MVLSDLEICKPTSSSHNKVGISRSGRDLPPAHYLFKIESYSELMNTGVEKYETNVFQAGGYKWNLRVYPRGIESERGKGLSVYLQLTDCERFPAKRTVYAKFKLGILDQLNNKYHERTDSHWFRASRNIWGFKKLVALSELYEAAKGYIKDDTVIVEVQILVMSIAKIST

SEQ ID NO: 78506 - protein, 300 aa, Chlamydomonas reinhardtii
MAASEPRLLIIDTDPGVDDAMAILLAANSPEVRLVGLTTVYGNVPTALATANALRLLEMAGLGQDVVVAQGAARSLKAGMDVERIADFVHGADGFGDIGLPPPKGAAADCSAAEFIVRTCRQHPGRVTILALAPLTNIAQALMLDPQLGDKWESLVILGGAFFVNGNVNPAAEANIFGDPDAADLVLGSTSNLRILGLDVTTQCKMSGEELEEWHDVDAIYLHDPTAMVAVLRPELFSWQRGAVRVATDGVTRGQTVMDASPKGFHGEHGWAAPRPRVEAALGINSDAVVALIRDRLTAA

SEQ ID NO: 78507 - protein, 90 aa, Brassica napus
  misc_feature (5)..(5): Xaa can be any naturally occurring amino acid
  misc_feature (16)..(16): Xaa can be any naturally occurring amino acid
  misc_feature (26)..(26): Xaa can be any naturally occurring amino acid
  misc_feature (46)..(46): Xaa can be any naturally occurring amino acid
  misc_feature (49)..(50): Xaa can be any naturally occurring amino acid
  misc_feature (57)..(57): Xaa can be any naturally occurring amino acid
  misc_feature (59)..(60): Xaa can be any naturally occurring amino acid
  misc_feature (64)..(66): Xaa can be any naturally occurring amino acid
  misc_feature (71)..(72): Xaa can be any naturally occurring amino acid
MMLRXAAKKALGLTSXQSTPCSVGIXRSYHENVIDHYDNPRNVGSXDKXXPSIGTGXLXXAPAXXXVMKLXXFPPPPRSRVQEPGWGKKA

SEQ ID NO: 78508 - protein, 359 aa, Glycine max
MSQTKKLTPNLDQQSTKVLNLTVLQRIDPFIEEILFTAAHVSFYDFNIESNQWSRKDVEGSLFVVKRNSQPRFQFIVMNRRNTDNLVENLLDFEYELKKPYLLYRNAAQEVNGIWFYNPDECEEVANLFNRILNAYPKTPPTTIPPVNISESEELQPVSIIPESPLESSSVAASAIDAVEDPAFTNFFSTLKVTGNYASNMENFRQHSATVTSAPGGLLSTAPTVQIPSASHSTSSISGFPLDSLETAKSGNQVINLVKPSTFFASTSSSSLLVPPIYSSVPPSAVVHHSLNVPRQYGTPVLQPFPPPNPPLSLTPISSSTPNRPVISRDNVRDALLSLVQEDHFIDMMFQALLKVSHS

SEQ ID NO: 78509 - protein, 337 aa, Yarrowia lipolytica CLIB122
MKSVQVKDDKGPAENLYIGEGPTPNPQNGQLLVKTEYFGLNRMDLLQRLGNYPLPPQAPKTLGVEFSGTIEKSESDKFAVGDKVFGLVYGGAYAEYVVAAEETLIKVPDDLSMEVAAGLPEVWFTGIQVLTTVGKFQKGDSVLFHAGASSVGIAVIQLAASLGASKIFTTVGSDEKCEFVKKLGNKFGVTVVPINYHNEDFKEVISKHYDASKGEGVNVIIDPVGQTYFVRNLEIAAKDARIVLMGAMSGPIVKGDVPIGLIIYKRLVVQGTTLRSRDLAYQEKLRDFFVSHVVPLILEGKIDTFVDKLFNFTTEDIVASHKYLESNKSMGKVIVKI

SEQ ID NO: 78510 - protein, 370 aa, Agrobacterium tumefaciens str. C58
MTVRSLFLLPGDGIGPEAMTEVRKLIEYMNSAHNAGFTVSEGLVGGSAYDAHGVAISDADMEKALAADAILFGAVGGPKWDGVPYEHRPEAGLLRLRKDLELFANLRPAICYPALAAASSLKPELVEGLDILIVRELTGGVYFGEPKQIIDLGNGQKRGIDTQIYDTFEIERIASVAFELARSRDNRVCSMEKRNVMKSGVLWNQVVTETHAAKYKDVQLEHMLADAGGMQLVRKPKQFDVIVTDNLFGDMLSDVAAMLTGSLGMLPSASLGAPDAKTGKRKAMYEPVHGSAPDIAGKSIANPIAMIASFAMCLRYSFNMVDEATKLEAAIANVLDKGIRTADIMADGCRQVGTSDMGDAVLAEFKALSA

SEQ ID NO: 78511 - protein, 182 aa, Anabaena variabilis ATCC 29413
MEQARQVKISKFLSKHLRHTPERLGLVLAPGGWVAVDELLSACASHQFPISRADLEQVVSNNDKQRFSFDETATKIRANQGHSVEVDLQLQPQLPPPILYHGTGEKSVPAILKSGLLKMSRHHVHLSKDIETARTVGIRHGKPVIFSVDAMVMYQSGFTFYCSDNGVYLVDHVPPEYLHMMN

SEQ ID NO: 78512 - protein, 376 aa, Nicotiana benthamiana
MADANMGGGGGGQFPDFPSVLTHGGQYVQYDIFGNFFEITTKYRPPIMPIGRGAYGIVCSVLNTELNEMVAVKKIANAFDNYMDAKRTLREIKLLRHLDHENVIGLRDVIPPPLRREFSDVYIATELMDTDLHQIIRSNQGLSEDHCQYFMYQLLRGLKYIHSANVLHRDLKPSNLLLNANCDLKICDFGLARPNIENENMTEYVVTRWYRAPELLLNSSDYTAAIDVWSVGCIFMELMNRKPLFAGKDHVHQIRLLTELLGTPTEADLGFLQNEDAKRYIRQLPQHPRQQLANVFPHVNPLAIDLVDKMLTLDPTRRITVEEALDHPYLAKLHDAGDEPICPVPSSFDFEQQGIGEEQIKDMIYQEALSLNPEYA

SEQ ID NO: 78513 - protein, 534 aa, Vibrio parahaemolyticus RIMD 2210633
MAIIKSKTKPTDELFLSNQAAMEMLVEKLQKDIATIKLGGGERAIAHQRQKGKLPVRERISHLLDDGSNFLEIGQFAAWQVYDESIPCAGVVAGIGMIEGVQCMVIANDPSVKGGTYYPLTVKKHLRAQEIAQRCQLPCVYLVDSGGANLPHQSDVFPDKDHFGRIFFNQARMSAKGIPQIAVVMGLCTAGGAYVPAMADVSIMVKEQGTIFLAGPPLVKAATGEVVTGEELGGADVHCRKSGVADYYAENDEHALDLAREAIANANRPKPPKSDSAILPPRYDAEEMYGIVNANLRLSFDVREIIARIVDDSDFDEFKALYGRTLVCGFARIHGQLIGIVANNGILFSDSSQKGAHFIELCAKRKTPLLFLQNITGFMVGKKVEEEGIAKHGAKLVMAVACADVPKFTVIIGGSYGAGNYGMCGRAYDPTMMWMWPNARISVMGGEQAAGVLTQVRKEINQRRGEEWSEQEEHTFKESIIDLYETQGHPYFASARLWDDGIIDPKETRNVLAQALMAALNAPIPDSEFGIFRM

SEQ ID NO: 78514 - protein, 713 aa, Schizosaccharomyces pombe 972h-
MAVQDEYILVTGGAGYIGSHTVIELINHGYKVIIVDNLCNSCYDAVARVEFIVRKSIKFFKLDLRDKEGLAQIFDTFKIKGVIHFAALKAVGESMKLPLEYYDNNICGTITLLNVMREHRVKTVVFSSSATVYGDATRFDNMIPIPESCPNDPTNPYGKTKYAIENIIKDLHTSDNTWRGAILRYFNPIGAHPSGLLGEDPLGIPNNLLPFLAQVAIGRREKLLVFGDDYDSHDGTPIRDYIHVVDLAKGHIAALNYLNKINNSEGMYREWNLGTGKGSSVFDIYHAFCKEVGKDLPYEVVGRRTGDVLNLTASPNRANSELKWKAELSITDACRDLWKWTIENPFGFQIDNYKWKLFNTLGIMDYKNRLHTICFQDLEVSIANYGALVQAVRYKGRNLVNGFNDFSRYKLKENPFFGATIGRFANRIANGQFEVDGHLYTLCKNENNKTTLHGGNNGFDKQFFLGPIARQYEDYNTLEFILVDKDGNNGFPSDLETLVKYTIKNNSLEIEYKSVIPEYSKLNVTAVNLTNHSYWNLASPNKTIDGTIIKSTTNVYLKVNSETSLPTGDIVEWQNDITKPTKLDPNISFDNCFIVDREASKFCLDTRKYSLKNIVEVIHPSVPVKLVVSTTEPAFQLYTGDGNDICEFQSRSGFCVETGRFINALNNEKWSKQVILRKGEVYGARSKFSLYAQDLEENKHFLDSASYNSGEYY

SEQ ID NO: 78515 - protein, 557 aa, Actinomadura madurae
MSTSDLDFVPVAVPRPGTGPAAAPSAPPPGPPAPPSSAPPPARSMRDLRAGRDELRARAAEGRAEGIERQHGLGKRTARERLELLLDEGSFIEVEMFRRHQAHGLKIGANRPYTDGVVVGSGTVHGRRVFVYAQDFTVFGGSLGAAHASKIHKVMDLAIANGAPLIGLNDSGGARIQEGVQALDGYGGIFRRSVQASGVIPQISVVLGPCAGGAAYSPALSDFTFMVRDTAQLYLTGPDVVEAVSGKRVTHAELGGADVHGDRTGVATFVYDDEETCLEEVRFLLSLLPDNNLEPPPAAPPRGAADDERPELAEIVPVEPSKPYDMRLVIAELADDGEFMELHERWAANVICALTRIDGEVAGVVANQPMVLAGVLDADAAQKAARFVRFCDAFRIPLVTLVDVPGFLPGLEQEHAGIIRHGAKLLYAYCEATVPRVQVILRKAYGGAYIVMDSRSIGCDLSLAWPTNEIAVMGAEGAVNVLFRRELAAAADPAALRAELIEEYTGQLVHPYYAAERGLVDDVIDPVRTRAVVAGGLRMLRNKRVRTPQRVHGNVPL

SEQ ID NO: 78516 - protein, 519 aa, Schizosaccharomyces pombe 972h-
MATVPTYHDLSFYSNPKENKARYAKLLNSFEQKYHCKPDFFSRSPGRVNIIGEHIDYNYFSVLPMAIDVDVIVSVTTSDDAKVELNNTNPEFKEEILELPSDGAVIEINKTHHTWGNYFRCSMIVAHKYILEKYPELVSGGKKPLKGLKLIFDGNVPTGGGLSSSAAFCVASILAILKANGINTITKEDLVKISVVSEHYVGVNTGGMDQCASIYGEQNKALLVQFKPKLMATPFKMPVLKPHDMVFLISNTLVEANKQETALTNYNLRVVEMAVASEFLAKKFNLELPKESNLHTGTLRGFMDEYYEKHLKQPHWDGSDIDMGVQRMQEMLRLTEIMFSEEQKVGFKTEELAKELGLSVEEFTKVFLTKIPVKYERMKIYQRTVHVYSDAMRVLQVLKLFHQHKDSDDPQKFMLAFGRLLNDSQRSEDIYNNSSSPELREVCKISLANGGYGARTTGAGWGGSAVHLTTHDKLAKLVEALTEQYYKKQFPKITQSELNAAVVVSKPAAGSCIVQLAEY

SEQ ID NO: 78517 - protein, 515 aa, Triticum aestivum
MTRCKILYTMDWFLGQLLALLCCCCFFYYRHLQSKKACKAEPTEWPLLGHLFGMLANLHHYHDWATVVLAGRRYNFPAQTGLTGVRFFITCDPSNVRHIFTSNFLNYPKGEEYAEIFDILGHGIFNADGESWRSQRAMSQLLLATPRFRSFSARCTRDKVDKSLLPFLAHVADAGARCDLHDVIRRMTFDMTCNLVFGVDPGCLRIGLPVVPVARAMDDVLDTMFLRHVFPPTCWSLMYRYELGPEKKMAVARRTIDRFAANTIAKRRSDHEVGVKQSSSDMLSSFISSNDDDVSDEFLRDTAINLLFAGRDTTGAALSWFFYLVCKNPRVEQKILDELAPVAATKKPEDMVVFDFSELSNLVYLHAALCECLRLYPPLPFQHKAAIAGDVLPSGHELKAGDKILVYCYSMGRMEGVWGKDCMEFRPERWVTDDGKLRHEPSYKFFAFNAGPRTCLGKDVAFTQMKAVAAAVLWNFAVEAVPGHVVEPKLSVMLHMKNGLAVTVKRRKVPCVHAT

SEQ ID NO: 78518 - protein, 906 aa, Oryza sativa Japonica Group
MERSLLPWLLLLLCFADGVFQSRAQPDSKGFISIDCGIQPNTSYVHNTTKISYVADDDFTDGGSNYNVSPEYIKPQLSQRYYNLRAFPDGARNCYTARSLAPGIKYLIRASFLYGNYDGLNKLPVFHLYIGVNFWTMVNITSLGLGGSRYEEAIVVVPDDFVQVCLINTGTGTPFISSLELRPLDKRLYPQVNATLGLLQLNRLNFGPTDNSLVRYPDDPHDRFWGNWDSYTSSLWKEISTASRVDNLDGDIFDAPTAVMQTAVTPRNASGNIYFFWEPWPQPNDPTPPYTVIFHFSELEILTNNASRQFYINLNGEPLIDTAYEPTYLTARYLYGLEPLERTSRYNITINATANSTLPPLINAAEIFSIISTAVIGTDSQDASSMMAIKDKYQVKKNWMGDPCMPKTFAWDKLTCSYPNSSGARIISLNLSSSGLSADISSAFGNLKALQYLDLSNNSLTGSIPDVLSQLPSLRVLDLTGNQLSGSIPSGILKRIQDGSLNVRYGNNPNLCINGNSCKAAKKKSKLAIYTVIPAVLVVLIASVTTLFCLLRRKKQGPMNNSLEQQNEMSTSTSHVLINSGYGDNVSLRLENRRFTYKELEKITNKFKRVLGRGGFGYVYHGFLEDGTEVAVKLRSESSSQGAKEFLIEAQILTRIHHKNLVSMISYCKDGIYMALVYEYMPEGTLEEHIVGENKKGKILNMEREAQYRIGICTRDVKATNILLNTRLEAKIADFGLSKASSYDNITHVSTNALVGTLGYVDPEYQMTMQATTKSDVYSFGVVLLELVTGKPAILHEPNPISVIHWTRQRLARGNIEDVVDTCMPSDYDVNGVWKAMDIAFTCTAQASTQRLTMTEVVMQLQECLELEDARCAIGDAHNEFYPDPRSDHNLSYNTYVSDRSNDVLE

SEQ ID NO: 78519 - protein, 379 aa, Oryza sativa Japonica Group
MATAGKVIKCKAAVAWEAAKPLVIEEVEVAPPQAMEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 78520 - protein, 613 aa, Pseudomonas aeruginosa PAO1
MEHGSSFLQSGVVFLIAAVFMVPLAKRLQLGAVLGYLLAGVLIGPSVLGLVDNPESVAQISEMGVVLLLFIIGLELSPRRLWVMRKSVFGVGLLQVLLTGLVIGTVALVGFDQPVNSAVVLGLGLALSSTAFGLQILAERKELTQPHGRLAFAILLFQDIAAIPLIAMIPLLSGAHSDAGGSELTQTLKVVGSIAAVVVGGRYLLRPVFRIVAQTKLQDMSTATALLVVMGTALLMELAGVSMALGAFLAGLLLADSEYRHELEAQIEPFKGLLLGLFFISVGMSADISLLLKSPWMVLGLTVLLIALKAPVLYFVGRISGGLDKASALRLGVVLAAGGEFAFVVFKMARDQGLFQNDLHNLLVLSITLSMALTPLLVLGLARLLAKEPEATKPPPEMERIDNDDTPRVVIAGVGRMGQIVARVLRAQRVPFIALDTSVETIELTRTLGAIPIFYGDPMRPEILRAAQVEKAEFFVIATDDPETNIETAKRVRKLYPHLKIIARARNRQHVHLLLDAGVEPVRETFFSSLEMSRMVLCGLGLSEEQADARIRRFRRHDEEVLASQHLFYNDRDALIKSAREARVELETLFQTDQLEDRGAVAAETPEKPSRAS

SEQ ID NO: 78521 - protein, 497 aa, Vibrio parahaemolyticus RIMD 2210633
MTRLVPLFIDGEFRESQTSDWVEVTNPATNDVIAYVPCSTNAEMKAAIESAQTAFQSWKEVAVSERARLMLRYQHLLKAHHDEIATLLSHETGKIFADAKGDVWRGIEVVEQAANIASNLMGETVENVATDIDSHSIIQPLGVCCGITPFNFPAMIPLWMFPIAIASGNTFVLKPSEQVPLTSIRLAELFEEAGAPKGVLQIVHGRKDQVDFLLAHPDIRAVSFVGSVPVAQYIYTTGTQYFKRVQAFAGAKNHMVVMPDANKEHVINNLVGSSVGAAGQRCMAISVAVFVGESKVWIADLKQEMAKIHPGAWDDEDAAYGPLISEQAKQRVLGLIELGKQQGAVCELDGSQCEVEGFPDGNWIGPTLFSGVTPNMSIYTQEIFGPVLVCIEVETLQEAIELVNRNPYGNGTSIFTANGAAARKYQHEIQVGQVGINVPIPVPLPFFSFTGWRGSFYGDLHAYGKQAVRFYTETKTVTARWFDDDIPTGPNLTIQLR

SEQ ID NO: 78522 - protein, 173 aa, Bacillus halodurans C-125
MKRTITALVNNTSGVLNRITGLFARRHFNIESITVGVTENPTVSRMTFVVIVDNQKNIEQVIKQLHKQVDVLKVKDITDEAIVARELALIKVVASPQQRGEIAAVVNPFRASIIDIGRESMTVQITGDHQKVETFIDLLRPYGIKELARTGITAFKRGSKKYDVEGNHITLIN

SEQ ID NO: 78523 - protein, 557 aa, Gibberella zeae PH-1
MSRRAPNPAAERAAQNQATIKSLLKLEANKVCSDCKRNKHPRWASWNLGVFICIRCSGIHRGMGTHISRVKSVDLDSWTDEQLQSVLKWGNARANKYWEAKLAAGHAPSEAKIENFIRTKYELKRWVMDGPMPDPATLDVEGDDDVPLSIVKEKQVIERKESIRKASLTNSSAPRTVPPPQGDLIGGDPVPVRSSSAAPQSSKVPPKGEPAPPRTTSTKDSLLGLDFFGEPQAPPRPASTTGTAPSGQSRPDLKQSILSLYASAPRVQPQAQPQQPPSAGGFGGFASPTFSHQSQGSVGGFNDAFSSLSVSNAPKPAAPDPFASLGSAGRTTSSNNNAFGGLGGGSFFDSKPSQPSAPTHQHQSSNFSNFGGFSSPAPVAAAAPAAPKPAQSSAMGDLFDLSAPVTTSPPPPQPAAAPASSVFNLSSPQSPPAAAPASTTTSSMGGFSGADVWGGGEWGAPATAPAPVQKAPEPVKPATTGFEWGNSGGAFANTPIVPGASGGLTSGGFNPIASPKVSADEEFGGWTSSGPPAGGSTSQTKSGGFGGDDDLFSNVWQ

SEQ ID NO: 78524 - protein, 336 aa, Agrobacterium tumefaciens str. C58
MYRQALASGEKIFAVAPMIDWTDTRCRFLHRQLSKRALLFTEMIVADAIIHGQREKLLGYHPQEHPVALQLGGSNPAKLAEAVRIAGDYGYDEINLNVGCPSDRVQSGTFGACLMREPEVVAQCISAMKAVAAVPVTVKCRIGVDDQEPETVLPDFLARVVAAGADAVWVHARKAWLQGLSPKENREVPPLDYDLVYRMKRDNPDVFIGINGGIADLDQAGEHLKYVDGVMLGRAAYHNTSILADVDHRIHGEEALQYDWMALRDTMMAYAADYIATGGRLNHVTRHMVGLFQGMPGARRFRQILSSDATRPGAGPEVIEAAFAAIDFNPMKELAG

SEQ ID NO: 78525 - protein, 146 aa, Gibberella zeae PH-1
MSYPDQRSNDEWRAVLNKEEQFRILREKGTEAPGSGTFDKHYPDEGVYTCAGCEAPLYKATHKFKSGCGWPAYFDSIPGAVVRHEDRTFGMARTEIVCSNCGGHLGHVFKGEGYDTPTDERHCVNSVSLNFSPNDKIVKDKPESKA

SEQ ID NO: 78526 - protein, 543 aa, Xylella fastidiosa Temecula1
MSYLVLARKWRPKRFAELVGQEHVVRALSNALESGRLHHAFLFTGTRGVGKTTIARIFAKSLNCEQGTSADPCGRCTACLDIDVGRYIDLLEIDAASNTGVDDVREMIENAQYMPSRGKFKVYLIDEVHMLSKAAFNALLKTLEEPPPHVKFLLATTDPQKLPVTVLSRCLQFNLKRLDEEQIQRQIAKILTAEQITADDTAIIELSKAADGSLRDGLSLLDQAIAYAGGTLREGAVRDMLGTVDRTQVEVMLAALIAGDGDRLLRVIATLAEFSPDWGGVLEALAEALHRIQVQQLVPSVVFAGDGLNVALLAEQTQPEVVQLWYQMAINGRHDLHLAPSPRVGFEMAVLRMLAFRPVPVVVPGMVSTEGQGQSVNAPLMASVGRNAHGANGYTMSQSRSDLQKVRVGSLDGKITDVGQWLALVERIELSGPSKQLAAHAAFVSHENNVLSLALAPEFEYLQSTRSVADLTQGLTRLLGQAPEVKIEARNIQVETLHERTYRQKSERQQLAEEAFMSDHVVQHLIYQQAAKVVTDSIRPYDE

SEQ ID NO: 78527 - protein, 262 aa, Bordetella pertussis Tohama I
TAGRTDCAPAAGRLAGRVALITGAAGGIGSAAALRFAAEGAALALLDRRPDAIEQLAGRICGQGGQAIGVAADVTDDDSVRQAVRRAVEHFGRIDTLFNCAGGSVAGDTAVDKVDLALWNRTLRLDLDGTMLCCRHAVPAIVRAGGGAVVNMSSGAGLRGSFGGHAYTAAKGAVIALTRALAAEYAPHGVRVNAICAGRIRTERILRNLDAGAPAQAGAAQRYPCREGDPIDIAHIALFLASHESRMITGEAIAANGGYSAF

SEQ ID NO: 78528 - protein, 383 aa, Rubrobacter xylanophilus DSM 9941
MDLYEHQGKELLGRFGLRTLPGVVATTPEEARRAAERLGGTVAVKAQVLTGGRGKAGGIKVAESPEEAEEAARRILGMDIRGHTVRRLLIESGADIERELYLSAMVDRESRRPLILFSTEGGVDIEEVAERSPGSIVRLHVDPLVGLLPYQVRELTFASGLSGETAKDFGRAVQNLYEAFRGIDASLVEINPLVVTGEGEVVALDAKVTVDNSSLYRHQEIAGWRDVEAADPQEHRAQEVGLQYVKLDGDVGILGNGAGLVMSTLDVVAQAGGRPANFCDVGGGADAEKIATALEIVASNENVRSVFFNIFGGITRGDEVARGLLAAIRKTGIDLPVVVRLDGTNAEEGLRLLAEGAPENVHTEETMLDAARRAVELARDGGH

SEQ ID NO: 78529 - protein, 356 aa, Vitis vinifera
MASSIPSSSFGTPPSILSIQELAKQPMATVPQIFLLEDQERPVLLENASLPDIPTIDMKRLIMSETTDFELDKLHSACKEWGFFQLVNHGVSSSLVENLKHEIVEFYKLPLEEKMKYKMPGDAEGYGPSIRSEDQKLDWADRFYMITKPIHRRKPHLLPQLPPSLRDNLELYISESQKLAMRLLGLMARAIKLDKREMEELFDDGRQEVRMTYYPPCPQSEMVMGIAPHSDPTGITILLQVNEVDGLQIKKDGVWIPVNLLQDALVVNVGDILEIVSNGMYTSIEHRATVNSTKERISIAMFFSPKFSAEIGPAPGLITPQNPPVFKRIGMEKYYQDFFSRKLDGKSNLEHMKIKK

SEQ ID NO: 78530 - protein, 193 aa, Solanum chilense
FVFAGVGSAIAYGKLTTNAALDPAGLVAIAVCHGFALFVAVSISANISGGHVNPAVTCGLTFGGHITFITGSFYMLAQLTGAAVACFLLKFVTGGCAIPTHGVGAGVSILEGLAMEIIITFGLVYTVFATAADPKKGSLGTIAPIAIGLIVGANILAAGPFSGGSMNPARSFGPAMVSGNFEGFWIYWIGPLV

SEQ ID NO: 78531 - protein, 346 aa, Xylella fastidiosa Temecula1
MIDSKQKIAVLGAGSWGTALAALVARHDYPTILWGRDVRVIQSIDIQHQNFRYLPSIMLPQTLRATTDLAAAVSGADWVLVAVPSYAFTETLCRLAPLLSIGVGVAWATKGFEPGSGRFLHEVAREILGGDAPLAVVTGPSFAKEVTLGLPTAVTVHGEDACFTQMVANAMHGPMFRAYTGNDVIGAELGGAMKNVLAVAIGVADGMQLGMNARAGLITRGLNEMLRLSAVIGARPETLMGLAGLGDLVLTCTGDLSRNRRLGFALGRGQSLSDAIREIGQVVESVQTSDEVMRHAEQNGVELPISEAVRAVLREEITPYAGMKVLLAREQKPEYLDILFKANCSL

SEQ ID NO: 78532 - protein, 365 aa, Arabidopsis thaliana
MIGGFALIVYLGHLYITAMVVVIQIFMARELFNLLRKTHEDKQLPGFRLLNWHFFFTAMLFVYGRILSQRLVNTVTPDKVLYRLVTSLIKYHMAICYSLYISGFVWFILTLKKKMYKYQFSQYAWTHMILIVVFTQSSFTVANIFEGIFWFLLPASLIVINDIFAYICGFFFGRTPLIKLSPKKTWEGFIGASITTVISAFLLANIMGRFLWLTCPREDLSTGWLLCDPGPLFKQETHALPGWISDWLPWKEISILPVQWHALCLGLFASIIAPFGGFFASGFKRAFKIKDFGDSIPGHGGITDRMDCQMVMAVFAYIYHQSFVVPEVLSVDKLLDQIITSLTLEEQQALLVKLGQMLQEKVIGS

SEQ ID NO: 78533 - protein, 513 aa, Lactobacillus reuteri
MLRKGMQILNDPFKNKGTAFTIEERKKYGLLGLLPSCVRTIEEQADEIYRLYQSKNSRIEQRHLLMEVFNTNRTLFFYLMEKHIAEFMPVVYDPVIAEAIEQYNERYIKPQDAAYLSIEHPDLIKEELADAADGRDIRLIVVTDAEGILGIGDWGVNGVDISVGKLMVYTAAAGIDPSQVLPVSIDAGTNNEKLLKDPHYLGNRMKRVEGQPYFDFIDKFVDAVEGLFPKSLLHFEDFGRGTAARILDKYQDKILTFNDDIQGTGIIALAGVLGAMNISKEKLTDQTFLTFGAGTAGMGIAKMLYDELIRQGLTPEEAKKHFYLVDRQGLLFDDTPGLTPKQKPFTRQRSEFANADELTNLLAVVKAVHPTVMIGTSTQPGSFDEAVVKEMAAHTLRPVIFPLSNPTKLAEAKAADLLKWTDGKALIATGIPVKDIEYNGTVYQIGQANNALIYPGVGFGALAAEAKVLNDNMLAAAAHALSGLVDPEKPGAAVLPPVSKLTEFSKRVAERVA

SEQ ID NO: 78534 - protein, 788 aa, Methanococcus maripaludis S2
MVDLMVAEAYQGDVGKGIVRIDPLTMEKLSLKAGDAIEIAGKEKTYATVWRGYLEDQGKGIIRMDGILRQNTKAGIGDKVKITVVEVKEAKKITLAPMQAVRFSTGFESYVGSRLVEQVVDKGSKVVIGVLGTAFPFIVTGTTPKGPVKINEYTQIELKTEPVTELKETKVPNVTYEDIGGLKEEVKKIREMVELPMRYPELFDKLGIEPPKGVLLAGPPGTGKTLLAKAVANEAGANFYTINGPEIMSKYVGETEENLRKIFEEAEENSPSIIFIDEIDAVAPKRDEASGEVERRMVAQLLTLMDGLESRGQLVILAATNRPDSIDMALRRPGRLDREITIGIPDRHGRNEILQIHTRNMPLQPDYEKSDVISILNELVGEYDRSKIESLVKLVEKASSEEEIEKILKDGEVEDKVKVKLNQLMVKELADKTHGFAGADLAALSKEAAMKTLRRFLPDIDLEKEEIPREVLDKIKVTKEDFVGGLKEVEPSALREVLVEVPNIKWSDVGGLEDIKQDLKEAVEWPIKNKEMFERMGIRPPKGVLLFGPPGTGKTLLAKAVANESEANFISVKGPEIFSKWVGESEKAIREIFRKARQAAPTVIFFDEIDSVAPKRGMDFGSSGVTEKVVNQLLTELDGLEEPKDVVIIAATNRPDILDQALLRPGRLDRIVLVPIPNETARLEIFKVHTKGMPIGKDVNLEKLAKETKGYTGADIEAVCREAAMIALRENINSEHVESRHFDGAFKRIAPSVKDDDMDEYKDLAKEYGQNAGVSEIEKGPENTGYHG

SEQ ID NO: 78535 - protein, 99 aa, Cryptococcus neoformans var. neoformans JEC21
MSSFFGSGAGSPSNDMTARKEQMKQSIQQELAIANAQQLINKINENCFAKCVTKPSTSLSSSQESCLSQCMTLYMAAFDQVSRSYVARISKERGVAPGL

SEQ ID NO: 78536 - protein, 143 aa, Triticum aestivum
PVETFNPIRQGIHHDILLSNFFAQTEALMVGKNEEQVRAEMGTNVVENIVPHKIFKGNKPTNSFLFQKLTPATLGSLIAMYEHKIFVQGAIWDINSYDQWGVELGKQLAKAILPELSASGEVASHDASTNGLINHYKKNKKQY

SEQ ID NO: 78537 - protein, 433 aa, Arabidopsis thaliana
MVVISSKEAAKQVLKSRDLETCSRPKLVANGLFTRNFKDIAFAQYGEDWREMKKLVGLELFNPKKHKFFRYIREEEGDLLVKKLSKSSQTQTLVDLRKAFFSFTAGIIFRVSFGQNFRECDFIDMDRLEELVQESETNVFSFAFTDFFPTGLGWLVDRISGQHSRIEKAFSKLTKFFQHVIDEELKIGQSQDHSNLVSSMLDMINRSTEYGSFKITSDHLIAMMTDIVLGGVNAGTITMIWTMTELTRHPRVMKKLREEIRATLGPNKERITEEDLEKVEYLKLVIKETFRLHPPGPFLLPRQVMSDIEIQGYHIPKNAHIKISTYAIGRDPKCWTNPEEFNPERFANTSINYKGQHYELLPFGAGRRSCPGMTLGITILELGLLNILYYFDWSLPNGMTIKDIDMEEDGALTIAKKVPLELIPTLPASLCIK

SEQ ID NO: 78538 - protein, 425 aa, Helicobacter pylori 26695
MLDFDLVLFGATGDLAMRKLFVSLYEIYTHYGFKNDSRIIASGRKELSNEEFLTLLCEKTQLHSREKGREFLAHISYLCVRLDNPKDFEELSKIATKNKPLIFYFSISPSFFATTAQHLAKNALNHANTRLILEKPLGHDLKTCKEIFQSISVFFKEEQIFRIDHYLGKKGVQNILELRLNNPILNILWDQISAVEICVYETLGVEERGEFYDKIGALRDMVQNHLLQVLSLIATDLPNNLKDLRKEKIKVLKTLQPPKDFKKQVIRAQYQGYRDENKVHKESQTETFVAIKAFLDTPKFKGVPFYLKHAKKMPHNQASVKIHFNAVNTLEFFLSQDKITLTLKDHQNPLILETHNKQEFLRPYAKLLYDAIQNNHNNFAHQLELEASWVFIDTLIEGFMNNATPLYSYESHHLNESEFLKPLYQ

SEQ ID NO: 78539 - protein, 281 aa, Oryza sativa
MQARVVVFPVKGRAWCFASPRATAPAAACGGGDGGALLPPLPPTVKDLWRGIAGGGRTASENAEAVVDFVADKMNRAWIGFGSAPEGSMKNRIHSFGLKLLSRVRPSEVLLKSVTKDVSLLEIVHPASINPRLVRRRLRHIAVRGASVHRKFLYGSVCLLPVTSVFMVLPLPNIPFFWVLFRAYSHWRALQGSERLQLLVSDSSDQWKILLEKQKEMSSRKDGNPCENTQYAPWNLQPSKKLDGFLESRKLNEGLDCDTISRICQAYDLDKIDVLKYRDLE

SEQ ID NO: 78540 - protein, 393 aa, Nicotiana benthamiana
MDGSGQQSDTMMSDAGAEQPPPAAQPVAGMDNIPATLSHGGRFIQYNIFGNIFEVTAKYKPPILPIGRGAYGIVCSALNSETIENVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIFMELMDRKPLFPGRDHVHQLRLIMELIGTPSEAEMEFLNENAKRYIRQLPLYRRQSFTEKFPHVHPDAIDLVETMLTFDPRRRITVEGALAHPYLNSLHDISDEPICMTPFSFDFEQHALTEEQMKELIYRESLAFNPEYQHM

SEQ ID NO: 78541 - protein, 315 aa, Synechococcus sp. WH 7805
MDCLCLGLLCADLVCHPVPALPNQGQLMETERMELSLGGCAANTAFDLAKLGVRTGISGCVGNDVLADFIVQTLNAAGVDTRGVVRSNEVATASTAVINVTDQDRRFISYAGANTAMTAALIPDELLESVSVLYIGGFLMLDGLESEAMLQRLAQARKAGTRILLDVVQVGDADAMERLQRFLPFTDVFLPNNDEAALLTGFSNPWEQAEAFRSAGARTVVITEGDRGAHLLNDQLKLRAGAYATDFQGGTGAGDAFDAGFIAALLQGHDLPTCLRWGSALGASCVRSTSATGSVFNREEALQFMGSHAITVESC

SEQ ID NO: 78542 - protein, 425 aa, Glycine max
MPAPPANAGLGVAAMSYIAVDYLRHLSPVWHSRLQPALWSLLALAAVVRVPSYRHWSAEFRSAIPFIASMFFMLAALLYEMISVRSVTAVLGLDWHLNTPPLPDTGQWLLLALNEKLPSPIVEILRARIIGLHHYLMLFMMLAFSVLFDSVKAPGLGLGARYMFTMAVGRLLRAITFASTILPSARPWCAGSRFRVPGYPHRWAQKYYVPYATDHDAISRVIKVDTAYVDIGKPVGDYQPNWGSMSFLIDFMRPTVSEGPSWYSLLKKAGGGCNDLLYSGHMLVAVLTAMAWTEAYGGFSSALVWLLVMHSAQREIRERHHYTVDCIVAIYVGILLWKMTGFIWSREATSSNRRLNKFEKIQSRLIQASKDSDIDEVRELLKEFELSSEESKNQIGIKYARLFRSATIVFALTIVVLAFTLTSDG

SEQ ID NO: 78543 - protein, 353 aa, Synechococcus sp. WH 7805
MAILQRSAGCLMVSSPPQVLCVGEALVDRLGPLGGDPNTAAPSDCDDRLGGAPANVACALARLGTPVAFIGRLGRDAIGDSFLELLNDRGVDLRGLQHDDQRPSRVVLVRRDASGERVFQGFAGDRGAGFADQALDQAVLDPHWSSLAKAARWLLIGTIPLASASSAAALRSLLAQAQRDGVRVALDVNWRPTFWDPGADPAAGPDAQALALMQPLVQQADLLKLAREEAEWLFHTNTPDQISAALPRHPDVVVTDGGEPVQWCIAGQCGSMPVLAPPQVVDTTGAGDAFTAGLLHQLVCLAPVAGQSHQLDNAAVKEVVRYAAACGALVCTGAGGIDPQPLPSRVLEFLEQV

SEQ ID NO: 78544 - protein, 464 aa, Yarrowia lipolytica CLIB122
MRANFIQPQQVHQGFVNGNAGPDPRMGMMGQAGGAQGVNGMMRSTATQNQGGQQAQNSTPVRSAQQPGQQQQQQQQPNSGQRPGSALGLNSTPGQQTGGQQQGFPGMVNPLPMGMRNPMMMGQQGGVSGGRRGPGGAGGPPMMGAAQMQHLSQQQQQQQHPAPVREVWGFNLEEEMARVREVSERARYVSLECKFPGIVARPIGQFRSTNEYHYQTLRANVDLLKVIQVGLSFSDDSVAPPVTWQFNFRFDETQDMCSEDIKDLLKQSGVDFVRHQQHGIDAFNFGELLISSGLVLDDGIEWITFHAGYDLGYVLGIMLNKELPAEEQQFLAQVRRYFPRVWDLKNAVKNSGLTIRSNSLSSLAEDLRVRDQEVTNNQAGADAKLAAECFFEMRRYLGDQMALEMANKLCGLSELHPEQLMLLEEDEDAPGEDLTEVPVPTVQKPKEKQDGVNVFQFSKMGGGK

SEQ ID NO: 78545 - protein, 252 aa, Oryza sativa Japonica Group
MAAAALTSQLNALVNNMFAMGLLDDQFQQLQMLQDSTAPDFVSEVVTLFCDDGERIICELSRQLEKPNVDFDRVDSYVHQLKGSSASVGAQKVKNTCIQFREFCQQRSRDGCLKTLDLVRTEFYDLRNKFQAMLQVKLNYFWIDMHQNSQEHIYNPAFPSSGSRYSTLKVEQLYVDLPLFVGRWLRFDHFVATTYIQHCKLQQQQEEARLQCSCECGPLAAFMVSSYCKTVIFLTNQKFTTNRKKIHTNNIF

SEQ ID NO: 78546 - protein, 1227 aa, Kluyveromyces lactis NRRL Y-1140
MTGYSLAQVLAEASRSVVSRNNVFYTTPSKSENSGISLELSKTDAIRLLNSNDPFATISEAASKDVFTTVFTDDSTLLKALPYLYSLKSLPVVINVELTLQDFSIIPALKDLDYVSFVSNSFADAKAAAEVSYKVASTLLQPVLHFISVPYHVEGIAELSFQKAEFTEDEEAESERLEDLLTVEKYNFYSHNKLPSTVVINLSPYAQEFSESLPKDTALIDLKVYRPFDLTSLLAEIPTSVKDIVIVQKSNSKPENTNGFEPIQLDFFSDFNLLVEREIKQIVVSNVGEITDFSKTLQQLISNIKSDSPDLSLYLGERVETEATQGLSISIAGALSLEFAYEKVLNQLFKSNLDVLNKYDNESVNVTNPEYGFGLFLKQKQERDSLISLANKSLNASEYTSSDGQKIVELLDQWIKLNNVALEESTIEKGNKVAEELFELLQNNDHSSTALSLLKKIGSVEALKFKSSWLVGSDAWSYDLGQSGVHHVLASNENINILIIDSDPYDKVKASEIKSRKKDVGLYAMNFGNAYVASVAVYSSYTQLLTSFVEASKFVGPSIILAYLPYNSERDTPLEVLKETKIGVESGYWPLYRFNPYEERDDQVFKLDSSVIKQQLKDFLDRENKLTLLAQKSPELARNLKHSASDAIQLKQDRRAKAAFDQLLEGLSGPPLHIYHASDGGNAANLAKRLGTRASARGLKTIVLSMEDIVLEELPGEENVVFITSTAGQGEFPQDGKAFWDALKSSTDLDLASLNFSVFGLGDSAYWPRKEDAHYYNKPAKDLFKRLELLSGQELVSLGLGDDQDADGYQTGYAVWEAQLWEKLGVSGATVPDEPKPITNEDIKIASNFLRDTIVEGLQDESTGAISAWDQQLTKFHGIYMQDDRDIRDTRKSQGLEPYYIFMSRVRLPGGKANPDQWLILDHLADKTGNGTVKITTRATFQLHGVVKHNLKHTIRAMNSTLMDTLAACGDVNRNVMLSALPANATVHKQIADVGTYLSERFLPQTTAYHEIWLEGPDKDDEDPSWPETYEKRQEGPIKKKKTLVAGNALVDAEPVYGPTYLPRKFKINITVPPFNDVDVWSSDVGLIAIIDEPTQTLTGFNLYVGGGMGSTHNNKKTYPRTGSLFGYVSVADVGDAIEKVMIVQRDHGDRTNRKHARLKYTVDDLTIEGYKQKVEELWGKKFEPAAAYEIKSNIDYFGWVKDETGLNHFTAFIENGRVEDTVELPQ

SEQ ID NO: 78547 - protein, 196 aa, Kluyveromyces lactis NRRL Y-1140
MKKDNFGHFRLTGNQHVLISDVDDEHLDEVKAIMNKYKLDNTNFSGLRLSSAACVALPTCGLAMAESERYLPVLITKLENALEEYGLRHDSIVMRMTGCPNGCARPWLAEVALVGKAPGTYNLLLGGGYYGQRLNKLYRASIKEDEILATLKPLFKRWSLERLEGEHFGDFVIRVGVIKPTLEGKYFHDDLPEEAL

SEQ ID NO: 78548 - protein, 251 aa, Brassica napus
MPIRNIAVGSPNEATRPDALKAALAEFISTMIFVFAGSGSGMAFNKLTENGATTPAGLVAASLAHAFGLFVAVSVGANISGGHVNPAVTFGAFVGGNITLLRGILYWIAQLLGSVVACLLLKFATGGLVVPAFGLSAGVGVSNALVFEIVMTFGLVYTVYATAVDPKNGSLGTIAPIAIGFIVGANILAGGAFSGASMNPAVAFGPAVVSWSWNNHWVYWAGPLVGGGLAGLIYEVFFINTTHEQLPTTDY

SEQ ID NO: 78549 - protein, 572 aa, Bacillus halodurans C-125
MHHKITGIAASSGVAIAKAFIHLEPNVDIEKTSITDVSTEIEKLTAALEKSKEELRAIKDQTEASMGADKAEIFAAHLLVLDDPELVDGIKGKIENEQMNAEYALKEVSDMFVSMFESMDNEYMKERAADIRDVSKRVLGHLIGVETGSLATIAEETVIIAEDLTPSDTAQLNKQFVKGFATDIGGRTSHSAIMSRSLEIPAVVGTKEVTEKIQHGDMVIVDGIEGIVIVNPTEEEVKAYEEKRAAFEKQKQEWAKLVGEPSTTKDGAHVELAANIGTPKDVDGVLANGGEGIGLYRTEFLYMDRDQLPTEEEQFEAYKEVVQRMDGKPVVIRTLDIGGDKELSYLQLPKELNPFLGFRAIRLCLEKQDIFRTQLRALLRASTYGNLKVMFPMIATLEELRQAKAIMQEEKDKLLSEGVDVSDSIEVGIMVEIPSTAVAANLFAKEVDFFSIGTNDLIQYTMAADRMNERVSYLYQPYHPAILRLVDMVIKAAHSEGKWVGMCGEMAGDEVAIPLLLGLGLDEFSMSATSILPARSQLLKLSKEELKPFAQKALMLDTAEEVEQLVKKTYLK

SEQ ID NO: 78550 - protein, 476 aa, Agrobacterium tumefaciens str. C58
MEQAEIGLIGLGVMGSNLALNIAEKGNKIAVFNRTPEVTRKFYADAGELQGQIIPCETIEEFVAAIRPPRPIIIMIKAGDPVDQQMEILKPHLANGDIMIDAGNANFRDTIRRFDNLKDSGLTFIGMGVSGGEEGARHGPSIMVGGTEDSWKRVEKVLTSISAKYNDDPCVAWLGNDGAGHFVKTIHNGIEYADMQMIAEIYGILRDGLKMSAVEIADVFAEWNKGRLNSYLIEITEKVLRAADPITGKPMVDLILDKAGQKGTGKWSVIEAQNMGVAATAIEAAVAARILSSQKDEREAAEKIFGLPTLAAAPADKKAFIADLESALLAAKVGAYAQGFAIMSAASKEFNWNLPMPTIARIWRAGCIIRSEFLDEITSAFTKDPHVANLIVTPAFSAIVKDTDAPLRRVVSYAVLSGLPVSALASALGYFDAYRRGRGSANLIQAQRDFFGAHGFERTDGVDKPHGPWGSGADIF

SEQ ID NO: 78551 - protein, 447 aa, marine gamma proteobacterium HTCC2143
MSAVIYPTTNFKAIEQLVIDRGEGIYVYDKDGKQYLEGMAGLWCTSLGYGNQEIIAASNEQMKKMSFTHMFGGKTHQAGIDLANRLAEMVPVENAKVFFGNSGSDANDTHIKLLRYYFNALGKPEKRKIITRERAYHGVTVAAGSLTSLPANLTHFDSPIDALGILRTDHPHYYRGANNGESEAEFVNRITNNLEQLIVREGPETIAAFIAEPITGASGVIVPPAGYYEKVQTILQRYNILFWADEVITGFGRTGNDFGCTTMNIKQPDMMTLAKQMSSAYYPISASIIRSELYEAMVELSSKVGVFGHGYTYSGHPVGCAIALKVLEIYQRDNIFKTAASTGDYLQRRLKAFSDHPLVGEVRGKGMIAALELVANKTTKAAFTDGSVGAKAVLACQHNGLIVRAVAGNSLALCPPLITTEAQVDEIMEKLGKALDSTLEHTTLSDR

SEQ ID NO: 78552 - protein, 391 aa, Rubrobacter xylanophilus DSM 9941
MADWFRRRVGRDVARGEGPPDDAARREGATPADGFTEEGIREALRDVRDPEIGRDLVSLNMVRSVDVRDGRVKVGVALTTAGCPLKHRITQDVRDRLMMIEGVREVEVDFGVMTDQDRQNLMSALHGGRAEIAPAFRDESKTRIIAVVSGKGGVGKSTVAVNLAAALDRAGHSVEILDADVHGASVPVMLGALQKPNVVDGVIFPVESPTGLKFISMGNFVSEGQAIIWRAPIVNKALTQLMRDVYWDEPDFIIVDMPPGTGDVALTVAQMIPKAEALVVTTPQADAARVAVKAGRMAVQAHLRVIGVVENMSYAECPDCGKELRIFGGDGGERVASELGSRVLGRIPILPDATGEPGRCLFEAGSSPARAFDEIAASLAATKARKRIKVL

SEQ ID NO: 78553 - protein, 247 aa, Methanococcus maripaludis S2
MTTDSKNARNSEVKIQGDEKISNVEKAIDALKSGKMVLLYDSDDREGETDMVVASEFITPEYIREMRKNAGGLICTCLHSDFCDKLGIPFMVDILDVASEKYPVLKELYPNDIPYDEKSTFALYANHRTTFTGITDNDRALTVKKITELCSEERFKDFGKEFRCPGHVAFLRATEGLVKNRQGHTEMTVALAEMAGLTPITTICEMMGDNGKAMSKDLVKKYAEENGLVTINGQELIEYYLKEFSKE

SEQ ID NO: 78554 - protein, 175 aa, marine gamma proteobacterium HTCC2143
MNRQVPDVVFKTRVRDESVDHENPFRWEDKSTADIFGGKNIVVLALPGAFTPTCSGTHLPGYENNIEAIKAKGVDDVYCLSVNDAFSMFQWAKQLGIEKVKMLPDGNGEFSRLMGMLVKKENLGFGDRSWRYSMHVIDGDIKALFAEPGLMDNCPEDPFGVSDADTMLDYLNQGA

SEQ ID NO: 78555 - protein, 342 aa, Pseudomonas aeruginosa
MTLPQTMKAAVVHAYGAPLRIEEVKVPLPGPGQVLVKIEASGVCHTDLHAAEGDWPVKPPLPFIPGHEGVGYVAAVGSGVTRVKEGDRVGIPWLYTACGCCEHCLTGWETLCESQQNTGYSVNGGYAEYVLADPNYVGILPKNVEFAEIAPILCAGVTVYKGLKQTNARPGQWVAISGIGGLGHVAVQYARAMGLHVAAIDIDDAKLELARKLGASLTVNARQEDPVEAIQRDIGGAHGVLVTAVSNSAFGQAIGMARRGGTIALVGLPPGDFPTPIFDVVLKGLHIAGSIVGTRADLQEALDFAGEGLVKATIHPGKLDDINQILDQMRAGQIEGRIVLEM

SEQ ID NO: 78556 - protein, 279 aa, Cryptococcus neoformans var. neoformans JEC21
MMSSSPTSTPHQVPSFLANILLSHISPLDPSSTSSTTFDHHRSPTTQNPSHPQALQTAEHPPNPLYLPPPALPKVEEDLVPPENFALVSSGVYRCGFPKKRNFKFMETLRLKTVLTLVLEEYPKANLEWCQSQDIQFMQFGIPGNKEPFDNIPEDVICAALVAILDRRNHPILIHCNKGKHRTGCLIGCIRRLQAWSLTSIFDEYRRFSAPKSRAVDQQFIDLFDIMPVWEAVCRPKGGGLGNLPDWGMLVLPKGVVEVGRDGKEKKRVERDIFHMRGL

SEQ ID NO: 78557 - protein, 391 aa, Methanococcoides burtonii DSM 6242
MRTQCKPSQFIANRMQKVPPSGIRKFFDLVSDSEDVITLGVGEPDYVTPWHIREACIHSIEYGETSYTSNYGLMELREELSKHYTRRHNVYYEPETEILVTAGVSEGLDLAIRAIVNPGDEIIVVQPSYVAYVPAIIFAGGVPVTLGARPENDFKITADEIRAAITNKTKAVIINYPNNPTGATMDKSDLEAIADVIVEHNILMISDEVYERLTYEGTHTCFSSLEGMRDRTILLNGFSKAYAMTGFRMAYALAPKEIIDAMMLIHQYTMICAPITAQIGAIEALRNGEEEVEKMAREYNRRRKLIVGGLNKIGLDCFNPRGAFYAFPAISSTGLSADEFAERLLNEYKVVTIPGNIFGDTGDGFLRCAYAASREDIKEALDRIGNFVDGL

SEQ ID NO: 78558 - protein, 530 aa, Bordetella pertussis Tohama I
MHQRILILDYGSQVTQLIARRVREAGVYSEIHAGDVDDAFVRDQVAQGLKGIILSGSHASAYEEGSMRVPAAVFDVGVPVLGICYGMQSMAQQLGGTVSFSDHREFGYAEVRAHGHTKLLDGLADFTTDEGHGMLKVWMSHGDKVTELPPGFKLMASTASCPIAGMADESRGFYAVQFHPEVTHTVQGKAMLARFVKDICGCEGDWNMPDYISEAVARIREQVGSDEVILGLSGGVDSSVAAALIHRAIGDQLTCVFVDHGLLRLDEGKQVMQTFTENMGVKIVHVDATSQFMGKLTGVADPEAKRKIIGREFVEVFQDEAGKLQGAKWLAQGTIYPDVIESAGAKTGKATSIKSHHNVGGLPDTLNLQLLEPLRELFKDEVRELGVALGLPPQMVYRHPFPGPGLGVRILGEVKHEYAELLRRADAIFIEELRNAKDPASGLTWYELTSQAFAVFLPVKSVGVMGDGRTYEYVVALRAVQTFDFMTADWAPLPHPLLARVSSRIINEVRGINRVVYDVSSKPPATIEWE

SEQ ID NO: 78559 - protein, 257 aa, Zea mays
MAKLVNKLVDSFDHDEAPAPDVGCVRAVLAELVLTFLFVFTGVSASMAAGAGGKPGEAMPMATLAAVAIAHALAAGVLVTAGFHVSGGHLNPAVTVGILVRGHITKLRALLYVAAQLLASSLACILLRYLSGGMVTPVHALGAGIRPMQGLVMEVILTFSLLFVTYAMILDPRSQVRTIGPLLTGLIVGANSLAGGNFTGASMNPARSFGPAMATGVWTNHWVYWIGPLLGGSLAGFVYESLFMVNKTHEPLLNGDI

SEQ ID NO: 78560 - protein, 251 aa, Silicibacter pomeroyi DSS-3
MRRKLAAGNWKMNGTGAALDALEAIAGAHSAAAVDLLICPPATLLYRAAQVAEGSRVRIGGQDCHAVTAGAHTGDISAMMLADAGASAVILGHSERRADHGETDAQVCDKARAALEAGLIAIICIGETLAQREAGQTLDVVCAQLAGSVPDGIDGTRVVVAYEPVWAIGTGLVPTLEQIAEVHDTLRQQLIGRFGSETAEAIRLLYGGSVKPGNAAEIFAVSNVDGALVGGASLTAADFSPIVSALEQAAG

SEQ ID NO: 78561 - protein, 436 aa, Bacillus cereus ATCC 14579
MHHDEKNKIGLTVALSIVVGTIIGSGVFMKPGSVLDYSGSSNMAILAWIIGGLLTLASGLTVAEIGAQIPKNGGLYTYLEEIYGSFWGYLSGWMQTIVYGPAIIGTLGLYFSSLMINFFYLDKVWNLPIAIGTVVFLGVVNSMGTKYGGIVQTITTIGKMIPIVLIVVLGFWKGNSDIFNVVVPISQNQSIGMAILATLFAYDGWILLASIGGEMKNPTKLLPKAMTVGILIVTAAYVLINLALLNVLPAAKIVDLGENATATAAGMLLGEYGGKIISIGIIVSIFGCLNGKILTFPRIPMSMAERGQLPFSKFIAKESPRFKTPANAITVEIILGIILMIISDPNKLSEISVFIIYIFYVMTFIGVFILRKRNKNKERAYSVPLFPIVPIVAILGSFFVIGSAIINDPVSCFLSIGIVFTGLPVYWYLNKKKETE

SEQ ID NO: 78562 - protein, 413 aa, Streptomyces avermitilis MA-4680
MHSAVLLIEFGAIILSLGLLGRAAARLRFSPIPLYLLAGLAFGEGGLLPLGASEEFVATGAEIGVILLLLMLGLEYTAGDLVSNLKAHYPAGLVDFTCNALPGAAAALLLGWGPVAAVVLAGVTWISSSGVIAKVLGDLGRVGNRETPVILSILVLEDLAMAVYLPIVTALVAGAGLAAGSVTLAVALAAAGLVLFVALRFGRLISRFVSSDDPEKLLLVVLGLTILVAGIAQQLQVSAAVGAFLVGIALSGEVAEGAHTLLSPLRDLFAAVFFVFFGLHTDPASIPPVLLPALALAAVTAVTKIATGYWAARRAGISVKGRWRAGGALVARGEFSIVIAGLAVTAGIEPSLGPLATAYVLLLVVLGPLTARYTEPLIARLNARSGRVRPEHRDAPVPTEPEGDTRAQTTVGD

SEQ ID NO: 78563 - protein, 256 aa, Zea mays
  misc_feature (228)..(228): Xaa can be any naturally occurring amino acid
  misc_feature (251)..(251): Xaa can be any naturally occurring amino acid
MNSNLFFPQKLAPSLPCGPCPSLHSTMAAPPATAPAASRCLSGAKSCWAAERSSSSFAVSAPSTGLRQSRSRILSVRAKVATGVQRASTVDDGAKRPWKLSDARLVLEDGSVWRAKSFGASGTQVGEVVFNTSLTGYQEILTDPSYAGQFVLMTNPHIGNTGVNPDDEESNQCFLGGLIIRNLSICTSNWRCKETLEEYLTKRNIMGIYDVDTRAITRRLREDGSLIXGVLSTDQSQTDNELLEMAKKWKXCWSLI

SEQ ID NO: 78564 - protein, 122 aa, Ustilago maydis 521
MAAQQSQGIQTLLEAEKEAAKIVQKARTYRTQKLKDARSEASKEIEQLKSNKEKEFNDFQKEHEGSTSSSQTTVDKETEQKLEELNKAFDANRDQVIAKLLDRVVDVKTELHRNLQLQQQKA

SEQ ID NO: 78565 - protein, 343 aa, Triticum aestivum
  misc_feature (8)..(8): Xaa can be any naturally occurring amino acid
  misc_feature (80)..(80): Xaa can be any naturally occurring amino acid
  misc_feature (214)..(214): Xaa can be any naturally occurring amino acid
MDHAAEAXRTDLMTITRHALNEQGRHPESRGDFTILLSHIGLGCKFVASAVNKAGLAKLIGLAGETNVQGEEQKKLDVLXSNEVFVKALVSSGRTCVLVSEENEAAIFVDAPLRGKYCVCFDPLDGSSNIDCGVSIGTIFGIYMIKDKDNATLEDVLQPGTHMIAAGYCMYGSSCTLVLSTGNGVNGFTLDPSLGEFILTHPNIKIPNKGKIYXSVNEGNARNWDAPTAKYVERCKFPQDGSSPKSLRYIGSMVADVHRTLLYGGIFLYPADKKSPNGKLRVLYEVFPMSFLMEQAGGQSFTGKHRALEIVPSEIHQRSPIFLGSYDDVEEIKSLYAAESSTA

SEQ ID NO: 78566 - protein, 577 aa, Streptococcus salivarius
MTEMLKGIAASDGVAVAKAYLLVQPDLSFETVTVEDTSAEEARLDAALAASQDELSVIREKAVESLGEEAAAVFDAHLMVLADPEMTGQIKETIRAKQVNAEAALTEVTDMFIAIFEGMEDNPYMQERAADIRDVTKRVLANLLGKKLPNPATINEESIVVAHDLTPSDTAQLNKKYVKAFVTNIGGRTSHSAIMARTLEIAAVLGTNNITELVKDGDILAVSGITGEVVINPTEEQIAEFKAAGEAYAKQKAEWALLKDAQTVTADGKHFELAANIGTPKDVEGVNDNGAEAVGLYRTEFLYMDSQDFPTEDDQYEAYKAVLEGMNGKPVVVRTMDIGGDKELPYFDLPKEMNPFLGYRALRISISETGNQMFRTQLRALLRASVHGKLRIMFPMVALLTEFRTAKGILEEEKAKLVAEGVAVADDIEVGIMIEIPAAAMLADQFAKEVDFFSIGTNDLIQYTMAADRMNEQVSYLYQPYNPSILRLINNVIKAAHAEGKWAGMCGEMAGDQTAVPLLVGMGLDEFSMSATSVLRTRSLMKKLDTAKMEEYANRALTECSTMEEVLELSKEYVNVD

SEQ ID NO: 78567 - protein, 285 aa, Zea mays
  misc_feature (170)..(170): Xaa can be any naturally occurring amino acid
MASPIPREWVGLQQFPPATQTELHELLGKLKEEDVSTLTILVMGKGGVGKSSTVNSIVGERIATVSAFQSEGLRPMMWSRTRAGFTLNIIDTPGLIEGGYINEQAVDIIKRFLLGKTIDVLLYVDRLDAYRMDTLDGQVIRAITNSFGKDIWRRSLVVLTHAQLSPPDGXIDYNDFFTRRSEALLRYIPSGAGINKRGFGDFPLPIALVEDSGRCQTTDHGEKVLPDGTPGVPNLMKEITIVISNGSSPTHVDQKLIDGPNPNNRRKLFIPLILAVEYHNLFYAQ

SEQ ID NO: 78568 - protein, 322 aa, Colwellia psychrerythraea 34H
MQRLAPALRQDNVPLDLISLIKTILAATKEISFRVSQGHLGDVMGSTLDENIQGEVQKQLDVVANELFKDILLESGFVKAISSEEEDHSVAGDENGKYIVSFDPLDGSSNIDINSLIGTIFSIHEAPKDIAAGDDDMFKQAGDKQVCAGYVLYGPSTMLVMTTGSGTHFYVLDRTHGGFLLVERNVQVPADTQEFAVNMSNQRFWQAPMQNYISDLLAGDTGPREKNFNMRWIAAMVGDIHRVLCRGGIFTYPADSRKPEQPYKLRLMYEANPMAFLLEQAGGLAMTSEGRIMDIEPNSIHQRVEVIMGSKNEVEKCLSYYN

SEQ ID NO: 78569 - protein, 198 aa, Streptococcus pneumoniae
GIEDILVVTGKSKRSIEDHFDSNFELEYNLKEKGKTDLLKLVDEATGMRLHFIRQTHPRGLGDAVLQAKAFVGNEPFVVMLGDDLMDITDENAVPLTKQLMNDYERTHASTIAVMPVPHEDVSSYGVIAPQGEGINGLYSVETFVEKPAPEDAPSDLAIIGRYLLTPEIFDILENQAPGAGNEIQLTDAIDTLNKTQR

SEQ ID NO: 78570 - protein, 241 aa, Xylella fastidiosa Temecula1
MEDIRSNLTKVYSRIVAACQSVDRDPSSVTLLPVSKTADEVHIRLSYEAGCRKLGENKAQDAYHKWEAMSDLTDLYWSVIGHLQTNKAKLVARFASEFQALDSFRVAEALERRLQIEGRSLDVLIQVNTSGETNKYGLPPEEVVRFVQALSAYPALRVRGLMTLAMLSGDTSRVRQCFTQLRILRDRIQQASPQGHHITELSMGMSGDLEIAIEEGATVVRVGQAIYGARALPNLHFHHTV

SEQ ID NO: 78571 - protein, 254 aa, Vitis vinifera
MGRKFFIGGNWKCNGTVEEVKKIVTVLNEAEVPSEDIVEVVVSPPFVFLPLVKSLLRSDFQVAAQNCWIRRGGAFTGEISAEMLVNLGIPWVILGHSERRSLLAESNEFVGDKVAYALSQGLKVIACVGETLEQRESGSTMAVVAAQTKAIAEKVSSWDNIVLAYEPVWAIGTGKVATPAQAQEVHCELRKWLHDNAGDEVAASTRIIYGGSVNGANCKELTTQLDVDGFLVGGASLKPEFIDIIKSATVKKSA

SEQ ID NO: 78572 - protein, 537 aa, Agrobacterium tumefaciens str. C58
MGNNGRDILAGLSVAGLMLPEAIAYSGIAGVPPQHALYAAMAGCLVYALLGQSRFAIISPTSSSAAILAAMLAALVPQPGQKMLLVAVAVFLVGLFFLAAGTLRLGALSSIISRPVLRGFAFGLAILISLKQFPAIFGMPQAGAGTFEAILQILTNPGQWNGFSLSIGIAALILLLFARRYPQIPGSLIIIALAIPISVMFDLQQRGVDVVGPIDLSGIWGSVTTLSLDELAHVARFAPPLVLILFAESWGTIRGLSLRHGEDVDANRELKTLGIANVASAALQGMPVGAGFSAGAASEAANPRTRMASAIAAIGLAGFTFAAADWFAYIPHAALSAIIIVALLHALDPSPFLRLWRLRQDLVLALAATAGVLFLGVLNGMLAAIVLSFAVFLQRLSSPRIVMLGRLGASHDFVDVKRHPDAAEPAGMLVLRPAQPLFFGNAEPTFAEITRRILASPDINAVIISLEETFELDTTALEALLEFDASLRGRNIGIRYAPMHDAVRDVVAAGGGDDLLRRANYSVDDAVAAMDGLKEEK

SEQ ID NO: 78573 - protein, 352 aa, Arabidopsis thaliana
MPESLNVGNGNPSIPIINERTLPKFLESARMEKSVNRTNTRLKLFSGTANPALAQEIAWYMGLDLGKVNIKRFADGEIYVQLQESVRGCDVYLVQPTCTPTNENLMELLIMVDACRRASAKKVTAVIPYFGYARADRKTQGRESIAAKLVANLITEAGADRVLACDLHSGQSMGYFDIPVDHVYCQPVILDYLASKSIPSEDLVVVSPDVGGVARARAFAKKLSDAPLAIVDKRRSGHNVAEVMNLIGDVRGKVAIMVDDMIDTAGTIVKGAALLHQEGAREVYACCTHAVFSPPAIERLSGGLLQEVIVTNTLPVAEKNYFPQLTILSVANLLGETIWRVHDDSSVSSIFL

SEQ ID NO: 78574 - protein, 378 aa, Flavobacteria bacterium BBFL7
MINSKLPNTSDSIFSIMSRLAHNNNALNLSQGFPSFPVDLELKEHLSNAIEQDHNQYAPMAGLPQLRESISLLMENIHNANYDPNSEICITAGATQAIYTAIQAIINHGDEVIVFTPAYDSYIPAIQMAGGTAVELPMTLPDFKIDWQMVVDHINQNTAMIMINSPHNPSGTMLDHDDMIELERIAEQHDLIVLSDEVYEHITLDENIHLSAARYPELKKRSFITASFGKTFHITGWKTGYCLAPKHLMKEFYKVHQYLVFSINHPTQVAIANYIQNEDRYLRLGTFYQRKRDLFLYAIEDSKFSFSPAQGTYFQLLNYSKITDQGDVAFANRLTIDHKIASIPISVFMNGADPKMLRFCFAKEDHEIIQAAHILNSL

SEQ ID NO: 78575 - protein, 299 aa, Aeromonas hydrophila
MTLGDKMKAVIPVAGLGTRMLPATKAIPKEMLPIVDKPLIQYVVNECIAAGIKEIILVTHSSKNAIENHFDKSFELEATLESRVKRQLLEEIQSICPKDVTIMHVRQGEAKGLGHAVLSAYPLVGDNPFVVVLPDVIIDDAASDLKKDNLAKMVRNYIESGHSQIMVEPVDAKDVSKYGIVDCHSIDVNAGESATIFDVVEKPEQDDAPSNLAIVGRYVLTPEIWSHLRTTKPGAGDEIQLTDAISELLKNGQVDAFCMQGKSHDCGDKLGYMKAFVEYGLRHKEYQHSFKEFIGSLAL

SEQ ID NO: 78576 - protein, 336 aa, Rubrobacter xylanophilus DSM 9941
MARTVTLIPGDGIGPEVTGSAKEVIGALGVDIEWEIAEAGETVMEREGTPLPEYVLESIRRNKVALKGPLTTPVGTGFRSVNVALRKELDLYANIRPALSLPGLDLPYRDIDILLFRENTEDLYAGVEHMVGKHAAESIKIITREGTERICRMAFEYSRDQGRRHVTVVHKANIMKYTDGLFREVFYEVARDYEDDFEEIDERIVDNMAMQLVMKPNLYDVLVCPNLYGDILSDLCAGLTGGLGVAPGANIGEDIALFEPVHGSAPKYAGQNRANPLATLLSAKNMLYYLGYGEAADRMQGAINAALKNPETRTKDLGGSAGTREFTRAVISNLTG

SEQ ID NO: 78577 - protein, 272 aa, Oryza sativa
MTDRQAMAMGSSDGDVLYARCLVTLYLLSPLNVFALWFMSAPYGKLSRPGWGPTVPAALAWCLMESPTLWLPPLVLSATTTSLSTPTLRVTILPAALYMLHYVHRTLVHPLRLLRLRRAPAPMPILIIMFGFSFNLLNAYIQARSWALDAVPPATATPLTVARCLVGLALFVWGMWTNIAADRELLRLKEAGKGYQIPKDGLFDLVACPNYFGETVEWLGYALVAWTPAAWAFFLYTCVNLGPRARDQRLWYISKFGDKYPASRKAFIPYIY

SEQ ID NO: 78578 - protein, 152 aa, Zea mays
ALYKSLSDHKVLLEATLLKTNMVTPGSDSPKVSAEVIAEYTVAALRRTVPPAVPGVVFLSGGQSEEEATQNLDAMNKLEVLKPWTLSFSFGRALQQSTLKKWVGKKENVAAAQATFVIRCKANSEAALGKYAGSGAGDAAASESLYVKGYKY

SEQ ID NO: 78579 - protein, 432 aa, Oryza sativa Japonica Group
MGTCLTTAEQRAMEVPAASVKGGGGRRSDEEAPGRIAGNGAGNVACLFTRQGKKGTNQDAMVAWENYNGRSDTVFCGVFDGHGPHGHLIARKVRDILPSRLCDLIYEDCGDSPTSNSDVSTLEENLSPYADAECRSPTLAGQKEHQEFFNAMKESFRKAFKNVDKELKLQRNIDSICSGTTAVTLIKQGHDLIVGNLGDSRAVLGTRDQNDKLVAHQLTVDLKPDHPREARRIRRCNGRVFAHQDEPDVARLWLPNCNSPGLAMARAFGDFCLKDFGLISVPDVTYRQITEKDEFIVLATDGVWDVLSNQEVVDVVASCSGRFAAARSVVDLANETWRFKYPTSKTDDCAVVCLFLNKYEVTGGLSGQPGYSPRMPALSGITRPNSKRVTPDDVDDGSDSNVSGDERSLDGFTRLNTLLALPKFGDTSPTKK

SEQ ID NO: 78580 - protein, 454 aa, Cryptococcus neoformans var. neoformans JEC21
MRSKSLVFRVAIYIIPLIISAYLFLPYPNKHSYSIVAMSLSSKLNITDVDLKGERVLIRVDFNVPMDKEGKITNPARIVAALPTIKYAIDNGAKSVILMSHLGRPDGSPNPKYSLKPVASKLSELLSKDVKFLPECVGDEVKSEVLKGENGQVFLLENLRFHIEEEGKGKKGDEKVKADPAAVKKFREQLTELGTVYINDAFGTAHRAHSSMVGVQLPKRAAGFLMKKELEYFAKVLEKPERPFLAILGGAKVADKIQLIENMLDQVNTLIICGGMSFTFKKTLDNVEIGTSLFDEAGSKQVKDLVEKAKKNNVKLVFPVDYVTADKFDKDAKTGSATDESGIPSDWMGLDCGPKSRELFAQTVAEAKTILWNGPAGVFEFPAFASGSNALLEACIKAAKNGSTVIVGGGDTATLVAQAGKEDELSHVSTGGGASLELLEGKTLPGVAELSEKK

SEQ ID NO: 78581 - protein, 445 aa, Rhodobacter sphaeroides 2.4.1
MSMSQLAPGVVPGRLPADAYARNFSDVEPPLDGHEAKVAADRCYFCHDAPCVTACPTAIDIPLFIRQIATGTPEAAARTIFNQNILGGMCARVCPTEQLCEEVCVRETAEGKPVEIARLQRHATDTLMARNVHPFERAEPTGKRVAVVGAGPAGLSAAHRLAMLGHEVTIFDARPKPGGLNEYGIASYKTPDNFAQAEVDWLLMIGGITLKTGQALGRDITLEGLRAEFDAVFLGMGLSGVNALRAEGEDREHVHPAVDFIAALRQAEDLASLPIGRDVVVIGGGMTAIDAGVQAKLLGAENVTIVYRRGQEKMSASRHEQDHATASGVRLIWHAAPVKVHGNGAVREVEFAYTEDGPGGLRLLSETFRLKADQLFKAIGQTLGEVPEGIALEGGKIAVDATGRTSLPGVWAGGDCAAGGEDLTVTAVAQGRDAAVDIHAELCPS

SEQ ID NO: 78582 - protein, 417 aa, Cryptococcus neoformans var. neoformans JEC21
MSLSSKLNITDVDLKGERVLIRVDFNVPMDKEGKITNPARIVAALPTIKYAIDNGAKSVILMSHLGRPDGSPNPKYSLKPVASKLSELLSKDVKFLPECVGDEVKSEVLKGENGQVFLLENLRFHIEEEGKGKKGDEKVKADPAAVKKFREQLTELGTVYINDAFGTAHRAHSSMVGVQLPKRAAGFLMKKELEYFAKVLEKPERPFLAILGGAKVADKIQLIENMLDQVNTLIICGGMSFTFKKTLDNVEIGTSLFDEAGSKQVKDLVEKAKKNNVKLVFPVDYVTADKFDKDAKTGSATDESGIPSDWMGLDCGPKSRELFAQTVAEAKTILWNGPAGVFEFPAFASGSNALLEACIKAAKNGSTVIVGGGDTATLVAQAGKEDELSHVSTGGGASLELLEGKTLPGVAELSEKK

SEQ ID NO: 78583 - protein, 567 aa, Helicobacter pylori 26695
MRRSFLKTIGLGVIALFLGLLNPLSAASYPPIKNTKVGLALSSHPLASEIGQKVLEEGGNAIDAAVAIGFALAVVHPAAGNIGGGGFAVIHLANGENVALDFREKAPLKATKNMFLDKQGNVVPKLSEDGYLAAGVPGTVAGMEAMLKKYGTKKLSQLIDPAIKLAENGYAISQRQAETLKEARERFLKYSSSKKYFFKKGHLDYQEGDLFVQKDLAKTLNQIKTLGAKGFYQGQVAELIEKDMKKNGGIITKEDLASYNVKWRKPVVGSYRGYKIISMSPPSSGGTHLIQILNVMENADLSALGYGASKNIHIAAEAMRQAYADRSVYMGDADFVSVPVDKLINKAYAKKIFDTIQPDTVTPSSQIKPGMGQLHEGSNTTHYSVADRWGNAVSVTYTINASYGSAASIDGAGFLLNNEMDDFSIKPGNPNLYGLVGGDANAIEANKRPLSSMSPTIVLKNNKVFLVVGSPGGSRIITTVLQVISNVIDYNMNISEAVSAPRFHMQWLPDELRIEKFGMPADVKDNLTKMGYQIVTKPVMGDVNAIQVLPKTKGSVFYGSTDPRKEF

SEQ ID NO: 78584 - protein, 269 aa, Methanococcoides burtonii DSM 6242
MHLTEKRIGFIGTGKMGESLIRGILAAHSEITLNASDVYKPALERLNNELGINVSTDNTETIGDSDVVVLAVKPQILKDVLVAIKDSITADKLVISIAAGVSVTAIEDELNEGTRVVRVMPNIAATVAEAASAVCAGKNATEDDMEVALEMFQSIGSAITIPEKLMDAVTGLSGSGPAYIFPVIEALADGAVHEGLDRANAITLAAQTVLGAAKMVLETGMHPGELKDMVTSPAGTTIRGIHTLEESGIRAAFMNAVIESSKRSKELGK

SEQ ID NO: 78585 - protein, 109 aa, Chlamydomonas reinhardtii
MGGRIIQVKSAEEWTSHMRECRAFGGKSYLVDFTASWCGPCQKIAPLYEKYSAENPNITFLKVDVDELADVAGECDVKAMPTFIGYFNGEQVDTVVGADDAKLRELIAT

SEQ ID NO: 78586 - protein, 176 aa, Brassica napus
MEDGENDGKRLVFVTVGTTSFDALVKAVVSENVKEELHKRGYTHLLIQMGRGIYSPPKCDGADGSLAVDYFTFSSSIADYIRSASLVISHAGSGSIFETLKLGKPLIVVVNEDLMDNHQCELAEELEERKHLYCARPHTLHQTLTKMELESLVRYTPGDGTPVARIIDRFLGFPDD

SEQ ID NO: 78587 - protein, 534 aa, Bordetella pertussis Tohama I
MTAPTLAPIDPPARAQLLTDLQGAPDWDVIVIGGGATGLGTAVDAAARGYRTLLVEAADFAKGTSSKATKLVHGGVRYLAQGNISLVREALHERGLLNRNAPHLVWPLGFVVPAYSLLDQPFYGVGLKMYDMLAGKLNLAPSRWLSRGETLRHAATVAERVNGRALRGGILYYDGQFDDARLAIALMRTLYDLGGVALNYARAVGLTRTDGRVDGVTVADALGELRVTLRAKCVVNATGVWVDAVRRMDDPAAQTMVAPSQGVHLTLPRDFLPGEDAILIPKTDDGRVLFVVPWNGHTIVGTTDTPRTDLPLDPQAGQNEIDFILATAARYLSRKPTRADVTSVWAGLRPLVKATGEASTKSLSREHTIVVSKGGLVTVTGGKWTTYRKMAQDVVDTAIEHKLLAAAPCRTSELPLHGAPADGQPNGAPHGTPDSYYGTDLATLRALPGADRMLVKASALTEAHVRYAARHELARTVEDVLARRNRALFLDAEAALLAAPEVARILAQELGHDEAWSRATLAEFEAVAAHYRLA

SEQ ID NO: 78588 - protein, 554 aa, Silicibacter pomeroyi DSS-3
MYRYSEFDTAFLAERNAQFRAQVERRIDGSLTEDEFKPLRLMNGLYLQLHAYMLRVAIPYGTLNAAQMRQLALLAEKWDKGYGHFTTRQNIQYNWPKLRDVPDMLDALAEVGLHAIQTSGNTIRNVTADHFAGAAADEVADPRPYAELLRQWSTDHPEFQFMPRKFKIAITGSANDRAVIKAHDIGLQLVVRDGVLGARVIVGGGLGRTPMIGQELSPFVAFDDLLAYLEATVSVWNQIGRRDNKYKARIKITVFEHGIEAIRARVNERFVKVRGRFKGADMALLDEIKGHFAPPSWRTSSLAPFEAAYAKDPVFRSWVDTNIAAHKQADHAIVTISLKAHGATPGDATAEQMRVMADLAERYGYDELRISHEQNVILPHVHKSDLPAIHAELAANGLGTANIGLISDIIACPGMDYCALATARSIPVAQEIATRFEELKLEHEIGALKIKISGCINACGHHHVGHIGILGLDRAGVENYQITLGGDATETAAIGERTGPGFAYDQIVPAVERIVETYLDQRRDREESFIETYRRVGMAPFKAALYPEARADAA

SEQ ID NO: 78589 - protein, 132 aa, Fagus sylvatica
MWNGVVVAYIVVALCYFPVALIGCYVFGNSVEDNILISLEKPTWLIVAANLFVVIHVIGSYQIYAMPVFDMIESVLVKKLHFRPTITLRFISRNIYVAFTMFVAITFPFFGGLLGFFGGFAFAPTTYFLPCI

SEQ ID NO: 78590 - protein, 237 aa, Synechococcus sp. WH 5701
MNPGDPQAVRELFEAIAPRYDQLNDWLSFGLHRLWKRQAALWLRPRPGQRLIDLCCGTGDLALVLAGKVRPGGQVLGFDAASAPLQVAAARAARQPWLPLQWRQGDALATGLPPQSFDGAVMAYGLRNLADPAEGLRELRRLLRPGGRAAVLDFNRPDPSTPAGAAAAAFQRLYLRRLVVPTARLFDLPDQYAYLEASLQRFPSGAEQEQLARRAGFSSARHRPLAAGQMGLLQLVA

SEQ ID NO: 78591 - protein, 134 aa, Oryza sativa
  misc_feature (30)..(30): Xaa can be any naturally occurring amino acid
  misc_feature (40)..(40): Xaa can be any naturally occurring amino acid
PGCRLSSLSLSVYCRRRRRSSTLLSPAVPXVPRRGVVRPXRCSGGGGAAAVETAASGAKVCTVSNRGDSLAICRVLGGMWQTSGGWGRIDRDAAVDAMLAYADAGLSTFDMADHYGPAEDLYGLFINRVRRERP

SEQ ID NO: 78592 - protein, 510 aa, Sinorhizobium meliloti 1021
MRAVLEQVEARRAEARAGGGERRIAAQHGKGKLTARERIDVLLDEGSFEEYDMYVTHRSVDFGMAGQKIPGDGVVTGWGTINGRQVYVFSQDFTVLGGSLSETHAQKICKIMDMAARNGAPVIGLNDSGGARIQEGVASLAGYAEVFRRNAEVSGVIPQISVIMGPCAGGAVYSPAMTDFIFMVRDSSYMFVTGPDVVKTVTNEIVTAEELGGARTHTTKSSVADGAYENDIEALEHVRLLFDFLPLNNREKPPVRPFHDDPGRLEMRLDSLIPDSAAKPYDMKELILAIADEADFFELQASFARNIITGFIRIEGQTVGVIANQPMVLAGCLDIDSSRKAARFVRFCDAFSIPILTLVDVPGFLPGTAQEYGGVIKHGAKLLFAYSQATVPMVTLITRKAYGGAYDVMASKHIGADVNYAWPTAEIAVMGAKGATEILYRSELGDPAKIAARTKEYEERFANPFVAAERGFIDEVIMPHSSRRRIARAFASLRNKQVETRWRKHDTIPL

SEQ ID NO: 78593 - protein, 412 aa, Bacillus halodurans C-125
MSIIVQKYGGTSVGSVQRIEHVANRIIATAASGKKVVVVVSAMGKTTDELVGLASEITDEPRKREMDMLLATGEQVTIALLAMALHKRGQEATSLTGWQAGMITESHHGNARILEVERARMDELLDKVHVVIVAGFQGIDQQGEIMTLGRGGSDTSAVAIAAALKAERCEIYTDVTGVFTTDPRVVKQARKLQTISYDEMLEMANLGASVLHPRAVEFAKNYEIPLLVASSMVDEPGTMIEEEGTMEQNLLVRGIAFENDVTKVTVHGLPNEIHTLPTLFAHLSAAGINVDIIIQNQTDSGMAISFSITQSSLKETLARLEELKGELSFQGIDYEEELAKVSIVGSGMVSNPGVAAKMFEILAANDIAIKMVSTSEIKVSAVIDEELMVLAVEMLHEQFKLHEEEPAVAVKV

SEQ ID NO: 78594 - protein, 418 aa, Xanthomonas axonopodis pv. citri str. 306
MSPDLRQLHTFGELDPPQRLLMGPGPVNAHPRVLRAMAADLLGQFDPEMTTYMNEVMALYRPLFGTENRWTFLVDGTARAGIEAALVSLVSPGERVLVLNFGRFGLLLTEILGRLGADVHSVDAPWGQVLPLSAIAEAIERVAPQLVATVHGDTSTTMAQPLDGVGALCRAAGALSYVDATATIGGMPIASDRWDVDVVTGGLQKCLGGPSGSAPITVSERAAEAIFARRHVERGIVRADIANGSGPRIASNYFDLAMIMDYWSDKRLNHHTEATTMLYGARECARVALQEGLDARFARHAAAGRAVSAGIRALGLEVFGDDAHRMTNVTGVVIPPGIDSEAVRRRMREDFEIEIGTAFGPLQGRIWRIGAMGYNAMKHKVLITLAALEAVLRAEGYACTHGLAVEAALAAWHAEVQA

SEQ ID NO: 78595 - protein, 890 aa, Magnetospirillum magnetotacticum MS-1
MYSFGGGKAEGRADMKNLLGGKGANLAEMSNLGIPVPPGFTISTEVCTYYYGNGETYPPSLKDEVMAALAQVEGDIGLKFGSTADPLLVSVRSGARASMPGMMDTILNLGLNDKSVEGLAKRSNDARFAYDSYRRFIQMYSNVVLGVDHHNFEEILDEVKEDKGVSLDTELDADDLKKVVAKYKDKVAEQLGKPFPQDVHEQLWGAVGAVFGSWMNQRAITYRRLHDIPAEWGTAVNVQSMVFGNMGSDCSTGVCFTRNPSTGENAFYGEFLVNAQGEDVVAGIRTPQQLTIAGKNAQSSDLPAMEECMPEVFKELNAIRHKLEAHYKDMQDMEFTVQQNRLWMLQTRTGKRTTNAALKIAVDMAREGLISRKDAIKRIDPASLDQLLHPTLDPKAPRKILGRGLPASPGAASGKVVFSADEAEDWVKNRKERVILVRIETSPEDIGGMHVSEGILTTRGGMTSHAAVVARGMGTPCVAGAGEIRVDYAAKTLKVAGQVVKEGETITLDGSTGEVFIGAVATIQPELTGDFGTLMEWVDTIRTLKVRANAETPLDAATARKFGAEGIGLCRTEHMFFDPKRIIAMREMILAETEKGRRAALAKLLPYQRQDFIELFEIMQGLPVTIRLLDPPLHEFLPNSEAEIAEVAKEAGVEPSVVKARNAALHENNPMLGHRGCRLGITYPEIYEMQARAIFEAAVHVSRDTGRTVVPEIMIPLVGAKRELDLMKASIDKEAEAVFAEQKYSVHYMVGTMIELPRAALLAGDIAQTGEFFSFGTNDLTQTTFGMSRDDSGPFLEVYRAKGIYEHDPFASLDQAGVGELIKIAAERGRATRPGLKLGICGEHGGDPASIHFCQGAGLDYVSCSPYRVPIARLAAAQAALGGSSSSGTA

SEQ ID NO: 78596 - protein, 1561 aa, Oryza sativa Japonica Group
MAAASRARRWSLAGKTALVTGGTKGIGRAIVEELAGFGVRVHTCSRHDADLQDCLRRWNAAGEGGGAAALVTGSVCDVSVRGDREALVAAARAALGGRLDMLVNNAGQVVVGPAAETAPEEYARLMATNLESCFHLAQLAHHLLRDAAAGGGAAASVVNISSTAAFYAAPHLAVYSATKGGMNQLTRCLAAEWARDGVRVNAVAPGATRTDICDTSGVALGEKTRRRLADAGAMDRVPIRRIGEPEEVAAAVVFLCMPAASYITGQAQGLWGAVEPEGDDLVDYRQDRQALAAILRAVPAEMLATLAVKETAQEAWEAIKTRRIGVQRVREANAQQLAENSVISSSRTVVPEHLQQIAISIETLLDVNELSLEEVTGRLRSVEQRKQRKTAAASSRVDANGRLLFTEEEWLAKFRKAASLQDAAHSSGGNGDRRGRGRGKKDDGAPKEAQPKPANPGGRNLGNCKNCGKRGHWAKDCRSKPKAQQAYVAQEEDEEPALLLAKVQLDPPRPRVAAPTNVVSPPSAPRALSPMGELAVVEAKVFAQLDGGGEHDPAMWILDTGATNHMTGSRSAFAELDTAVTGTVRFGDGSVVRIEGRGTILFSCRFGEHRGIAGVYYIPRLTANIVSLGQLDRSGSKVLIHHGVLRVWDPRGHLLVRVRRSDDCLYTIKLDIDRPVCLAARSAEPAWRWHARYDHLNFPTLRKLAQQEMVRGLPLLQQVTQVCDGCLLRKQRRAAFPTQSKYRADEHLELVHGDLCGPIEPATPAGNRYFLLLVDDMSRYMWLTLIRSKDESANAIKHFQARAEVESGRKLRALRTDRGGEFTSIEFGEYCANLGVGRQLTAPYSPQQNGVVERRNQTIIATARSMMKAKGVPGRFWGEAMSTAVFLLNRSPTKSLDNQTPYEAWYGQRPAVHFLRTFGCVGHVKITKPGLKKLDDRSAPMVLLGYEQGSKAYRLYDPVSERVHVSRDVVFDEDAAWDWGPVVTTTIGTAPASSPTPPSPPSPAPSAPTTPAPPSPPSPEAVEFVTPPTQDSILDVDADDDVVPRYRLVDNLLGNASPPGHAPRVLEQLELHVVSANEPASLAEAEADPNWRGAMQDELNAIVDNDTWSLTDLPHGHRAIGLKWVYKLKRDEQGAIVRYKARLVAKGYVQRQGVDFDEVFAPVARLESVRLLLVVAVHQGWQVHHMDVKSAFLNGELLEEVYVSQPPGFVDDNHKNKVYRLHKALYGLRQAPRAWNAKFDSSLLSLGFHRSSSEHGVYTRTRGGRRLTVGVYVDDLIITGDHDDEIRSFKGEMMKLFKMSDLGALRYYLGIEVTQDSDGITLGQAAYASKILEKAGLKDCNPCQTPMELGWESALSRQHATRPGILCWVCQSLHGVTQGRPSCCRSTHTALCGARCALPMLVGYSESDLAGDPDERKSTSGQIFFINGGPVTWQSSKQKVVALSSCEAEYIAAAAATCQGVWLARLLAEVLGDEIATPLLKVDNQSTISLIKNPVHHDRSKHIDVKYHYIRECAEKKLIEMMFVGTAEQLGDIFTKSLGRTRFQELRSKIGVCSLDKSSQT

SEQ ID NO: 78597 - protein, 210 aa, Rhodobacter sphaeroides 2.4.1
MKDPIDLYMNTLVPMVVEQTSRGERAYDIYSRMLKERIIFLSGPVHDGMSSLICAQLLFLEAENPSKEIAMYINSPGGVVTSGLSIYDTMQYIRPKVSTLVIGQAASMGSLLLTAGEKGMRFSLPNSRVMVHQPSGGYQGQATDIMIHARETEKLKRRLNEIYVRHTGQDLETVEAALERDNFMSAEDAKAWGLIDEILESRNRPDDTAK

SEQ ID NO: 78598 - protein, 526 aa, Xanthomonas axonopodis pv. citri str. 306
MLQTLRARRGMVVAPHHLAAQAGRDVLRDGGTAIEAAVATAACLAVVYPHMTGIGGDGFWLIHEPDGRVHAIDACGRAAQAATLDFYRGHAHIPWRGPGAANTVAGTVSGWALALQQANGNLSLQRLLSDAIHHASAGVPVTLGGAQIAASKGAELRPQPGAYREIFEPHAVPLQEGALLQQPQLARSLQRLADEGLEGFYRGSLAHDIAADLHALGSPLSAHDLAAHRADASVPLSVVIQGARLYNHAPPTQGLASLLILALFDRLKVESADGHAHLHGLIEASKQAFLIRDAHLGDPAWMTLDAQALLDDSAALDALAARIDMSAALPWPQPSQAGDTVWFGAIDAHGRAVSCIQSTYFEFGSGLVLPRTGITWQNRGCSFRLAPDGWNALVPGRKPFHTLNPALATFDDGRVMAYGTMGGEGQPQTQAAVFSRYARFGMPLQQAVSAPRWLLGRTWGEDSTSLKLENRFDPAVVQALRNAGHAVELLPAYSSVMGHAGALVRERDGVLSGASDPRSDGAVAAW

SEQ ID NO: 78599 - protein, 232 aa, Oryza sativa
  misc_feature (15)..(15): Xaa can be any naturally occurring amino acid
  misc_feature (31)..(31): Xaa can be any naturally occurring amino acid
  misc_feature (202)..(202): Xaa can be any naturally occurring amino acid
CIWRGHSRFSVSPPXRSISRPPASAAAGDCXRAPRRCFRSADRSPSMAAAEEGPWVLMATGRSPTNIAVIKYWGKTDDALILPVKDSISVTLEPDHLSDTTTVAVQPSFPSDRMWLNGHEISLSGPTLQSCLRETRKRAQDVDDATHGITITTEDWRKLHVHIASSTNFPIAAGLASSAAGLARVATTLGTPLPVPDDPGEXLSSIATQGSRNACRTIYAGIRTGVWTNYYA

SEQ ID NO: 78600 - protein, 446 aa, Rhizobium leguminosarum bv. viciae 3841
MDVLNPNPKSGWRHERGEASLSDVYRTVGTGRHSSAWRRAAAFAGPGYMVAVGYMDPGNWATSLAGGSKFGYALLTVALLSNLMAIVLQSLCARLAIASGRDLAQACRDAFPKYVSLPLWAFAEIAIIATDIAEVIGTAIGLNLLMGIPLELGVLITALDVFVILFLQKLGFRWVEAFIIALLGVIAVCFGVQILLADPQWGAVLTGFFPTTEIVTNPEMLYLALGILGATVMPHNLYLHSGIVQTRAYGHTIPEKREALTFATIDSTVALCFALLINASILILAAAAFNAHGKTDVVELGDAYSLLSPLLGLAIAPTLFGIALLCCGLNSTVTATLAGQIVMEGFLKIRLKPWVRRLITRAIAIVPAAIVTIWYGDKGTAELLILTQVVLSLQLSFAVFPLVMFTANKAKMGELVAPRWLSGVAYLIAVVIAGLNVKLLLDFVTG

SEQ ID NO: 78601 - protein, 469 aa, Helicobacter pylori 26695
MKAMEGKIIQVLGPVVDVEFESYLPAIFEALDINFEVNGVQKSLVLEVAAHLGGNRVRAIAMDMTEGLVRNQVIKARGKMIEVPVGEEVLGRIFNVVGESIDNLEPLKPSLTWPIHRKAPSFEQQSTKTEMFETGIKVIDLLAPYSKGGKVGLFGGAGVGKTVIIMELIHNVAYKHNGYSVFAGVGERTREGNDLYFEMKEGGVLDKVALCYGQMNEPPGARNRIAFTGLTMAEYFRDEKGLDVLMFIDNIFRYAQSGAEMSALLGRIPSAVGYQPTLAGEMGKLQERIASTKNGSITSVQAVYVPADDLTDPAPASVFAHLDATTVLNRKIAEKGIYPAVDPLDSTSRILSPQMIGEKHYEVATGIQQVLQKYKDLQDIIAILGLDELSEEDKKTVERARKIEKFLSQPFFVAEVFTGSPGKYVTLQETLEGFGGILEGKYDHIPENAFYMVGSIQEVLEKAKNMKNS

SEQ ID NO: 78602 - protein, 459 aa, Vibrio campbellii AND4
MSKQTFDQVGLNPALLETLESLNYTHMTPIQALSLPVILNQRDVIGQGKTGSGKTAAFGLGVLSNLNVKRFRVQSLVLCPTRELADQVAKEIRTLGRGIHNIKVLTLCGGMPMGPQIGSLEHGAHILVGTPGRILDHLDKGRINLEELNTLVLDEADRMLDMGFQDALDAIIDAAPKQRQTLLFSATFPKKIEQIAQRIMRSPEMIKVESTHDTSSIVQHFYKVEGTEARDEALANLLLTHQPESAVVFCNTKKEVQNVADELHHKGFSVIELHGDLEQRERDQALTQFANKSVSILVATDVAARGLDVDNLDAVFNFELSRDPEVHVHRIGRTGRAGSKGLAFSFFGEKDGLRVARIEEYLDMDVVPATLPAKSNLQPYQAKMVTISIDGGKKQKVRAGDILGCLTGKGGITGAQVGKIQLMAMRAYVAVEKSVAKKALQVISDGKMKGRQFRARILK

SEQ ID NO: 78603 - protein, 257 aa, Oryza sativa Japonica Group
MAANFWTSSHCKQLLDQEDVDKVPQADSDRGITLEEFRLVKIHMSFHIWRLAQQVKVRQRVIATAVTYFRRVYTRKSMTEYDPRLVAPTCLYLASKVEESTVQARLLVFYIKKMCASDEKYRFEIKDILEMEMKLLEALDYYLVVYHPYRPLLQLLQDAGITDLTQFAWGIVNDTYKMDLILIHPPYMIALACIYIASVLKDKDITLWFEELRVDMNIVKNISMEILDFYDTYKIDPQRGLPEDKIAPVMNKLPSKA

SEQ ID NO: 78604 - protein, 235 aa, Anabaena variabilis ATCC 29413
MTQNRSEKPIVISPSILSADFSRLGDEIRAVDAAGADWIHVDVMDGRFVPNITIGPLVVEAIRPVTKKPLDVHLMIVEPEKYVEDFAKAGADIISVHCEHNASPHLHRTLGQIKELGKQAGVVLNPGTPLELIEYVLELCDLILIMSVNPGFGGQSFIPGVVPKIRKLRQMCDERGLDPWIEVDGGLKANNTWQVLEAGANAIVAGSAVFNAKDYAEAITNIRNSKRPTPELAKV

SEQ ID NO: 78605 - protein, 154 aa, Zea mays
MALTRIGLAGLAVMGQNLALNIAEKGFPISVYNRTTSKVDETVQRAKAEGNLPVYGFHDPASFVKSIQKPRVVIMLVKAGAPVDQTIATLAAHLEQGDCIIDGGNEWYENTERREKAMEERGLLYLGMGVSVFSSLLINAPCSKGDVHNSDKSR

SEQ ID NO: 78606 - protein, 282 aa, Glycine max
MASQNPAEEENSKRHWSLEDFEIGKPLGRGKFGRVYVAREVKSKFVVALKVIFKEQIDKYRVHHQLRREMEIQTSLRHANILRLYGWFHDADRVFLILEYAHKGELYKELRKKGHLTEKQAATYILSLTKALAYCHEKHVIHRDIKPENLLLDHEGRLKIADFGWSVQSRSKRHTMCGTLDYLAPEMVENKAHDYAVDNWTLGILCYEFLYGAPPFEAESQSDTFKRIMKVDLSFPSTPSVSIEAKNLISRLLVKDSSRRLSLQKIMEHPWIIKNADFVGIC

SEQ ID NO: 78607 - protein, 527 aa, Oryza sativa
MATLLSKLLALPQQWQLLLLLLLLPIASLLLVIGRNTGGRRRRRHLRLPPGPARLPVLGNLLQLGALPHRSLRDLARRHGPVMMLRLGAVPAVVVSSPEAAQEVLRTHDADCCSRPSSPGPMRLSYGYKDVAFAPYDAYGRAARRLFVAELFSAPRVQAAWRARQDQVEKLIGKLTRPEPEPVELNDHIFALTDGIIGAVAFGSIYGTERFAGGGRKRFHHLLDDVMDMLASFSAEDFFPNAAAARLFETPHGLVAHRERVFQQLDAFFEMVIEQHLDSDSSNAGGGGGNLVGALIGLWKQGKQYGDRRFTRENVKAIIFDAFIGGIGTSSVTILWAMAELMRSPRVMRKVQAEIRATVGDRDGGGMVQPDDLPRLAYLKMVVKETLRLHPPATLLMPRETMRDVRIGGYEVAARTPVILNVRAIGRDAARWEEAEVFDPDRFEAKRVEFNGGHFELLPFGSGRRICPGIAMGAANVEFTLANLLHCFDWALPVGMAPEELSMEESGGLVLHRKAPLVLVPTRYIQL

SEQ ID NO: 78608 - protein, 285 aa, Zea mays
MRATSMAAAAGIRSREERWSLAGKTALVTGGSKGIGRAIVEELAGFGVRVHTCARTAADLDERLRAWAADARLPGRVTASVCDVSARGDREALVAAARAELGPRLDILVNNAGQSTFRAATETAAGDYARLMATNLESCFHLAQLAHPLLLAAGAGAGAGAAVVNVSSIAGLVAYPALAAYSATKGGLNQLTRSLAAEWAGDGVRVNCVAPGGVQTDMFSSVALEMDPDRETSLRMMEAELARVPLRRFGETEEIASLVAFLCMPASSYITGQVICADGGRTIAA

SEQ ID NO: 78609 - protein, 176 aa, Kluyveromyces lactis NRRL Y-1140
MSEIAQDSNVSIFSKNEKKARELILKLGLKPIQGVSRVTFKKKDGQIFAIDRPEVYKSQGGNFVVFGEAKVDDFTQRLAKAQESLQQNEGVLPAGQDAVSKDPQSIQADMQAAADSATDKPSADDAVDDAEVDETGLNADDIELVMQQAGVPRAKAAKALKEHDSDIVNAIMALSG

SEQ ID NO: 78610 - protein, 356 aa, Schizosaccharomyces pombe 972h-
MWGFIVTCGIFLVLLCQLRLLSKRKSKSTPYNALLPNVTVFAMGGTIAGCANSSLEIVNYIPGSVGIEKLIEAVPAIKAIANINGVQVTNMGSENLTPADVLKLAKLILAEVAKPNVHGIVITHGTDSLEETAMFLDLTISTAKPIVVVGAMRPSTAIGADGPMNLLNAVAVASSNQSMGRGTLVLLNDRIGSAFYTTKTNGNTLDTFKSYEAGSLGIVLNQKPFYFFSPAVPTGKVFFDIYNIKQLPRVDILYGYQGLNPKLAESAVHLGAKGLVLAAMGATSWTDDGNEVISSLIREHNIPVVYSHRTAEGYSSNSCLGIPSYFLNPQKARYMLMLAISSGYSIRDIEDLFSIK

SEQ ID NO: 78611 - protein, 481 aa, Prochlorococcus marinus subsp. marinus str. CCMP1375
MPERFSQQRQRVRPNSNEEAVVKRAQEHFERSLIKINGHLAGSVAALEHPANNDALNYGEIFLRDNVPVMIYLLTQKRYDIVKKFLTVCLDLQSTSYQTRGVFPTSFVEEKDELIADYGQRSIGRITSADASLWWPILCWLYVRKSKDTTFGISQKVQRGIQLLLDLVLHPTFEGTPVLFVPDCSFMIDRPMDVWGAPLEVEVLLYASLSSCIELMDLSSKHQVSRLLDQRLLLTRQWVHDLRQFLLKHYWVTSKTMQVLRRRPTEQYGEDQHQNEFNVQPQIVPSWLQDWLENRGGYLIGNIRTGRPDFRFYSLGNSLACMFGVLTAPQQRALFRLVLHNRQHLMAQMPMRICHPPMEVEEWQNKTGSDPKNWPWSYHNGGHWPSILWFFGASILLHEQRYPKADVLLMGQMRSLLEECYWSQLNQLPKQKWAEYFDGPTGTWVGQQSRTYQTWTIVGFLLMHHFLKTSPEDVSMLDLNQ

SEQ ID NO: 78612 - protein, 389 aa, Xanthomonas axonopodis pv. citri str. 306
MPHSIAGAMPSTFHDKNAMTDPHLPSSRRRVILEDDIDGFTPAQLLLLQSPDVEVLGISAVSGNIWRDEVLAHTCRLLELAGHPQIPVLPGPVHPLINSELATERWEALYGKLVWKGAWTKHWVDGDTVQSAPRYHAHDVVPDLALGNPSVVRPSDEPAALFMLRMVRQYPGEVSIIATGPLTNLALAQSLDPAFATLARELVYMGGSLNPRQQRNSVSAQQFAREFINSPRREFNIRWDPEAASIVMRAPWRRITMVPVDPSTATELTAELLARMSAADTTIGHALRRREPGFPMWDELATAVWLRPELARHTETLYVDTNTAFDAGYGDILSWAPGYQPGLGEQAQTVVHAVDVPALEQLLVDRLTAPQPPAVGSPLPLRPSGPRSP

SEQ ID NO: 78613 - protein, 186 aa, Streptococcus pyogenes M1 GAS
MSLIGKEIAEFSAQAYHDGKFITVTNEDVKGKWAVFCFYPADFSFVCPTELGDLQEQYETLKSLGVEVYSVSTDTHFVHKAWHDDSDVVGTITYPMIGDPSHLISQAFEVLGEDGLAQRGTFIVDPDGIIQMMEINADGIGRDASTLIDKIHAAQYVRKHPGEVCPAKWKEGAETLTPSLDLVGKI

SEQ ID NO: 78614 - protein, 327 aa, Photobacterium profundum SS9
MNEVDKPEMGHNDLLIRIKKTAICGTDVHIYNWDEWSQKTIPVPMVVGHEYVGEVVGIGQEVRGFTIGDRVSGEGHITCGHCRNCRGGRTHLCRNTTGVGVNRDGAFAEFLVIPAFNAFKIPAGISDDLASIFDPFGNAVHTALSFDLVGEDVLITGAGPIGIMAAAVAKHVGARHVVITDVNEYRLDLARKMGVTRAVNVANEKLEDVMSELGMTEGFDVGLEMSGVPSAFNGMLASMNHGGKVALLGIPPSDMAVDWTQVIFKGLVIKGIYGREMFETWYKMASLIQSGLDLTPIITHHYKIDDFQKGFDMMRSGMSGKVILDWE

SEQ ID NO: 78615 - protein, 304 aa, Staphylococcus aureus subsp. aureus COL
MITYDLIGNTPLVLLEHYSDDKVKIYAKLEQWNPGGSVKDRLGKYLVEKAIQEGRVRAGQTIVEATAGNTGIGLAIAANRHHLKCKIFAPYGFSEEKINIMIALGAEVSRTSQSEGMHGAQLAARSYAEKYGAVYMNQFESEHNPDTYFHTLGPELTSALQQIDYFVAGIGSGGTFTGTARYLKQHHVQCYAVEPEGSVLNGGPAHAHDTEGIGSEKWPIFLERRLVDGIFTIKDQDAFRNVKSLAINEGLLVGSSSGAALQGALNLKAQLSEGTIVVVFPDGSDRYMSKQIFNYEENNNEQEN

SEQ ID NO: 78616 - protein, 343 aa, Triticum aestivum
MATLTSLASNPNPNKSFEVLPNPGDSLSSLSFSPKSNLLVATSWDNQVRCWEIGNGNSQPKASISHDQPVLCSAWKDDGTTVFSGGCDKQVKMWPLLSGGQAQTVAMHDAPVKEVSWISQMNLLVSGSWDKTLRYWDTRQPNPAHVQQLPDRCYALAVNYPLMIVGTADRNIVIFNLQNPQTEFKRIQSPLKYQTRCVAAFPDQQGFLVGSIEGRVGVHHIDDSQQSKNFTFKCHREGNDIFSVNSLNFHPVHHTFATAGSDGAFNFWDKDSKQRLKAFSRCPQPIPCSSFNNDGSIFAYGVCYDWSRGAENHNPANAKTSIYLHSPQEAEVKGKPRIATGRK

SEQ ID NO: 78617 - protein, 457 aa, Prochlorococcus marinus subsp. marinus str. CCMP1375
MIQGFQIENLRNKVVSGHTRSESWRRAQLKKIKGIIDQNQKEILNALSEDLQKPSTEAFFEILSLRQELQLYENQLSSWMKPQNIKVPLWLKPGEASVIAEPLGCVLIIGAWNYPFMLTLQPLISALAAGNTAILKPSEYSPATSELIEQLFTKYFPPDIVKVCQGDEYFAAELLKHKFDHIFFTGGSETGKKVMSAASKYLTPITLELGGKNPALVLKDANIDITAKRLIWGKSINSGQTCLAPNHLLVHKDIEKELIEKMKYYINSFYGKEPQKSKDLAKINDHQFEKIISLIEKAQKENKIISGGEINSIDKKVSPTLIHIENLEESIISDELFGPIFPILSYSNFDSALNNIRSQEKSLAIYMFGGNEQEKNQLLSSTSSGGVCFNDVVIQAGIPELPFGGIGLSGIGRYHGKAGFETFSHLKSILKRPFWLDLKFRYPPYKIDISFMSKLMR

SEQ ID NO: 78618 - protein, 193 aa, Solanum chilense
FVFAGVGSAIAYGKLTTNAALDPAGLVAIAVCHGFALFVAVSISANISGGHVNPAVTCGLTFGGHITFITGSFYMLAQLTGAAVACFLLKVVTGGCAIPTHGVGAGVSILEGLVMEIIITFGLVYTVFATAADPKKGSLGTIAPIAIGLIVGANILAAGPFSGGSMNPARSFGPAMVSGNFEGFWIYWIGPLV

SEQ ID NO: 78619 - protein, 378 aa, Brassica napus
  misc_feature (36)..(36): Xaa can be any naturally occurring amino acid
EQLSDIIAMTNEDLNKVQYSYNKTAMSLKRVLDEKXNLHEAYANETKKMQQMSILSIQKILNDKERLSNELEKKMQKLSEWSKALDKKEALTELERQKLDEEKKKNDAMNISLQLASHEQKKADESVLRLVEEHKRQKEEALSKILQLETQLDTKQTLEMEIQELKGKLQVMKHLGDDDDEAVKQKMKEMNDELEDKKSELEGLEQMNSALMTKERQSNDEIQAARKKLIAGLTGLLGAETDIGVKRMGELDEKPFLNVCKKRFSEDEATVEAATLCSTWQENLKDSSWQPFRREGTGDKAKEVVDEDDEQLKKLKGEWGEEVHNAVKTALEEMNEYNASGRYTTSELWNFKVGRKATLKEVINFISNDIKTVKRKRT

SEQ ID NO: 78620 - protein, 464 aa, Agrobacterium tumefaciens str. C58
MTEIGFRTPSTDTTGAQPVSKLATARLALSLIRNPLKALPPEIFSEPAVFTRLGGVMRVHLADPVLIHEALVKNAALLGKGEDVRRALGPALGQGLLTADGDHWKWQRQSVAAAFRHEKLLELLPVMIETARRTQKRWRSSSTADIDIGHEMMRTTFDIIVETMMSGGYGIDIARVEQSITDYLKPTGWTFALAMLGAPEWLPHPGRRKSRAAVDYLRASLATVITGRRKNPTDRPDLVSMLLEAKDPETGRMMSDEEIIDNLLTFITAGHETTALGLAWTFHLLSQNPETERKAVEEIEAVTGGEPVAAEHIANLAYVRQVFSEAMRLYPPAPVITRTALQDFRLGEHDIPAGTVLYVPIYAVHRHTALWDEPERFDPSRFEPEKVKARHRYAYMPFGAGPRVCIGNAFAMMEAVAILAVILQKNHLENRTMASAEPLMRVTLRPQERLMMKITQRQNKSPAV

SEQ ID NO: 78621 - protein, 304 aa, Populus trichocarpa
MGSGGGLQYFSIFLLYLSLYSGHPSVAGTPTLESIQKHKIVGDQENRMLISHAVSTTQLDTITGGVPVINPTTPGTTPIVNPVDSPPASTGISPIPTTPPAGINPVDSPPAPIGISPIPTTPPAGIMTPVTPNPPASTNPTSSGGQWCIASTIASQTALQVAIDYACGFGGADCSAIQPGSGCYNPNTLRDHASYAFNSYYQKNPGSTSCVFGGTAQLTNTDPSNGNCHYESSSTTTPSTSSPVNPTPTMTTPATTSFPDGPPAVYGVAEPTGEPSSATSISCSLLLLYSTTAIVGFLVATKHL

SEQ ID NO: 78622 - protein, 249 aa, Guillardia theta
MICSKEEKNSTQGISQQSIDDIILRKTNNTSNNVFFQGKNLHAFDVIRTRGPSTEAQSSVVPFRAVRANEITPNIQNVVSTVSLGIQLDLKRIALKARNAEYNPRRFAAVIMRIRDPKTTALIFSSGKMVVTGAKSEDSARVACKKYARIIQRLGYGHAKFIDFRIQNIVASCDVRFPIRLESLAHAHNQFCSYEPELFPGLIYRMITPKVVLLIFVSGKLVLTGAKQRNDIFQAFSNIYSVLCLYKKT

SEQ ID NO: 78623 - protein, 341 aa, Prochlorococcus marinus subsp. marinus str. CCMP1375
MRIGINGFGRIGRLVLRALWDRENIEITHINDPFGDAKGAAHLLEFDSVHGRWDKSISSDQNKLSIEGHSISFSQESDFTKVQWDETGIELILECSGKFKSPQTLNPYFDTLGMKRVVVACPVKGEIQGEDALNIVYGINHDLYKPNKHRLITAASCTTNCLAPVVKVVNQAFGIKHGSITTLHDLTNTQVIVDSFKPDLRRARSGSQSLIPTTTGSAKAIGMIFPELQGKLNGHAVRVPLLNGSLTDAVFELEKEVTQEEVNHVFKEASEGELKGILGYEEKPLVSIDYVNDSRSSIIDALSTMVVNKTQLKVYIWYDNEWGYSCRMADLVSHVIKLEKE

SEQ ID NO: 78624 - protein, 240 aa, Glycine max
MCSKIVPPRFSFSHDVPELQKQQDVPRKDTMLLESNHDFEFSTSRRSLEFESSSADELFSNGVILPIQMQKKRNTTRKHTLCGEAPYMRLPPLPCTPSSVDKIKKESTREVLDKKAHSASFWGFSRSKSLSCDTKKSLMCYSPPLSRSNSTGSVPQPKRVSSTRQHSAVKPLSSSTDAWVNLYPIQRSHSSKSYGGSYANGLWISPVLNLPTPCISKGSGTSLFGLGSFLRVGKAKKSNK

SEQ ID NO: 78625 - protein, 399 aa, Bacillus cereus ATCC 14579
MDTLIFEVGTALVLVAIAAVIAGKFKFSVIPFLIVLGMLVGPHAPTIGVIDLKFIESASVISFLGRIGVLFLLFYLGLEFSMKKLIKSGRSIAIGGTIYILINFSLGLLYGFIMGFPLLEILIIAGIITISSSAIVAKVLVDLRRTGNNETELILGIIMFEDIFLAVYLSVVSGLVLGDHASFLGALTSIGIALGYMLLFFIVARKATPLLNKLLNISSDEIFIIVVFASLFFIAGFSETIHVAEAIGALLLGLVFSETEHSDRIEHLVVPFRDFFGAIFFFSFGLSIDPFSLGGAIWLTLGAVLLTIIGNFVAGMIAGRQAGLSHKASTNIGLTIVSRGEFSIIMANIGIAGGLMSVLKPFSALYVLILSILGPLLTKESRNVYKFLNKIFKWDTKTN

SEQ ID NO: 78626 - protein, 286 aa, Glycine max
MEREEDVKVGAQKFSERQALGTGAKSDKDYKEAPPAPLFEPGELKSWSFYRAGIAEFVATFLFLYITVLTVMGVNRAPNKCSSVGIQGIAWAFGGMIFALVYCTAGISGGHINPAVTFGLFLARKLSLTRAVFYIVMQCLGAICGAGVVKGFEGNARYELFRGGANFVSHGYTKGDGLGAEIVGTFILVYTVFSATDAKRNARDSHVPILAPLPIGFAVFLVHLATIPITGTGINPARSLGAAIIYNRDHAWDDHWIFWVGPFIGAALAAVYHQIVIRAIPFKTRG

SEQ ID NO: 78627 - protein, 589 aa, Physcomitrella patens subsp. patens
MAALKQAASLWGVRGGTKLGSVSSVSRSASLMSPTSLSATARSYRMVAVRAAVSGGKSVKLAQESSNDETIKSIERVITQDESPKPGFLNGSAVSTETTVSITVVGASGDLAKKKIFPALFALYYENCLPKHFTIYGFARSKMTDEQLRELISGTLTCRIDRRENCGDKQEEFLKRCFYHSGQYSSEDSFSDLSKKLQKEEGERVANRLFYLSIPPDIFVDVARSSSCAASSKNGWTRVIVEKPFGRDAESSSELTKGLKKHLKEDQIYRIDHYLGKELVENLSVLRFSNLVFEPLWSRQYIRNVQFIFSEDFGTEGRGGYFDNYGIIRDIMQNHLLQILALFAMEPPVSLDAEDIRNEKVKVLRSMRKLDIDNVVVGQYKGHTRGGVKYPAYIDDKTVPNNSITPTFAAAALFIDNARWDGVPFLMKAGKALHKRGAEIRVQFRHVPGNLYKRSFGTDLDKATNELVIRVQPDEAIYLKINNKVPGLGMRLDRSNLNLHYAARYNKEIPDAYERLILDAVEGERRLFIRSDELDAAWALFTPLLKELEKRKVAPELYPYGSRGPVGAHYLAAKYNVRWGDNSYEPTEN

SEQ ID NO: 78628 - protein, 309 aa, Triticum aestivum
  misc_feature (175)..(175): Xaa can be any naturally occurring amino acid
  misc_feature (202)..(202): Xaa can be any naturally occurring amino acid
  misc_feature (228)..(228): Xaa can be any naturally occurring amino acid
MAKDIEAAPPGGGYAAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRALLYIIAQCLGAICGVGLVKGFQSAFYVRYGGGANELSSGYSTGTGXLAAEIIGTFVLVYTVFSATDPKRSARXDSHVPVLAPLPIGFAVFMVHLATIPXITGTGINPARSLGAAVIYNNEKAWDDHWIFWVGPFIGAAIAALYHQYVLRASATKFGSSASFRQPLDRPAAVSVMVGGTEL

SEQ ID NO: 78629 - protein, 912 aa, Chlamydomonas reinhardtii
MALQWGSFANAGIKELVAGADPTLNIKEGTLGDRYELQREIGSGSYGQAVLATRLEDGMQVVCKQIRLFEMDDKARADTLTEAKVLAQFNHVNIVHYYECVLESGVLNIVMEYANGGDLAAAIQRRQAEKKPYSEDEIMFWFVQIVLALYHVHGRNVLHRDLKSQNIFIAEGNLLKLGDFGIARVLNSDTELARTVIGSPYYLSPEICEDRPYNRKSDVWSLGCVLYELATLRRAFDGQSLPALVVKILRGKYPPVPTRYSTPLRGLIESMLKQNPKDRPSADAILKSDFVRQHVERYAAHVMALGVGAGGEALGEGEDGAAAAAAALGLAELVAANVRPKPSPPSRATRPGAARPPRAPSTAGALTPASSGAPVSPAPGGSGGDMERGSSREVSEAETGVSTPADGSSPNKPPAAPAGGRRAAGQKLVESGWVRQQQDKLAELAGALAAQKAGGVGAEAAAGAMDATLPSAAVGGGGVSQNTAAKAKLAELKLQRDAELEAQRKANAAAREQKAAAAARRNHEAAVAVRGRAAARQKDIERNLAEQKAEMAAKARKAAALAVAIKQREEARKRELDEAAQHMSAHKEQVKAARARINKEQLSELGAQFAARLASGGGASGAGETSSGQVLVVDFTADQPSSSTPVSKASPAHLRHRSPAHGAPVAGRQSPTPAAKAPRARAAAAAGSDSEGAGPSGRGAQKPAADPPWKLRHKPKGEFPEVQIFTPFGSGAVGSAADTAAAESDAGAGNTEEDDEAGQQAAGVLEVLAQIHTVLEGDDDEGGGGHASARPSSAATADEDEGGTGRPGGAAQAAANALKVEQLRIDLEGQLGGAAFLAAYRCLRDMQAAEEADGEGAAGSSTGGGSGGGAAAGGVGVGGGGTQRELERILGPKLHLVRQVHKLITLEDAVFA

SEQ ID NO: 78630 - protein, 283 aa, Zea mays
MAAAGSSPSFSSSSKRLEGKVALVTGGATGIGEAIVRLFMEHGAKVCIADIQDEAGQQLRDALGGDAQGAMFVHCDVTSEEDVSRAVDAAAERFGALDVMVNNAGVTGTKVTDIRNVDFAEARRVLDVNVHGVFLGMKHAARAMIPRKRGSIVSLASVASAIGGTGPHVYTASKHAVVGLTKSVAAELGRHGVRVNCVSPYAVPTALSMPHLPQGARADDALKDFLAFVGGEANLKGVDAMPEDVAQAVLYLASDEARYVSAVNLMVDGGFTAVNNNLRAFED

SEQ ID NO: 78631 - protein, 278 aa, Methanococcoides burtonii DSM 6242
MSSNIQSSESLLNTKPEEPKLVTNLRGIKNKIMVMSGKGGVGKSTVSANLAAALADRGYSVGLLDSDIHGPTIPKMFGVENEKPMVNEKGIVPVKVNDNLKIMSIGLLLDSNDSPVVWRGPAKMSAIKQFLEEVDWGVLDYLIIDLPPGTGDEPLSISQLIGNLTGAIVVTTPQDVALTSVRKSLNFAKIIKVPVIGMVENMSGIVCPHCDEKIYVFGSGGVAKAAEDFDVKVLGTLPIETEVAAAGDNGHVHIDIKRDSEWYIGFNKVVDAVEEFVK

SEQ ID NO: 78632 - protein, 77 aa, Oryza sativa
MQVSIGQYYEAANREMSQRNQEAIEMSRQQRNIRKKRQKWFWGSVGLAVTLGTAAIAWSYLPAAQPQASQDSNTNSD

SEQ ID NO: 78633 - protein, 325 aa, Anabaena variabilis ATCC 29413
MTSEQIIRRSDILNTQVITRDNGKRLGIVSQVWVDIDQREVVALGLRDSLISISGLPRYMYLSSIHQYGDVILVDNEDVIEDIEVEALSNLINWEVITETGEVLGRVRGFRFEAETGKLNTIVIASLGLPQIPDQFLSTYEISIEEVVSTGPNRLIVFEGAEERVNQLTVGVLERLGIGKAPWERDTEEEYGYSAPRAVAPSNQLPSGVPLQPPKPKVRTPEPVAEEEWTEDYIEEERPQRQVMKARQYESIQYEEDEEDNWSEATGRDRYQPPSQPYSKPYTEDYEDYDDDIEGDAWEDVPPQPVNIPKKVKERQPEYEEEGGY

SEQ ID NO: 78634 - protein, 473 aa, Triticum aestivum
MNGGGGDESGSDHEGSGTRKPLLLKNTGSWYRMVGSSSRQIVGASSMAVLRESHVSALLCTLIVALGPIQFGFTCGFSSPTQDAMIRDLGLSISQFSAFGSLSNVGAMVGAIASGQMAEHIGRKGSLMIAAIPNIIGWLAISFANDSSFLYMGRLLEGFGVGVISYTVPVYIAEISPQNKRGALGSVNQLSVTLGIVLAYVLGMFVPWRMLALIGTLPCTILIPGLFFIPESPRWLAKMNKMDDFEASLQVLRGSETDITSEVNDIKTAVASANKMTAIRFQELNQKKFRMPLILGIGLLVLQQLSGINAILFYAGSIFKAAGLTNSNLAACGLGAIRVLATGVTTWLLDRAGRRILLIISSAGTTLSLLAVAVIFFLKDTVSQDSHMYYILSMVSLLAIVAYVIAFSFGMGAIPWVIMSEILPVSIKSLAGSFATLANWLTSFGITMTANLLLSWSAGGTFVSYMLVSAFTL

SEQ ID NO: 78635 - protein, 191 aa, Carboxydothermus hydrogenoformans Z-2901
MLLLIDNYDSFTYNLVQYFQMLGEAVTVYRNDKITVEEIRALNPDYIVISPGPCTPNEAGISLEVIKNLYRYPILGVCLGHQAIGQVFGGKVVRAARPMHGKTSPIYHDGKTIFKGIPSPFLATRYHSLIVELPEETELIVSAKTAEGEIMGLRHKDYPVEGVQFHPEAILTEYGLLLLKNFLEVYRKGVE

SEQ ID NO: 78636 - protein, 504 aa, Streptomyces avermitilis MA-4680
MAQSTRTVIPKGFRSAELGWPELHRIPHPPHRLPVVGDVLGVNVRTPVQDSLRIGRRLGPVFRRKAFGKEIVFVGGADLAAELADESRFAKHVGLGVANLRPVAGDGLFTAYNHEPNWQLGHDVLAPGFSREAMAGYHPMMLAVTERLIDHWDREQTAGRAVDVPGDMTKLTLETIARTGFGHDFGSFERARPHPFVTAMVGTLTYAQRRNVVPEPLAPLLLRTATRRNAADLAYLNRTVDALVRARRTTSGEGDLLDRMLDTARPGTGERLAPENIRRQVITFLVAGHETTSGALSFALHYLSRHPDVAARARAEVDRVWGGTARPGYDQVAKLRYVRRVLDESLRLWPTAPAFAREARRDTVLGGVHPMREGAWALVLTAMLHRDPGVWGADAERFDPDRFDAQAVRSRAAHTFKPFGTGARACIGRQFALHEATLVLGLLLRRYELRAEPGYRLRVAERLTLMPEGLRLRLDRRVPAVEDVPVANPEVSSGPRCPVTGAGE

SEQ ID NO: 78637 - protein, 458 aa, Leptospira interrogans serovar Lai str. 56601
MAKIAEMTQLSPTMAEGKIVRWLKQKGDPVSPGEIIAEVETDKAVMEMEAFETGILLEILAPEGTLLPVGAPVAIIGKQGEDVSALVETAKKSIPAKKESSITQGQAPTSTQNATSQSSTTSGANTVKNLTTKASDASSQNTESNGLTTHEERSLKTQIPFDSEDSPIRSARGGRSIKASPLAKNLALQKGVDLGEVIGSGPGGRIIKRDLLAYQESGSVKKSTFVKRQDRKLEITGMRKTIASRLAHSTSTIPHFYLTLELDATPLDTLRNSYNKDLKLEGSSKISLNDLIIKACSLSLKEVPEVNSSWREDHILEHGRIDIGVAVSIEGGLITPYIRNADQKSVSEIGREIKELASRARERKLKPAEYTDGTFTVSNLGMFGISSFTAVINEPEAAILAVGALVEKPVLKEGSIVVGKTLNVTLSCDHRVVDGATGARFLSSFRDYTEYPLRLLTG

SEQ ID NO: 78638 - protein, 447 aa, Streptococcus pyogenes M1 GAS
MASNHMNEQEREQAKFSLSGATLYGINAVIGSGIFLLPRAIYKGLGPASIAVMFGTAILTIMLAVCFAEVSGYFGKNGGAFQYSKRAFGDFIGFNVGFLGWTVTIFAWAAMAAGFARMFIITFPAFEGWHIPLSIGLIILLSLMNIAGLKTSKIVTITATIAKLIPIVAFCACTLFFIKNGLPNFTPFVQLEPGTNLLGAISNTAVYIFYGFIGFETLSIVAGEMRDPEKNVPRALLGSISIVSVLYMLIIGGTIAMLGSQIMMTNAPVQDAFVKMIGPAGAWMVSIGALISITGLNMGESIMVPRYGAAIADEGLLPAAIAKQNQNGAPLVAILVSGAIAIVLLLTGSFESLAKLSVVFRFFQYIPTALAVMKLRKDDPDANVIFRVPFGPIIPILAVIVSLVMIWGDNPMNFVYGAVGVIIASSVYYLMHGRNHQMDQMPPKEQI

SEQ ID NO: 78639 - protein, 469 aa, Oryza sativa
MVSAAAAASSLRCFPPSLGNRGPGAATARGGLVRLSSRRARSTAGVAAPSREAESAASLGDLTRVDFPILDQEFDGSKLVYFDNGATSQKPSCVMKTLDEYYRFYNSNVHRGIHVLSAKATDAYESARTKVANFVNAANSREIVFTRNATEAINLVAYSWGMSNLKQGDEIVLTIAEHHSAIVPWQFVSQKTGATLKYVGLTKEGVPDIEQLKGLLSNKTKIVVVHHVSNVLGSMLPIEDIVTWSNRIGAKVLVDACQSVPHMPVNVQRLGADFLVASSHKMCGPTGVGFLHGKFDLLSSMEPFLGGGEMIADVFQDKSTYAEPPSRFEAGTPAIGEAIGLGTAIDYLSQIGMQKIHEYENELATYLYESLIAVPNVRIYGPAPCQTVHRAPLCSFNVENVHPTDIAEILDLQHGVAIRSGHHCAQILHRTLGINASARASLHFYNTKEEVDVFVDALKDTIDFLTSEH

SEQ ID NO: 78640 - protein, 396 aa, Lactococcus lactis subsp. lactis
MRNKYVNTSNETRSHRKFIALFGDGAKANYFSPGQINLIGEHTDYNGGYVFPAAISIGTFGVARKRTDSLVKVYSLNFETVGVIAFSLENELVNTPEANWGNFVKGYLLKLKEAGHAIQTGFELVIEGTIPNGSGLSSSASLELLVGTVVNDLYHLGLDKLTLVQLGQKVENEFIGVNSGIMDQFAIGFGEIGKAILLDTNTLKYELVPAEFGDYKIVIMNTNKRRELADSKYNERRAECEEALKRLQTKLEITALGQLTPTEFEENRALIGDVTLEKRAKHAVYENERTKLAKTCLEAGELQAFGQLLNASHESLKNDYEVTGIELDTLAETAQGLSGVLGARMTGAGFGGCGIALVATSEIETFITKLSATYLEKIGYAASFYVATIADGARKL

SEQ ID NO: 78641 - protein, 398 aa, Methanothermobacter marburgensis str. Marburg
MILNIRLDHKTSDVKTMETASGRIEEIVGELEALGAVTEKVPLMTCNRVEYYLHVTGVPPEFDFNGFTVEKDEDALLHLLRLASGLESMIIGEDQILGQIKAARLQALREGTCGPLLDMVFTKAVHVGQTVRRKTKINRGSVSIGSAAVDLAESIHGDLKCKKVLVIGAGKMGTLVARALAEKHLKAIMVANRTYERAYQLACELGGDAIHFDRLNRALRDADVVISATGSPHYILTRERVMDAVPPERRSSIVMVDIANPRDIEESVRELGVRLFTIDDLRGVAEENRKRREAEAREAEGIVRAELELLLRAMKHREVEPLLAEIRGRMESLRQREAGKAIKKIENSKDPERVVEGLTRSIVDKIFHDIALKIRDAAERDDREFLRMCSELFDCDES

SEQ ID NO: 78642 - protein, 550 aa, Triticum aestivum
  misc_feature (125)..(125): Xaa can be any naturally occurring amino acid
MATAAPGQLNLDDYPSWGSRGVDCFEKLEQIGEGTYGQVFMAKETETKEIVALKKIRMDNEREGFPITAIREIKILKKLHHQNVIQLKEIVTSPGPDRDEQGKQSTVLFKNDISVSDSSLKKLKXMVRCLVLPFDLSCCCSIVDGNKYKGSIYMVFEYMDHDLTGLADKPGMRFTIPQIKCYMKQLLTGLHYCHINQVLHRDIKGSNLLIDNEGNLKLADFGLARSFSSDHNANLTNRVITLWYRPPELLLGSTKYGPAVDMWSVGCIFAELLNGKPILPGKNEPDQLTKIFELCGTPDELIWPGVTKMPWYNNLKPPRQLKRHVKDAFKHFDFHALDLLERMLTLDPSKRISANEALDSEYFWTDPLPCDPKSLPKYEASHEYQTKKRRQQQRQADDAAAKRQKTHHSQPPHARLPPIQQSGHQIRPAQPTNNPHPPMASGSNHHYGKPRGPGGPNRYPPGGNQGGGGYPNRGGQGGGYGSGPYPPQQGRGPPPYPGGGPRGGGSSGGYGGAPNFPQAGPYGPGGPGRGPNYPPQAGSRNQQQQYGNWQ

SEQ ID NO: 78643 - protein, 362 aa, Carboxydothermus hydrogenoformans Z-2901
MEIGIVGLPNVGKSTLFNAITKAKAEAANYPFCTIEPNVGVVEVPDPRVDKIAEVVKPERVVRAVTRFVDIAGLVRGASRGEGLGNKFLSHIRQVDGIAHVVRCFTDPNVTHVEGSVDPARDIDTINTELILADLETAQRRLERAEKVAKSGEKRGKIEAEMLKRIIDGFDRGLPVRAHEFSDEEKEILREIGFITAKPVVYVANVGEKDLLSPPKEVDIVREIAAKENAEVVVLSAKIESELQELPEDERALFLEDLGIEEPGLNKLIRTGYALLGLITFFTAGPQEVKAWTIKRGTKAPQAAGKIHSDIERGFIRAEVIPWEELIEVGSMTAAREKGLIRLEGKDYVVQDGDVIYFRFNV

SEQ ID NO: 78644 - protein, 426 aa, Xanthomonas campestris pv. phaseoli
MTLWVLGLNHQTAPVDLRERAAFAGDALPRALESLRALPQVSEAALLSTCNRTELYAMAEEAHSLVTWLETHAPALSGYLYQHQEAEAVRHLFRVATGLDSMVLGEPQILGQVKDAWAVARAHGTLGSGLDRLFQQTFSVAKRARTDTRVGANPVSVASTAVRLAQDSFARLNESTVLLIGAGETIELAAKHLSEGRVRRLLIANRTLAHAQTLASQHGGFALPLTDLERHLAEADVVFSATAAREPLVTRAQVEQALRARKRKPMLLFDLAVPRDIEASVGELSDAYLYTVDDLERAVEDNRRGRREAADQAEAIIDLQVARYVETLQANARQAPLKRLRAFGDSTRDELLAKARQQLHNGKPADEVLEQLAHALTNRLLHPPTAALRDAALNNDLELTTAADRLFPEKPGLPTSPHSYPDREDR

SEQ ID NO: 78645 - protein, 383 aa, Crocosphaera watsonii WH 8501
MQDKHMLMIPGPTPVPESVLLAMAKHPIGHRSGDFSQIIGEITENLKWLHQTQNDVLMLTTSGTGAMEAGIINFLSAGDRVLVGNNGKFGERWGKISRAFGLEVEEITAEWGKPLDPEAFKTKLEADTDKSIKAVIITHSETSTGVLNDLQTINSYVKAHGEALIMVDAVTSLGAVNVPMDEWGLDMVASGSQKGYMIPPGLGFVAVGPKAWKAYETATLPKFYLDLGAYKKATDKSSSPFTPPVNLMYGLQVALEMMKAEGLEAMFTRHQRLTQATRAAVKGLGLSPFAADEVASYAVTAVMPSTVEAEAIRSTMKKEFDIALAGGQDHLKGKIFRIGHLGFVSERDVLTAIAALEATLQKLGHQGATSGAGIAAASQVFKS

SEQ ID NO: 78646 - protein, 221 aa, Thermoplasma acidophilum DSM 1728
MSEEWVPKTQLGKLVASGQIKTMGEALRSKLPLKEYEIVDYLLPNLKDEVIDIKRAQRMTDSGRRMTYSITVVVGNGDGYVGLGIGRSKEAAPAIRKALINAKLNIMEIRRGCGSWECGCGRAHTLPFLVQGKSGSVRITLKPAPRGVGLAVGDVARTILSIAGIEDAWGFAAGHTKTTVNYALAVYNALKETSKVRINPGIVLSTPIYSGSVVNVSGHKD

SEQ ID NO: 78647 - protein, 547 aa, Triticum aestivum
  misc_feature (510)..(510): Xaa can be any naturally occurring amino acid
MGLDLGALALKYTGLAVSDHDSIVAINIFIALLCGCIVFGHLLEGNRWVNESTTALVLGLITGGVILICTKGVNSRILIFSEDIFFIYLLPPIIFNAGFQVKKKQFFRNFATIILFGAAGTLISFVIITFGAMGLFSKLDVGPLELGDYLAIGAIFSATDSVCTLQVLNQDEAPLLYSLVFGEGVVNDATSVVLFNAIQNIDINHFDVFVLLQFIGKFLYLFFTSTVLGVAAGLLSAYIIKKLCFARHSTDREVAIMILMAYLSYMLSMLLDLSGILTVFFCGIVMSHYTWHNVTESSRVTTKHTFATLSFIAEIFLFLYVGMDALDIDKWKLASSSPKKPIALSAVILGLVMVGRAAFVFPLSFLSNLSKKESHPKISFNQQVIIWWAGLMRGAVSIALAYNKFTTSGHTAVRVNAVMITSTIIVVLFSTMVFGLLTKPLINLLIPPRPGTAADISSQSFLDPLTASLLGSDFDVGQLTPQTNLQYLLTMPTRSVHRVWRKFDDKFMRXPMFGGRGFVPFVPGSPIERSVHGPGLLGTVTEAEDRS

SEQ ID NO: 78648 - protein, 540 aa, Prochlorococcus marinus subsp. marinus str. CCMP1375
MPNKSSATSMRSGHIAPVVLTILDGWGHREENINNAINNADTPVMDALWQAYPHTLIEASGADVGLPDNQMGNSEVGHLTIGAGRIIQQELVRISNTIRSKKLDQITNLSNLANKLIETDKTLHLVGLCSDGGVHSHINHLCGLLEWAKNKGIQKVAVHAFTDGRDTPAKSSLQYLKIIKEKFEVLGIGELATLCGRYWSMDRDNRWERIEKAYELLTNPNYPLSELSSDEIITNSYDSSITDEFLEPIRLTPSYLKDGDGLIMFNFRPDRARQLIKSITLPSFSEFKRKYQPQLNVVTLTQYEMDLPVSVVFPPESLDNLLGQVISEHGLLQYRTAETEKYPHVTYFFNGGIEQPLPGEKRHLVPSPRVATYDLSPEMSAEKLTKSCQEAIESGIYSLIVINYANPDMVGHTGIHAATKKAISTVDKCIGKILDSTGKMSGTLLITADHGNAELMKGPDGEPWTAHTTNPVPVILIEGEKRKISGQGNQIRLREGGGLADIAPTLLEVLSLPKPDAMTGSSLIETIQTNSKTNLVQQHV

SEQ ID NO: 78649 - protein, 178 aa, Vibrio campbellii AND4
MSLNNVPAGKSLPEDIYVVIEIPANADPIKYEVDKDSGAVFVDRFMSAPMFYPCNYGYVNDTLSLDGDPVDVLVPTPYPLMPGSVIRCRPVGVLKMTDESGEDAKVFAVPHSKISTEYEHIQDVGDIPRLLKAQITQFFERYKELEAGKWVQVDGWEDVAAAKAEILESYQRAQNKKS

SEQ ID NO: 78650 - protein, 338 aa, Vibrio campbellii AND4
MSGLRTLGEFIVEKQADFPHANGDLSSLLASIRLAAKIVNREINAAGLGDITGAVGTENVQGEDQQKLDVYANDKFKAALEARDQVCGVASEEEDEAVAFNKELNQNAKYVVLMDPLDGSSNIDVNVSVGTIFSIYRRVSPIGTIPTEEDFLQPGHKQVAAGYVIYGSSTMLVYTTGNGVNGFTYDPSIGSFCLSHENMMIPEDGKIYSINEGNYIRFPLGVKKYIKYCQENVPEDGRPYTSRYIGSLVADFHRNLLKGGIYLYPSTQSHPQGKLRLLYECNPMAFLIEQAGGLASDGVNRILDLKPTELHQRVPFFVGSKNMVNKVEAFLELNREED

SEQ ID NO: 78651 - protein, 181 aa, Brassica napus
MASSMLSSAAVVTSPAQATMVAPFTGLKSSSAFPVTRKANNDITSIVSNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 78652 - protein, 183 aa, Hevea brasiliensis
MASSMLSTAAVACINRASPAQASMVAPFTGLKSTSAFPTTRKTTTDITSIASNGGRVQCMQVWPPRGKKFYETLSYLPPLTREQLAKEVEYLLRKGWVPCLEFELEHGTVYREYHRSPGYYDGRYWTMWKLPMFGCTDAVQVLQELDEMIKAYPDCYGRIIGFDNVRQVQCISFLAYKPKGAE

SEQ ID NO: 78653 - protein, 279 aa, Bacillus cereus ATCC 14579
MKNLQSKAVLNNGVEMPWFGLGVFKVEEGPELVEAVKSAIKAGYRSIDTAAIYGNEKAVGEGIRAGIEATGIAREELFITSKVWNADQGYETTIAAYEESLKKLGLDYLDLYLVHWPSEGKYKDTWRALETLYKEKRVRAIGVSNFQIHHLQDVMKDAEIKPMINQVEYHPRLTQKELQAFCKEQGIQMEAWSPLMQGQLLDNETLQEIAEKHGKTTAQVILRWDLQNGVITIPKSTKEHRIIANADVFNFELTKEDMEKIDALNQNHRVGPDPDNFDF

SEQ ID NO: 78654 - protein, 586 aa, Mesorhizobium loti MAFF303099
MSSHFRAFAPTRHSHRRPLDSAAALRKIGCGEGIRCDHNLPISTPMPSPAGLPHEPRTMTRLADRLLAVLLMALAAACLVHLYLLPGGKDFGLTAMREPWATQLVAFSLLAFACLAGAVLFWAGLLPGRPAHLTGAPLFGRAAEVQETGRPGLRKIFLALPLIVLAALAVDRFGPWGGGEVTARPNEPKMAEPKPSEPKPDEPKLTEPKPAEPKGQDVASAPPAPVPAPAPQPAPPPIAANPPPVAVPAAPPVAMPPAPVAPPEVAVIPPPTVAPLPPPPPAAPTQPDGHRDAVVWLAVAPDGRSIMSASTDRVIKLWDIGGKQLIRNLGVHKDMARTALYMPDGVSALTGGDDGEIVLRKLADGAVLHVFQAGQNGGVNKLAISPDGKRAVSGHDTGNVIVWDLVNNSVLHVLTGHDWSISAVAVSPDGKQALSGSIDGTLKLWDIESGKQLRSWHGHEQGTYGAVFTADAHRLITGSGDLTIKVWDLDSGREVKRFEGHEGTVYALALSADGKRLLSGSLDGTARLWDMETGNQIALFDSQTGPIYAVAFAPDGTVLTGGYDRTIRDWPAAGGDGVVLFAGAPG

SEQ ID NO: 78655 - protein, 548 aa, Ustilago maydis 521
MSKSDLPQWGRVLVAGGIDWPTLGRKATKSGPPLTVNPDHPDLPAPHILRSVSNVRMKRVFSSHSSCHAVLLSVDGNAYIIGRNEQGQCGLPIRPIPASSKPSGPAVWDAYLLDHATDFSPALPTGANGQIVYAACGRSHTLLLTASGSVYSAGLNTSGQCGHPESQTVPIFTRIETAPFIKERDAIVAASCGLTFSMLLTQSGKVYTMGSSEKGQLGNGRTGEHFTSSNRLAFNTFSEPFLVKQLADKKIVHIACGQQHTIALDDQGFVYVWGFGGYGRLGLGSQQDQLVPTLVPQFARENVVMRAKAIYAGPTNSAVVDGQSMFWLAGKWKTSGDGSAGQGFMTFKYLPDMMGVKVTNVGLGGVTLLCTAIEEPSLSGDHGATMNICWGQNANCGELGLGEGKPRSATKPLRCETLDGIAIIDIAAAQNTTFYLARNMGERYGELPRWPEVVPSQEVCMVCGKEEGEGGDDNALLECEKCENPWHLHCLQPKLTEIPEGEWHCPNCQPPAPQTDTNGNSSNNSNNSNKRGNEDDDEQASQTKKRRA

SEQ ID NO: 78656 - protein, 182 aa, Arabidopsis thaliana
MSENEVKDPRIDGIKTKIRVVPDFPKKGIMFQDITTLLLDPKAFKDTIDLFVERYRDMNISVVAGIEARGFIFGSPIALAIGAKFVPLRKPKKLPGQIIFEEYELEYGSDRLEMHVEAVDSGDRALVVDDLIATGGTLCAAMNLLKRVGAEVIECACVIELPELKGRERLEGKPLYVLVEYR

SEQ ID NO: 78657 - protein, 458 aa, Bacillus pumilus SAFR-032
MKVVKFGGSSLASGKQLQKVFDIVTADPARKAVVVSAPGKRHSTDTKVTDLLISCGEQYLRLGEAHDLQEAVIERYASIADELGLSHDVIDTIRQDLDSLLQADTSHPERYLDAIKASGEDNNAKLIAAYFRYQGVEAHYVNPKEAGLFVSDEPGQAQVLPESYDHLYKLRERSGIIIFPGFFGFSLSGDIVTFSRSGSDITGSILANGLKADVYENFTDVDAVYAVNPTIVHEPKEITELTYREMRELSYAGFSVFHDEALIPAFRAGIPVQIKNTNNPSAKGTKIVNQRDHTNGPVVGIASDSGFCSIYISKYLMNREVGFGRKVLQTLEEYGLTYEHVPSGIDDMNIILRQDQLEEQHIEQELLDRLKLVLDADEVVLEPNLSLIMIVGEAMRHNVGTTARAAKALSKAKVNIEMINQGSSEVSMMFGVKAAQEKEAVQALYEEFFSMSTVPVSL

SEQ ID NO: 78658 - protein, 192 aa, Kluyveromyces lactis NRRL Y-1140
MFATTLKSARIANLAPVQRLFSSSAYLLRTKVFFDTSINGNKMDRIEFELYDDIVPKTAENFRALCTGEKGFGYKGVPFHRIIPNFMLQGGDTDLTNGYGGKSIYGNKFADENFQEKHTKPGLLSMANAGPNTNGSQFFITTVPCPWLDGKHVVFGEVTDGLSTVKTIESFGTVSGRPRAKIVIEECGELKD

SEQ ID NO: 78659 - protein, 164 aa, Carboxydothermus hydrogenoformans Z-2901
MKHTLSVLVLNKPGVLARISGLLSRRMFNIESITAGYSEEPNITRITIVVQGDDLVLEQVINQLSKLIDVIKIKELPMEETIARELALIKVRALPEKRADIVNIVNIFRANIVDVNRETMVIELTGDEDKINALCEVLTDHGIVEIVRTGKVALNRGPRPAKEL

SEQ ID NO: 78660 - protein, 207 aa, Prochlorococcus marinus subsp. marinus str. CCMP1375
MHFKSFLNSLPNGVKLVAVSKGQSTSQIRSLASQGQVDFGESRLQEALPKLNSLKDLKTVRWHFIGSLQANKVRQVVKAFDVIHSIDSLKLAKRISRISAEECKKPRVMAQVKFRNDPSKFGFTPDGLLEVWNEFIALPNIDVIGLMTISPKELDLNQRKILFRECRVFSEKLGLKDCSMGMSQDWKEAVEEGATWIRVGSLLFGGR

SEQ ID NO: 78661 - protein, 275 aa, Prochlorococcus marinus subsp. marinus str. CCMP1375
MACSLGVIGLGRMAQVILQSLFEAGQFNPEEVFGVVGKKNSVERVLHQFKSPFTVVDVNDKNAIDVWNTPVKILAVKPQQLNQVQEKCSKEFLAKLPAKPLLISILAGVKLKRLQSLFPDHVCVRAVPNTPALVSAGLTGLSWGEEVTEDQKSLVESIFKPISQVFELPEDQLDAFLALTSSGPAYLALISEALADGAVAAGLPRALAQSLTNFTLEGTAILLKKKELHPGQLKDMVASPAGTTISALRHLEKEGVRSALIEAVILAAKKSREMA

SEQ ID NO: 78662 - protein, 396 aa, Crocosphaera watsonii WH 8501
MENLYQILAIIAAFTFIYSIFAGVLESISISDAMVYVVFGFLSGQNGLNILPLDIESEGVRLLAELTLALVLFSDASGADLKILKSSLSLPSRLLLIGLPITIIFGVGVGKLLFPNVSWLEVGILATMLAPTDAALGKAVVSNPKVPAQIRQVLNVESGLNDGICVPILFVLLAIVIPGNMEGSISDLVVHLFVEEIGIGALVGASIAVLGAQLGSFAVRKNWVTKTWRQISLPAIAFTCFATAQSLGGSGFIASFVGGLFFGSIIKVYKDEMIEVSEGIGNAMSLITWVIFGVTVVGKYMGQLTLPIILYSILSLTIVRILPVFLCLFGVTLDLESKLFMGWFGPRGLASIVFAVIVLNSNLPSGDILTTTVTCTVLLSIIAHGLTANPWANRYG

SEQ ID NO: 78663 - protein, 273 aa, Wolbachia endosymbiont strain TRS of Brugia malayi
MHLFCFGYGYVARFLSKKLLSLSWKVSGTSRNQDVHNTNFFNYDKVNKDTFQDVTHVLVSIPPDGDDALERYGHYFQNTKWLGYLSAASVYGDHAGNWVKEESETKPIESRGKSRLRAEKKWLNSKLPVHIFRLTGIYGPGRNVLVDLQLNKARNVQKEGHFFSRIHVEDISNILFSSMQNIKPGEIYNCADDLPATQSEVVAYAAELLNVSVPEPVEISSLPDHAQSFYLGSKKVSNIKVKRDLGISLVYPNYKVGLENLISNQQAPIERGE

SEQ ID NO: 78664 - protein, 144 aa, Vitis vinifera
MASNPSPAFAYVVLYVKDVAKSTAFYAKAFGCNVRRLDESHRWGELESGKTTIAFTPVHQRETDRITGAVQDPWSGRERPPVELCFAYVDVDAAYKRAVENGAMSVSEPEEKEWGQKVGYVRDIDGIVVRMGSHVSPPKQYHQD

SEQ ID NO: 78665 - protein, 455 aa, Kineococcus radiotolerans SRS30216
MAAGGRHPEVSKGWCGALVLERRLHNMTSVEQSIQNPAVDPSLLRTSVAAPIAPPPRLLMGPGPITVDPRVLRAMSAQLVGQYDPAMTAYMNETQALYRAVFRTTNAATLLVDGTSRAGIEAALVSLIVPGDRVLVPVFGRFGHLLREIAERCGADVHVREVPWGQVFTLEALEDAVREVQPKLVALVQGDTSTTMNQPLEGVGRMCHRHGALLYVDCTASLAGNPFEMDAWEVDVATAGLQKCLGGPSGSAPISLSPRAVAVIEARRSVEAGLRADPASAEDTAPAGLRIRSNYFDLAMILDYWGEERLNHHTEATTMLYGARECARLVLEEGLDATVARHRRHGEAMLAGVRGLGLAVFGDVEHKMHNVVAVEIPSGIDGDAVRAELLHDYGIEIGTSFGPLAGRVWRIGTMGYNARKDAVLVTLAALEQVLRRHGAPVEAGAGTAAAQEVYA

SEQ ID NO: 78666 - protein, 249 aa, Oryza sativa Japonica Group
MVGSGAAGGGGGGGGGGDHARSKEAAGMMALHEALRNVCLNSDWTYSVFWTIRPRPRCRGGNGCKVGDDNGSLMLMWEDGFCRPRVAECLEDIDGEDPVRKAFSKMSIQLYNYGEGLMGKVASDKCHKWVFKEPSECEPNIANYWQSSFDALPPEWTDQFASGIQTIAVIQAGHGLLQLGSCKIIPEDLHFVLRMRHMFESLGYQSGFFLSQLFSSSRGTSPSPSSFPLKRRRRRRTRGTAARRTWRST

SEQ ID NO: 78667 - protein, 341 aa, Streptomyces albus
MHRVFGERFPEPSPHGGGSAEQRGSAMPRKIILDCDPGHDDAIAMLLAHGNPDVELVAVTTVVGNQTLEKVTRNALSVARIANITGVPFAAGCSRPLIRTVETAPDIHGESGIDGPVMPEPTLALDDRHAVDLIIETVMAHEPGEITIVPTAGLTNIALAARKEPRIVERVREVVLMGGGYHTGNWSPVAEFNIKIDPEAAHIVFNEPWPVTMVGLDLTHQALATPEVVERIAKVGTGPAVFVTELLDFFGAMYLQAQGFDAPPVHDPCAVAYVIDPDVMTVRKAPVDIELTGTLTLGMTVTDLRAPAPADCHTQVAVDLDHQRFWDLVVDAVERIGDVRA

SEQ ID NO: 78668 - protein, 62 aa, Vitis vinifera
MRKFDPWPVFFRREWNRNWPFLVGFAVTGIIITVYSLSLTEEDAKKSPFVQRHERRYLSKLL

SEQ ID NO: 78669 - protein, 374 aa, Triticum aestivum
  misc_feature (151)..(151): Xaa can be any naturally occurring amino acid
  misc_feature (314)..(314): Xaa can be any naturally occurring amino acid
  misc_feature (352)..(352): Xaa can be any naturally occurring amino acid
MSAFVGKYADELIKTAKYIATPGKGILAADESTGTIGKRLASINVENVESNRQALREMLFTAPGALEYLSGVILFEETLYQTAADGTPFVDILKAGNVIPGIKVDKGTVDIAGTVGETTTQGLDSLGARCAKYYEAGARFAKWRAVLKIGXAPEPSELAVKQNAEGLARYALICQENGLVPIVEPEILTDGPHDIKACAAATERVLAAVYKSLNDHKVLLEGTLLKPNMVTPGSDSPKVGAEVIAEYTVAALRRTVPPAVPGVVFLSGGQSEEQATQNLDAMNKLAVLKPWTLTFSFGRALQQSTIKKWAGKKXENVADAQATFLARCKGNSEATLGKYGGAAAGGDAAASXESLHVAGYQVLKAPSLPRHSRT

SEQ ID NO: 78670 - protein, 226 aa, Zea mays
MDHEKVAPIDEKAPHGVSQPTVSSQEEYTGDWREQEDFMTRNGLNLKSFQRRPKGGELVVLDKSMKTRHLHMIAIGGSIGAGFFVGSGAALAKGGPASLLLDFSIMGVMIFNVVYALGELAVMYPVSGGFYTYSTRFIDPSWGFAMGWNYVFQWAIVLPLEINVAAITLEYWPGARNVHVAVWMLIFWLFIVIINVFGTLGYAEEKFWSSLLKLSATVIFMIIALV

SEQ ID NO: 78671 - protein, 243 aa, Oryza sativa Indica Group
MRKRERENPCGICGHYHKYELGEVCGVCGHRPPASAGAQAAAGAAQAAAPRQDSAFPSEILKDFLFLGSYDNASRSELLKNIGILPHPQSVLIVEGDERQCCLRSAAFVIAFLMKTKGWRLSQCFQWVKERRPQVQLADAAQRQLIEYEQKLFNSTVGIPAQAFVPTDAFPSLGFGFPKPSGDIQVPIFNQQAPASIFERVSPHNIPSNFTFGAERTTEVKLPDNNSFGVVNSSGGDSMMDSS

SEQ ID NO: 78672 - protein, 269 aa, Zea mays
MKMATMTAYKYQAQALMRDYLLADLLVPYTSVLFGIVLCKVAYDFTRILSSFYFKGYTLLTKIQRIEWNNRGMSSAHAIFITAVSLYIVTSTDLFSDCVKGPITFRNSIISTSALGVSVGYFITDLEMIFWLYPSLGGMEYVLHHTLSLVAIAYTMLSGEGQFYTYMVLISETTTPEINLRWFLDTAGLKKSSAYLVNGILMFVAWLVARIFLFMYVFYHIYLHYSQIMQMHAFGYYLTFVVPSVLFVMNTMWFMKILKGVMKTLAKWS

SEQ ID NO: 78673 - protein, 401 aa, Guillardia theta
MQEDMEYNIRFVGSYILDKTLGVGATGKVKLAKHSRTKEKVGVKIIKKDLFYDKPSLRLKIQREISVMKLMFHPHVIKIYDVLEDSKYLFLIIEYASKGELFNYLVEKRKLENREALKFFHEIISGLEYCHKHRICHRDLKLENILLDMKLQIKIADFGMASLSIPNIMLKTFCGSPHYASPEVVSNEPYNGIKADIWSCGIILYALVVGKLPYDEENDNMRKLFNKIRFEPPRIPRIIHPDCRDLIRALLTINPQKRITIDKIKKHPWYKSSPLPESCRISIQNLSFASVQNPISNPDPEIISFLLPLQLVKDKKTLCGILSTKKPSFLRVLYRQLEWRKMKMDSVRSNLINEANFKRKKLFKQGKLGNITGLKYWKNLKCKFLSINIKSFVRTGIYIYF

SEQ ID NO: 78674 - protein, 257 aa, Helicobacter pylori 26695
MEILQFIGYGNMAQAILEGAHEILSKRFILEITGRNPEKIAPFLQEKNIQAQIVPYKDAIDIHQKFVFLLFKPYNLKDFNYQGQAKSVLSALAGVGFKALSDAIDSLHYLKCMPNIASKFALSSTAVCEKSPMPLISQKALSVIESFGNCVRVGHEELVDASVATNGSALAFLSLVANSLKDAGIREGLNARGSLELVKMSFKGFAKLLEKERPEMIIEQICTPKGATIEGLSVLEKKGVRGAFIEACHKSVKKMRL

SEQ ID NO: 78675 - protein, 563 aa, Bacillus subtilis
MSYQALYRVFRPQRFEDVVGQEHITKTLQNALLQKKFSHAYLFSGPRGTGKTSAAKIFAKAVNCEHAPVDEPCNECAACKGITNGSISDVIEIDAASNNGVDEIRDIRDKVKFAPSAVTYKVYIIDEVHMLSIGAFNALLKTLEEPPEHCIFILATTEPHKIPLTIISRCQRFDFKRITSQAIVGRMNKIVDAEQLQVEEGSLEIIASAAHGGMRDALSLLDQAISFSGDILKVEDALLITGAVSQLYIGKLAKSLHDKNVSDALETLNELLQQGKDPAKLIEDMIFYFRDMLLYKTAPGLEGVLEKVKVDETFRELSEQIPAQALYEMIDILNKSHQEMKWTNHPRIFFEVAVVKICQTSHQSAADLPEVDMLMKKIQQLEQEVERLKTTGIKAAAESPKKEAPRVPKGGKSNYKAPVGRIHEILKEATRPDLDLLRNSWGKLLAHLKQQNKVSHAALLNDSEPVAAGSAAFVLKFKYEIHCKMVAEDNNGVRTNLEQILESMLGKRMDLIGVPEAQWGKIREEFLEDHQQANEGSNEPAEEDPLIAEAKKLVGADLIEIKD

SEQ ID NO: 78676 - protein, 638 aa, Rhizobium leguminosarum bv. viciae 3841
MTQLPKTPLLDQVIYPADLRKLEDRDLPQLAREVRDEMIDAVSRTGGHLGAGLGVVELTIAIHSVFDTPDDRLIFDVGHQCYPHKILTGRRDRIRTLRQEDGLSGFTRRAESEYDPFGAAHSSTSISAGLGMAIAADLDKSDRRVIAVIGDGAMSAGMAYEALNNAGALDARLIVILNDNDMSIAPPTGAMSAYLARLASGRTYMGFRDFGKKLTAYLGKNIDRAITRAVEHARGYVTGGTMFEEMGFYHIGPIDGHSFDHLLPVLRNVRDNGRGPVLIHVVTQKGKGYPPAEAAADKYHGVNKFDVITGAQARVKPNAPSYTSVFAEALVQEATLDDKIVGITAAMPNGTGLDKLAEAFPSRCFDVGIAEQHAVTFAAGLAAEGYKPFAALYSTFLQRAYDQVVHDVAIQGLPVRFPIDRAGFVGADGPTHAGSFDTAFLTTLPGFVVMAAADEAELKHMVRTAVAYDGGPISFRYPRGEGVGVDMPARGEILQIGKGRIVKEGTKVALLSFGTRLADCLLAAEDLDAAGLSTTVADARFAKPLDHDLIRQLARHHEMVITVEEGSIGGFGSHVMHFLATEGLLDNGLKLRSLVMPDIWMEQAKPEAMNAHAGLDRAGIVSTVFKALGRGVAVGVAG

SEQ ID NO: 78677 - protein, 861 aa, Glycine max; identical to SEQ ID NO: 1371

SEQ ID NO: 78678 - protein, 86 aa, Triticum aestivum
  misc_feature (48)..(48): Xaa can be any naturally occurring amino acid
DLPAGWHIARHTSLAGNYKLPWDNDSYWREPCNNRLAPDIGACEALSXQTGSIFFFPALLLTDAQNDKGFKMPDTPNVFPADIKRA

SEQ ID NO: 78679 - protein, 96 aa, Euglena viridis
ATYSVKLINPDGEVTIECGEDQYILDAAEDAGIDLPYSCRAGACSSCTGIVKEGTVDQSDQSFLDDDQMAKGFCLTCTTYPTSNCTIETHKEDDLF

SEQ ID NO: 78680 - protein, 322 aa, Streptomyces avermitilis MA-4680
MNTAQHKIGSGFGATSTAVDVLHGIDLSGQLAIVTGGYSGLGLETTRALTGAGARVVVPARRPDVAREAVAGIDGVEVDELDLGDLESVRGFAERFLASGRTIDIVINNAGIMACPETRVGPGWEAQFATNHLGHFALVNRLWPAVEPGGARVVSVSSGGHHLSGIRWDDVHWTHDYDKWEAYGQAKTANVLFAVHLDRLGRESGVRAFSLHPGGILTPLQRHLAKEEMVERGWIDENGDLVHPDAFKTPEQGAATQVWAATSPQLAGMGGVYCEDCDIAEPASADGERGGVKDWATDPEQAARLWDLSAELTGVNAFASRA

SEQ ID NO: 78681 - protein, 95 aa, Gleichenia japonica
AIFKVKFLTPDGERTIEVPDDKFILDAGEEAGLDLPYSCRAGACSSCTGKLLDGRVDQSEQSFLDDDQMAEGFVLTCVAYPAGDITIETHAEEKL

SEQ ID NO: 78682 - protein, 259 aa, Nocardioides sp. JS614
MSPDPSLAEDAALAARLVRDAGTLAARMRAEGLEAATKTSISDVVTAADHAAERLVVDALAAERPRDGVLGEEGAASEGTSGRTWVIDPVDGTYNFVAGLDWWCSALALTDGDDLVLGAVHHPASGRTFVGGPGLPTTVDGVALPALDDRRLAAACLTTYLHPPSYGAEVGAAFTRLVGGAATLRMLGSASMDATAIASGQLHVRCQHSLPPWDDLPGAALILGVGGATAHVDAAGVRWSAAGAPRAVADVCAALEATG

SEQ ID NO: 78683 - protein, 438 aa, Bacillus pumilus SAFR-032
MSQTTTNRFSTEEWQGKRDQYVARGVSNGNRHLAAKGKGAELFDIDGKRFIDFAGAIGTLNVGHSHPKVVEAVKAQADSLIHPGFNVMMYESYIELAEKLCHLTPGDHDKKAIFLNSGAEAVENAVKIARKYTKRQAVVSFTRGFHGRTNMTMSMTSKVKPYKFGFGPFASEVYQAPYPYYYQKPEGLSDAAYDEYIIDQFNQFFVATVAPETVACVVMEPVQGEGGFIVPSKRFVQHVASFCQQHGIVFVADEIQTGFARTGKYFAIEHFDVVPDLITVSKSLAAGLPLSGVVGRKELLDAADPGELGGTYAGSPLGCVAALAVLDIIETEQLNQRSEHIGQVIEDKANHWRTKYPFIGEVRRLGAMAAIEIVEDQTTRTPDKKTAAAIASYGNEHGLLLLTAGINGNIIRFLTPLVITDELLQEGLGIIEDAFKAR

SEQ ID NO: 78684 - protein, 96 aa, Leucaena leucocephala
AFKVKLLTPDGPKEFECPDDVYILDQAEELGIELPYSCRAGSCSSCAGKLVEGDLDQSDQSFLDDEQIEEGWVLTCAAYPRSDVVIETHKEEELTG

SEQ ID NO: 78685 - protein, 464 aa, Bacillus pumilus SAFR-032
MTNELKVYNPATGEEIASVAQHTKEQIEDAISRSHQAFKAWAKTSAHERANIIRKWFDLMIEHKERLAKIITKENGKPYQEALGEIVYAAGYIEWYAEEAKRIYGRTIPSHTTNKRLFVTKQPVGPVAAITPWNFPAAMITRKAAPALAAGCTFIVKPAEDTPLTAIELVKLGHEAGIPEDALQWVIGDGKEVGEIFTDSPLIRKITFTGSTPVGKHLIKNSASTVKHVSMELGGHAPLIVDKDANLELAVKQAMASKFRNAGQTCVCANRLIVHEDIHEAFAQVFSKEVEKLKVGNGFEEGTSIGPIINKRGFDKIVSQIQDAVDKGAKILVGGDTHFDDDKSYYFVQPTVLTHVDPSMNIMHEETFGPVAPITTFKTLDEAIELANDTPFGLAAYFFTENYRNGLYISENLDYGIIGWNDGGPSAVQAPFGGMKESGIGREGGIEGIEPYLETKYVSIGLDE

SEQ ID NO: 78686 - protein, 95 aa, Marchantia polymorpha
TFKVTLNTPTGQSVIDVEDDEYILDAAEEAGLSLPYSCRAGACSSCAGKVTAGEVDQSDESFLDDDQMDEGYVLTCIAYPTSDLTIDTHQEEALI

SEQ ID NO: 78687 - protein, 639 aa, Ustilago maydis 521
MSEPSAVSVAVGEPTTQWAYRAQKSIGLNTGSPSYTSVSGFDQVTGATRVFQYSPDGSTFAAAMDDFTRLVDTRAASTSSVKRDLPVPKVVDLQFSPRGAFLSTWERPSKLDDGSNARNLKMWDTETGETVAAFERKSQEGCFFQFTANEQYCVRQVSTELQIYEPRHITDKGVIGRLRLEGITSFEVGPGDKPSIAVFCGEKKGAPASVRVYSLASLIPCPESPPAPVSQKTFFKADKIQIKWNKAGSALLFMTSTDHDKTGKSYYGETNLYLMSVRGDFDCRVALDKEGPIHDFEWNPNSKEFIVIYGYMPAKAVLFSHRVNVIAELGTQPRNFVAFNPQGRLFCIAGFGNLSGTVDVWDRQELSKGKIFSMDASNSSVCQWSPDGHFLLTATLSPRLRVENGVKIWHCTGQLVHVDMIDELYQAGWRPGSNAGLVAFPAQIPSAPAASAAAASYLATKAATKRPTGTYRPPGARGQGTPDIYKRIDEGGSGASTPDLARSGSQNGTYQAPGSGNRKRAIPGAPGSAPRTNGNAATNQKDGKKKGGKQQQNGKNANAASASVTVVEESAGTASSGAAEVGGNSSAANLEKKVRNLNKKLKAIEELKLRQAGGEKLEAMQLAKIAAEQEVRRDLATLE

SEQ ID NO: 78688 - protein, 97 aa, Medicago sativa
ASYKVKLVTPEGTQEFECPDDVYILDHAEEEGIVLPYSCRAGSCSSCAGKVAAGEVNQSDGSFLDDDQIEEGWVLTCVAYAKSDVTIETHKEEELTA

SEQ ID NO: 78689 - protein, 658 aa, Physcomitrella patens subsp. patens
MCLSDPLSQVEDTRPPKSTIGLVQSLKIPEADTVGAVVVRDSGGAVSAEAGGRLEGFCGVWSSRLCGGGGLAVTRGCLSLPEGWAQFVPIVVGRFRSRGLEVGGGGLAFNSPGRLRSKGKFAHRCGGVRPGTMANHSANAPAQIPAAAHVVGNAFVNQYYTVLHQSPQVVHRFYTDSSRLTRAEAGADGAVDTVSTQNEIHQKVMSLDYSQLKAEIKTVDSQDSLNGGVLVLVTGSLSTSSSGKRNFVQSFFLAPQEKGYFVLNDVFRYLDDATPQEKTDQPVPEPAAEQQASAPEPELVREVSPSASESETMVQEVRVHPETAGSEGEDEDGQAPVLDTTTPVIEEPESPMVQDAPSSAVNEAESGGEAPKKHSYASILRVIGTPPPKATPQAPAERPAASATASPAPATAPTQEVQEESAPVENEADGRSVYVKNLPMNTTAPELEEVLRNYGAVKPGGVNVKNQKRGFWNGTCKGWFRTRGIVGEASGMLLLRCMGGTDDGLVGCMRQGVCYAFVEFEEVSGAQSAIEASGVEIRGRPVYIEEKKPMGRAPRRSVDNRGERPYRSDRGEGGRGRGSYGGRNFGRGMGLESRERDGGSRGGRGSGAPRGGYPNSNGSGAAAYGGGERRGEGQRAPRRNPGAAQGGRGNGAPAAAPA

SEQ ID NO: 78690 - protein, 110 aa, Oryza sativa
  misc_feature (9)..(9): Xaa can be any naturally occurring amino acid
  misc_feature (15)..(16): Xaa can be any naturally occurring amino acid
  misc_feature (19)..(20): Xaa can be any naturally occurring amino acid
  misc_feature (25)..(26): Xaa can be any naturally occurring amino acid
  misc_feature (31)..(32): Xaa can be any naturally occurring amino acid
  misc_feature (38)..(38): Xaa can be any naturally occurring amino acid
  misc_feature (44)..(45): Xaa can be any naturally occurring amino acid
  misc_feature (52)..(52): Xaa can be any naturally occurring amino acid
  misc_feature (55)..(55): Xaa can be any naturally occurring amino acid
  misc_feature (57)..(58): Xaa can be any naturally occurring amino acid
  misc_feature (64)..(64): Xaa can be any naturally occurring amino acid
  misc_feature (66)..(66): Xaa can be any naturally occurring amino acid
  misc_feature (69)..(69): Xaa can be any naturally occurring amino acid
  misc_feature (72)..(74): Xaa can be any naturally occurring amino acid
  misc_feature (77)..(77): Xaa can be any naturally occurring amino acid
  misc_feature (87)..(87): Xaa can be any naturally occurring amino acid
  misc_feature (92)..(92): Xaa can be any naturally occurring amino acid
  misc_feature (98)..(99): Xaa can be any naturally occurring amino acid
  misc_feature (104)..(104): Xaa can be any naturally occurring amino acid
  misc_feature (106)..(108): Xaa can be any naturally occurring amino acid
TPASFFLVXRLSNKXXLEXXVEATXXFLNKXXKPVLVXGPKLRXXKAGKAFXDLXHXXGYAYEXMXSAXGLXXXTYXHLIGTYCGAXSTAFXAEIFEXXDGYLXAXXXFN

SEQ ID NO: 78691 - protein, 208 aa, Wolbachia endosymbiont strain TRS of Brugia malayi
MTLIPIVIEQTSRGERAYDIYSRLVKERIIFVTGPVEDNMASVIVAQLLFLESENPDKDIYMYINSPGGVVTAGLSIYDTMQYIKPDVSTLCIGQAASMGSLLLAAGTEGKRYSLPHSRIMIHQPSGGYQGQATDIEIHANEILRVKRKLNQIYEKHTGNSLKKIEGMMERDKFMDPEEARRIGLIDRVIAERKDIKVENIKVEQKVG

SEQ ID NO: 78692 - protein, 498 aa, Arabidopsis thaliana
MSMFLGLLFLFPLFFILFKNLLPPRKKLPPGPTGLPLIGNLHQLGRLLHSSLHKLSLEHGPVMLVRWGVVPMAVFSSNEAAKEVLKTHDLETCNRPKLVANGLFTHGYKDIGFTQYGEEWREMKKFVGLELFSPKKHKSFRYIREEEGDLLVKKISNYAQTQTLVDLRKSLFSYTASIIFREAFGQNFRECDYINMDKLEELVQETETNVCSLAFTDFFPRGLGWLVDRISGQHSRMNIAFSKLTTFFEDVIDELLKTKQLDDHSDLVTAMLDVINRPRKFGSLKITYDHLIAMMSDVVLAGVNAGTVTMIWTMTELTRHPRVMKKLQEEIRATLGPNKERITEEDLEKVEYLNLVIKESFRLHPPAPLLLPRETMSDIEIQGYHIPKNAHVKINTYAIGRDPKRWTNPEEFNPERFLNTSINYKGQHYELLPFGAGRRNCPGMTLGITILELGLLNILYYFDWSLPSGMTIKDIDMEEDGALNIAKKVPLQLVPTLP

SEQ ID NO: 78693 - protein, 176 aa, Physcomitrella patens subsp. patens
GKIFIGGLSWDTSTDNLQSHFKKYGEIIDAVIMKDRSTGHPRGFGFVTFADPDVCDKVVLDKHVIDGRTVEAKKSVPRENLATSKGPKTKKIFVGGIPPSITDEEFKSYFAGFGSVMEHQIMQDHSTGRSRGFGFVTFDSEQVVEDILAHGKLHELAGKQVNDWEFYWSQPCHSMN

SEQ ID NO: 78694 - protein, 460 aa, Prochlorococcus marinus subsp. marinus str. CCMP1375
MASHDIFMPALSSTMTEGKIVEWLKQPGEKVSRGESVLVVESDKADMDVESFQDGFLAAVLMPSGSTVPVGETIGLIVETEAEIPAVQAANPTKSNVSPPENLSVSKDSKQTSDDSKQTPEDKPSTAEPFTSPKASSASLPAKAIINQGRIVATPRAKKLSTQLGVDLATVSGTGPHGRIQAEDVQKAQGQPITVPWIAESNAPASIPTAPSVVVTESSRNRSQPVEVPKGNSFGNPGETIPFNTLQQAVNRNMEMSLSVPCFRVGYAITTDKLDAFYKQVKPKGVTMTALLAKAVGKTLARHPQLNAAWSNEGMTYPKQINVAVAVAMEEGGLITPVLQNADLTDLFELSRQWADLVKRSRTKQLQPNEYNSGTFTLSNLGMFGVDRFDAILPPNTGGILAVAASLPKVIAGRDGSISVKRQMQVNLTADHRVVYGADGASFLKDLANLIENNPESLSS

SEQ ID NO: 78695 - protein, 181 aa, Arabidopsis thaliana
MVSFMFSSTDEVTSPAQATMDAPFTGLKSSASFPVTRKANNDITSITSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 78696 - protein, 328 aa, Prochlorococcus marinus subsp. marinus str. CCMP1375
MTPIYEDNSLAIGNTPLVKLHSVTKNCKATVLAKIEGRNPAYSVKCRIGANMIWDAEKKGLLNKQQTIIEPTSGNTGIALAFTAAAKGYKLTLTMPESMSLERRRVMAVLGAELILTEAAKGMPGAIAKAKEIAESDPNKYFMPGQFDNPANPEIHFKTTGPEIWNDCNGNIDVLVAGVGTGGTITGVSKFLKQEKRKQVLSVAVEPSHSPVISQTINGQEVKPGPHKIQGIGAGFIPKNLDLSLVDQVEQVSNEESIAMALRLAKEEGLLVGISCGAAATAAIRLAEQEQFAGKTIVVVLPDLAERYLSSVMFAEVPTGIIEQPKTN

SEQ ID NO: 78697 - protein, 346 aa, Vitis vinifera
MKVEEIQVEPPKSSEVRVKMLYASICHTDIFYCSELSLPMFPKVPGHEGVGVVESVGENVTGLKEGDVVIPTYLGECGECENCRSPKTNVCLKHPVTFTGLMPDGTSRMSIRGQRLHHIFSCSTWTEYMVVNANYLVKIDPRIAPSDASFLSCGFSTGYGAAWKDAKVEKGSSVAVLGLGAVGLGVLQGARNQGAARIIGIDKNERRREVGEAFGMTDFINPNESNKSISELVNELTGGQGVDYSFECTGIPSLVNEALQATKVGKGMSMVLGIANVPTVDISLMALLSGKTLKGCFFGGIKLTNASIRQDIQLDELLTHEVQLEDMNKAFELLKQPDCVKVLIKI

SEQ ID NO: 78698 - protein, 487 aa, Vitis vinifera
MRKNLIVLKDVEEKRQRGVRRGGETEEGELAGDFFGLGRRKSWEGKLFRYSESKREVGKTFGMIDFINSSESNKPISKLVYELTKGESVDYSFECIGIQSLINEVLQATKVVHLWIHINLNHDILLHIKLKLSYLYKSLGQNHFFTSSTSRSNQVITCKAAVCWGAGEAVKVEEIQVEPPKSSEVRVKMLYASICHTDILYCSGFPLPLFPRVPGHEGVGMVESVGENVIALKEGDLVIPTYLGECGECENCRSGKTNLCLEHPLTLNGLMLDGTSRMSIRGQRLYHLFSCSTWAGYMVVNANYLVKIDSRIALSEASFLSCGFSTGYGAAWKEAKVEKGSSVAVLGLGAVGLGVLEGARNQGAARIIGIDKNERKREMGKTFGMTDFINPILQTTKVGKGMLIVIGAGNKASVDINFLTLLLGRTINGCIFGGIKVQSDIPLLVNKCINKEIQLDDLLTNEIQLEEIKKAYELLKQPDCIKVLIKI

SEQ ID NO: 78699 - protein, 479 aa, Wolbachia endosymbiont strain TRS of Brugia malayi
MITRIPSVIYSLLNMRKLVSEYDIVVIGSGPGGYIAAIRAAQLGFKTAIIEKEKSLGGICLNWGCIPTKSLLRASKVYELIKRSEEFGIKVKDASFDIQSIVKSSRNVVGKLSSGVAYLMKKNGIKVYQGFGKLAGNHTIKVSSGREEQEISSRHIILATGVRMRNLHGIEADGDLLWNAQHAMTPDRLPKSLLIIGSGAIGIEFASFYSTLGVDVTIIEVKNAILPLEDKDISNLAQEIFTRKGIRIYTNNSVKAFTKGKNSIKVQLSSGESKEFDRVIVAVGIQASTESIGLENTKVKLSASGFVETNEWYETDESSVYAIGDIAGPPCLAHKASHEAVICIERIAGKNVRALRKECIPNCTYSHPQIASVGLTEEQAIKDGYDIKIGKFHSNFNGKSITLGETEGLVKVIIDKKTGELLGAHMIGVGVTELISNFVLVKQLEGTDCDIKSVVFPHPTISEMIHESVLAAYDESLNS

SEQ ID NO: 78700 - protein, 385 aa, Kineococcus radiotolerans SRS30216
MSAPHTLFCAGRRPDRAAKEQSMAETQTTGKTMQAVIVHGPHDYRLEEVPVPVAGPGEALLKVEAVGICASDLKCYHGAAKFWGDENRPAWAETDTVPGHEFTGRIAEIDEEASERWGVVVGDRIVAEQIVPCWNCRYCNRGDYHMCQPHDMFGFKRRTPGAMAEYLVLPKEALVHKAPDDLPPWQVAYAEPLSCALHAVERADIRFGDTVVVAGCGPIGLGMIAGAAAKFPQRIIALDALPQKLELARKCGADVTLNITEVDVVEEVKKLTGGYGADVYIEGTGHPSAVAQGLNLLRKLGTFVEYSVFKDPVTVDWSIISDDKELNVLGAHLGQNTWPAALRLIASGRLPLDEICSHQLPLARFQEGLDLVADSANSVKVSLIP

SEQ ID NO: 78701 - protein, 154 aa, Vitis vinifera
MKSPPHIVSRNNNHKLLVMSSWANLTIGPPPMSLYAKFMKRGLNLGGLVWSSSNILKDQPRKTRLSSPPTKFAGGPIGSFEAYKYIEDILKVTAQVSDNGPCATYIDKRGSGNFVKMVHNGIEYGDIQLIAKAYDVLKSIGGHPLIDQSNATSS

SEQ ID NO: 78702 - protein, 558 aa, Zea mays
  misc_feature (110)..(110): Xaa can be any naturally occurring amino acid
MAAQVVVAGGGGSWPQQWRLTLVLAALVPLLSLCLLLARTTRRARASSWSSSSKGGRLDVHRLPPGPPRLPLLGNLHQLGSLPHRSLRELARRHGPVMLLRLGSVPTLVXVSSADAAREVMKARDADCCSRPDTPGARRLSYGHKDVAFAPYTDYWRQMRKLFVVELLSARRVRAADHAREAEVDKLIARLSSAGGKPVQLEDHMFALMDGVIGTVAFGNIYGAEQFAHRNHFHDVLDEALSAKAGFSAEDYYPNAAGRLVDRLTGAAARRERVFRDLDAFFDTIIDQHLVVVDPSSSPPSSATTTPDLIDVFVDLMEESRHQPQVHGSLRFTRDHIKGLLSNVFTAGVDTSSVTMVWAMAELTRRPAMLRKAQEEVRSVVGGDRERVHPDDMPKLRYLKAVVKETLRLHPAAPLLLPRETMRHVSVCGYDVPAKTRVLVNAWAIGRDPRSWGPRAEEFDPGRFEDGGDVGFNGTHFELIPFGAGRRMCPGIAMGVATMEFTLANLLYCFDWELPEGVGVEDVSMEEAGSLTVHKKTPLLLVPTRYKANCQSRHSFQF

SEQ ID NO: 78703 - protein, 462 aa, Wolbachia endosymbiont strain TRS of Brugia malayi
MNNYDLIVIGGGPSGYKCAIAAAKLGLKVACIDKNSIFGGTCLRVGCIPSKALLHSSYQYVYTKNNLPKLGIKTKDVNFNLKEMLGYKDARVQELGKGIDYLFNLYKITKINGLGKITSFDQDSLKVSVEDKVLKTKNIVIATGSNVSSLPGINIDEKNIISSTGALSLTEVPKKLVVIGAGAIGLEISSVWSRLGSEVIVVEFLDRIAATMDGELSKSLLSSLQKQGIKFMLSTKVEKIKQNSNSLSVKVSSIKDNQTNTIETDKVLIAVGRKPCTEDLGIDEKIEEDNRGFIQVNNRYETNVKGIFAIGDVIGGAMLAHKAEEEGVAVAEIIAGQSPHVDYEIIPSVIYTHPAVSSIGKIEEELKSAGRKYKVGKCQFAANGRAKITDDAEGFVKVLTCSTTDTILGVHIIGAYADTLINEAAVAMAYGAAAEDIYRICHSHPDINEAFRDACIDAFFKK

SEQ ID NO: 78704 - protein, 390 aa, Alkaliphilus metalliredigens QYMF
MNYGERSLKMHEEKRGKIAVASKVTVKNRDDLSLAYTPGVAEPCKKIHEDKENVYKYTAKGNLVAVVTDGTAVLGLGDIGPEAAMPVMEGKAILFKDFADVDAFPICLDTKDVDEIVKAVKFIAPTFGGINLEDIGAPRCFEIEERLKKELDIPVFHDDQHGTAIVVVAGIINALKVVNKKIEETIIVVNGAGAAGVAITKMLNNMNPKDVLLCDRQGILYPGSPENNEYKEAMAQVTNKDKRKGKLEEAMKGADIFIGVSASNVVTEEMVRTMNQDAIIFGMANPVPEIMPDLALKAGAKVVGSGRSDFPNQINNILAFPGVFRGALDVRASEINEEMKLAAAQGIASIISEEELRADYVIPDPFDKRVAGRVAQAVAKAARETGVAKK

SEQ ID NO: 78705 - protein, 545 aa, Helicobacter pylori 26695
MLTQLKTYPKLLKHYEEIKEVHMRDWFFKDKERASRYFLQFESLSLDYSKNRLNDTTLKLLFELANDCSLKEKIEAMFKGEKINTTEKRAVLHTALRSLNDTEILLDNMEVLKSIRSVLKRMRAFSDSVRSGKRLGYTNQVITDIVNIGIGGSDLGALMVCTALKRYAHPRLKMHFVSNVDGTQILDVLEKLNPASTLFIVASKTFSTQETLTNALTARKWFVERSGDEKHIAKHFVAVSTNKEAVQQFGIDEHNMFEFWDFVGGRYSLWSAIGLSIMIYLGKKNFNALLKGAYLMDEHFRNAPFESNLPVLMGLIGVWYINFFQSKSHLIAPYDQYLRHFPKFIQQLDMESNGKRISKKGEIIPYDTCPVVWGDMGINAQHAFFQLLHQGTHLIPIDFIASLDKKPNAKGHHEILFSNVLAQAQAFMKGKSYEEALGELLFKGLDKDEAKDLAHHRVFFGNRPSNILLLEKISPSNIGALVALYEHKVFVQGVIWDINSFDQWGVELGKELAVPILQELEGHKSNAYFDSSTKHLIELYKNYNQ

SEQ ID NO: 78706 - protein, 310 aa, Chara vulgaris
FGRIGRLVLRAALLNHPEIEVVAVNDPFIDTKYMVYMFKYDSVHGQFKGKISAKDEKTLIINGKEVAVYGSRDPAAIPWSDTGVEVVVESTGVFTDKDKAAAHIKGGAKKVIISAPSKDAPMFVVGVNEDKYTPDLTIVSNASCTTNCLAPLAKVINDNFGIVEGLMTTVHSLTATQKTVDGPSGKDWRGGRGAGFNIIPSSTGAAKAVGKVLPELNGKLTGMAFRVPTADVSVVDLTVRLAKPASYDTIKQCIKAASEGPLKGILGYTDEDIVSTDVIGDAHSSVFDAKAGIALNDNFVKLVSWYDNEW

SEQ ID NO: 78707 - protein, 94 aa, Brassica napus
FLRGRKGDRLGFVFGGIFYTIGGISTGEAVITRIHRLSESSGDLYALHNVLKRAVDSLRNDSELQLSTLDQSETPKHILGYPYILDDLTHGAQS

SEQ ID NO: 78708 - protein, 312 aa, Chara vulgaris
KVGINGFGRIGRLVLRASLNHPNVQVVAVNDPFLDPEYIVYLFKYDTVHGKYKGEVGLSADKKLVVDGKEIAIFALRDPAAIPWGEAGADYVVESTGVFTAKDKAAAHLKGGAKKVVISAPSGDAPMFVMGVNEDKYTADLDVISNASCTTNCLAPLAKVMNDNFGIVEGLMTTVHAVTATQKTVDGPSGKDWRGGHGAGFNIIPSGTGAAKAVGKVLPELNGKLTGMAFRIPTADVSVVDLTVRLAKSTTYDEIKAVIKKASESDLKGILGYTDDDVVSSDFIGDVRSSIFDAKAGIALNGNFVKLVSWYD

SEQ ID NO: 78709 - protein, 542 aa, Bordetella pertussis Tohama I
MKAFNWVNPYPSTRIPVFARNVVSTSHPLAAQAGLRMLLKGGNAVDAAIAAAATIVLVEPVSCGLGGDCFAIVWDGRQLHGLNSSGVAPAAWNVEYFKRKYGTGPDGLAVQPKRGWDAVTVPGVVAGWAALHEKLGKLPFEQLFEPAIEIAERGYTVPPVVAHKWAAAAAELGEQPGYAQAFMPEGRAPRVGEHFLFPDAAYALRRIAASGGRDFYEGELAERIAAFSKECGGAMTLDDLRNYRPEWVKPISRSYRGYELHEIPPNGQGIAALIALGICERFDLADMPVDSVQSQHLQIEAMKLAFSDLYRYVADPRSMEVTPQQMLDDAYLDSRARLIDPDRATHFEAGRPHAGGTIYLTAADENGMMISFIQSNYMGFGSGVVVPGTGISLQNRGVGFSMNPASANVVEGGKRPFHTIIPGFLTRGGKPVMSFGVMGGDMQPQGHLQTVIRMLDYHQQPQAACCAPRWKVNRDFTLDIESTMNRATVEGLKNLGHRLKAVDDPYMDFGAGQFIWRMAESDNDLGYVAASDSRRDGQAVGF

SEQ ID NO: 78710 - protein, 572 aa, Ustilago maydis 521
MGLLSYILLGFTHPSELRAMIGYKVWRDPLNDIKANPQASGWDRQRMRDCWGFLDLTSRSFAAVIKELKGELSRVICLFYLVLRALDTVEDDMTIPAQRKIPLLVNFYKYLEQPGWNFTESGPNEKDRQLLVEFDKVIAEYQLLDVGYKTVISDITAKMGAGMASYIELSAKGPLKVAMWKHFDLYCHFVAGLVGEGLSRLFSESKLERPWLGHQLELSNHMGLFLQKTNIIRDYAEDCEEGRYFWPQQCWGDDFAKFESQPDVAKGIIEIKPGHFRPADNELGQRSMYVLSSMLLDAMSHATHALDYLALLKEQSVFNFCAIPQVMAIATLELMFNNPDVFKKNVKIRKGVAVGLILRAVNPRDVAYTFLHYSRKMHARLSPADPNFTRWSVELARIEQWCETYYPSFIAAASEGKPTDIRANALRSWSESRRTQALILKQAKLNGSDASTLDAKSVLEAAQNSALDPRDLMTEDERAAQDKRDRDQMVKFFLIILVGMVTFMGIVALITWEIVWWWTMDTPDPLSVYVKHAYYLVKTQGWSTVKEVLRTTRLSFEHVWKHGLTSPPKLEL

SEQ ID NO: 78711 - protein, 317 aa, Streptomyces avermitilis MA-4680
MRDIAVFSGSAHPELVAEVCAHLGVPLSPSRVSRFANDCLEVQLQANCRERDVFLVQPLVAPVQEHLVELLLMCDAARGASAGRITVVMPHYSYARSDKKDAPRISIGGRLVADLLVAAGASRVLAMTLHSPQVHGFFSVPVDHLHALRELAAHFRGHDLSRTTVVSPDLGNAKEAAAFARMIGAQVAAGAKQRFADDRVSISAVIGDVVDRDVIVLDDEIAKGSTVLELLDRLRELGPRSIRVACTHGLFAAGALKRLSEQPDVLEIVCTNTVPVAALERTGKLRVLSIAPALAEAVRRIHNGESVSALFDAPQGE

SEQ ID NO: 78712 - protein, 93 aa, Peridinium bipes
FKVTLDTPDGKKSFECPGDSYILDKAEEEGLELPYSCRAGSCSSCAGKVLTGSIDQSDQAFLDDDQGGDGYCLTCVTYPTSDVTIKTHCESEL

SEQ ID NO: 78713 - protein, 666 aa, Physcomitrella patens subsp. patens
MANHSANAPIQIPATAHVVGNAFVNQYYTVLHQSPQVVHRFYTDSSRLTRAEEGADGAVDTVFTQKEIHQKVMSLDYSQLKAEIKTVDSQDSLNGGVLVLVTGSLSTSSSGKRNFVQSFFLAPQAKGYFVLNDVLRYLDDATPQEKTGPSVPSVNVEAAVVHQPVPEPAADQQASAPEPELVREVSPSSSESETMVQEVRVHSETAESEGEGEDGSAPVLDTTTPVIEEPESPMVQDAPSSAVNEAESGGEAPKKHSYASILRVIGTPPPKAAPQAPAERPAASATASPAPATAPSQEVQEESAPVENEADGRSVYVKNLPMNTTAPELEEVLRNYGAVKPGGVNVKNQKRGFWNGTCKGWFRTRGIVGEASGMLLLRCMGGTDDGLVGCMRQGVCYAFVEFEEVSGAQSAIEASGVEIRERPVYIEEKKPMGRAWSRWLQRRGVRSTTEASGHIVATEAKGEEDAGHTVGETSVVAWGKSHGSETEAAGAGAGPELREEGTLTRTAVVRQHTAGESVAAKVKEHQDATLVRRRVGVVTVRLRPLRREQRWWWDGRGCGRAKRSRANAWVEWWEGLWEEVYRGGDVGKHATVRSKDFDERRLVDNCWETSLVWRARKMYIGVLVQCVLIFGGTDYRCSCTPVSLFLNASTHGTSAKQFPPSFLQKA

SEQ ID NO: 78714 - protein, 330 aa, Aspergillus fumigatus
MDQAASIFSRRGYLLYTQFYPNFAFQHVPIPKADEDITFLMAQSFVTSNKAETAPRHYNLRVAECTLAAVVLAAQHGITLTKDNSSLGYSLRNFHEELMRKEGRLGDPLEYQIDSVIQSTMELLTQEQGYTREEIAKLLGITVPELEAKFLSAFPVQAERFLLRQRALHCFKEARRVLDFKACLAKAHTLDERRIHYLGQLLNESQESCRADYDCSAPEVDEICAIARRAGTWGSRLTGAGWGGCTVHMLPQSKVEAVTKALKEEYYLKRLPDISEEKLAQAMVISKPSNGSFVYVYPCLDDVFIVPTENAESLTAFARITGAAITAVKI

SEQ ID NO: 78715 - protein, 185 aa, Nocardioides sp. JS614
MTLPGPEAPGLSEALALIADVPDFPQPGILFKDITPLLAEHAALEAVVAALAAPGRDQTGAPVVDKVLGMESRGFILGAPVALALGVGFVPVRKAGKLPRATYAVSYALEYGEATLEVHQDALEPGDRVLLVDDVLATGGTARATIDLVEKCGASVHAVAILMELGFLPGREALGTVPLTTLLTV

SEQ ID NO: 78716 - protein, 359 aa, Arabidopsis thaliana
MSCFKSKFADELIANAAYIGTPGKGILAADESTGTIGKRFVSINVENVESNRRALRELLFTTPGALQYISGIILFEETLYQKTASGKLFVDVMKEAGVLPGIKVDKGTVELAGTNGETTTTGLDGLGDRCKKYYEAGARFAKWRAVLKIGNNEPSELAIHENAYGLARYAVICQENGLVPIVEPEILVDGSHDIEKCAYVTERVLAACYKALSDHHVILEGTLLKPNMVTPGSDSGSKVKPEVIAKHTVRALRRTVPAAVPAVVFLSGGQSEEEATVNLNAINQLKGKKPWSLTFSYGRALQQSTLKAWGGKEENVDKAQKAFLARAKANSEATLGGYKGDAQLGEGASESLHVKDYKY

SEQ ID NO: 78717 - protein, 204 aa, Wolbachia endosymbiont strain TRS of Brugia malayi
MNRLIMNLVTKSAINFTAPAVLPNGEIVDDFCLSEHIKGKYAILLFYPLDFTFVCPTELISLNNRISEFAKRDVEVIGISVDSKFSHYQWRKTSVSNGGIGEISYTLVSDIKKSISRDYGVLYDDSIALRATFVIDDKFIVRHQSINDMPLGRNMDEFIRIVDAIKHNEEHGEVCPAGWKKGKPAMQASDEGVTDYLNSYSEEL

SEQ ID NO: 78718 - protein, 321 aa, Oryza sativa
  misc_feature (215)..(215): Xaa can be any naturally occurring amino acid
MPPGQMLEPSEPEAEFTLACLQNGLRIDGRSFLAARPVDITFGEELGNVTVAIKGTRVSTSVRATLMPPRSDRPYEGFLQITTDISPMAGVEYDSTGGGANSSARAREVLFDRLIEKAVRRTEAVDREALCVVAGEQVWNVHLTVHLLSDTGAALDAAVLSSMLSLRHFRRPDYSIENGNQVRLYSADERVPVPLAIHHTPLCVTFSIFNCLPPXSAQPEKNDDDDLIDPTSSTPAQTADSGSVALLDPSLLEETLAHSKLTLVLNAQREICVLDKSYGSPINPHTLLELINVGLNRIDVLTETLETALKNDAATRIIEVI

SEQ ID NO: 78719 - protein, 281 aa, Kineococcus radiotolerans SRS30216
MRTPTATTPGSAAQRHDVHVLGHPQGPVLLLLHGFGTDQSSWNRVLPALTPHHRVVLLDQAGAGGFDATAYDRTRYSTLDGYAADLVEVCEELDLHDVTLVGHSVSAMIAARVALAAPDRIRQVVMLVPSARYTDDPASGYDGGFSTEDIDELLDTLDSNYLSWTATVAPMVMGNPSRPELGEELTASFRQLHPDAARDFARATFRTDSRALLAEVSTPVLVLQSRDDVLAPDTAVRDVVARLPHATLVSLDASGHCPHLSHPDATAAAVLAHLAPPGHRS

SEQ ID NO: 78720 - protein, 619 aa, Clostridium tetani E88
MGKITYQSLYLKESVVMIGTLLGNRYELLEKVGEGGMAEVYKAKCHFLNRYVAVKILKEEFSQDAQFVEKFKREATAAASISDNNIVNIYDVGSEENINYIVMEYVQGETLKDVIRKKGKIPYKEAVKLAIQIAKGLECAHRNNIIHRDIKPHNILVTADNLVKVTDFGIAKATNSVTITNTSQIIGSVHYFSPEQAKGGFIDFRTDIYSLGIVLYEMVTGQLPYNGETAVSIALKHIQGDFIPPKTINPSLSESLNSIILKCMEKEPVKRYQNVGELINDLKKIENNEQVNIESTNIEDDRTRVMSPINVDDFNDELEDDGQYYEEDRGKPISSKNKKTIVTITAVILVLCVGFLSGYVIYNKRLNGSKRVTVPKIVGLHKDEAKKIVEAQNLVFQIVSVENSDKPEGTVLKASPEEGAPIKAKSEVRVVVSGGKEKLKVPDLHDIDLEVAKDILNRYDLRLGNVSSEYSNNVSSNSVIRQSPEKGSEIELKSKIDLVISKGPEVRYSTVPNLNSKTLDEVKNLLENAKLKLGNQRIVETSDKNLDGKIFAQTIEANTQVKEGTSVSISYYAYKEPEIKPEEPTEEPTDEEDENKNITAPEEDGKKEDTKQDKNKKSQ

SEQ ID NO: 78721 - protein, 361 aa, Streptococcus pneumoniae TIGR4
MMDSPKKLGYHMPAEYEPHHGTLMIWPTRPGSWPFQGKAAKRAFTQIIETIAEGERVYLLVEQAYLSEAQSYLGDKVVYLDIPTNDAWARDTGPTILVNDKGKKLAVDWAFNAWGGTYDGLYQDYEEDDQVASRFAEALERPVYDAKPFVLEGGAIHSDGQGTILVTESCLLSPGRNPNLTKEEIENTLLESLGAEKVIWLPYGIYQDETNEHVDNVAAFVGPAELVLAWTDDENDPQYAMSKADLELLEQETDAKGCHFTIHKLPIPAVRQVVTEEDLPGYIYEEGEEKRYAGERLAASYVNFYIANKAVLVPQFEDVNDQVALDILSKCFPDRKVVGIPARDILLGGGNIHCITQQIPE

SEQ ID NO: 78722 - protein, 217 aa, Clostridium tetani E88
MVKIAPSILSADFANLGRDIEAIEKYGAHVVHFDVMDGKYVPNISFGVPIMKSIKGLTKLPFDVHLMIEEPSKYIEDFAKAGADIITFHYEAETHLDRTINYIKSFGVKAGIALNPGTPVSLIKDLIPSLDMVLIMSVNPGFGGQKYIYYASDKIRELKKLKDELNKDLIIEVDGGVGKDNIKDIANCGVDLVVAGSAVFKDGKIEENLKVLREALR

SEQ ID NO: 78723 - protein, 315 aa, Coleochaete scutata
  misc_feature (289)..(289): Xaa can be any naturally occurring amino acid
KVGINGFGRIGRLVARVALGRDDVELVAINDPFISTEYMVYMFKYDSVHGRWGGNVELKDAKTLLFNGKPVNVYDKRDAAEIPWSEMGAEYVVESTGVYTDMDKAAAHLKGGAKRVVISAPSKDAPMFVMGVNHEKYKGEAIVSNASCTTNCLAPLAKVVNDRFGILEGLMTTVHSITATQKTVDGPSSKDWRGGRGAGFNIIPSSTGAAKAVGKVLPELNGKLTGMAFRVPTADVSVVDLTVRLEKAATYDEIKAALKEASEGAMKGILGYTEDDVVSTDFITDERSXVFDAKAGIALNNKFVKLVSWYDNELG

SEQ ID NO: 78724 - protein, 248 aa, Thermoplasma acidophilum DSM 1728
MKRMEANKIKLINEDNLRLDGRSFNELRPIKIQAGVLNRADGSAYIEWGGNKIMVGVYGPKEAYPKHSQDIDHAIVKARYNMAAFSVDERKRPGPDRRTMEISKVISEALSSSIMIEQFPRAEIDVYIEVLQADAGTRIAGLTAATVALADAGVPMRDMVVGCTAGKVDGHMVLDLSKEEDNYGEADIPIAIMPKTGDIVLMQMDGDVTEDELYQAMDMIFEATKRISQIQREALLNKYKIQDIGEGE

SEQ ID NO: 78725 - protein, 312 aa, Klebsormidium flaccidum
GINGFGRIGRLVMRAALERSDVEVVAVNDPFIDADYAIYMFTYDSVHGEVQREDREEDAHTISFDGHDVAFYAARDPSEIPWGKHGADYVVESTGVFTDMDKAAAHLKGGAKKVIISAPSKDAPMYVMGVNHEKYKTSDDVISNASCTTNCLAPLAMVVNNKFGILEGLMTTVHATTATQKTVDGPSNKDWRGGRGASTNIIPSSTGAAKAVGKVLPELNGKLTGMAFRVSTADVSVVDLTVRLEKPAKYDDIVAAIKEAADGPLKGILGYTSDDVVSQDFVHDSRSSIFDIKAGIALNDSFVKLVSWYDNE

SEQ ID NO: 78726 - protein, 283 aa, Glycine max
MATSAMTLAMVAATDASLFHPTFPAQHKLAPASASLPLIFSRAPLLRSTRPRVPLTPLVASSDAAEAGLDWADAEEAEETVTEEEPAVAASGGDAGYAAEPPEEAKVYVGNLPYDVDSERLAQLFDQAGVVEVAEVIYNRESGQSRGFGFVTMSTIEEADKAIETFNRYDISGRLLNVNRAAQRGSRVERPPRQFASSFRAYVGNLPWQAEDSRLVQLFSEHGEVVNATVVYDRETGRSRGFGFVTMASKEDLDSAISALDGQEMDGRPLRVNVAAERPQRGF

SEQ ID NO: 78727 - protein, 317 aa, Coleochaete scutata
NGFGRIGRNFLRCWYEREDSPIEVVAINDSGGVKNAAHLLKYDSMLGTFKAEVKAIDDKTLSVGGKPITVVSNRDPLKLPWADLGIDIVIEGTGVFIDGPGAGKHIQAGAKKVIITAPAKGADIPTYVVGVNADDYDHDVANIISNASCTTNCLAPFVKIMDAEFGIVKGTMTTTHSYTGDQRLLDASHRDLRRARAAALNIVPTSTGAAKAVALVLPQLKGKLNGIALRVPTPNVSVVDLVVNTVKKGFTAEDVNTAFRNAANGSLKGILGVSDLPLVSIDFRCSDESSTIDSSLTMVMGDDMLKVVAWYDNEWGY

SEQ ID NO: 78728 - protein, 442 aa, Acidovorax avenae subsp. avenae
MHDMNGTARIARWMEREIAAAPLVRRSGKVAEVIGTLMRVNGLDAKLGELCHVLDERGELLQAAEVVGFANGQSILSPFGSILGVRGGSPVVGLGEVLSVPVGPRLLGRVIDSLGQPIDGKGPLDCSETRPVFALPPTPMEREMIEHPLPTGVKAIDGLITLGEGQRMGIFAPAGVGKSTLMGMLARGTQCDVSVIALIGERGREVREFVEFILGEEGMARSVVVCATSDRSSSERAKAAHVATAVAEYYRDQGLKVLLMMDSLTRFARAQREIGLAAGEPPARRGFPPSVFAEIPRLLERAGMGARGSITALYTVLYEDESGNDPISEEVRGILDGHMILSRKIAARNQYPAIDVLGSLSRVMSQIVPREHQQAGGRFRQLMAKYEEIEPLVQMGEYKPGNDPLADEAMEKHEEIRAFLNQSTSDLWDFGRSVDTLSDISG

SEQ ID NO: 78729 - protein, 195 aa, Populus tomentosa
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRPNLWGLINSPKEVPLVANLFLGWKGVLLIGGGPKNLGLLSPKPK

SEQ ID NO: 78730 - protein, 428 aa, Salmonella typhimurium LT2
MKLYNLKDHNEQVSFAQAVTQGLGKQQGLFFPHDLPEFSLTEIDEMLNQDFVSRSAKILSAFIGDEIPQQILEERVRAAFAFPAPVAQVESDVGCLELFHGPTLAFKDFGGRFMAQMLTHISGDKPVTILTATSGDTGAAVAHAFYGLENVRVVILYPRGKISPLQEKLFCTLGGNIETVAIDGDFDACQALVKQAFDDEELKTALGLNSANSINISRLLAQICYYFEAVAQLPQGARNQLVISVPSGNFGDLTAGLLAKSLGLPVKRFIAATNVNDTVPRFLHDGKWAPKATQATLSNAMDVSQPNNWPRVEELFRRKIWRLTELGYAAVDDTTTQQTMRELKAKGYISEPHAAVAYRALRDQLNPGEYGLFLGTAHPAKFKESVESILGETLALPEALAERADLPLLSHHLPADFAALRKLMMTRQ

SEQ ID NO: 78731 - protein, 363 aa, Vibrio campbellii AND4
MTDKAYKIAILPGDGIGPEVMAQAHKVLNAIEKKHGITFERDEHDVGGIAIDNHGCPLPESTVKACEESDAVLFGSVGGPKWEHLPPNDQPERGALLPLRKHFQLFCNLRPAQIHSGLEAFSPLRADISGRGFDIVVVRELTGGIYFGQPKGREGEGPTEKAFDTEIYHRYEIERIAKIAFESARLRRKKVCSIDKANVLQSSILWREVVEEIAKDYPDVELSHMYIDNATMQLIKDPAQFDVMLCSNIFGDIISDECAMITGSMGMLPSASLNESKFGLYEPAGGSAPDIAGKNIANPVAQILSAALMLRYSLGEEAAAQDIETAVSKALSAGELTGDLASDNPALSTSEMGDKIAEYILNS

SEQ ID NO: 78732 - protein, 357 aa, Rhizobium leguminosarum bv. viciae 3841
MREYAIATIPADGIGPEVIAAGTRVLAAIEKREGGIKFNIENFDWGSDYYKKHGIMMPTDGLKQLKKFDAIYFGAVGSPDVPDHITLWGLRLPICQGFDQYANVRPTKILPGITPPLRNCGPGDLDWVIVRENSEGEYSGHGGRAHRGLPEEVGTEVAIFTRVGVTRIMRYAFKLAQSRPRKFLTVVTKSNAQRHGMVMWDEIAAEVAEEFPDVTWDKMLVDAMTVRMTLNPRSLDTIVATNLHADILSDLAGALAGSLGVAPTANIDPERRFPSMFEPIHGSAFDITGKGIANPVATFWTAAQMLDHLGETDASARLMQAVERVTGAGILTPDVGGTANTKEVTDAVVDAIYASNV

SEQ ID NO: 78733 - protein, 380 aa, Oryza sativa Japonica Group
MAAEDNPGYALRATLAGHRRAVSAVKFSPDGRLLASASADKLLRVWSTSDLASPVAELAGHGEGVSDLAFSPDGRLIASASDDRTVRIWDLGDGGGGGGGGEPRLMKTLSGHTNYAFCLAFSPHGNMLASGSFDETVRVWEVRSGRCLRVLPAHSEPVTSVDFNRDGAMIVSGSYDGLCRIWDSATGHCIKTLIDDESPPVSFAKFSPNGKFVLAATLDSKLDLCLLVMSATLVGVMSVLLEVKMYIRSFQQSYQPPSMLETILGTISQEIGVGLSARRLWNFSAGKFLKTYTGHVNTKYCIPAAFSITNGKYIVSGSEDKCVYIWDLQSRKILQKLEGHTDTVIAVSCHPNENMIASGGLDGDKTVKVWVQKEEDQMEV

SEQ ID NO: 78734 - protein, 365 aa, Bacillus cereus E33L
MKRQLILEDGTVLIGTGFGGEIEKSGEVVFTTGMTGYQETLSDPSYCGQIVTFTYPLIGNYGINRDDFESIHPSVNGLIVNEICDHPSNFRNEISLNDYLKERKIPGLAGIDTRKLTRKIRQYGTLRGRLCNMDADVEYIVSQLKATVFTDHVKRVSTKDPYPSPGRGHRVVLVDFGMKHGILRELNKRDCDVIVVPYNTTAEEILRLSPDGIMLSNGPGDPKDVPEAIEMLKDIIGKVPLFGICLGHQLFALASGANTSKLKFGHRGLNHPVKNIATGKVAITSQNHGYAVEEESVENTELEITHVALNDGTVEGLRHKKFPAFTVQYHPEASAGPEDANDLFEDFLTMIENFKKEGEELCQNA

SEQ ID NO: 78735 - protein, 97 aa, Rhodymenia palmata
AVKYTVTLSTPGGVEEIEGDETTYVLDSAEDQGIDLPYSCRAGACSTCAGIVELGTVDQSDQSFLDDDQLNDSFVLTCVAYPTSDCQIKTHQEEKLY

SEQ ID NO: 78736 - protein, 97 aa, Sambucus nigra
ASYKVKLITPDGPQEFECPDDVYILEHAEELGIDIPYSCRAGSCSSCAGKLVAGSVDQSDQSFLDDEQIEEGWVLTCVAYPKSDVTIETHKEEELTA

SEQ ID NO: 78737 - protein, 96 aa, Scenedesmus quadricauda
ATYKVTLKTPSGDQTIECPDDTYILDAAEEAGLDLPYSCRAGACSSCAGKVEAGTVDQSDQSFLDDSQMDGGFVLTCVAYPTSDCTIATHKEEDLF

SEQ ID NO: 78738 - protein, 574 aa, Vibrio campbellii AND4
MTAMLSGAEMVVQSLIEESVEQIFGYPGGSVLDIYDALHAKTDQIKHVLVRHEQAATHMADGYARATGKPGVVLVCSGPGATNTITGIATAYMDSIPMIVISGNVPNNLIGNDAFQECDIVGVSRPVVKHSFLVKKAEDIPETIKKAFYISTTGRPGPVVIDLPKDILNPQIKLPYEYPKNISMRSYKPTTSGHKGQIKKALKALVEAKKPVLYIGGGAIISGAHEHIQTLSDELNLPVVSTLMGLGAFPGTHKNSLGMLGMHGTYEANMAMHEADLIFGIGVRFDDRTTNNLEKYCPNAKIMHIDIDPSSISKNVKVDLPIVGSAEKVLATMVGLLNEQNGNNDAQAIAQWWEEIQVWRERECLAYETSTERIKPQQVMQTLHKLTNGDAYVASDVGQHQMFAALYYPFNKPRRWINSGGLGTMGFGLPAGMGVKFAMPEEEVVVVTGDGSIQMNIQELSTAMQYDIPVKIINLNNRFLGMVKQWQDIIYQGRHSNSYMSSVPDFAAIAEAYGHVGIRIETPDQLEAGLQKALDMKDRLVFVDINVDETEHVYPMQIKGEGMDKMWLSKTERT

SEQ ID NO: 78739 - protein, 167 aa, Bordetella pertussis Tohama I
MTIKAGDRVPDGTLTEFIETETAGCTLGPNAFQVADLVKGKKIALFAVPGAFTPTCSAKHLPGYVEQAAALRAKGIDEIWCVAVNDAFVMGAWGREQQAGGKVRMLADGSALWTTALGLELDLVQRGMGVRSQRYSALIDDGVVKQLNIEAPGKFEVSDAATMLAQA

SEQ ID NO: 78740 - protein, 498 aa, Brassica napus
MRINPTTSDPAVSIREKNNLGRIAQIIGPVLDVAFPPGKMPNIYNALVVKGRDTLGQEINVTCEVQQLLGNNRVRAVAMSATEGLKRGMDVVDMGNPLSVPVGGATLGRIFNVLGEPVNNLGPVDTLTTSPIHKSAPAFIDLDTTLSIFETGIKVVDLLAPYRRGGKIGLFGGAGVGKTVLIMELINNIAKAHGGVSVFGGVGERTREGNDLYMEMKESGVINELNLADSKVALVYGQMNEPPGARMRVGLTALTMAEYFRDVNEQDVLLFIDNIFRFVQAGSEVSALLGRMPSAVGYQPTLSAEMGSLQERITSTKKGSITSIQAVYVPADDLTDPAPATTFAHLDATTVLSRGLAAKGIYPAVDPLDSTSTMLQPRIVGEEHYETAQQVKQTLQRYKELQDIIAILGLDELSEEDRLTVARARKIERFLSQPFFVAEVFTGSPGKYVGLAETIRGFNLILSGEFDSLPEQAFYLVGNIDEATAKATNLEMESKLKK

SEQ ID NO: 78741 - protein, 1028 aa, Physcomitrella patens subsp. patens
MGGGYFDNMWDPYSSSYVYPGAQPRPGHYRPRAPVNDSYGYSRVPEDWTYPAKVKETPSKKTVRIIPVTDGSAFEAVAQEVVQVEVPPRVGKFESETAAATKVQAVYRGYCVRKTKPLKHLKLIRKVKEELENFELRFQEVPQKKRICTDPQERLKWTEGIMALLLRLDQLQGAHSDVRLVRKSVAKELIKFQEKLDSISDASEDEDLKDSSMVEENGDNLDFSNEGSKLIDNGEDSPGEKSVKEMGIDKSIPESIGASENLDYLEGAINEDGINVTSEPQQAVDYDGAVEAKNELREKDSNSIKGIEDVASEQQAPEEHVASISTSHHDQDGLLHSSMGVIVDPIVSDGLDPSLTEPFAAFPMDVENEVAGEPAVDLEENVESESQYLESVPPMDVEGGNQESCQLENFVASEPSSVVADESASQESDAIASVENDVVHGKEHNVRRGEAEEPSNVLVKPDLSRLSCCDSGRDNLDISKCLEERQTKAGSVDLDNRCMIPAGTSLITPQATSLAPQCCQRLLQGHPQSSTADNNEALSNRALLQQLLDENRKLKDVVGRVLHWGKQQNDIIHNLASRIEQLEEPQFQVDMLHGEKQIGRKRINTDSCVAGGGKRSLRRIEKGRKKGKSALQISRLPHCGSSEEISEAIRCAALRLSHLCSINRWSDKVELSTALRNTAITSCSISDFDQDRENLGDSCKEIAIAMNKRQRTEAEEDYVNTRSQIQKLEKDSAAKDVRIVELENKSKFPEQRNSNNFSGGQSFLDTGPTPTLLYKALERVNTTSSNFTKLLMLALSNDGVPCSTVAKTLKPSVLFERDAHTKFVYQALVCKVLFADFESECFNIEDNALGILDPEQSREDNFQRYKDIVDLQNPEELVYEDATNNEFRRFCIKKREDLITAISHTEARGARNLGALLFGQVFAADGMRRRLASSNEPEFKMTSSFVRFALSVFIVHKLAFSLHPNARIFRVQDGKMFDSQYMEPVVPHADGEYNKSTSISISAGFTVVPGFQVNRIVVKSRVFTTIRV

SEQ ID NO: 78742 - protein, 146 aa, Silene latifolia subsp. alba
MASTLSTLSVSASLLPKQQPMVASSLPTNMGQALFGLKAGSRGRVTAMATYKVTLITKESGTVTFDCPDDVYVLDQAEEEGIDLPYSCRAGSCSSCAGKVVAGSVDQSDQSFLDDDQIEAGWVLTCAAYPSADVTIETHKEEELTA

SEQ ID NO: 78743 - protein, 320 aa, Sinorhizobium meliloti
MDRVRTVRKAVIPVAGNGTRFLPATKAVPKEMLTIVDRPVVQYAVDEARQAGIEHIVFVTSRNKQVIEDHFDDAPELISSLSRSGKSAQISELEAMLPAAGSVSFTRQQAPLGLGHAVWCARDLIGDEPFALLLPDMVSFGARGCVAGLMDLYHEVGGNVVGVEQCAPEEASKYGIVGKGETVRHGFSVTEMVEKPAAGKAPSNYYLNGRYILQPEIFSILAHQTRGAGNEIQLTDGMLTLSQSQSFHAHPYEGRTFDCGSKQGFIEANVAFALLVRTSAISFSNPSATWFCLTKAASGRHKRRLPAVLRDCRNKDRRRR

SEQ ID NO: 78744 - protein, 358 aa, Bacteroides fragilis NCTC 9343
MKNVTLILDDGSRFHGKSFGYEKPVAGEVVFNTAMTGYPESLTDPSYAGQLMTLTYPLVGNYGVPPFSIEPGGLATFMESERIHAEAIIVSDYSQEYSHWNAVESLADWLKREQVPGITGIDTRELTKVLREHGVMMGRIVFDDEPESAPEAVYSGVNYVDKVSCKEVIRYNEGADKKKVVLVDCGVKTNIIRCLLRRDVAVIRVPWNYDFNHLKFDGLFISNGPGDPDTCDAAVQNIRKAMQNPKLPIFGICMGNQLLSKAGGAKIYKLKYGHRSHNQPVRMVGTERCFITSQNHGYAVDNNTLGTDWEPLFINMNDGSNEGIRHKTNPWFSAQFHPEAASGPTDTEFLFDEFVKLL

SEQ ID NO: 78745 - protein, 336 aa, Alkaliphilus metalliredigens QYMF
MKTITLIPGDGIGVEVTTAVQRVIEAANVAIDWEVVNGGETAYLETGQYIPDELIDSISKNKIAFKGPITTPIGTGFKSINVTLRQKYNTYANVRPVKSMSGIKTPFDNIDLVIFRENTEGLYCGIEHLVTEGVAEAIKVITEKASKRIGKSAFEYARKHKRKKVTAVHKANIMKISDGLFLDCIRSVAKEYPEIEYEEVIVDNMCMQLVMYPERYDVLVLPNLYGDIISDLAAGLVGGLGLVPGANIGDDIAIFEAVHGSAPLIAGKNMANPTACILSATMMLDYIGEESAAKRIRQAVEFVIKEGRYTTSDIGGTATTKDMTEAICQYIKSKNH

SEQ ID NO: 78746 - protein, 252 aa, Vitis vinifera
MPIPRIALGSPAEAGQADALKAALAEFISVLIFVFAGEGSGMAFNKLTDDGSSTPAGLVAAAVAHAFALFVAVSIAANISGGHVNPAVTFGALVGGHITLFRSLLYWIAQLLGSVVACLLLKFATGGLTTSAFSLSSGVSAWNALVFEIVMTFGLVYTVYATAIDPKKGNIGIIAPIAIGFIVGANILAGGAFDGASMNPAVSFGPAVVSWTWSNHWVYWLGPFIGAAIAAFVYSIFYLSPTTHEQLPTTDY

SEQ ID NO: 78747 - protein, 141 aa, Zea mays
MGIGEHFEGVKQHWASNFAFLDYYKKVYGRAEPLPKWSDADVDEFIASDPVYGPQLKALRESRKFALAGAFAGAAHLGGVALKYSKAPHGVVLATGFGAITGAVLGSEVAEHWYQLYKMDKQGANLRFIYWWEDKVSGQKS

SEQ ID NO: 78748 - protein, 457 aa, Erwinia carotovora subsp. atroseptica SCRI1043
MMTSRLGRWLSSLDSFEKRIDDTPSVRRYGRLTRATGLVLEATGLHMPLGATCLIERQNGSKVEEIESEVVGFNGQKLFLMPLEEVEGITPGARVYARVGQDSSSQGKQLPLGPELLGRVLDGSAKPLDGLPAPDTGYRAPLITPPVNPLQRTAIDSVLDVGVRAINALLTVGRGQRMGLFAGSGVGKSVLLGMMARYTQADVIVVGLIGERGREVKDFIENILGTEGRARSVVIAAPADVSPLLRMQGAAYATRIAEDFRDRGHHVLLIMDSLTRYAMAQREIALAIGEPPATKGYPPSVFAKLPALVERAGNGIHGGGSVTAFYTVLTEGDDQQDPIADSARAILDGHIVLSRQLAESGHYPAIDIEASISRAMTALIDEDHYASVRQFKQLLSSYQRNRDLVSVGAYAAGSDPMLDKAIRLYPHLEAFLQQGMFEQSDYEESCQALHTIFPRNE

SEQ ID NO: 78749 - protein, 471 aa, Lactobacillus reuteri
MAKAEKKISSAFIYFFGSFGGILFGYDIGVMTGALPFLQADWHLENAASLVGWITSAVMFGAIFGGALAGQLSDKFGRRKMILMSAIVFMVFSVLSGVSPDMGEASAYYLIIVRMLLGLAVGAASALVPAYMSEMAPAKARGRLSGLNQTMIVSGMLLSYVVDFLLKDLPGEWAWRLMLGLAAVPALILFLGVLRLPESPRFLLRKGDEAQARKVLSYIRKNPAEIDQELASIKETAKEERQANQKTSWSTLFSGKYRYLVIAGVGVAAFQQFQGANAIFYYIPLIVQKATGQAASSNLMWPIVQGVILVVGSLVYMWIADKFNRRTLLMVGGAVMGLSFILPAVINWMIPNMNPMTIVVFLCIYVAFYSFTWAPLTWVLVGEIFPLAIRGRASGLASSFNWIGSWLVGLIFPIMTASMPQEAVFAIFGIICILGVIFVKTCVPETRGHTLEEIEEQGTNHGRVKASNPEN

SEQ ID NO: 78750 - protein, 450 aa, Vitis vinifera
MDSVLFPHPLFPHIFISSRYDTQLSAFSSSTSVWCLFELIYTLTMGFSSIEQALNTLRQGKFVIVVDDEIGKAEGNLVMAASLTSPRDMAFMVKHGSGIVSVGMKEEHLERLKLPLMSPDSEDKDSSAPTFTITVDAKAGTSTGVSASDRAKTVLALSSPISTPQDFRRPGHVFPLKYREGGVLRRAGHTEASVDLVMLAGLQPISVLSAIVDGDDGSIATLPSLRKLALEHSIPMVSITDLIRYRRKREKLVERTAISRLPTKWGLFQAYCYRSKLDGTEHVAIVKGSIGQGQDVLVRVHSECLTGDIFGSARCDCGNQLDLAMQLVEQAGRGVVVYLRGHEGRGIGLGHKLRAYNLQDEGHDTVEANLELGLAVDAREYGIGAQILRDIGVRTMQLMTNNPAKFTGLKGYGLAVVGRVPVLTPITEENKKYLETKRTKMGHIYGSDIE

SEQ ID NO: 78751 - protein, 510 aa, Nocardia farcinica IFM 10152
MVRELTHFIGGQHVAGTSGKFGDVYDPNIGQVQARVPLASKSEVEAAIANAEAAQQEWAAFNPQKRARVMMKFLALVQDEMDSLAALLSSEHGKTIADAKGDIQRGLEVIEFAVGIPHLLKGEYTEGAGTGIDVYSMRQPLGVVAGITPFNFPAMIPLWKAGPALACGNAFVLKPSERDPSVPLRLAELFLEAGLPAGVFNVINGDKEAVDTLLHDPRIKAVGFVGSTPIAQYIYETATANGKRAQCFGGAKNHAIVMPDADLDDVADQLIGAGYGSAGERCMAISVAVPVGEETADRLVAKLTERVHKLNVGRSDDPGADFGPLVGKDGVDRVNNYVQIGIDEGAELVVDGRGLTVEGGEDGYFVGATLFDKVTPEMRIYKEEIFGPVVSVVRAKDYEEGLRLANEHEYGNGVAIFTRDGDTARDFAARVQVGMVGINVPIPVPIAYYTFGGWKRSGFGDLNQHGPDSIRFYTKTKTVTQRWPDGGSRAVLSGRSAGSASNAFVIPTMD

SEQ ID NO: 78752 - protein, 339 aa, Clostridium tetani E88
MKGDNTYMKLMEEIWAKAKANKKKIVLPEGEEERNIEACSKIIENAIADVVLVGNPERIKEIANKLGVNVDGAEIVDPETSDKTADYAKALYELRKHKGVTIEKAEKIIRDPLYFGTMMVQKNDVDGMVSGAIHTTGDLLRPGLQIVKTAPGTSVVSSSFIMMVPGSKFGNEGLLLFADCAVNPNPTAEDLASIAISTAETAKNLCGLDPKVALLSFSTQGSASHDLVDKVVTATKLAKEKRPDLAIDGELQLDAAIVKSVADLKAPNSEVAGKANVLVFPDLQAGNIGYKLVQRFANAEAIGPITQGFAKPINDLSRGCTSDDIVNVVAVTAVQAQNQ

SEQ ID NO: 78753 - protein, 265 aa, Streptococcus pneumoniae TIGR4
MKIGFIGLGNMGASLAKSVLQTRTSDEILLANRSQAKVDAFIADFGGQASSNEEMFAEADVIFLGVKPAQFSELLSQYQTILEKRESLLLISMAAGLTLEKLASLIPSQHRIIRMMPNTPASIGQGVISYALSPNCRAEDSELFYQLLAKAGLLVELGESLIDAATGLAGCGPAFVYLFIEALADAGVQTGLPREIALKMAAQTVVGAGQLVLESQQHPGVLKDQVCSPGGSTIAGVASLEAHAFRGTVMDAVHQAYKRTQELGK

SEQ ID NO: 78754 - protein, 497 aa, Triticum aestivum
  misc_feature (48)..(48): Xaa can be any naturally occurring amino acid
  misc_feature (278)..(278): Xaa can be any naturally occurring amino acid
  misc_feature (485)..(485): Xaa can be any naturally occurring amino acid
MPSALGSGFAGSVRLKYVKLGYQYLVNHFLTLLLVPVMAATALELARXGPGELLALWRALDLDLVHILCSAFLVVFVATVYFMSRPRPVFLVDYCCYKPSPSFRVPFTTFMEHIKLISNNDKSLRFQTRILERSGLGEETCLPPANHYIPPNPSMEASRAEAQLVIFNAIDDLVRRTGLKPKDIDILVVNCSLFSPTPSLSAMIINKYKLRSNIRSFNLSGMGCSAGLISIDLARDMLQVHPNSNALVISTEIITPNFYHGSRRDMLLPNCLFPDGRXAAILLSNRRREARRAKYRLVHVVRTHKGADDRAYRCVYEEEDDEGHSGISLSKELMAIAGEALKSNITTMGPLVLPMSEQLLFFFRLVGRKVINSKWKPYIPDFKLAFEHFCIHAGGRAVIDELQKNLELSPRHVEASRMTLHRFGNTSSSSLWYELAYIEAKGRMRKGDRVWQIGFGSGFKCNSAVWKCLRTVKTPTDGPWDDCIXRYPVHIPEVVKL

SEQ ID NO: 78755 - protein, 263 aa, Rhizobium leguminosarum bv. viciae 3841
MTVIDRNHVQVRGDGQRAMIFSHGFGCDQNMWRFVAPAFEADFKTVLFDHVGAGRSDLTTYDARKYSSLSGYADDLVEICRALGLTQTVFVGHSVSAMIGVIASLEAPELFESLILVGPSPRYINDDDYHGGFSAADIDELLTSLDDNHMGWSAAMAPVIMGNPDRPELGEELTNSFCRTDPEIAKAFARVTFTSDNRSDLPEVTARTLILQCRDDVIASEEVGEFVHRQVPNSQLVVLNASGHCPNLSAPDEVISAIRRFIR

SEQ ID NO: 78756 - protein, 201 aa, Myxococcus xanthus DK 1622
MQEFWNLPNMLTLGRILIIPLFVWLTYDADPLNSLLAGLVFAVAAITDVVDGYLARKWNLITVVGKFMDPLADKLIAMAALVMMVRLGRIAAWVVIVLLARELIVSGLRTIAASEGMVIAAGQEGKWKTSLQLVGIISLCVHYVHPLEFGTFSVPVDYNLVGQVLVYLSGAFSVWSAVVYFRAFLAMLAKRGGEPDPAKSV

SEQ ID NO: 78757 - protein, 434 aa, Prochlorococcus marinus subsp. marinus str. CCMP1375
MDKAMDNILSYPENWHQNIWPPFTQITSSRPPLQISNAKGCLIFKDNGEPIIDAISSWWVTLHGHSDPYIASAIYNQAKQLEQVIFADFVHPQAELLAKRLSQATGLQRLFFSDNGSTAVEVALKIALQYWHNKGEQRHHIIAFEGAYHGDTFGAMSVGERNLFNEPFKEMLFPVSRATWPSTWWGDEGIERREEEAIKKLEIMLERPTAAVILEPLIQGAGGMTMVRPEFLQAVQGVVRQAKALLIADEVMVGFARTGSLFASQRAKISPDLMALSKGLTGGFLPMGITMASQEIYNTFLGNDPQKTFWHGHSFTANPLGCAAANASLDLLERNPTAYTNFESRHLPHLEQLVKHPKIKKIRLTGTIAAFDLKTDGNDGYLNNTGKVIKAYALANNVFIRPLGNVIYLLPPLCISDHQLEQCYKVIKSSLDII

SEQ ID NO: 78758 - protein, 159 aa, Triticum aestivum
  misc_feature (61)..(61): Xaa can be any naturally occurring amino acid
  misc_feature (118)..(118): Xaa can be any naturally occurring amino acid
  misc_feature (138)..(138): Xaa can be any naturally occurring amino acid
NQIVNAVIDGDDIIYRDYVDVSVAVAHPKGLVVPVIRDADTMNFADIEKGITNLRKTLPEXMRAFNDEMAGGQFTISNGGVYGSLISTPIINPPQSAILGMHSIVQRPVVVDGSILAXRPMMYLALTYDHRLIDGREXVYFLRRIKDVVEDPRRLLLDI

SEQ ID NO: 78759 - protein, 164 aa, Vibrio campbellii AND4
MRHIISLLMENQPGALSRVVGLFSQRGYNIESLNVSPTDDETLSRLNITTNSDEMQLEQIQKQLHKLIDVLKVQEVTEFEHIERELMMVKVKASGFARAEVKRTADIFRGQIVDVTASQYTVQLAGTSEKLDAFIQAISEVTEVVEVARSGVVGVARGERCLKP

SEQ ID NO: 78760 - protein, 470 aa, Vibrio campbellii AND4
MKKTKIVCTIGPKTESVEKLTELVNAGMNVMRLNFSHGDYAEHGTRITNFRKVMEATGKQLAILLDTKGPEIRTIKLEDGNDVDLVAGQEFTFTTDISVVGNKDKVAVTYAGFAKDLNVGNTILVDDGLIEMEVLATSETEVKCKVLNNGALGENKGVNLPGVSVNLPALSEKDKNDLKFGCEQGVDFVAASFIRKASDVQEIRDILTANGGENIHIISKIENQEGVDNFDEILELSDGIMVARGDLGVEIPAEEVIFAQKMMIEKCNRARKMVITATQMLDSMINNPRPTRAEAGDVANAVMDGTDAVMLSGETAKGKYPVEAVTIMAQIANRTDSALKAELGSRLDSPRLRITEAVCKGAVDTAEKLAAPLIVVATEGGKSARSVRKYFPTANILALTTNTKTAAQLVLTKGVTPVVVESIESTDAFYVAGKELALESGLGSKGDIVVMVSGALVASGTTNTASVHVL

SEQ ID NO: 78761 - protein, 511 aa, Leucaena leucocephala
MDSLLLHLQPLAMALLFAIPLLLLLGLLSRFRKRPPYPPGPKGLPIIGNMAMMDQLTHRGLAKLANLYGGILHLRMGFLHMVAISDADSARQVLQVHDNIFSNRPATIAISYLTYVRADMAFAHYGPFWRQMRKICVMKLFSRKRAESWQSVQDEVETVVRTVGANTGKEVNIGELVFSLTKNITYRAAFGSSSREGQDEFIGILQEFSKLFGAFNIADFIPSLSWVDPQGLNARLAKARGSLDSFIDKIIDEHMQNKKKEDEEGDMVDELLAFYSEDHSKVSESDDLHNSIKLTKDNIKAIIMDVMFGGTETVASAIEWAMAELMRSPEDLKRVQRELAEVVGLDRRVQESDMEKLTYLKCALKETLRLHPPIPLLLHETAEDAVVSGYFVPKKSRVMINAWAIGRDRNAWEDPDSFKPARFLGEGVPDFKGSNFEFIPFGSGRRSCPGMQLGLYALEMAVAHLLHCFSWELPDGMKPSEMDMSDVFGLTAPRASRLVAVSRKRLVCPLF

SEQ ID NO: 78762 - protein, 440 aa, Oryza sativa Japonica Group
MASRIASRLLRRSNATLGLIRSYSHARNYSSQLSALIPIGSQSSKLTRRRYYLPNASPYQLWSRSFASDNGDQVEAVVPFMGESVTDGTLANFLKKPGDRVEADEPIAQIETDKVTIDVASPEAGVIEKFIASEGDTVTPGTKVAIISKSAAPAETHVAPSEDSTPKETPPKAEETKPKLEEKSPKAEPPKMPLPPKTSPTEPQLPPKERERRVPMPRLRKRIANRLKDSQNTFAMLTTFNEVDMTNLMKLRSDYKDEFVTKHGVKLGLMSCFVKAAVTALQNQPIVNAVIDGDDIIYRDYVDISVAVGTSKGLVVPVIRDADNMNFADIEKGINALAKKATEGALSIDEMAGGTFTISNGGVYGSLISTPIINPPQSAILGMHSIVQRPVVVDGNILARPMMYLALTYDHRLIDGREAVYFLRRIKDVVEDPRRLLLDI

SEQ ID NO: 78763 - protein, 367 aa, Rhizobium leguminosarum bv. viciae 3841
MSYDQKRVVDAIRAFEAGEMVVVMDDNDRENEGDLIVAAVHCTPEKMAFIVRHTSGIVCAPMPKEEAKRLNLNAMVAENDSAHTTAFTVSVDFKHGTSTGISADDRTLTVRNLANPNVGASDFVRPGHIFPLVSREGGVLMRSGHTEAAVDLCKLAGLPLIGVISELVNDDGTVTRGPQVVDFAAQHGLKLVSVADLIAYRQRKETLIELGTSFDIETPFGRAKAHTYSLPWDPMQHLAVVFGDIRDGVDIPVRLHPENVAEDLFGKNSPVDFYMQKISEQGRGVIVYLREGSVGVGHHDNGRKARNQGREAHAEAQTRDSEWLEIGLGAQILRDLGVSSIKLLTSRERHYVGLEGFGIKISTTEIC

SEQ ID NO: 78764 - protein, 429 aa, Vibrio sp. Ex25
MSVVQLTILTFINMAGSGIIMLPSKLAQVGTISVLSWLITAAGSLALAYVFAKCGRFSKRDGGMNGYASYAFGKSGAFMAGWTYGLSLLIANIAIAITCVGYGSAFFEVTLSPVETCLYTIAILWICTFANFGGAKITGQIGTFTVWGVILPVCSLGIVGWFWFNPTMYIEAWNPHHLPFGEAVSASIAMTLWAFLGLESACANSEAVENPEKNVPIAVLGGTLIAAVVYIVSTNICSGIVANSELAASTAPFSTVWSVMLGSAAGKAVAGMAVLACAGSLLGWQFTIASVFKSSSDAGFFPKLFSQVDKRGTPIKGMVAITVIQSVLSLMTISPTLNEQFEALVNLAVVTNVIPYILCMGAIFIMQQVAHVPEREMKTTNIIALIGSLYSFYALYGSGYEAMMWGSIVTFLGWSAYGLIAAKHEPLAN

SEQ ID NO: 78765 - protein, 188 aa, Sinorhizobium fredii
  misc_feature (167)..(167): Xaa can be any naturally occurring amino acid
MPVKKRIPFVAFRTRVRDETIGGPNPYRWEVRTTEDYFSGKRVVLFSLPGAFTPTCSTQQLPDFERLYDEFRKVGIEAVYCLSVNDAFVMNAWGKALGLEKVRLIPDGSGEFTRKMGMLVAKDNLGFGMRSWRYAAVVNDSVVEQWFEEEGFSDNCESDPYSASSPXNILETLRTFDTARLGRVPIKF

SEQ ID NO: 78766 - protein, 359 aa, Oryza sativa Japonica Group
MALRGGHAAAAAGVSSGSEDDDEEAGFSRSYFLAKEKEPSSGKKRARAAGKLSDLNLVDEQVLRASLAEIPPKHEREVEALTRSYKEQYRNWLFELRCGFGLLMYGFGSKKMLLEDFASTTLSDFTVIVVNGYLPSINLKQEVLVILWRTIDFYIKALNSAKFSALLPFQVIVTIAEIFWEQTKLKRKRQTATRSQLQPFASQSIDDIISFLNNQTSDNGDDNVCLLIHNIDGPALRDAESQQYLAQVSCCPQVHVVASVDHVNAPLLWDKKMVHTQFKWSWYHVPTFAPYKVEGMHFSSLYTKCRERFLVSSQVTLNSHLTEFKDHDLVKIRKHSDGQDCLHIPLVSDALEKLLQELT

SEQ ID NO: 78767 - protein, 456 aa, Nocardioides sp. JS614
MDEGLFAAPGTAARTGGGSLSANTHASAPLAVRMRPRTLDELVGQAQLRAAGSPLRRLVEGDQSMSLLLWGPPGTGKTTIAAIVSQQTDRRFVEVSAVSAGVKEVRAAIDAARAELAGGGRETVLFVDEVHRFSKAQQDALLPGVENRWVTLIAATTENPFFSVISPLLSRSLLLRLESLDDDDVRAVLDRAITDERGLAGSVGVDDDALGHLVRLAGGDARRSLTYLEAAAGAALAQGLETVDLATAETAVDRAAVRYDRQGDQHYDVVSAFIKSVRGSDADAALHYLARMIEAGEDPRFIARRLMILASEDVGLADPTALPTAVAAAQTVQLIGMPEAQLTLAHATIALAVAPKSNAVTTAIGAALADVRAGKIGQVPPHLRDAHYSGAKKLGHGARYKYSHDEPFGIAEQQYAPDVVADAEYYRPTTLGAEAAIKERWERVRRLIRGQRQGER

SEQ ID NO: 78768 - protein, 202 aa, Triticum aestivum
MMGGFVSRILLLVFGYAYPAYECYKTVELNKPEIEQLIFWCQYWILVALMTVMERFGDLTISWLPFYSEAKLLFFIYLWYPRTKGTTYIYGTFFKPYISQHENEIDRNLLELRARASDVVVVYVQKVAAVGQNTFFDVLKYVASQSPSQKSKHNVLRNHSRLSNSNHTHNRQCSSSNHKGKRILLCAEQHLSLLGKEEWTAS

SEQ ID NO: 78769 - protein, 510 aa, Colwellia psychrerythraea 34H
MTQDKVLCDIGFIGLGVMGKNLVLNLADNGFNIAAFDLSDEKVQAVIAQDEAENATDTPRVYGCSSYTELLSQLKAPHLIVLSVPAGAPVDQVCENLIGAGIQPDDIIIDTGNSLWTDTVAREKKYKSNFLLFSSAVSGGEVGARFGPSLMPSGSPYAWARVKPIWEAIAAKVDAETGKPIDRTKPGQVITEGEPCAAYIGPAGAGHYVKMVHNGIEYADMQIICEAYHVLKSGLNLTCDEIADIFAQWNDGPLDSYLMEISVEVLRHKSTDTNTPLVELILDKAGQKGTGLWTAMSSLEVGCPAPTIAQAVYARSISSFKELRTQASSLLEGPQLAPLSAAEQQQVIEQLHDAMYCAKICAYAQGFQLMKLAAKEHGWVLDFASIAKIWRAGCIIRAAFLQSITNAYERNENLDNLLLDDFFVKELNKRQLNWRKAICHATMQGVPIGALSSSLAYYDSMRSETLPANLLQGQRDFFGAHTFERIDKTAGKKYHVQWSTKGKETILVDG

SEQ ID NO: 78770 - protein, 568 aa, Xanthomonas campestris pv. campestris str. ATCC 33913
MTHSVEDIKSTSRRLRGSLEQSLADPVTGALREDDQTLIKYHGSYQQDDRDIRDERRRQKLEPAYQFMIRTRTPGGVISPSQWLALDGIATRYANHSLRITTRQAFQFHGVIKRELKATMQAINATLIDTLAACGDVNRNVQVAANPLRSQAHATLYADAARVSEHLLPNTRAYYEIWLDEERVSGSGAEDEPIYGDRYLPRKFKIGFAAPPHNDVDVFANDLGFIAILREGQLLGYNVSIGGGMGASHGDAETWPRVANVIGFVTGDQLLDIATAVVTTQRDLGNRAVRKRARFKYTIDDHGLDTIVAEIERRAGFSLQPAQPFAFAHNGDRYGWVEGEQGDWHLTLSLPAGRIADTDTAAHLSGLRAIAQLQMGEFRMTPNQNLVIAGVPAEQRAQIDQLVAQYGLDAGNLAPTALARGAMACVALPTCGLAMAEAERYLPDFSAALQPLLERHGLAQTPIVLRLSGCPNGCSRPYLAEIALVGKAPGRYNLMLGGDRRGQRLNTLYRENINEADILAALEPLLARYAAERDRHTDEGFGDFLHRSGLIALPPYPTHRHLDLELLA

SEQ ID NO: 78771 - protein, 562 aa, Colwellia psychrerythraea 34H
MPQSQRPLYIPYAGPSLLETPLLNKGSAFSKEERGSFNLTGLLPPRFESIDEQAERAFRQYSCFQTNINKHIYLRAIHDNNETLFFKLVQNNLAEMMPIIYTPTVGDACEQFSDIYRSSRGLFISYEDRFNIDDMLRNATKNKVKVIVVTDGERILGLGDQGIGGMGIPIGKLSLYTACGGISPAHTLPVMLDVGTNNQKLLDDPMYMGARHKRIDQDSYDEFLELFISAVKRRWPNVLLQFEDFAQPNAMPLLQRYKDRICCFNDDIQGTASVTVGTLLAACRSKGSKLSELNVAFVGAGSAGCGIAEQIISQMMNEGLGAEQARSQVFMVDRFGLLTQGMGELRDFQQKLVQSNEAIAEWDIAGEFASLVEVMHGAKPDILIGVSGQAGLFTEKVITAMKSHCEMPIIFPLSNPSRQVEATPSQVINWTQGQVIIATGSPFDPIEYQGKTFPIAQCNNSYIFPGVGLAVVAANISRITDGMLQVASETLAAASPLANGESDELLPPLTSIAQLSRDIAFAIAKVAYKQGLALELTDDELLAKIEHNFWKPEYRQYRRTSL

SEQ ID NO: 78772 - protein, 148 aa, Zea mays
  misc_feature (11)..(11): Xaa can be any naturally occurring amino acid
  misc_feature (19)..(19): Xaa can be any naturally occurring amino acid
  misc_feature (65)..(65): Xaa can be any naturally occurring amino acid
  misc_feature (106)..(106): Xaa can be any naturally occurring amino acid
HGRSRRWWSTXVVFQPVAXPPGSDGSTITGRSERASASRSGEQRSCKSRASSTHLEDADVPALSXKWRGKTAEELASETAFLSDVATGDMEKFRRVTMMLPVMGDXNAEKVTENCEAFWKVGVLYTNTEGVTREKFNMVMKPQTVMWG

SEQ ID NO: 78773 - protein, 487 aa, Colwellia psychrerythraea 34H
MPLIKYKNYVDGAYTSNGTGETFDVTNPATGQVIYQVEIADELIKSKAIESAKRGFAQWSAMSATERSRVLLKAVDLLRERNDELAEIEVLDTGKPWQEASVVDVQSGADSIEFFAGLAPGIEGNQQQVGADFYYTRREALGICAGIGAWNYPLQIACWKAAPALACGNAMIFKPSEETPLGALKLAEIFSEAGLPDGVFNVLQGAGDVGSWLSHHPEIAKVSFTGEVGTGKKVMAGAATTLKDVTMELGGKSPLIIFDDADVDNAVSAAMLGNFYTQGEICTNGTRVFVQKEIYPTFIKKLVERTKNNIIVGDPMDPETNFGALISAKHQRLVLDYIDLGLKEGATLLQGGAALNPIGCDAGYFVEPTIFTDCNDDMRICCEEIFGPVMSVLTFDDEDEVIKRANATEFGLAAGVFTQDITRAHRVIHQMQAGICWINSYGLSPAEMPVGGYKLSGIGRENGLATLNHYTQIKAVYVGLEPLESPF

SEQ ID NO: 78774 - protein, 449 aa, Oryza sativa
MAVTIQSVKARQIFDSRGNPTVEVDVGLSDGSFARGAVPSGASTGIYEALELRDGGSDYLGKGVLKAVSNVNTIIGPALIGKDPTEQVDIDNFMVQQLDGTSNNWGWCKQKLGANAILAVSLAVCKAGAMVKKIPLYQKLQHIANLAGNKTLVLPVPAFNVINGGSHAGNKLAMQEFMILPTGASSFKEAMKMGVEVYHHLKSIIKKKYGQDATNVGDEGGFAPNIQENKEGLELLKAAIAKAGYTGKVVIGMDVAASEFYSEKDKTYDLNFKEDNNDGSHKISGDSLKDVYKSFVSEYPIVSIEDPFDQDDWATYAKLTDEIGQQVQIVGDDLLVTNPTRVAKAISEKTCNALLLKVNQIGSVTESIEAVRMSKRAGWGVMASHRSGETEDTFIADLSVGLSTGQIKTGAPCRSERLAKYNQLLRIEEELGDAAVYAGEKFRAPVEPY

SEQ ID NO: 78775 - protein, 445 aa, Oryza sativa Japonica Group
MRKKPARAVPEWLNSPLWSAPPPSSSSPSPPVPPDPYGADLSPPPPPPPKPPPTVPPPSYEQAVGSSRRARSEAGWEEEEEEDGEVGGGAALRAHLLADFKLALSKKVVNMGELRRLACLGVPDGGAAVRPLVWKLLLGYLPTERAFWPHELEKKRSQYSAYKDEFLLNPSEKIRRFEESKLLRKKELNSDKIGLLPRAKVTNEEHPLSFGKSSLWNQYFQESEILEQIDRDVKRTHPEMPFFSAKANQESLRRVLIIFSKLNPTIRYVQGMNEVLAPLFYVFKNDPDTSNSASAEADTFFCFVELLSGFKDNYCKHLDNSQVGIRSTLSKLSQLLKRHDEELWRHMEITTKVYPQYYAFRWITLLLTMEFSFNVCIHIWDAILGDPEGPPDTLLRICCAMLILVRRRLLAGDFTANIQLLQHYPPTNIDHLLHIANRLRGSVAS

SEQ ID NO: 78776 - protein, 171 aa, Wolbachia endosymbiont strain TRS of Brugia malayi
MDLSKITIASDAVNVIIEISANAEPVKYEFDKELGLLRVDRFLSTAMVYPCNYGFVPNTCAGDGDPVDVLVLTQFPLAPGVLISVRPVGALLTKDEKGKDEKVLAVPVSSVDSYYDHVKNCSDLPKNLLDKITHFFLHYKDLEKEKTVTVGEWVDAEKAKKIVESAIKSRN

SEQ ID NO: 78777 - protein, 508 aa, Wolbachia endosymbiont strain TRS of Brugia malayi
MQDFKALENLQTKTLEAEKGGGLDRINKQHEKGKLTARERLSILLDENSFEEYDKFVKRHVTDFGMQNASFLGDGVVIGHGTIYGRKVFVYSQDFTVFGGSLGASHAKKICKIIDMAINVRVPIIGLNDSGGARIQEGVNSLAGYGELFQRNVNASGVIPQISLIMGPCAGGAVYSPALTDFTFMVKNSSYMFITGPDVVKKVTYEDVNHEDLGGAKIHTSKTGVVDFAFNNDVEMLLKIREFFTFLPANNQELPKSVPICDDVDDINESLNTLIPHNPNTPYDMHELIEKVCDERNFFELKPDFARNIIIGFGRIKGNTVGIVANQPMYLAGCLDIDSSRKAARFVRFCDAFNIPITTLIDVPGFLPGTNQEYNNIIQHGAKLLYAYAEATVPKISLITRKAYGGAYIVMNSKHLKGDINYAWPTAEIAVMGPESAVEIIFRHEKDQQTLIKEYKEKFANPFFAASHGYIDDIIVPSKTRYHLYKALELLKNKKIERIWKKHDNLPL

SEQ ID NO: 78778 - protein, 416 aa, Chlamydomonas reinhardtii
MMHANCFTHSRRTFQRGAPSSSSSRGRCLRVQAQAAAPRDGAPLQTSRRQILKLGSAALMMAGTAGTALPQLSPALAAGAPLATVERIDLAQGLNISRVVKGCWQLSGGHKGSRETDRTSGLAAVEDFGKFVAAGVTTFDAADHYGPAEALIGRYLASNPDQRPPKTQVLTKYCVFGQMDMATINKGAVVQVRRLGVDSVDLMQYYWADYDVKRYVDGALYLSECAAEGLIKHVGVTNFDVPRMEAMTKAGVRIAANQLQYSLLDRRPENGMSAFCAANNIQLLPYGVLAGGFLSDKYLGVPASKVTSDTYSKGKYARVIMEAGGWSWFQDLLQALDGVARKHDVTISNVAARWVLDRPGVAAVILGARNADHVEDNQRLFSFRLDADDLGAIDEVLARGRRPRSDCYSWERGGQW

SEQ ID NO: 78779 - protein, 311 aa, Arabidopsis thaliana
MGMLSTAAYVLTMDMFGPIADNAGGIVEMSQQPESVREITDLLDAVGNTTKATTKGFAIGSAALASFLLFSAYMDEVSAFANVSFKEVDIAIPEVFVGGLLGAMLIFLFSAWACAAVGRTAQEVVNEVRRQFIERPGIMEYKEKPDYSRCVAIVASAALREMIKPGALAIASPIVVGLVFRILGYYTGQPLLGAKVVASMLMFATVCGILMALFLNTAGGAWDNAKKYIETGALGGKGSEAHKAAVTGDTVGDPFKDTAGPSIHVLIKMLATITLVMAPVFPLKVNRYLSIPAYLLSCTYTNREGERLVIK

SEQ ID NO: 78780 - protein, 345 aa, Kineococcus radiotolerans SRS30216
MTTPRDHTPDSSGSGRSVVVDTDTGIDDALALLWLAGRRDVEIAAVTAVYGNCTVQDATRNIGAVLSVAGLTVGEGGIPVSVGAAGPIDGRPAHFATYVHGHDGLGDLGGERPDVPVEDRSAAEQLVHLANTDPGRHDLLVLGPMTNIAAALERDPDLLTKFRSTVVMGGSGPFPALGVAQIVDANIANDAAAARAVFAAPRTQLVMVGVNVGAGAIVDEAAVRRLHDSPTEVGRFSAALLESYMDFYQQVWGRRVSPAWDGLAAALLVEPRWISDFEDGPVGLVPDGERWRAHLLRTAEGGPVPFEPATRPGRPAPSTRVALAVDVEAFLDDFLTTLAGDGARP

SEQ ID NO: 78781 - protein, 364 aa, Nocardia farcinica IFM 10152
MSTAGVAPQAGVHSRWPGLIAAYRDRLAGAADWEPVTLFEGGTPLVPAPYLSELTGCEVYLKVEGANPTGSFKDRGMTMAMTDAKYRGQQAVLCASTGNTSASAAAYATRAGMTCAVLIPQGKIAMGKLAQAVMLGAQIIQVEGNFDDCLELARKVTAEFPAVGLVNSVNPARIEGQKTASFEICDVLGKAPDVHALPVGNAGNITAYWRGYREYYADGITGSLPRMLGVQAAGAAPLVHGAPVKEPETIATAIRIGAPASWNGAVAAKEESGGAFRAATDEEILAAYRLVAAKEGVFVEPASAASVAGVLAARADGWLEPGLTVVCTVTGNGLKDPDTALLGMPQVEAIKVDPVAVATRLELA

SEQ ID NO: 78782 - protein, 525 aa, Oryza sativa Japonica Group
MALLRAHHLLLMRPRAAFSSRPPPLSSSPCRRALPTTAIASRLLCSHHASSPPEDASASASPSIVADLLDYLNESWTQFHATAEAKRQLLDAGFTLLSENDDWDLQPGGRYFFTRNMSCLIAFAVGEKYKLGNGFNIIAAHTDSPCLKLKPRSASFKSGHQMVNVQTYGGGLWHTWFDRDLTLAGRVILKDADGSFKHELVKVSRPLIRVPTLAIHLDRTVNSDGFKPNLENHLVPLLATKHEETTANSSEKNSSSSTKVVHHPLLLQVLSDEIGCKSGEIIGIELNVCDTQPSCLGGGNNEFIYSGRLDNLASCYCALRSLMDSSKMPEELSNEKAIRMIALFDNEEVGSNSMQGAGAPTMFHAMRRIVDSLMHQSMGEGALERAINSSFLVSADMAHALHPNYPDKHEEHHRPELQKGLVIKHNANQRYATSAVTAFLFKEIARLHNLPVQEFVVRNDMGCGSTIGPILASGVGIRTVDCGIPQLSMHSVREMCGKEDVDTTYKHFKAFFEMFSDIDRKLNVD

SEQ ID NO: 78783 - protein, 226 aa, Triticum aestivum
  misc_feature (139)..(139): Xaa can be any naturally occurring amino acid
  misc_feature (173)..(173): Xaa can be any naturally occurring amino acid
  misc_feature (184)..(184): Xaa can be any naturally occurring amino acid
  misc_feature (203)..(203): Xaa can be any naturally occurring amino acid
  misc_feature (207)..(209): Xaa can be any naturally occurring amino acid
  misc_feature (217)..(217): Xaa can be any naturally occurring amino acid
  misc_feature (221)..(221): Xaa can be any naturally occurring amino acid
MARGGGNGEVELSVGVGGGGGGAAGGGEQPAVDISLGRLILAGMVAGGVQYGWALQLSLLTPYVQTLGLSHALTSFMWLCGPIAGLVVQPCVGLYSDKCTSRWGRRRPFILTGCILICIAVVVVGFSADIGAALGDSKXEECSLYHGPRWHPAIVYVLGFWLLDFSNNTVAGXPARALMADLSXAQHGPSAANSSSVLGMALXKTLXXXSGSTNNWXKWFXSPGFL

SEQ ID NO: 78784 - protein, 576 aa, Oryza sativa Indica Group
MRGNLREQKAYHMEGADEERPLIHHLPPQEQCSQYTCDGTVDIDRRPALKHSTGNWRACFFILGAEFTQCLCFSAVVKNLVRYLTSVLQESNVNAARSVSTWIGTCFFTPLIGAFLADTFWGRYRTIVICLSVYSIGMLILTTSASLPFLLHDSYNNGDDIRRVVAYLGLYLIALGAGGIKPCMSALGADQFDGADPVERVTKGSFFNYYYFSNNMGTLLSTTVLVWVQDNIGWGIGFATPMLLMGFGLSMFVAGRRVYRYRKLGRSPLTRVSQVVVAAARNHRLKLPDDSSLLHELPSLTEGGYRIQHTTRFRFLDKAAIPSDSDDNSPVQPDPWRLCTVSQVEELKMLLRVFPVWASLLVFFVVTAQMSSTLIEQSAAMDGRIGPFTVPPASLATFNVVAVLIWVPVYDAVLVPLARRATGNDRGLSHVQRIGVGLALSAVAMAYSAQVERRRRRPAAEEEAMSIMWQAPCYLVLGMAEVFTSIGMLEFFYERSPGSMKSLGTSLAHLAVATANYLNSGVLGVVVAATTRGGGAGWIPDNLDEGHLDYFFWMMALVSVLNLLQFLHCSIRDRGQ

SEQ ID NO: 78785 - protein, 178 aa, Triticum aestivum
  misc_feature (58)..(58): Xaa can be any naturally occurring amino acid
  misc_feature (71)..(71): Xaa can be any naturally occurring amino acid
  misc_feature (84)..(84): Xaa can be any naturally occurring amino acid
  misc_feature (112)..(112): Xaa can be any naturally occurring amino acid
  misc_feature (126)..(126): Xaa can be any naturally occurring amino acid
GANVSEVAYAVGKDTRIGPKFLNASVGFGGSCFHKDIPEAWCTSATCNGLPEVANYWXKQVIRINDYQKTXLERVRGSMFNTVXGKKIASSGSPLKKTPGEPRETPALTSAXGCLGDKPVYIYDPXLRETNSGPMTIGHITSTDTPRHYKYSGPYKHAQHPWTLNLTQFKKLAKIHRN

SEQ ID NO: 78786 - protein, 566 aa, Oryza sativa Indica Group
MEAGAADEETPLIQQLPPEEQCSQYTCDGTVNSDKKPALKQSTGHWRACFFILGAQFAETLCFFMVSKNLVTYLTSALHESNIDAAQSVSIWIGTSFFTPLIGAFLADTYWGRYWTTVISLFIIIIGMLIVTVSSSPLFLNSSYYNWNICRATVYTGLYLTAVGSGCMKPCIPAFGADQFDSADPVERLAKGSFFNWYYFSMNVGSLLSTTLLVWVVANIGWSVGFAIPMLLSGFGIALFFAGRKVYRYKKQGGSPLTRVSQVVVAAVRNHRLKLPDDSSLLHEVSKVTEDDYRTQLTTQFRFFDKAAILSDEISPAQWSPWRLCTVSQVEELKMLLRMFPVWVSMVVFFVVTAQITSMLIEQGMAMDGRVGPFTLPAASIATFDVISVLVWVPVYDTVLVPLARRVTGKDRGISHLQRIGVGLALAAVAMAYSAVVEARRLGTAPAPVSIMWQAPSYLVLGVAEAFSVIGMMEFFYEQSPESMKSLCTALGQLAIAVANYLNSGVLVVVAAATTRGGGAGWIPDNLDEGHLDYFFWMMAVVSVLNLLHFLHCSIRYRANNNTLSS

SEQ ID NO: 78787 - protein, 787 aa, Colwellia psychrerythraea 34H
MTQEIKSNDSEGTIKDNAEESNEVNNEVNSTAENSITKAYGNDAAEAKVTDEKVSEHNDPVEPTGSAFTIVRHDNGIAHLVIDVIGENVNTLKAEFTEQVNAVLAEIKVDKAITGIVLCSGKKGSFVAGADINMLDACQSRDEVVALSRQGQRIFSLLEQLPIPIVAAIDGACLGGGLELAMACHARVCSDNSKTALGLPEVQLGLLPGSGGTQRLPQLVGLQKALDMMLTGKQLRAKQALKSGLVDDVVPSSVLLTVAEDLAISLRQRGKKTVKRKQGLMDKLLENNAVGRKVVYQQAQKTVLAKTQGNYPAPAKIIDCIRTGIESSPEKGYRVEAEHFADLVMSDESAQLRQLFFATTAMKKEQGVADVMPEKMTKAGVLGGGLMGGGIAFVTATKANMPVRVKDISHKGIGQALKYSYQILNKKVKRRFLLNSEMQKQLAMITGSVEYTGFKALDIVVEAVFEDLTLKQNMVAEVEAQGHDKTIFASNTSSLPIGKIATNAKRPENVIGLHYFSPVDKMPLVEIIPHDKTSDQTISNTVAFAKKQGKTPIVVKDKAGFYVNRILAPYMNEAAILLLAGEPIDKIDKALVKFGFPVGPMQLLDEVGVDVGAKIGPILQADLGERFAAPAAFDKLLADGRLGKKVKKGFYQYEKPTFTKNLQNTFKGIKSGHKQVDETIYSLLNIKPMGSLSAVEISKRCTYMMLNEAARCVDEGIVRNARDGDIGAIFGIGFPPFLGGPLRYIDKIGAKSVVAQLSQWAEQHGERYTPCEALITMAENDAVYYPK

SEQ ID NO: 78788 - protein, 906 aa, Oryza sativa Indica Group
MEAADEERAPLLHPQPQPSRGDADSEYTGDGSVDVNNQPALKRSTGNWRACFMILGVEFSENLAYYGISKNLVTYLTKVLHESKVNAARNSSAWSGACYLTPLFGAFLADTYWGKYRTVLTFLPIYILGLLTLMASTSLPSSMTSSDAGHQLHSVAVYLGLYLVAFGNGGVKPCTSAFGADQFDGGDAAELRRKGSFFNWYTFMINSGSLLASTVLVWLQDNVGWGISFVIVVVVMAFFLAVFFAGSRVYRYRPVRGSPLTGVCQVVVAAVRKWHLELPDDSSLLYEAQVADHRIKHTDQFRFLDKAAIVVTPSSLNGEKGNVAAAAAPGDADSEYTGDGSVDVNNQPALKRSTGNWRACFMILGVEFSENLAYYGISKNLVTYLTKILHESKVNAARNSSAWSGACYLTPLFGAFLADTYWGKYRTVLTFLPIYILGLLTLMASTSLPSSMTSSDAGHQLHSVAVYLGLYLVAFGNGGVKPCTSAFGADQFDGGDAAELRRKGSFFNWYTFMINSGSLLASTVLVWLQDNVGWGISFVIVVVVMAFFLAVFFAGSRVYRYRPVRGSPLTGVCQVVVAAVRKWHLELPDDSSLLYEAQVADHRIKHTDQFRFLDKAAIVVTPSSLNGEKGNVAAAAAPVSRWRQCTVTQVEEVKMLVRMCPIWACLVLFFSVSSQMSSTLVEQGTAMDNRVGPFTIPPASLATFHSIGVLLWIPVYDVALVPLARRATGKPKGITQLQRIGVGLAVAALIMAYSALVEERRLAAARAGAARTSILWQVPAQLMHGMAVVFTSIGKSEFFYDQAPRSMRSMCTALGQLAIAAGNYLSAFLLAVVASATTCGGDPGWIPDDLNKGHLDYFFWLMAALLLLDLLFFVFCAMRTREHCCFLIDPPKNVTLCMAFVGLYKN

SEQ ID NO: 78789 - protein, 351 aa, Bacillus pumilus SAFR-032
MKHVSIAAIPGDGVGKEVVPEAIRVLKAVSEVHGGLSFTFQDFPWSCEYYLEHGEMMPKDGLDQLKAFDSIFLGAVGDANLVPDHVSLWGLLIKIRREFEQVINVRPAKQLNGIRSPLSQPKDFDLLVVRENGEGEYSEIGGRIYQGEDQLAVQNAVFSRKGTERAMRFAFQLAEKRRKHVTSATKSNGIVHTMPFWDEVFQDVAKDYPEVTADSQHIDALSAFFVTRPEKFDVIVASNLFGDILTDLGAAIMGSIGVAPAANINVNGKYPSMFEPVHGSAPDIAGKGIANPIGQIWTAKLMLDHFGEEELGTHLLETIESVTADGFLTADIGGAYQTQEVTNEIIKRLKK

SEQ ID NO: 78790 - protein, 570 aa, Psychrobacter arcticus 273-4
MPSIASRLIPVWLRQYQLSALPTDIIAGIVVGVLVIPQSLGYAVLAGLPPVYGLYAAIVPVAVYSWLGSSNVQAVGPAAVTAIMTASVLHPYADKGVEQYVLMAALLALMMGAILWLAGQLKLGWIMQFISRGVSAGFISGAAVLIFISQLKYLTGIPIAGNGLIGYLSSMQMYASQLHPLTLIIGMSALILMVLNRYGKKWVWQSWLSPSYAKWAERLFPLILLTIAIVLSVVLHWTTSGVATIGNVPQGLPNFTAPYLPDFHEALNLLPTAGLMALIAFVSSSSVASTYARLRGELFDANRELTGLGLANVAGSFFQSFPIAGGFSRTAINVDSGAKTPLASLVTVLVMIAALIAFGYMLAPLPYAILGATIMAAIIGLIDMATLKSAWHRDRLDAASFIAAFAGVLIFGLNTGLVIGLMVSFASLIWQSSKPHVAIVGQLAGTGHFRNINRHDVVTFHNLLMLRIDESLFFGNSESVHRHVVQATRQYPEAHEIILIMSAVNHIDLTGQEMLISLNQELLNQRKHLSFSFIKGPVMDIIEHTPVITDLSGRVYLSTMDAVNGLTDTH

SEQ ID NO: 78791 - protein, 319 aa, Xanthomonas campestris pv. campestris str. ATCC 33913
MALYDNILDTIGRTPVVKLNRLAPDHVSLYVKVESFNPGGSVKDRLALAIILDAEQRGLLKPGDTIVEATSGNTGVALAMVAAARGYKFVATMVETFSIERRKLMRAYGAKVILTPAAERGSGMVRKAKELAEQHGWFLASQFANPANPAYHRNTTAAEILRDFAGHRLDHFVTGWGTGGTLTGVGEVLRVARPEVRITATEPAGAALLQGQDWKPHKIQGWTPDFVPEVLNREVAHEILSVEDTDAISVARRLAAEEGIFTGISGGGTVSTALRVAETAVPGAVILAMLPDTGERYFSTPLFADINEGSDDDWLAGLP

SEQ ID NO: 78792 - protein, 275 aa, Bacillus thuringiensis serovar konkukian str. 97-27
MHIPTTTLHNGVKMPLIGLGVYKAKEGDEVKQAVKTALEVGYRSIDTATVYENESGVGEAVRESGIPREDIFITTKVWNDDQGYEETLEAFEKSLKKLQMDYVDLYLIHWPIRGKYVDTYRALEKLYEEGKVRAIGVSNFHKHHLELLLPNCKIKPMVNQVELHPMLTQFELRNFCQGEQIQMEAWSPLMRGGEVFQHPIIQAIATKYEKTPAQVILRWDIQSGIVTIPKSVTPSRIQENFSIFDFSLTEEEMTEINTLNRNLHVGTNPDKYDTL

SEQ ID NO: 78793 - protein, 234 aa, Petunia integrifolia subsp. inflata
MHPHPPPYVMVENGRQPPPPYHSRKAPRYGGEYYYEERPRRGNCCIRCICCCYCVLFFIIVLLGAFAFYFYTMYQPKLPTYKFQSLEVKEFGYQPDFSLTTDIIVTIRAENPNKAISLIYGKESSVNVTYTDSTICSGTLPSFHQGHKNVTMMQIELKGKSQFGSGLYEAMQDNEKNGKIPLLVKLKVPVQVYVGEYPLRQFNVLANCSLVVDNLKPGKKVEIIKNDVTFKLAP

SEQ ID NO: 78794 - protein, 344 aa, Arabidopsis thaliana
MQPKTEFVKFLRKGAYGSVDLVKYIKRDDNALPLYAAVKTAECEDYNSLEREIQILSKLEGCRRIVQCYGNYTLEEDFDVGGFRVYKMVMEYAAAGSLFSFMDSYKDRKLPETMIKDFTRMILQGLVSVHRLGYVHCDLKPDNLLVFPCRQSYELKISDFGSSRKVGEYSDCWDVDLPFVGTPVYMSPESVRSGVAEKALDLWSLGCIVLEMYTGVIPWSEVEFEDLAPALSKGKAPEIPKSLPCDARKFLETCFSRNPKERGSASDLLSHQFLRGEVVSGFSLPPLKLKIKLAPEKPTNVSKKPLKLKIIPPKPPQFKKGGIKPLKLKIMPLKPPASSFVSVQ

SEQ ID NO: 78795 - protein, 760 aa, Colwellia psychrerythraea 34H
MKIGIIVGTRPEIIKMAPVIRECKKRGIAYFIIHSNQHYSQEMDSIFFKELELPAPDYNLGVGSGLHSNQTGNILIEMEPILLQEKPDVVLVQGDTNTVLAGALAASKLDIKVGHIEAGLRSYDRTMPEETNRILTDHMSEYLFAVGPNQHAILAKEGIDSDKIFTVGNTVSDSLFQHLDISASTSTILADLDVTSGEFFLVTAHRASNVDIPANLLELLALFDKLHAKYSQTIVWPIHPRTQSKLKEFSIELPSYLKLIPPIGYLDFIQLQKHAQLILTDSGGIQEEACLLGVPCITLRENTERPESIEVGANVLVGRDAVKALAAADKWLASDAASFSWSNPFGDGHVAETILDIITNSVPNTLEEEIIAKNETLSVIGMGYMGLPIASLLAEAGYKVTGVDLNSDKVSVINEAQCPFDEAGLPELITKVVSQGFLTASTEIPSSETYLVAVPTPHKNNSCDRSYVFSAVDAIAKVAKNGQTVIVESTISPQTSVAVAQRFADAGLTIDVVHCPERAIPGQTLHELVHNDRIIGATSIEAQQKVKTIYQSFVKGEVFLTDLTTAECIKLVENTSRDVGIAFANELSQICEELEVDVYEVIRLANRHPRVNVLTPGPGVGGHCIPIDPWFLVENTKAGEFVRLAREINDKRPSIVAEQALALLGDTKDNLAGKKVGILGVAYKANVDDCRESPADAILDHFKKAGVDVNYHDPFVPNWHCEKQETITEIDNWADVLILVTDHECYSNLKVSSLLLNARA

SEQ ID NO: 78796 - protein, 323 aa, Burkholderia thailandensis E264
MQAIEIRETGGPDVLEYVTRAGREPGEGELLVELAAAGVNFIDLYRREGRYPMPLPGTPGEEGAGCVIAVGPNVTRFKPGDRVAWTTVMGSYATRVIVPEDKAIAVPDGIDLQTAAAALVQGMTAHYLVNDSYRAREGDVVLVHAAAGGVGLLLTQWLKRRGVRVIGTVSSAGKAALARSNGADDVLLHRATDDLAAEVRRLTDGKGVHAVYDGVGAATFDASLASLRMRGTLVIFGGASGPVPPVDVMRLLWGGSLTLTRPYLEHFRATVEEFLWRAGEVFDGVLDGSLKIRIGGTYPLAEARRAHADLAARRTTGKLLLVP

SEQ ID NO: 78797 - protein, 334 aa, Xanthomonas campestris pv. campestris str. ATCC 33913
MSIEQLAETAQAMVAPGKGIIAIDESTSTIAKRFSGVGIENTEENRRAYRELLLTTPKLSDYISGAILFDETIRQKTKDGVPFAKYMADHGIIPGIKVDKGAQPLAGMPGELVTEGLDGLRARLEEYYTLGARFAKWRAVINIGEDIPSGTCIEANAHALARYAALCQEQGLVPMVEPEVIMDGDHDIETCYEVTEATLRSLFGALYEQNVVLEGTILKASMVISGKGCEEQASVEEVAESTVMCLKSTVPAILPGIVFLSGGQTDEQSTAHLNEMHQLGNLPWPLSFSYGRAMQQAALKLWSKDMTGNYAKAQQIIYERAKENGLAALGKWKG

SEQ ID NO: 78798 - protein, 214 aa, Bacillus cereus E33L
MIKIAPSILSADFSKLGEEIKDVEKGGADYIHVDVMDGHFVPNITIGPLIVEAIRPITSLPLDVHLMIENPDNYIPTFAKAGADIITVHVEACPHLHRTIQLIKSHGIKAGVVLNPHTPVSVIEHVLEDIDMVLLMTVNPGFGGQKFIHSVLPKIKQVAEMVKERNLEVEIEVDGGVNAETARLCVEAGANVLVAGSAVYNQKDRGEAIRIIRG

SEQ ID NO: 78799 - protein, 314 aa, Populus sieboldii x Populus grandidentata
FYDQTCPNVSTIIRDVITETLASDPRIGASLIRLHFHDCFVNGCDGSLLLDNSDTIVSEKEAGGNNNSARGFEVVDRMKALLESACPATVSCADILTIAAEESEVLAGGPNWTVPLGRRDSTTASRDAANAFLPAPNITLDQLRESFTNVGLNNNSDLVALSGAHTFGRAKCSTFDFRLYDFNSTGAPDQSLDPTLLAALQELCPQGGNGSVLTDLDLTTPDAFDSNYYSNLQGNQGLLQTDQVLFSTPGADDVIALVNAFSANQTAFFESFAESMIRMGNLRPLTGTEGEIRLNCRVVNANLAGPDSKLVSSI

SEQ ID NO: 78800 - protein, 391 aa, Xanthomonas campestris pv. campestris str. ATCC 33913
MSIVRMTDLDLSGKRVLIRQDLNVPIDNGQITSEQRITASVPTIKLALEKGAAVMVTSHLGRPKEGTWSEEDSLAPVAARLTTLLGLDVPLVRDWVDGVDVAPGQVVLLENCRMNVGEGKDDEALARKYAALCDVFVMDAFGTAHRAQASTHGVIRFAPVAAGGPLLMAELDALAKALDNPAKPLLAIVAGSKVSTKLELLSNLVNKVDQLIVGGGIANTFIAAAGHDVGKSLSEPDLIPTANQIVADAKARGAEIPLPTDVVVAKQFLPDAEASVKSLDQVDADDLILDIGPQTAAHYAELIANAGTVVWNGPVGVFEFEPFSHGTETLARAIAASKAFSIAGGGDTLAAVDKYAIAKDVTYISTGGGAFLEFLEGKTLPAVAALEARGQ

SEQ ID NO: 78801 - protein, 458 aa, Nocardioides sp. JS614
MDAHEVDLVVIGTGPGGEALATGAARAGLRVVAVDRHLVGGECPYYGCIPTKMMVRGSDAVAEVRRAAGVAGEATIAPAWSVVARRIDEEATTGWDDTIAVDRLRDAGVTFHHGAGRLDGPGRVRVEEPDGTATTYAATRGVLVNPGTRPAVPPVDGLADAPYWTNREAVRVTELPGSLVVLGGGPIGCELAQVFSRFGVRVAVVQRGPRLLPADEPEAAELVAEVFAEEGIRVLTGAEATRVAYDEGGFTIRLDTGEQLSADKLLVAAGRTPNLDDLGLDTVGLDPTARTLEVDERLRAGDRLWAIGDVTGRGAFTHVSMYQSAIALRDILGEPGAPARYHAVPHTTFTDPEVGGVGLTESRARESGLRVRTGGTDLAGSSRGFTHGPGGHGLIKVVEDADRGVLVGATAVGPAGGEILGFLAVAVHAEVPVETLRNMMYAYPTFHRAIESAIADLS

SEQ ID NO: 78802 - protein, 456 aa, Colwellia psychrerythraea 34H
MIKVGQTTEVENFLSNHPEVEAIDVLISDLVGFARGKRIEKSSLEKIYSSGLNMPATIFSMNVLGETIEECGLGQDIGEPDMVCKPIANTLHMASWHDRPIAQVLMSMFNHDGTPFFADPRNILSNVVRQLAEINLYPVVAVELEFYLLDKNKDNKGNLQAPISPKTGKRDEHTQVYSVDTLNDYSALLDDINRVCIEQNVPADTAVAECAPGQFEINLKHEADPVAACDNAILLKRIIKTVADKHNFDATFMAKPYSNEAGSGMHVHASLLDECGNNVFADEHNDYNETLEHAIGGMLELMPASMPLLCPNVNSYRRFMPGYYVAMAKNWGVDNRTVALRLPRGHKNATRIEHRVSGADANPYLVMAVILASIHHGITNKIKPINPTVGNAFDDDCEALPLKLDRALAELEKDQILTSYLGEEFTKNYHTVKQKELEQFDMHISELEVKWYLSNS

SEQ ID NO: 78803 - protein, 444 aa, Brassica napus
MATITVVKARQIFDSRGNPTVEVDVHTSTGVKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGASSFKEAMKMGVEVYHNLKSVIKKKYGQDATNVGDEGGFAPNIQENKEGLELLKTAIEKAGYTGKVVIGMDVAASEFYSSDKTYDLNFKEENNNGSQKISGDALKDLYKSFVAEYPIVSIEDPFDQDDWEHYAKMTAECGDSVQIVGDDLLVTNPKRVAKAIAEKSCNALLLKVNQIGSVTESIEAVKMSKRAGWGVMASHRSGETEDTFIADLSVGLSTGQIKTGAPCRSERLAKYNQLLRIEEELGSEAVYAGANFRKPVEPY

SEQ ID NO: 78804 - protein, 682 aa, Staphylococcus aureus
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKASLNNKNIQRDTTKNNNANPSDVNQGLEQAINDGKQSKVASQQQSKEADNSQDSNANNNLPSQSRIKEAPSLNKLDQTSQREIVNETEIEKVQPQQNNQANDKITNYNFNNEQEVKPQKDEKTLSVSDLKNNQKSPVEPTKDNDKKNGLNLLKSSAVATLPNKGTKELTAKAKDDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNHDNMISSITTTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTKATDKIQKGIWQVTPTKHDWDHVDFVGQDSSDTVRTREELQDFWHHLADDLVKTEKLTDTKQA

SEQ ID NO: 78805 - protein, 163 aa, Carboxydothermus hydrogenoformans Z-2901
MMIRIGFGYDVHPLVEGRKLIIGGVEIPFTKGLLGHSDADVLYHAIADAFLGSLALGDIGQLFPDNDERYRGIDSGLLLQEVYRRVRERGYCLNNLDAVIVAQKPKLLPFIQKMRENLAVLLNTAIENISVKATTTEGLGFAGREEGIAAYAVITVKEVLENG

SEQ ID NO: 78806 - protein, 327 aa, Wolbachia endosymbiont strain TRS of Brugia malayi
MTISILGAGAWGTAIANSLSGKQNVILWTHNKTTFESISRTRESDKLLGCQIPENVSVKLAIKETVNASAMIFAVPTQSLRKVCQQLHDCNLKKDVAIILACKGIEKSTLKLPSEIVNEVLPNNPVAIFSGPSFAIEVAKKLPYSMVLACQDDTLGSKLISELQQENIKLHFSSDVVGVQICAALKNVFAIACGIVLGKKLGFNAHAALVTKSMNEVKTLYLAKTDSVSIDIDTLLGPACLGDLIMTCTSLNSRNLSFGFKIGSSNNSFDAQQTLSEGKSVIEGFSTAQSAFNLAEKLKIKMPICEAVYRLLYESASIEDTISVFVG

SEQ ID NO: 78807 - protein, 326 aa, Oryza sativa Japonica Group
VFTRNATEAINLVAYSWGMSNLKQGDEIVLTIAEHHSAIVPWQFVSQKTGATLKYVGLTKEGVPDIEQLKGLLSNKTKIVVVHHVSNVLGSMLPIEDIVTWSNRIGAKVLVDACQSVPHMPVDVQRLGADFLVASSHKMCGPTGVGFLHGKFDLLSSMEPFLGGGEMIADVFQDKSTYAEPPSRFEAGTPAIGEAIGLGTAIDYLSQIGMQKIHEYENELATYLYESLIAVPNVRIYGPAPCQTVHRAPLCSFNVENVHPTDIAEILDLQHGVAIRSGHHCAQILHRTLGINASARASLHFYNTKEEVDVFVDALKDTIDFLTSEH

SEQ ID NO: 78808 - protein, 443 aa, Alkaliphilus metalliredigens QYMF
MFKYNLMHHWRSLVSGVETKIPLKNGQMTTYINFDNAATTPPLLSVLEEVVAFSPWYSSIHRGTGYKSQLSSDRYEKSRELIGHFVGADLEKNTVIFLKNATEAINKLSYRLSNQSPNPVVLSSFMEHHSNDLPWRDKYRVDYVDIKENGCLSLEDLEHKLIHYKGEVKLVAITGASNVTGCKNPINRIANIVHQYGAQLLVDGAQLIPHAPFYMSSSNPLENPDYLVFSAHKMYAPFGIGVLIAPKDVFRQGPPEYVGGGTVELVTHDHIKWADVPNREEAGSPNILGVVALTAAMKTLNEIGMEHIDRHEQSLTRYTLEKLNSISDITVYGDMTLKNRVGIISFNIEGLTHDLVAKILSDEGGIAVRNGCFCAQPYVQRLLGIPPDEVEKRKEDPTLFHPGMVRVSFGFYNTYREIDIFISLLKRIIQYKGYYVKKYTNHH

SEQ ID NO: 78809 - protein, 355 aa, Chlamydomonas reinhardtii
MSTQDLEGKTALVTGATSGIGLETAAALASRGANVILGVRNTKAAEDVVKQIQERYPGAKLVVGPSLDLLSQKSVKEFADWVNKTFPKLDILVNNAGVSFMQRTMTPEGVGGIAQTNHLGPYTLTRLLEKKLVASKARVVTVASVTHRTTVMKDAKAFLTDWRSGYYQHSKLANVLFAYELQRRLGNHGVTSCAADPGGVRSHIWDTSPMFKKGWKKTIIDMCYSPPVDGAKAVIHAATVDWAKDRRTVNGTPVLPADDLRYYSRGLFTAPTLCNLDGYTGKGFGTGQQIKGTLWGLSTLFTSLWDWPLRKLSGGMLGGATRPVRSATQSYDAKLAAELWDASAEIAGVPAQPAV

SEQ ID NO: 78810 - protein, 490 aa, Erwinia carotovora subsp. atroseptica SCRI1043
MSRYGLQQLYINGAYVDSTGNDTFDAVNPANGDIIACIQSATAADVDRAVSAATAGQKVWAAMTAMERSRILRRAVDILRERNDELALLETHDTGKPLSETRTVDIVTGADVLEYYAGLIPMLEGQQIPLRDTSFVYTRREPLGVVAGIGAWNYPIQIALWKSAPALAAGNAMIFKPSEVTSLTALKLAEIYTEAGLPAGVFNVLTGTGKSVGQALTTHPGIAKVSFTGGIASGKTVMANAAGSTLKDVTMELGGKSPLIIFDDADLDKAADIAMMANFFSSGQVCTNGTRVFVPKALQAQFEEKILACVQRIRAGDPTDESVNFGPLVSFPHRESVLRYIESGKREGARVLVGGEPMTDGDYAQGAYVAPTVFTDCRDDMKIVRKEIFGPVMSILTYQDEDEVIRRANDSEYGLAAGIVTRDLNRAHRVIHQLEAGICWINTWGESPAEMPVGGYKHSGVGRENGVTTLEHYTQIKSIQVELGEFRSVF

SEQ ID NO: 78811 - protein, 344 aa, Kineococcus radiotolerans SRS30216
MSARVLTLGETMALLTTPASGRLTLGGSLTVGLGGAESNTAIGLARLGVPTAWVSRVGDDAYGRLITRELRAEGVEVLVDVDAVAPTGSMLKELHAGRPRRVRYQRAGSAASRLTPAHVDAVSARITAADVVHLSGITPALGPGPAAAVERAVELARSAGTEVSFDVNHRTALWSAQEAGPVLAGTAARADVLFAGPEEAAMLLTGAGAGTENHPVPTDPDAAAACARRLCELGAGTVVVKLGALGSVAAQGGRVWVAPTHPVDAVDTVGAGDAFVAGFLAARLAGQDVPRSLAQGNAAGGAVCQVPGDWEGAPTRDELADLLERGRSNVGGPRTTRPSMEVQR

SEQ ID NO: 78812 - protein, 260 aa, Kineococcus radiotolerans SRS30216
MPTNEELLDLLVTTLPTAAARVTRPERRFTTAPELTVALAANDDAVTASLRPVLLAALPGSQWTAEEHGAGPMPAGDWWVIDPVGGNLNAIQGTPDWNIGVSLVRDGDVVLAALHAPAVSEMFTALNGAGATLNGASLTVSAKTELALALTGTGQARPSTDPTRADLRGRAIAAMMRSALSVRQSIPVGQHLTHVAAGRADVHWQFENLRSHIAPVLIAREAGATVTDLDGAPWAITSEGYVAAAPGVHAAALTILGSLR

SEQ ID NO: 78813 - protein, 213 aa, Cucurbita maxima
MASFQCNKPAERSHHQRHDQCHQEHQHHHGHGPAGGHGHGPAWGHGHGPSGGHGCGPSGGHGHGPSGGHGHGPSGGHGHGPAWGHGHGPSGGHGCGPSGGHGHGPSGGHGHGPSGGHGHGPSGGHGHGPSGGHGHGPAWGHGHGPSGGHGCGPAGGHGHGPAGGQGHCQPANPNVGHCQPANPNVGHCQPASPNVGHHSDSSDSDNDCRRGQH

SEQ ID NO: 78814 - protein, 237 aa, Prochlorococcus marinus subsp. marinus str. CCMP1375
MTDLQTQMKIAVAQEAIGEIKDGMILGLGSGSTAALMIKSLGEKLKEGSLKEIIGVPTSFQGEVLASQLGIPLRAFSAVSKIDLAIDGADEVDPNFQLIKGGGACHVQEKLVASIADRFVVVVDSTKIVEKLNLEFKLPVEVLPAAWKLVQKELNDLGAKSDLRMAEKKAGPIVTDQGNLVLDVQFADGISDPQNLEKQINNFPGVLENGLFVNLTDEVLVGEIKNGVSSVNRLKKA

SEQ ID NO: 78815 - protein, 366 aa, Zea mays
PLERKLCILKGVFPRQPKKKVEGNHKTYYHTKDIAFLAHDPLIEKFREIKVHRRKVKKAVAKKNRDLADRLLNRPPTYKLDRLVLERYPTFVDALRDLDDCLTMVHLFAALPAVDGERVEVKRIHNCRRLSHECLTFISVKGIYYQAEVQGQKITWLTPHALQQVLTDDVDFNVMLSFLEFYETLLGFVNFKIYHSINVNYPPILDPRLEALAVELYALCRYMSAGSRRMIGNSQTDEVMEDKDEKSKAEEVIEEEKVVKNKASSKADESEFRLAQLQHQLPTNEPGALMNLVEESTADDADDDDTKDCKGLFKNLKFYLSREVPRESLLFIIPAFGGTVSWEGEGAPFKEIDEDITHQLKTCPTH

SEQ ID NO: 78816 - protein, 188 aa, Psychrobacter arcticus 273-4
MASIINQEIPEFSAQAFVNGEFKTITSEDVKGSWAIFLFYPADFTFVCPTELEDMAAHYEELKGLGVEVYSVSTDTHFTHKAWHDSSEAIGKVTYPMIGDPTGRITRGFNVMIEEAGLAERGTFLVDPDGLIQVAEIHAGGIGRSAKDMLRKVKAAQYVRENDGEVCPAAWEAGQETLKPSLDLVGKI

SEQ ID NO: 78817 - protein, 147 aa, Oryza sativa Japonica Group
MAAAALTGQLNALVNNMFAMGLLDDQFQQLQMLQDSTAPDFVSEVVTLFCDDGERIICELSRQLEKPNVDFDRVDSYVHRLKGSSASVGAQKVKNTCIQFREFCQQKSRDGCLKTLDLVRTEFYDLRNKFQAMLQLEQQIQAWYPKH

SEQ ID NO: 78818 - protein, 221 aa, marine gamma proteobacterium HTCC2080
MALDSTPKIPLPNIDFRVASFMQSASSLGNAPSDTGSEVAFAGRSNAGKSSAINTLTSNRKLARTSRTPGRTQLINFFSLSDSQRLVDLPGYGYAKVPLKMKQEWNRHMADYLQRRESLRGLILLMDIRHPLTDADEQMIGWASKAQMPIHALLTKADKLKRGPAKATLLSVQARLLEFGDLASAQLFSSLKEDGLPALRTKLKTWLTDDSVFEEPDPSSG

SEQ ID NO: 78819 - protein, 1189 aa, Bacillus cereus E33L
MFLKRLEIAGFKSFAERVSVDFVPGVTSVVGPNGSGKSNITDAIRWVLGEQSAKSLRGAKMEDIIFAGSDTRRAVNVAEVTITLNNEDQRLPIEYNEVCVTRRVSRSGDSDFYINKQSCRLKDIIDLFMDSGMGREAFSIISQGKVEEILSSKSEERRGVFEEAAGVLKYKLRKKKAESKLADTQENLNRVQDIIHELSSQVEPLERQASIAKDYLEKKEELEKVEAALIVHEIEELHEKWEALRNQFGHNKNEEAKMSTHLQKGEEELEELRGQLQAVDESVDSLQEVLLLSSKELEKLEGQRELLKERKQNATTHCAQLEQLIVELTEKATSYDGEIESSTEVLMQFVNHVKELETKLHDNEQLLATFADNLEEQIENLKGDYIELLNQQASHRNELSMIEEQSKQQNSKNERLDEENAKYVEMRMEITAKKTKLVESYEQVKEKVAGILSNIQKTEAALGKCKAQYSENETKLYQAYQFVQQARSRKEMLEEMQEDYSGFYQGVREVLKARENRLQGIEGAVAELLTVPKEYEIAMEIALGAAMQHIVVQKEEHARNAIAFLKQNKHGRATFLPQAVMKGRSLSFEQLRIVNQHPSFVGVAAELVQYNNKYENVVSNLLGTVIVAKDLRGANELAKQLQYRYRIVTIEGDVVNPGGSMTGGAVKQAKSSLLGRQRELEEWTSKLTDMEEKTTKLENFVKAVKQEIQEKEVQIRELRKSVETERVDEQKLREEISRLELEEHRINDRLSIYDLEIEGFLQDQVKMQGRKEELEKTLATLQAEITELDSKIVTLTKQKSEQHSSKEKVQKEMTELKVLAAEKQQRLSNQKEKVERLTKEKEETDATLVKTKEDLAFLKQEMTSNSSGEEQITNMIEKKAYDRNQTSELIRSRREQRVSLQERVEQLERNLKETTGKHKYILEMLKDQEVKINRLDVELENRLQHLRETYTISFEAAKLKYTMVMPAEDARKKVKLIKLSIEELGTVNLGAIDEYERVAERHTFLLEQKDDLEEAKTTLHQLITEMDEEMKKRFSTTFEGIRMEFQSVFSELFGGGRADLVMTNPEDLLNTGIDIVAQPPGKKLQNLGLLSGGERALTAIALLFGILKVRPVPFCVLDEVEAALDEANVARFAQYLKKFSDETQFIVITHRKGTMEESDVLYGVTMQESGVSKLVSVRLGDGEELVASK

SEQ ID NO: 78820 - protein, 1349 aa, Candida albicans SC5314
MPHSRQPSISSSIMSQSNHNHPQKIGPWKLGKTLGRGATGRVLLATHQTTGQKAAVKVVSKSELQDEETEKNGDGLPYGIEREIIIMKLLTHPNVLRLYDVWETSKALYLVLEYVEGGELFDLLVERGPLPEVEAIKYFRQIILGTAYCHALGICHRDLKPENLLLDSQLNVKLADFGMAALESNGKLLETSCGSPHYAAPEIVSGLKYHGAASDVWSCGVILFALLTGRLPFDDENIRNLLLKVQAGNFEMPVDEVSREARDLIARMLEVDPMRRISTEKILRHPLLTKYPMSNEDLISEKSLPHPQTGYKSLGSVRNIDKQILSNLTILWNDRPEEEIVDCLLKDGSNPEKTFYALLMRYKHNQEDNTNNNSPKKSTSFNNKVVRSGSKYSLNGTPRRKRASHISVSRPTSFQYKSNPGAGATANRNSVARHSVASSANNSPRKSPYKSPYRSPYRSPYKSPSKRYSYNQSPTKSPYGRRSNSQRQFENEPLKAKPRNIYNEIVDAQSNFSLPPSLPPSLPSKDSRYMIDEPNQPQLQQPALSQVPENPIVDESPDLMQSAKISSGKRNSIIGKNNNNSNSNKRMSKRKSIRASMTTGLKRNSITMKLLSTYAKLSGDDDWEYMDKQTKRTSATFAALCDKIFNQEDYDEEDEQLVDPEEKEAKEYERLMELERKKHEAELKARRELEKKKRRQKRRSILSSKKLSIIVKNDADPNNSEQELVDEGIKQPKRQSKNLTALRALSEGNHASEELTLEDVENLKRRSASQPVPKRRQTPVLTRRPVSRLDPLWQAHENEQLDRAKDALEQEWRDSQKRSSTVSRKKVNRESMISVMDDIVEEDQGRVNRRSTRNTYYERERDYELPEPTVEDSNLTDDYMTEIRKSRLLNSQLNVRDPLNEKRKSEPKTLISNVQIPSVTRKSRNFTTSNKRLSVLSMYSTKESYRDLNSIINSPDENPEQHQNMNKPALRTSIADRLDKAGLAEPEYETETDGEDKVSVIDLDDHLADRRTSYYDGSGKRASRASTTKRYNVHSSSGQRPKSKVPDLPKNDYDDTFVSNSDEVHKRQYKSMVSDESSASDDVFDKIKLPDGKSTKSSIDELANGTSTSGHRKPKIRHSQPGPEMLIPHLNGGIESSQPMSKVRGNNSSGHDDSVPPPPPAHKVNKKPLDDKTNFPPPEVDPKRKGSFFRKLSWGSKKTIENNTNAATNTTTQQQLPSPAESKEEKPKSSFFRWFSSSNTPSAAEIRKFNTILPKHEMSTALFALLNSWSNFGLKDLRNDQVGYYITGAISKHNSFNLKSCKFRIKINQRDFNQKSEIVCVRVKGSKVTTDTLFSEIEKVLLKEGVLDK

SEQ ID NO: 78821 - protein, 333 aa, Xanthomonas campestris pv. campestris str. ATCC 33913
MAIKVGINGFGRIGRNVLRSAVQNFANDIEIVAINDLLEPDYLAYMLQYDSVHGRFKAEVSVDGNTLIVNGKKIRLTQERDPANLKWDAVGAEVVIESTGLFLTKETAQKHIDAGAKKVILSAPSKDDTPMFVYGVNDKTYKGEAIVSNASCTTNCLAPLAKVINDKWGIKRGLMTTVHAATATQKTVDGPSNKDWRGGRGILENIIPSSTGAAKAVGVVIPELNKKLTGMSFRVPTSDVSVVDLTVELEKPATYAEICAEVKAQSEGALKGILGYTEDKVVATDFRGETCTSVFDADAGIALDSTFVKLVSWYDNEWGYSNKCLEMVRVVAK

SEQ ID NO: 78822 - protein, 570 aa, Aspergillus oryzae
MATDIATRDLRKPIDVAEYLFRRLREVGVRAVHGVPGDYNLVALDYLPKCDLHWVGNCNELNAGYAADGYARINGMSALVTTFGVGELSALNAIAGAYSEFVPIVHIVGQPHTKSQKDGMLLHHTLGNGDFNVFTRMSADISCTLGCLNSTHEVATLIDNAIRECWIRSRPVYISLPTDMVTKKIEGERLDTPLDLSLPPNDPEKEDYVVDVVLKYLHAAKKPVILVDACAIRHRVLDEVHEFVEKSGLPTFVAPMGKGAVDETHKNYGGVYAGTGSNPGVREQVESSDLILSIGAIKSDFNTTGFSYRIGQLNTIDFHSTYVRVRYSEYPDINMKGVLQKIVQRMGNLNVGPVSPPSNLLPDNEKASTEQAITHAWLWPTVGQWLKEKDVVITETGTANFGIWDTRFPAGVTAISQVLWGSIGYSVGACQGAALAAKEQGRRTVLFVGDGSFQLTLQEVSTMIRNNLNPIIFVICNEGYTIERYIHGWEAVYNDIQPWDFLNIPVAFGAKDKYKGYKVTTRDELRELFANEEFASAPCLQLVELHMPRDDCPASLKLTAESAAERNKSL

SEQ ID NO: 78823 - protein, 334 aa, Nocardioides sp. JS614
MPVNLRGRHLLSLRHHSADEIRYLLDLSRDLKRAKYAGSERQLLQGRNVALIFEKTSTRTRCAFEVASYDQGAHVTYIDPASSQLGHKESVKDTARVLGRMYDAIEYRGFSQQVVEELAEYAGVPVFNGLTDEFHPTQMLADVLTMREHCDKPLHEIAFAFMGDGRNNVANSLLLVAAKLGMDVRIGAPKELWPEDELVKLCHDLADVSGARITITDDPTQAVAGVDFIYTDVWVSMGEPVESWAERVERCLPFQVNADLLHATGNARVKVLHCLPAFHNTETKVGHQVVAQYPQLANGIEVTEDVFESAANISFDQAENRMHTIKALLVASLA

SEQ ID NO: 78824 - protein, 346 aa, Burkholderia thailandensis E264
MRHRIAERASMPEMQMRSLNADLLRYHRGPRSRVLGHASMTETNYQEILERIHCDIEPLRTAGRVADYIPELASVPAERFGMAVVTLDGRVFSVGDARERFSIQSISKLFACTLAFQLLGDSLWKRVGREPSGTAFNSLVQLESERGIPRNPFINAGALIVTDVLCRRFVGAETALVQFMRRLTGVTDLDYNLRVANSELAHAERNRAMAHFMASFGNLHMPPETVIDAYCRQCAIEMNCIELATAALFLANAGVAPVSGERILDASSAKRLSALMLTCGTYDAAGDFVYRVGLPAKSGVGGGIVAVLPGEMAVCVWSPGLDANGNSVAGVHALEQLTTLTGQSIF

SEQ ID NO: 78825 - protein, 156 aa, Aspergillus fumigatus
MPPKRIQTPSSSSLSSGPAVLSSNSSVYQIAHHVWQQYLTTTPQRTMMLDAFMVFLLFVGAVQFLYCVLAGNYPFNAFLSGFCAAVGQFVLTASLRMQTSSELKGVNSKPSSKGKNARFAAVEGGEQQGAVSHERAFADYIFGSLILHFFCINFIN

SEQ ID NO: 78826 - protein, 378 aa, Nocardioides sp. JS614
MTRAILVLEDGRSFQGESYGAEGETFGEAVFNTGMTGYQETLTDPSYHRQVVVMTAPHIGNTGVNDEDPESRRIWVAGYVVRDPARRSSSWRSRRTLDDELREQGVVGISDIDTRALTRHLRERGAMRVGISSTETDPAVLLERVRASEPMSGAELASEVSTQEAYVVPAIGERRYTVAALDLGIKSMTPHRMAERGIEVHVLPATASLADINAVSPDGLFYSNGPGDPAATTHQVDVLQGALAQGLPYFGICFGNQLFGRALGFGTYKLKYGHRGINQPVMDRTTGKVEVTAHNHGFAVDAPLSGSTTTPYGEASVSHVCLNDDVVEGLELRDGAGALRAFSVQYHPEAAAGPHDAAYLFDRFVDLMSGDHHSGEEA

SEQ ID NO: 78827 - protein, 404 aa, Vitis vinifera
MASLSLSAPSYHAESLVSRYSLRQSSFLPNESRYQFPTYSATKQSLFLFIKCDMNESLKFENGKPCVPVLNDRTFPSFLESRRMEKSVSRNSDRLKIFSGTANPTLSKEIAWYMGKELGKINIKRFADGEIYVQLEESVRGCDVYLVQPTCPPANENLMELLIMIDACRRASAKTVTAVVPYFGYARSDRKARRESIAAKLVANVITKAGADRVLACDLHSGQSMGYFDIPVDHIYCQPVILDYLASKTICCNDLVVVSPDVGGVARARAFAKKLSDAPLAIVDKRRQGHNVAEVMNLIGDVKGKVAVMVDDMIDTAGTITKGAALLHQEGAREVYACCTHAVFSPPAIERLTSGLFQEVIITNTIPTLEKNYFPQLTVLSVANLLGETIWRIHDDCSVSSIFL

SEQ ID NO: 78828 - protein, 479 aa, Zea mays
MGASLGSAASKDRQQEHGGEAPRPDPCKKTRLSSPLCTIHGSHGHPRLIPGLPDEVSLQILARMPRMGYLKAKMVSRSWKAAVTGAELYRLRKELGVAEEWLYILTKAAAGGQKLVWHALDPVSNQWQRLPLMPGIECRSGGVYGLGLRDLVSVGVGIFDVIRGWLGQKELSGGVPPFCGCAVGAAGGCLYVLGGFSGASASKRVWRYDPSANSWREVSPMRAGRAFCKASLLNDKLYVVGGVSKGENGLIAPLRSAEVFDPATGAWAELPDMLFSKSQAMPTAIADLLKPVAAGVTSYGGKLHVPQSFYSWPFAVDVGGEVFDPETNSWEQMPAGMGEGWPARQAGTRLSAVVEGDLYALEPTTSSSGGCEIKMYDAQEDAWKVAVSQVRAGAFDESDSPCLLAAFLGKLHLVVKDMGSRISVVQMDSLMKPVDSPALSAATTCRTPDVSSEQTHVWKAIASKNIAAAELVSCQVLSI

SEQ ID NO: 78829 - protein, 506 aa, Saccharomyces cerevisiae
MAKSEQQTDSRHNVIDLVGNTPLIALKKLPKALGIKPQIYAKLELYNPGGSIKDRIAKSMVEAEASGRIHPSRSTLIEPTSGNTGIGLALIGAIKGYRTIITWPEKMSNEKVSVLKALGAEIIRTPTVAAWDSPESHIGVAKKLEKEIPGAVILDQYNNMMTPEAHYFGTGREIQRQLEDLNLFDNLRAVVAGAGTGGTISGISKYLKEQNDKIQIVGADPFGSILAQPENLNKTDITDYKVEGIGYDFVPQVLDRKLIDVWYKTDDKPSFKYARQLISNEGVLVGGSSGSAFTAVVKYCEDHPELTEDDVIVAIFPDSIRSYLTKFVDDEWLKKNNLWDDDVLARFDSSKLEASTTKYADVFGNATVKDLHLKPVVSVKETAKVTDVIKILKDNGFDQLPVLTEYGKLSGLVTLSELLRKLSINNSNNDNTIKVEYLDVKKLNNFNDVSSYNENKSGKKKFIKFDENSKLSDLNRFFEENSSAVITDGLKPIHIVTKMDLLSYLA

SEQ ID NO: 78830 - protein, 482 aa, Nocardia farcinica IFM 10152
MTAAVTQDNTSRTGAAAGRVVRVIGPVVDVEFPRGAIPELFNALHADITLTSVAKTLTLEVAQHLGDNIVRTISMQPTDGLVRGATVTDTGKPISVPVGDVVKGHVFNALGDCLDTPGLGRDGEQWGIHRKPPSFDQLEGKTELLETGIKVIDLLTPYVKGGKIGLFGGAGVGKTVLIQEMITRIAREFSGTSVFAGVGERTREGTDLHLEMEEMGVLQDTALVFGQMDEPPGTRMRVALSALTMAEYFRDVQHQDVLLFIDNIFRFTQAGSEVSTLLGRMPSAVGYQPTLADEMGELQERITSTRGRSITSLQAIYVPADDYTDPAPATTFAHLDATTELSRPISQKGIYPAVDPLTSTSRILEASIVGDRHFAVANEVKRILQKYKELQDIIAILGMDELSEEDKVLVGRARRLEKFLGQNFIVAEKFTGQPGSVVPLEQTIDDFDRVCKGEFDHYPEQAFNSCGGLDDVEKAAKKIAGK

SEQ ID NO: 78831 - protein, 419 aa, Oryza sativa
MRRTAGRGMAATTNDDDDDDDDDDDDDEEEEEEVEGDEQEELGTEYLVKPLGDAEDEEHSSDFEPDENGEGAEDEEIDEDDDGDDDSAKAQSSSKRKRSGGDDEDDDDDDDDGDDDDDEDEQEADRVAFLPGQPRSPQMSQFSGYITVNSQNGRALFYWFFEAQALPSKKPLLLWLNGGPGCSSVGYGAASELGPLMVNGNGTGLEFNKFAWNNEANLLFLESPVGVGFSYTNTSSDLESIDDRFVAEDTYNFLVNWFKRFPQYKNHDFYISGESYAGHYVPQLADVVYERNKHVETNQHINLKGFIVGNAETDDYYDYKGLVEFAWSHSVISDQLYKHVNNVCDFSYSIFDNYDITVFSVLPIYSKLIKAGLRIWVYSGDVDGRVPVIGSRYCVEALGLPVKSQWQPWLFMYAIVCVN

SEQ ID NO: 78832 - protein, 442 aa, Acidovorax avenae subsp. avenae
MHDVNGTARIARWMEREIAAAPLVRRSGKVAEVIGTLMRVNGLDAKLGELCHVLDERGELLQAAEVVGFANGQSILSPFGSILGVRGGSPVVGLGEVLSVPVGPRLLGRVIDSLGQPIDGKGPLDCSETRPVFALPPTPMEREMIEHPLPTGVKAIDGLITLGEGQRMGIFAPAGVGKSTLMGMLARGTQCDVSVIALIGERGREVREFVEFILGEEGMARSVVVCATSDRSSSERAKAAHVATAVAEYYRDQGLKVLLMMDSLTRFARAQREIGLAAGEPPARRGFPPSVFAEIPRLLERAGMGARGSITALYTVLYEDESGNDPISEEVRGILDGHMILSRKIAARNQYPAIDVLGSLSRVMSQIVPREHQQAGGRFRQLMAKYEEIEPLVQMGEYKPGNDPLADEAMEKHEEIRAFLNQSTSDLWDFGRSVDTLSDISG

SEQ ID NO: 78833 - protein, 199 aa, Haemophilus parasuis
EAGDIIIDGGNSNYPDTNRRVKALAEKGIRFIGSGVSGGEEGARHGPSIMPGGNSEAWQYVKPIFQAISAKTDKGEPCCDWVGKEGAGHFVKMVHNGIEYGDMQLICEAYQFLKDGLGLSYNEMQAIFAEWKKTELDSYLIDITTDILGYKDTDGTPLVEKILDTAGQKGTGKWTGINALDFGIPLTLITESVFARCVS

SEQ ID NO: 78834 - protein, 120 aa, Listeria grayi
KRRPRPNVAEVMNIVGNVEGKVCILIDDIIDTAGTITLAANALKNAGATQVYACCTHPVLSGPAMERIDQSPIEKLVVTNSIALPEEKWIDKMEQLSVAPLLGEAIVRVHENASVSSLFE

SEQ ID NO: 78835 - protein, 199 aa, Haemophilus parasuis
EEGDIIIDGGNSNYPDTNRRVKALAEKGIRFIGSGVSGGEEGARHGPSIMPGGNEEAWQYVKPIFQAISAKTDKGEPCCDWVGKEGAGHFVKMVHNGIEYGDMQLICEAYQFLKDGLGLSYDEMQAIFAEWKKTELDSYLIDITTDILGYKDTDGTPLVEKILDTAGQKGTGKWTGINALDFGIPLTLITESVFARCVS

SEQ ID NO: 78836 - protein, 473 aa, Triticum aestivum
MDVPLASKTFPSPSPSKREQCNVDGHKSSSKHADLNPHANDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLDDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 78837 - protein, 503 aa, Rhodococcus sp. RHA1
MTESVTRTAPHRSEVVSESASTTRHFDSHTAPLRHTKIVCTLGPATATGDRIRELVESGMDVARLNFSHGEHADHEENYKRVRAASDATGKAVGVLADLQGPKIRLGRFAEGRTTWANGEEVRITVDEVEGTHDRVSTTYKQLAEDAKAGDRLLVDDGKVGLVVSGVDGNDVICRVTEGGPVSNNKGVSLPGMNVSVPALSEKDIADLEFALGLGVDFIALSFVRSPADVELVHAVMDRVGRRIPVIAKLEKPEAIDNLEAIVLAFDAVMVARGDLGVELPLEQVPLVQKRAIQIARENAKPVIVATQMLESMIENSRPTRAEASDVANAVLDGADAVMLSGETSVGKYVMETVRTMARIVEAVENESTQVPPLTHVPRTKRGVISYAARDIGERLDAKALVAFTQSGDTVRRLARLHTPLPLLAFTPLPEVRSQLSLTWGTETFIVDPVESTDAMVRQVDHALLGLGRYQKGELVVIVAGSPPGTVGSTNLIHVHRIGEEDH

SEQ ID NO: 78838 - protein, 150 aa, Cucumis sativus
MITGSLQRRRRDSAISYKHWSTSRNAVLREELEATAVPTSVPVRVALELLQAGQRYLDVRTPEEYSVGHAPGAINIPYMYRVGSGMTRNPHFLAEVAIYFRKDDEIIVGCLSGKRSLMAAADLLASGYNYVTDIAGGYEAWSRNGLPMEF

SEQ ID NO: 78839 - protein, 226 aa, Oryza sativa
IVDGREFDEFKKLYGTTLVTGFARICGQPVGIMGNNGILFTESALKGSHFIELCAQRNIPLIFLQNITGFMVGSKSEASGIAKAGAKMVMAVSCSKVPKITIIVGGSFGAGNYGMCGRAYSPNFLFMWPTARISVMGGIQAAGVLAQIEKNNRKRQGVEWTKDEEEAFKAKVVEAYDKEGSPYYSTARLWDDGIIDPADTRRVLSLCLSAAAKPVPEDTKYGVFRM

SEQ ID NO: 78840 - protein, 605 aa, Oryza sativa
MELALVGDPSNGVAKPSCDSVGSLPAVSSKAVIHPPVTSAAGATLGRHLARRLVQIGATDVFAVPGDFNLTLLDYLIAEPGLKLIGCCNELNAGYAADGYARARGVGACAVTFTVGGLSVLNAIAGAYSENLPVICIVGGPNSNDYGTNRILHHTIGLPDFSQELRCFQTITCYQAVINNLDDAHEQIDTAIATALRESKPVYISVGCNLAGLSHPTFSREPVPLFISPRLSNKANLEHAVEAAADFLNKAVKPVMVGGPKIRVAKAKKAFAGIAESSGYPFAVMPSAKGLVPEHHPRFIGTYWGAVSTTFCAEIVESADAYLFAGPIFNDYSSVGYSLLLKREKAVIVQPDRVVVGNGPAFGCILMTEFLDALAKRLDRNTTAYDNYRRIFIPDREPPNGQPDEPLRVNILFKHIKELLSGDTAVIAETGDSWFNCQKLRLPEGCGYEFQMQYGSIGWSVGATLGYAQAAKDKRVISCIGDGSFQMTAQDVSTMLRCGQKSIIFLINNGGYTIEVEIHDGPYNVIKNWDYTGLIDAIHNSDGNCWTKKVRTEEELIEAIATATGAKKDCLCFIEIIVHKDDTSKELLEWGSRVSAANSRPPNPQ

SEQ ID NO: 78841 - protein, 541 aa, Burkholderia thailandensis E264
MPAQGNAQRSAPLARPTPTDAGHGTFKKQLSLTDLTFIGLGAIFGSGWLFAASHVSTIAGPAGILSWLLGGFAVLLLGIVYCELGAALPRAGGVVRYPVFSHGPLLGYLMGAITLIAFSSLIAIEVVAARQYAAAWFPGLTVEGSGNPTTLGWLVQAALLCLFFYLNYSSVKTFAKANNLISVFKFVVPLSVIVVLFTFFKPANLTMHGFAPFGMPGVEMAVSAGGIIFAYLGLTPIVSVASEVRNPQRTIPIALILSIVLSTLIYVLLQLAFLGGIPSAMLAGGWHDIGKAFSLPYRDIALALGVGWLAYMVVADAMISPSGCGNIYMNATPRVVYGWAKTGTFFKVFTRVDEASGIPRAGLWLTFALAIFWTLPFPSWEALINTVSAALVLSYAVAPVSVAALRRTAPGLPRPFRASAFAITGPASFVIAALIVYWSGWSTVSWLLGLQIAMFVVYLACRRWVPTAHLSLAEQVRSSAWLIAFYALMIAASYFGGFGGTGRLAHPYDTLAVAAVALVIYYWGAHTGVPAAKLQLDDDEN

SEQ ID NO: 78842 - protein, 328 aa, Burkholderia thailandensis E264
MTNTPISLFAFATSRPFGERIAARLGVALAAHEERAFEDGEHKTRPLASVRGHDVYVVQSLHGEPGSSVNDKLCRLLLFIGALKDASAASVCAVVPYLCYSRKDRRSQPRDPVSTRYVAAMLEAVGVDRVVTIDVHNVAAYQNAFRCPTEHLEANGLLVDWFAERAGALPIVVVSPDAGGVHRAEDFRARLTARLGRPVDAAFAGKLRSSGVVTAKPLVGDVAGRCAIIVDDLIGSGTTLAHTAADCRALGAQSVYAVATHGMFFGRAAELLGGDALTALAVTDSVPPWRVPPGALQDKLTVLDSAPLFAEAIARIHRGGSLTDLLRR

SEQ ID NO: 78843 - protein, 288 aa, Ustilago maydis 521
MLRRQTRERREYIYKKALESKEKQIYERKQQIREALASGKPLPPSLSSAEATELGRDLNLDAAQDVPSSSIDDEYSRGGTYDPRVLVTTSRDPSSKLTQFAKEVRLLFPNSTRLNRGGYTVSDLVAAARSNGITDMVVLHEHRGVPDAMVVSHLPHGPTLLFTLHNVVLRHEVSAQSSTVSEQYPHLIFENLSSKLGLRVQTALKHLFPVPKPDSSRVMSWINNNDFISFRHHVFLKTSHRDVQLAEVGPRFEARVYQINQGTLDQPDADIEWVLRPYMNSAKKKPQL

SEQ ID NO: 78844 - protein, 2111 aa, Mycobacterium bovis AF2122/97
MESRVTPVAVIGMGCRLPGGINSPDKLWESLLRGDDLVTEIPPDRWDADDYYDPEPGVPGRSVSRWGGFLDDVAGFDAEFFGISEREATSIDPQQRLLLETSWEAIEHAGLDPASLAGSSTAVFTGLTHEDYLVLTTTAGGLASPYVVTGLNNSVASGRIAHTLGLHGPAMTFDTACSSGLMAVHLACRSLHDGEADLALAGGCAVLLEPHACVAASAQGMLSSTGRCHSFDADADGFVRSEGCAMVLLKRLPDALRDGNRIFAVVRGTATNQDGRTETLTMPSEDAQVAVYRAALAAAGVQPETVGVVEAHGTGTPIGDPIEYRSLARVYGAGTPCALGSAKSNMGHSTASAGTVGLIKAILSLRHGVVPPLLHFNRLPDELSDVETGLFVPQAVTPWPNGNDHTPKRVAVSSFGMSGTNVHAIVEEAPAEASAPESSPGDAEVGPRLFMLSSTSSDALRQTARQLATWVEEHQDCVAASDLAYTLARGRAHRPVRTAVVAANLPELVEGLREVADGDALYDAAVGHGDRGPVWVFSGQGSQWAAMGTQLLASEPVFAATIAKLEPVIAAESGFSVTEAITAQQTVTGIDKVQPAVFAVQVALAATMEQTYGVRPGAVVGHSMGESAAAVVAGALSLEDAARVICRRSKLMTRIAGAGAMGSVELPAKQVNSELMARGIDDVVVSVVASPQSTVIGGTSDTVRDLIARWEQRDVMAREVAVDVASHSPQVDPILDDLAAALADIAPMTPKVPYYSATLFDPREQPVCDGAYWVDNLRNTVQFAAAVQAAMEDGYRVFAELSPHPLLTHAVEQTGRSLDMSVAALAGMRREQPLPHGLRGLLTELHRAGAALDYSALYPAGRLVDAPLPAWTHARLFIDDDGQEQRAQGACTITVHPLLGSHVRLTEEPERHVWQGDVGTSVLSWLSDHQVHNVAALPGAAYCEMALAAAAEVFGEAAEVRDITFEQMLLLDEQTPIDAVASIDAPGVVNFTVETNRDGETTRHATAALRAAEDDCPPPGYDITALLQAHPHAVNGTAMRESFAERGVTLGAAFGGLTTAHTAEAGAATVLAEVALPASIRFQQGAYRIHPALLDACFQSVGAGVQAGTATGGLLLPLGVRSLRAYGPTRNARYCYTRLTKAFNDGTRGGEADLDVLDEHGTVLLAVRGLRMGTGTSERDERDRLVSERLLTLGWQQRALPEVGDGEAGSWLLIDTSNAVDTPDMLASTLTDALKSHGPQGTECASLSWSVQDTPPNDQAGLEKLGSQLRGRDGVVIVYGPRVGDPDEHSLLAGREQVRHLVRITRELAEFEGELPRLFVVTRQAQIVKPHDSGERANLEQAGLRGLLRVISSEHPMLRTTLIDVDEHTDVERVAQQLLSGSEEDETAWRNGDWYVARLTPSPLGHEERRTAVLDPDHDGMRVQVRRPGDLQTLEFVASDRVPPGPGQIEVAVSMSSINFADVLIAFGRFPIIDDREPQLGMDFVGVVTAVGEGVTGHQVGDRVGGFSEGGCWRTFLTCDANLAVTLPPGLTDEQAITAATAHATAWYGLNDLAQIKAGDKVLIHSATGGVGQAAISIARAKGAEIFATAGNPAKRAMLRDMGVEHVYDSRSVEFAEQIRRDTDGYGVDIVLNSLTGAAQRAGLELLAFGGRFVEIGKADVYGNTRLGLFPFRRGLTFYYLDLALMSVTQPDRVRELLATVFKLTADGVLTAPQCTHYPLAEAADAIRAMSNAEHTGKLVLDVPRSGRRSVAVTPEQAPLYRRDGSYIITGGLGGLGLFFASKLAAAGCGRIVLTARSQPNPKARQTIEGLRAAGADIVVECGNIAEPDTADRLVSAATATGLPLRGVLHSAAVVEDATLTNITDELIDRDWSPKVFGSWNLHRATLGQPLDWFCLFSSGAALLGSPGQGAYAAANSWVDVFAHWRRAQGLPVSAIAWGAWGEVGRATFLAEGGEIMITPEEGAYAFETLVRHDRAYSGYIPILGAPWLADLVRRSPWGEMFASTGQRSRGPSKFRMELLSLPQDEWAGRLRRLLVEQASVILRRTIDADRSFIEYGLDSLGMLEMRTHVETETGIRLTPKVIATNNTARALAQYLADTLAEEQAAAPAAS

SEQ ID NO: 78845 - protein, 326 aa, Bacillus thuringiensis serovar konkukian str. 97-27
MQKETAIIIGGGPCGLAAAISLQKVGINPLVIEKGNIVNAIYNYPTHQTFFSSSEKLEIGDVAFITENRKPVRNQALAYYREVVKRKSVRVNAFERVEKVQKDGEVFQVETTKRDGSKEIYIAKYIVVATGYYDNPNYMNVPGEELKKVAHYFKEGHPYFDRDVVVIGGKNSSVDAALELVKAGARVTVLYRGSEYSPSIKPWILPEFEALVRNGTIHMHFGAHVKEITEHTLTYTVDGETNTIQNDFVFAMTGYHPDHSFLTKMGVRIDEATGRPIYAEDTMETNAANIFIAGVIAAGNNANEIFIENGRFHGDAIAQTIATREM

SEQ ID NO: 78846 - protein, 567 aa, Oryza sativa Japonica Group
MDSARSWLQKLQPRDKDRGKPASPTAARKDGAAAMAEDGEEAISSTTATKVAAAKQFIENHYKDQMRSLEERKERRRMLESKLADPDVSEEEQNNILKDFENREREIMRSRRHKMGVDDFELLTIIGRGAFGEVRLCREKATSNVYAMKKLKKSEMLRRGQVEHVRAERNLLAEVDSAYIVKLYCSFQDEEFLYLVMEYLPGGDMMTLLMRKDTLTDDESRFYVAETILAIESIHKHNYIHRDIKPDNLLLDRTGHLKLSDFGLCKPLDSSSFPNLSEFDYAVGKNINPSMDGDKLLSSSAAPRRTQQEQLLHWQKNRRMLAYSTVGTPDYIAPEVLLKKGYGMECDLWSLGAIMYEMLVGYPPFYSEDPMSTCRKIVNWRSHLKFPEEAKLSPEAKDLISKLLCNADLRLGTKGAHEIKAHPWFKGLEWEKLYQMEAAFIPEVNDELDTQNFEKFEEIAPMQTSSKAGPWRKMLSSKDTNFLNFTYKNLELSDDPEHPGIAQVKKKNNKPTRRTFKSILHEFADTEEEPQSSSLNSTPSQLDQLPESLEPSPHSSISSEDSQSRHR

SEQ ID NO: 78847 - protein, 441 aa, Burkholderia vietnamiensis G4
MTDKATRIDLFSFRSAPMRAFHMTWMAFFVCFFAWFACAPLMPLISREFHLTAAQVANINIAAVAATIAVRLLVGPLCDRFGPRRVYVGLLLLGAIPVFAVSFVHDYLSFLICRLGIGAIGAGFVITQYHTSVMFAPNVVGTANATTAGWGNAGAGATQAMMPLLVAAGLLLGFGDDASWRIALVVPGIAMLAMAWAYWRFTQDCPQGDFVALRKQGVTVDSGKKGGWASFFAACGNYRVWMLFVTYGACFGVEVFIHNIAALYYVDHFKLSLKDAGFAVGLFGLLALFARALGGWLSDRIAARRSLDVRATLLCALIIGEGLGLLWFSHAQGIGMALVAMLTFGLFTHMACGATYALVPFIDRRALGGVAGIVGAGGNVGAVAAAFLLKGVGDVQHALSLLGLVVTATALCAMAVRFSAEHKAREAELRDRALATANAAN

SEQ ID NO: 78848 - protein, 577 aa, Acidovorax sp. JS42
MTFEELKLAPAILRAVQEQGYDNPTPIQAQAIPAVLAGHDLLAGAQTGTGKTAAFTLPMLHRLAEGQAPRSQFGGKGVRALVLTPTRELAAQVEESVRGYGKYLDLNSTVIFGGVGMNPQIERIKRGVDVLVATPGRLLDLQQQGFMDLSTVEILVLDEADRMLDMGFIHDVKKVLALLPQSKQSLLFSATFSDDIRELANSLLKNPQSIQVTPRNTTVQRISQVIHPVGRGKKKQVLLHIIQEHDWSQVLVFTRTKFGANNVAEYLTKNGVSAMALHGNKSQSARTQALEGFKTGQIRALVATDIAARGIDIDDLPHVVNYEIPNVPEDYVHRIGRTGRAGREGHAVSLVCMDEEGFMMEIERFTKQEIPVQVIDGFGPDEGEKAEPIAMGRQTIWGGAGKPPSREVMQAAAKAARQEMMERIRTNKAATGGQRGSRQGGGQGEGQQRAGGQNGSGGRGGNAGNAGRPAGPRDQQRPQNTAGGRRRGGPAGAGNGGGNGGNRRFDDSQPRSENAHLGTQLGNIGIGPRHGSGRASQPDPMRTSVDSMADRGRRGGFGRGNGGGGGGRGPRGGGFGR

SEQ ID NO: 78849 - protein, 371 aa, Ipomoea nil
MVSTITATVPSRVERLASSGIERIPKEYIRPEEERRSIGDIFEEEKIAGGPQVPTVDLKGINSEDLEVREKCREELRKAAVDWGVMHLVNHGISEELTGRVKAAGEGFFGQPIEEKEKYANDQAAGNVQGYGSKLANNASGQLEWEDYFFHCIFPEDKTDLSIWPKTPSDYIDATKEYAKQLRALATKVLAVLSLGLGLEEGRLEKEVGGMEELLLQMKINYYPKCPQPELALGVEAHTDVSALTFILHNMVAGLQLFYGGKWVTAKCVPNSIIMHVGDTVEILSNGKYKSILHRGVVNREKVRVSWAVFCEPPKDKILLQPLPETVSEAEPPRFPPRTFAQHIKHKLFRQSDQEAADTPKPDNDDHHQSN

SEQ ID NO: 78850 - protein, 436 aa, Clostridium tetani E88
MEEFMYKLYSLNNGLRVALEKIDYVQSVSIGLWVKNGSRNENEHNNGISHFIEHMMFKGTNNRNAKEIVKTIEDLGGHINAFTGKEATCYYIKLLYTHLDVALDILSDMIFNSKFNEEDIELEKGVILEEISMNEDSPEDVLVELHSKAAWGDDPISLPILGSAKGVRSFTRNHIIEYLKSHYTPENCVISIAGNFDENIYKLIEDYFGHWKASNEKPLLYSTPDVLNNHLFRKKEIEQLHMNLGMQGVEIGNEDMYTILLLNNIFGGSTSSILFQKIREEKGRCYSIYSYVNSYNNTGIVNIYTGLNSKYSIEVLKLIVEEVHKFSKYCICQEQIIQGKEGLKGSYILGLESTSSRMFSNARSVLFLNRINKPEDIIKKIDKIDMESIHRVKENTFEKGIINSAFVGENIDIETVNNMMDKSINPFKNNSNSTFI

SEQ ID NO: 78851 - protein, 401 aa, Clostridium tetani E88
MKIIVQKFGGTSVSTKERRQRVVEKIIKAKNAGYSPVVVVSAMGRKGEPYATDTLLSLVSNELKKNNLAIDLLMSCGEIISTVVMADELLSKNIDAVPLTGGQAGILTDDNYSNASILKLECDKILDVVEENKIPIVAGFQGISENGFITTLGRGGSDVTAVLLGGALKAEKVEIYTDVDGIMTADPRIVSDATLIKEISYNETFQFSHEGAKVIHPRAVEIAMNENIPIVIKNTLTNCDGTLINNISDLNLNNIITGITHTNDRTQIKIELEQNKENESYFRILDILAENSISIDLINVFPRESIFTIDGKDFEKFSSIMNKINLKYSHIDSCSKIAIIGNRMRGIPGVMAKIIYVLMNENIEVLQTADSHATIWCLVKDIHTEKAIKALHNAFNLSNNK

SEQ ID NO: 78852 - protein, 630 aa, Hordeum vulgare subsp. vulgare
  misc_feature (602)..(602): Xaa can be any naturally occurring amino acid
  misc_feature (614)..(614): Xaa can be any naturally occurring amino acid
MSKFLAIGLLLLHLINHGIYLVKAWDDKDFFKYCPPSQCSQHGPEIRFPFCLESSNKSSSSSSSSSCGCDGRSIRKLACSGQDTILVHPFLGPYSVSAIDYRHSSMKVIPLVDPCLMLNQNLIISRNSSSLQIDVINVYKTKFDRDFFWPSYAAVVRCSREFSPGADDRIVGPVSCLSNATHFFYFVASYADMSILPLDCKAAPLSHGVSGSLIPMYWSCSPYNLGSFKEGAETFLSSAETTVCWLGSECRKCEIIGGRCAFSSERNLAFCMPGGSRIKVIAATSSVAAFVVLLLTVAIVLYLSLKTRYNAEIHLKVEMFLKTYGTSKPTRYTFFEVKKMARRFKEKVGQGGFGSVYKGELPNGVPVAVKMLENSRGEGEVFINEVATIGLIHHANIVRLLGFCSEGMRRALIYEFMPNESLEKYIFSDDPNIFQNLLVPDKLVDIALGIARGMEYLHQGCNQRILHFDIKPHNILLDYNFNPKISDFGLAKLCARDQSIVTLTAARGTMGYIAPELYSRNFGGVSYKSDVYSFGMLVLEMVSGRRDSDPSIESQSDVYLPEWIYEKVINGEELALTLGATQGEKEKVTQLAMVALWCIQWXPRNRPSMTKVLXMLTGRLQTCRCHQSRS

SEQ ID NO: 78853 - protein, 461 aa, Myxococcus xanthus DK 1622
MDFSALALSPPLLQVLEELDFKTATPIQAQSIPVLLQGRDLVGQAQTGSGKTAAFALPLLQKVQLQHRKVQALVLCPTRELCAQVAGEIRRLGRRLPGLQVLVLAGGQPIRPQLEALEKGAHLAVGTPGRVMDVLDREALETRQLSTVVLDEADRMLDMGFREDMERILGAMPPRRQTVLFSATFPPDIEALSRDFQRQPVRVTVEAATAGPDIQQVRYDCEPGDKQALLLRILRHYQPASAIVFCNLKATVVELKKSLSASGVSVDGLQGDLEQFERDRVMAKFRNQSTRVLIATDVAGRGIDVEALDAVINFDLPMQAEPYVHRIGRTGRAGRAGLAVSIVTPRDGRKVDDIQLATGVKLERGDVESLPSADPRNAVSLESTWDTLYISAGRKDKMRPGDILGALTGEAGGLEATDVGKIEIQDHVAYVAVARRVSRVAFQRLSEGRIKGRRYKIERVK

SEQ ID NO: 78854 - protein, 675 aa, Hordeum vulgare subsp. vulgare
  misc_feature (177)..(177): Xaa can be any naturally occurring amino acid
  misc_feature (646)..(646): Xaa can be any naturally occurring amino acid
MGNPGAFHHSITLQSLTVFSLVAVLAADHVQGRDDGCAPFSCGHLQDIRAPFRRQGDPLECGVEAYELGCNSSKANIHISTGTYYVTAINYTGSYFWVIDTNFDTISSCPLPLWNHVPYGRYLGGINSVSPPGFLYLVSQSYDIACFANCSQAVTDSSSYKPVSCLSANNSHVYVWXSHYSCVVEDFEPYCGYLAKIPFGKDYTPYWHNASYADITQFIGKGFTVQFPVDIMGPSASVKLRKNINICLNNSISYFKEQASGASIVNWAHAFFWSEVHFLECVTQSSEDHYCTTQFLLAVVTIFLAIAIPKFFFVLCRLLLAPLAVWIFLAYKYMKTRIIIDAVEKFLRIQQMIGPTRYSYTDIVAVTSHFRDKLGQGGYGTVYKGILLPGGVHVAVKMLEGNSNCNGEDFISEVSTIGRIHHVNVVRLVGFCSEEMRRALVYEYMPHGSLDKYIFSAEKSFSWDKLNEIALGIARGINYLHQGCDMQILHFDIKPHNILLDSNFVPKVADFGLAKLYPRGDSFVPLSAMRGTVGYIAPEMISRSFGVISSKSDVYSFGMLLLEMAGGRRNADPNMGSSSQAYYPSWVYDRLTQEEAGETSAVAADMHELEKKLCVVGLWCIQMRSRDRPTMGEVIEILESGVDGLXMPSRPFFCDEGHIHVEDSYHFTSELTAVS

SEQ ID NO: 78855 - protein, 128 aa, Glycine max
IRLEGLIYRMKQPKIVLLIFVSGKIVLTGAKVRDETYTAFENIYPVLTEFRKNQQWYGSGSFSIAIGYTCCNPWARNIMNQYHCLYYFFFFVQLSEYNCVRCRAEVFLIEMTKFFTQFLFWVIYLYKF

SEQ ID NO: 78856 - protein, 669 aa, Hordeum vulgare subsp. vulgare
  misc_feature (668)..(668): Xaa can be any naturally occurring amino acid
MGNPGAFHHSITLQSLTIFSLVAVLAADHVQGRDDGCTPFSCGHLQDIRPPFRRRGDPLECGVEAYELGCTSSKATIHINTGTYYVTAINYTGSYFWVINTNFDTSSSCPLPPRNQFLLVGIDSVSPPGFRYLDTAMYYTACFANCSRAVRDNSSYKPVSCLSASNSHVYVWVSPYGCMVVDLEPYCGYLAEIPFDYEYSEEYWQNASYADIIQVISKGFIVRFPVDTMTEPSDSVKLRKNMNLCLNNSISYFKEQSSGASIVNWTHAFFWSEVHFLECVTQLFPEDADYKYNDHYFTTPFVLVVVTIVSAIVIPKFLFVLCRFLLAPLAVWIFLAYKYWKTRIIIDAVEKFLRVQQLIGPTRYAYTDIIAITRHFRDNLGQGGYGSVYKGVLLPGGVHVAVKMLEGNSNCNGEDFISEVSTIGRIHHVNIVRLVGFCSEEMRMALVYEYMPNGSLDKYIFSAEKSFSWDKLNEIALGVARGINYLHQGCDMQILHFDIKPHNILLDSNFVPKVADFGLAKLYPRGDSFVPLSAMRGTVGYIAPEMISRSFGVISSKSDVYSFGMLLLEMAGGRRNADPNAGSSSQAYYPSWVYDQLTREEVGEISPVAADMHELEKNLCVVGLWCIQMRSRDRPTMSEVIEILEAGVDGLQMPSRPFFCDEGHIHVXG

SEQ ID NO: 78857 - protein, 220 aa, Nocardioides sp. JS614
MGIQITPSILNADFAALGAEVARIGSADWVHVDVMDNHFVPNLTFGPTMVEALARSTEVPLDAHLMVEVPDRHALAYVEAGCGSVTFHVEAAQAPVRLAREIRAHGARASMALRPATPVEPYEDLLPELDMLLIMTVEPGFGGQRFLDLCLPKIRRARELMDKHGLETWLQVDGGISLETIERCVDAGADVFVAGSAVYSAADPDRMVAELRAAAERAVR

SEQ ID NO: 78858 - protein, 298 aa, Candida albicans SC5314
MVVGESRAELLNWLNSTLGLNYTKIEQCGSGAAFCQLMDTIVGDVPLSKVKFNAKTEYEFRHNYKILQHVFVKNSITKTIDVEKLIRCKLQDNLELLQWIKRYASSNNVPMKTTVARQPPKQTTKPTTSSPGSSPINAGPSAAPLISKPRERKSNTPIGSRKTSSNGPINLTPTAVRSTNIAASKNNNRSGNGTIVNNGHVGAVSASEPEAVDAAAVGAAAAAAAPIDSGATSSIPEDFAIYSQHVESERDFYFNKLRAIEILVQHAKEMEGLSGDVLQFANEIEKIMYEEYVEDDEF

SEQ ID NO: 78859 - protein, 499 aa, Aspergillus awamori
MMVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASRNAIRNYAISKDTGFVTYKNWPIYKDDTTIPMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 78860 - protein, 426 aa, Nocardioides sp. JS614
MSTEIRLDTVERAIADIAAGKAVVVVDDEDRENEGDIIFAASKATPDLMAFTIRYSSGVICVPMPARMLDRLEIPLMTPHNKDRLRTAYTISVDARDGVTTGISAADRAHTVRVLADSATEPWEITRPGHVFPLRYREGGVLVRRGHTEAAVDLAKLAGLTPAGVLVEVVNDDGTMKRGPELRAFADEHGLAMISIDDLVRYRRRHETLVERVAETQLPTRHGDFTAYGYRITVDGSEHIALVHGDISGPEPVLTRVHSECLTGDVFGSHRCDCGPQLEEALERIVAEGRGVVVYLRGHEGRGIGLVAKLQAYQLQDGGRDTVDANLDLGLPADARHYGTATQVLRDLGVGSVRLMTNNPDKVRNLEDYGVSVAARVPLTPHPNDHNIAYLLTKRDRMGHDLPNLADGVPDTRADGVPDTLAQNGA

SEQ ID NO: 78861 - protein, 585 aa, Erythrobacter sp. NAP1
MLSRYLPILEWGRTYNRNVLTDDLMAAVIVTIMLIPQSLAYALLAGLPPVVGLYASILPLVLYAIFGTSRTLAVGPVAVISLMTASAAGAVAAQGTAEYLEAAITLAMLSGVMLAILGFLRAGFLANLLSHPVISGFITASGILIATSQLKHILGIQAGGANWPEMLGSLSSAIDETNVWTLAIGIPATLFLFWVRKGAKPALQRIGIPERAADMSAKAGPVVAVALTILAVLALDLGDKGVNLVGAVPQGLPPFALPSTDLSLIEKLWVPALLISIIGFVESVSVAQTLAAKRRQRISPDQELIGLGAANVASAFSGGYPVTGGFARSAVNFDAGAQTPAAGAYTAVGIALATLFLTPLLFSLPIATLAATIIVAVLSLVDLKTPGRLWRYSKADFAAHIATIGITLLAGVEMGVIAGVAVGLLLYLWRASRPHAAIVGRVPETEHFRNVERHKVITVPHILSIRIDEALTYLNARWLEEYVLEEVADRPAVRHVILMCSAVNEIDASGLESLEAINHRLGDGKIGLHLSEVKGPVMDRLKRSHFIEELNGEVFLSQSKAFEKLVVDDGAPPEPHDHYLARGLI

SEQ ID NO: 78862 - protein, 161 aa, Nocardioides sp. JS614
MSGHGAPAPAPVDCSDLRVAVVAASWHTQVMDGLIAGAQRALADYHVAEHRLVRVPGAFELAVVADALARQHYDVVVALGVVIRGGTPHFDYVCQAVTEGLVRVALDRSLPVGFGVLTCDGDQQALDRAGLEGSKEDKGYEATSAALLTARTLKELGTTAP

SEQ ID NO: 78863 - protein, 333 aa, Leptospira interrogans serovar Lai str. 56601
MFDEISRSIDEFGNSFLSALNNIQKSFGRELSVAKPVKETILQMIGNTPLIRLNQIGSHIPNVEFYLKAEFCNPTGSVKDRTALSMLLSSERRGELKPAGQVIQPGYNTTAMSLAWICTIRQYKFRCLVAGDTDPLKIKDLQTFGAHVEIVPGAKGNWDDSLLKRAKEIKEKEKNTIILNEYKDMANTNAHYLFTGPEIWRDLGGNVDAFVAGGGSGGTLSGVGRFLKSKKSSVRVIMGVSQKSRFIRKMVQNESSIYLPESFDPKIVDEYVGVDREQALLYQSDLYQKEGIFAGQTTGTTLASAIRFAEGLSIKEDSKSQVYRIVVLSPDRF

SEQ ID NO: 78864 - protein, 308 aa, Thermosynechococcus elongatus BP-1
MLILDTLERGHRDLVESVLKTELIVGDIGDRPLLDWLFQTYPVTAVMHFAAYIEVGESIHSPDRFYQNNVHGALTLLQAMVAAKIPYFIFSSTAAVYGVPPEIPISETCPCAPINPYGRSKWMVEQMVADMGTAYGLKSVIFRYFNAAGADPHSRLGEDHRPETHLIPLVLQAAMGRRPHIAIYGTDYPTPDGTCIRDYIHVVDLAQAHVRGLKYLLSGGNSQIFNLGNAQGFSVRQIIETAQRVTGCSIPVIEGDRRAGDPAILVANSDRARCLLGWQPQYPDIEQIIHHAWQWHQRRHRGNHIIMS

SEQ ID NO: 78865 - protein, 601 aa, Chlamydomonas reinhardtii
SSEASMLVPLGLDFLTFLSATVLVIPLFKSLKLSPVLGFLFSGVVLKQLGLFQDLKDTERLAELGVLFLLFEMGLELSLDRLKALAKYAFGIGSLQVLLCTGIFTAFALPAGHSIGTIFLEQVAHAPHRLVSIRSVDEAVVIGAALSMSSSAFVLQLLRERGEVTSKFGNATLGVLLFQDIAVVPFLVLLPLITTHGTDLEGASPVSLLSQLGPTALQTVAGLGALLLADRLIMKRIFEMVAQSRNSETFIALCLLTVAGTSLITQRLGLSDTMGAFLAGVLLSETSYRTQVEADIRPFKGLLLGLFFVTTGSSINLQFLQLHWQEAGWILAGLVTIKTVVVAAVGQLFGLTRSESIRTGFMLSQGGEFAFVLLSLANQLRILPTNLNQLLIIVVVLSMALTPFLAESGKVVANKLDELWPPAPRGSPSGGSGVPDPVVICGFSPAGQMVANMLESPLATPGGGGEPPAYLAFDLDPERVAAGRKAGFKVVWGDATRGAVLRAAGVDAPRAVAVCYADKESALQAVYTCRAEFPAVPIYACAADLRHAAELEEAGASRVIIRSVEAGLALGGALLGEMGASEADLAYLKRGIEETIEARTQ

SEQ ID NO: 78866 - protein, 190 aa, Clostridium tetani E88
MYVMNLANKLTIIRIFLVPVFLIFIAINDIPYGKTIATAIFIIAALTDKLDGYIARSRNQITRFGKFMDPLADKLLVTAALISLVELQVISTWVAMIIIAREFAVTGLRAVAASEGIVIAASPLGKAKTVTQIIAIIIALINLNNINILSIPSNYISSLTNITMGAAVIITIISGIDYFVKNKEAIKIDK

SEQ ID NO: 78867 - protein, 405 aa, Lentisphaera araneosa HTCC2155
MKKIGKSSHLESVKYEIRGRVAKASERLRLDGVNVLELNIGNPGVFGFKVPDTMNMALIRNLEKSAAYCASKGIYSAREAIVVDTQNQGVKGLDIDRVYLGNGVSELILMAMEGLLNLDDEVLLPSPDYPLWSAAVKISGGQPVYYPCDSKNDWMPNLEAMEASVTSKTRGLVVINPNNPTGAVYSREILEGIVDIARRHNLIIFSDEIYSKVLYDENEFIPMATLAEDILIVSFNGLSKSYRACGFRCGWMYLTGAVDMAESYLEGLDLLASMRLCSNVPAQWAVQTALGGYQSIFDLCSGGGRLKRQRDLCHKRLNAIEGVSAVNAGGALYLFAEIDLDIYKFSNDEDFVLRFLEEEHVLLVHGSGFNYERSAAFRVVFLPYEEDLQRAFDRLEKFLARHRRK

SEQ ID NO: 78868 - protein, 325 aa, Wolbachia endosymbiont strain TRS of Brugia malayi
MVGAVQIKKTGGPEVLEFIDKSIGEPKGEEVLIRHTAIGLNRYDLEHRKGVRKIKGLPSVLGVEAVGVIEKLGKKIDDSLQIGDRVGYCTAPPGAYCEKRVIHQKYLVKIPDEIPDEVVAAVLFKGMTAHYLINQSYKIKPGAFVLVHGANGGLGQIICQWAKDKKGVVIGSVSSDKKMEVALQNGCTYAINYNDKNFVSKIMEITQNRGVGAVYDPIGYSTSRLSFESLSKFGIYVSYGQISGIAPVSFSLLSSRSLFATGTSIYHYKRDRFALVLTAMEIFEMVKKKLLTVRINKKYKFDEIIKAHHDMENRKVSGLNIIKVF

SEQ ID NO: 78869 - protein, 725 aa, Salmonella enterica subsp. enterica serovar Paratyphi A str.
MLYKGDTLYLDWLEDGIAELVFDAPGSVNKLDTATVASLGQALEVLEKQHDLKGLLLRSNKAAFIVGADITEFLSLFLVPEEQLSQWLHFANSVFNRLEDLPVPTLAAVNGYALGGGCECVLATDYRLATPDLRIGLPETKLGIMPGFGGSVRLPRMLGADSALEIIAAGKDVGAEHALKIGLVDGVVKQEKLIEGAIAVLRQAITGDLDWRAKRQPKLEPLKLSKIEAAMSFTIAKGMVAQTAGKHYPAPMTAVKTIEAAARFGREEALNLENKSFVPLAHTNEARALVGIFLNDQYVKGKAKKLTKDIETPKQAAVLGAGIMGGGIAYQSAWKGVPVIMKDINDKSLNLGMTEAAKLLNKQLERGKIDGLKLAGVISTIHPTLDYAGFDRVDVVVEAVVENPKVKKAVLAETEQKVRPETVLASNTSTIPIGELASALERPENFCGMHFFNPVHRMPLVEIIRGEKSSDETIAKVIAWASKMGKTPIVVNDCPGFFVNRVLFPYFAGFSQLLRDGADFRKVDKVMEKQFGWPMGPAYLLDVVGIDTAHHAQAVMAAGFPQRMQKEYRDAIDALFDANRFGQKNGLGFWRYKEDSKGKPKKEEDAAVDDLLASVSQPKRDFSDDEIIARMMIPMINEVVRCLEEGIIASPAEADMALVYGLGFPPFHGGAFRWLDTQGSAKYLDMAQQYQHLGPLYEVPEGLRNKARHNEPIIPRLNQPVRLVL

SEQ ID NO: 78870 - protein, 428 aa, Arabidopsis thaliana
MTKQIGGPMHQLAAKVDEYARGMISGTGSSLFEELGLYYIGPVDGHNIDDLVAILKEVKSTRTTGPVLIHVVTEKGRGYPYAERADDKYHGVVKFDPATGRQFKTTNKTQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEADLFNMVATAVAIDDRPSCFRYPRGNGIGVALPPGNKGVPIEIGKGRILKEGERVALLGYGSAVQSCLGAAVMLEERGLNVTVADARFCKPLDRALIRSLAKSHEVLITVEEGSIGGFGSHVVQFLALDGLLDGKLKWRPMVLPDRYIDHGAPADQLAEAGLMPSHIAATALNLIGAPREALF

SEQ ID NO: 78871 - protein, 194 aa, Acidovorax sp. JS42
MPQLAPMFFTIPTIMTWTRIVAIPLIVGVFYAPLDPAMRNLIATVMFIVFAATDWLDGFLARKLNQTSAFGAFLDPVADKFLVCASLLVLVHMQRADVFVALIIIGREIAISALREWMAQIGASKSVAVHMIGKLKTTVQMIAIPFLLYDGQLFGVIDTGVWGTWLIWGAAVLTVWSMVYYLQKALPEIRARVR

SEQ ID NO: 78872 - protein, 305 aa, Pyrococcus abyssi GE5
MVLVMICSIGELLVDVIATEEGDLKDVRLFEKHPGGAPANVAVGIARLGFDSCLVSKVGDDPFGEFLVESLRRENVKTDGIVKDEEKHTGIVFVQLTGVSPSFILYDGVAYFNLRREDINWELINSSRIVHFGSVILARSPSRETVLDVIKRVKTIVSFDVNLRLDLWKNRGEDMLRTIEEAIKLADIVKASEEEVDYLEDNGIEVEGKLITAITMGSKGAKLNGIQVPGYKVNPVDTTGAGDAFTAALLVGIMKVREITNENLEKIGKFANLVAALSTLKRGAWSVPKVEELLKYKEAREILRL

SEQ ID NO: 78873 - protein, 307 aa, Arabidopsis thaliana
MDQYGIPVERKEMKHKGRNVIWSVGMDKCLIEALAVQAKNGNKVDKCFNDKAYTAACVAVNTRFNLNLTSQKAINRLKTIKKRYRVMRDILSRDGFWWNSSTKMIDCESDELWRRYIAVNPDAKAFRGKQIEMYEELRTVCGDYQTPGKYNKVKKESSHHLNDVKQFEEDSVSFPLGSSEEHSDTDGTESYAGASEYMHEESQDLPPPRDPLRRPSKRSRNSDPCQEAMLVVASSIRRLADAVVQSKTLINTEELLKAVMEIDELEEAKQMYAFEYLNGDPVKARAFMAYNNRMRKMFLFRQFWWWK

SEQ ID NO: 78874 - protein, 199 aa, Haemophilus parasuis
EAGDIIIDGGNSNYPDTNRRVKALAEKGIRFIGSGVSGGEEGARHGPSIMPGGNEEAWQYVKPIFQAISAKTDKGEPCCDWVGKEGAGHFVKMVHNGIEYGDMQLICEAYQFLKDGLGLSYNEMQAIFAEWKKTELDSYLIDITTDILGYKDTDGTPLVEKILDTAGQKGTGKWTGINALDFGIPLTLITESVFARCVS

SEQ ID NO: 78875 - protein, 397 aa, Clostridium tetani E88
MLSKKGKEISPSVTLAITAKANEMKKDGIDVVGFGAGEPDFNTPENIQNAAIKAMREGYTKYTPVSGVVELKDAIVNKFKKENNLIYKSSQIIVSTGAKQCIANLFMAILNPGDEVLISAPYWVSYPELVKLADGVPVFVDCKKENDYKYSIDELEKRVSSKTKAIIISSPNNPTGSIYYEEELRDIAEFCKKHNLIILSDEIYEKLIYGHNKHISIASLNEDTYNRTVVINGVSKTYAMTGWRIGYAAGPGNVIKLMNNIQSHMTSNPNSIAQYAALEALTGEQESINSMVSEFEKRRNYMVERINSINGIECIEPKGAFYMFADINKVIGKKINGEEIKNSVDFCEKLLELYKVAVVPGAAFGLENHIRLSYAISMENIEKGLDRISNCVSELQS

SEQ ID NO: 78876 - protein, 320 aa, Nocardia farcinica IFM 10152
MARYESLIATLGDTPLVGLRTLSPKWDGDDHVRLWAKLEDRNPTGSVKDRPALRMIEQAEAEGRLRPGCTILEPTSGNTGISLAMAAKLKGYQLVCVMPENTSVERRQLLTMYGARIIDSPAAGGSNQAVALAKQIAAENPDWVMLYQYGNPANAQAHYDTTGPELLADLPEITHFVAGLGTTGTLMGTGRFLREQVPGIEIVAAEPRYGELVYGLRNIDEGFIPELYDETVLTTRYSVGPYDAVKRTRELVGEEGIFAGISTGAILHAALGIGRKALQAGRRADIAFIVADGGWKYLSTGAYDGTLEDAESRLEGQLWA

SEQ ID NO: 78877 - protein, 199 aa, Haemophilus parasuis
EEGDIVIDGGNSNYPDTNRRVKALAEKGIRFIGSGVSGGEEGARHGPSIMPGGNEEAWQYVKPIFQAISAKTDKGEPCCDWVGKEGAGHFVKMVHNGIEYGDMQLICEAYQFLKDGLGLSYDEMQAIFAEWKNTELDSYLIDITTDILGYKDTDGTPLVEKILDTAGQKGTGKWTGINALDFGIPLTLITESVFARCVS

SEQ ID NO: 78878 - protein, 856 aa, Brassica napus
MKGVQNIYHHSYTFSFLLVFLFLNLFHPALSIYVNTLSSSESLTISSNRTLVSHGGVFELGFFKPLGRSRWYLGIWYKKVSQKTYAWVANRDSPLSNSIGTLKISGNNLVLLGQSNNTVWSTNLTRENVRSPVIAELLPNGNFVMRYSSNKDSSGFLWQSFDFPTDTLLPEMKLGYDFKTGRNRFLTSWRSYDDPSSGKFTYELDIQRGLPEFILINRFLNQRVVMQRSGPWNGIEFNGIPEVQGLNYMVYNYTENSEEIAYTFHMTNQSIYSRLTVTDYALNRYTRIPPSWGWSMFWSLPTDVCDSLYFCGSYSYCDLNTSPYCNCIRGFVPKNRQRWDLRDGSHGCVRRTQMSCSGDGFLRLNNMKLPDTKTATVDRTTDVKKCEEKCLSDCNCTSFATADVRNGGLGCVFWTGDLVEIRKQAVVGQDLYVRLNAADLASGEKRDRTKKIIGWSIGVTVMLILSVIVFCFWRRRQKQAKADATPIVGNQVLMNEVVLPRKKINFSGEDEVENLELSLEFEAVVTATEHFSDFNKVGKGGFGVVYKGRLVDGQEIAVKRLSEMSAQGTDEFMNEVRLIAKLQHNNLVRLLGCCVYEGEKILIYEYLENLSLDSHLFDETRSCMLNWQMRFDIINGIARGLLYLHQDSRFRIIHRDLKASNVLLDKDMTPKISDFGMARIFGRDETEADTRKVVGTYGYMSPEYAMNGTFSMKSDVFSFGVLLLEIISGKRNKGFCDSDSNLNLLGCVWRNWKEGQGLEIVDRVIIDSSSPTFRPREILRCLQIGLLCVQERVEDRPMMSSVVLMLGSETALIPQPKQPGYCVSQSSLETYSSWSKLRDDENWTVNQITMSIIDAR

SEQ ID NO: 78879 - protein, 199 aa, Haemophilus parasuis
EAGDIIIDGGNSNYPDTNRRVKALAEKGIRFIGSGVSGGEEGARHGPSIMPGGNEEAWQYVKPIFQAISAKTDKGEPCCDWVGKEGAGHFVKMVHNGIEYGDMQLICEAYQFLKDGLGLSYDEMQAIFAEWKNTELDSYLIDITTDILGYKDTDGTPLVEKILDTAGQKGTGKWTGINALDFGIPLTLITESVFARCVS

SEQ ID NO: 78880 - protein, 260 aa, Cryptococcus neoformans var. neoformans JEC21
MSRLSPFRPLASLCSAGPSRISRIPARKFGFSPSPLPGLDGFSDEAANPVVRDSLVPIVVEQTARGERSYDIYSRLLKERVIFLGPVNSQDSTLLTAQLLFLEAEDPKRPIKLYINSPGGVVTSGLAIYDTMQYISPPVHTFCMGQAASMGSLLLAGGEKGHRYALKNSSVMIHQPSGGAQGQASDIALHAKEILRIRAALTDIYAEHCTRPGEERSAALDRFEKALERDYFMTSEEAVEFGIVDKIVTQRGKEVSEEEK

SEQ ID NO: 78881 - protein, 595 aa, Oryza sativa Indica Group
MAAPGPGWMVPPPPQPQPQQQQQAVVVDGRDGLVAWLRGEFAAANAIIDLLLAHARDAADPAGFDAVAAAVQRRRHHWAPVLHLQHYFPVTEVALALHHAAARQGPPPPPPPPRPPSGSAGAEGDDAAIASGGVKEVETSAEATQNSQLVSHISHATEAQPQKGLHVISNVVPVPTCFVVNEVIDGRMVNVLEGLKLYKGYVDLTEIGKVLSFVNEAKTMRRKPGLEGQTVVVAKRPMKGHGREIIQLGLPITEGPPEDEHLREVKVDPIPGVLQNLFDSLVHQKVVPSSPDYCVIDIFNEGDYSHPHHHPPWYGRPICTLCLTDCDMVFGHVIAADSRGDHAGPLKLSLSTGSVLVFEGKSADIAKRALPATSKQRILLSFGKSVSRKHVQSESSLLITPPLTPPPMPWAAPLRPGNIAIHPSSPKQLVYNPSNRVPAVSTPGLHHIPSNGIQTVFVAPLPITPKAVPFASAVTLPNSTAAWIAEAAPRPASPRLPLQGTGVFLPPGSGNPPPAQKLGVKHADAKPFFPQESSASSSGVSARAHKANGSVSSKPTRKDDMAEAKPKCNGSSDGGSSVAHAKATGGLEEQNVVAK

SEQ ID NO: 78882 - protein, 185 aa, Vibrio sp. Ex25
MINTKIKPFAATAYKNGEFVEVTEQDVLGKWAVFFFYPADFTFVCPTELGDLADHYEELQKRGVEVYSVSTDTHFTHKAWHDSSETIGKIQYYMLGDQTGNITNNFGVMREGQGLADRATFLIDPEGTIQAMEITAEGIGRDAEDLLRKVKAAQYVAAHPGEVCPAKWKEGEETLAPSLNLVGKI

SEQ ID NO: 78883 - protein, 402 aa, Triticum aestivum
  misc_feature (96)..(96): Xaa can be any naturally occurring amino acid
  misc_feature (215)..(215): Xaa can be any naturally occurring amino acid
  misc_feature (237)..(237): Xaa can be any naturally occurring amino acid
MADKENSAYAAAAAPRTTRASAKRAAAVTAVAVAAKRKRVALSEIPTLPNGAPQPQTKPKKSSSQVAKPKKRSVSSLSLPAPKPAPGAADETGDPXLCAPYASDIYSYLRSMEVQAKRRPAADYIERVQVDVTPNMRGILVDWLVEVAEEYKLVSDTLYLTVSYIDRFLSANSLNRQKLQLLGVSAMLIASKYEEISPPNVEDFCYITDNTYMKXQELVKMERDILNNLKFEMGNPXTAKTFLRMFIKSGQEEKKYPSLLLEFMGSYLTELSLLDYGCVRFLPSAVAASAVFVARLTLNPDSNPWSKKLQSVTGYRASELKDCITAIHDLQLSRKGQSWNAIRDKYKQHRVSMHQQSHFTYDHLHDSAVGLTVQSSLEQFKGVSSLLPPVGIPASYFEDLKE

SEQ ID NO: 78884 - protein, 488 aa, Legionella pneumophila str. Paris
MEIYEMYIDGKFTLAKSGTTRDIFDPANGELIARVPESAKEDAILAIKAARKAFDEGEWRKSLALDRGKLLFKLADLIRANAKMLAELETRNCGKPLPEAEFDVTDAANCFEFYGGLATKIHGETMSVPANSFSYVVREPIGVCGQIIPWNFPLLMAAWKLAPALAAGNTAVLKPSELTPITALELFKLIDQCGFPAGVVNLITGTGIGVGEELANNAMVDKVAFTGGSATGRKIMQAATGNLKKISLELGGKNPNIVFADCDLEMAIDGALFGAFANQGEVCSAGSRLLVERSIHKKIVEGMLKKIPNIKLGHGLDAGVKMGPLVSSAHREKVESYVKLGMEEGAKLLCGGKRPTGSEFAKGNFFEPTIFDEVKSTMRIAREEIFGPVLVVIPFDTEEEAIRIANDTDYGLSGAVWTKSVTRAHRVTSQIRAGILWVNHYHPTYNEMPWGGYKQSGAGRELGLYGIESYLEVKQVNINLDETPIGWY

SEQ ID NO: 78885 - protein, 363 aa, Buchnera aphidicola
MKKNYRIAVLSGDGIGPEVMQEACKILNVLKKYFFLSLEIQKFNIGGIAIEREGVALPKTTLLGCENSDSILLGSVGGKKWDNLPVEQRPERAALLPLRKYFNLFSNLRPAKLYPELKCLSPLRSDIVKNGFDILCVRELTGGIYFGEPKGFVNKNNTKYAFDTEIYHEYEIIRIAHLAFKLARSKKKKVCSIDKSNVLRSSILWGKVVESVSKKYPDVHLSHLYIDNAAMQIIKDPNQFDVLLCSNLFGDIISDECATITGSIGMLPSASFNEKNFGLYEPAGGSAPDIEGKNIANPIAQILSLSMLVRYGMNLNQIADKIDKAVNNVLKKGYRTSDISHDNNFLKTDEMGDLIVDSLINGK

SEQ ID NO: 78886 - protein, 499 aa, Oryza sativa Indica Group
MRGERGCAANQVRPGEILVNGRGLSQGELDLLLGCAVPPERLAAGRYWYDKDSGLWGKEGERPDRIVSSKLSIGGKLQTDASNGTTQVFINGREITKTELRMLKLANVQCPRNTHFWLYDDGSYEEEGQNIIKGNIWQKAKFLYGTEFSPEEILNLKLMIQSNVYKYLSTLLEWRECFEDEALEEEKELGMSNHKGDDSCLGNLDAFFPAATREYAPIVEEVWKDPAIQATYKRKNELHFLPDVASYFLDRVVEISSNEYEPTETDILYAEGVNQWNGLSTLEFSLDDRGPLSDSYADKAGNPAIQTKYQLIRMNSKGLTGGFKCLGMLEDIRAIIFCISLADYDQTWVQSSGEPCNKMIASRDLFEDVIRHPSFEDTPCVLLLNKYDAFEEKISRVPLTVCEWFADFSPVRPHHTSQTSLASHAYYYVAVKFKDLYSSVADGRKLFVFQTKALERRTVDDAFRYIREVLRWDDVKNSDAGYCSADESSYSVDMTTSPS

SEQ ID NO: 78887 - protein, 165 aa, Zea mays
  misc_feature (14)..(14): Xaa can be any naturally occurring amino acid
  misc_feature (26)..(27): Xaa can be any naturally occurring amino acid
  misc_feature (134)..(134): Xaa can be any naturally occurring amino acid
MCQDRCIRVMPNTXTAAVESASVMSXXTGAANEYGAIAAMLWDAEEKLLKRDEKTFDAVTRLSRSGPAYISLTSEALADGGVAAGISRELALSLASQTVPGSATMFSKSGKHAGVLKDDVTSPGDTTISGVHEXEKASSRATPINAVVDAVTRNRELSQNSMIHM

SEQ ID NO: 78888 - protein, 182 aa, Citrus limon
MSGSVMLGESSSWSRALVKISPYTFSAIGIAVAIGVSVLGAAWGIYITGSSLIGAAIKAPRITSKNLISVIFCEAVAIYGVIVAIILQTKLESVPASQIYAPESLRAGYAIFASGIIVGFANLVCGLCVGIIGSSCALSDAQNSSLFVKILVIEIFGSALGLFGVIVGIIMSAQASWPAKPV

SEQ ID NO: 78889 - protein, 622 aa, Hordeum vulgare subsp. vulgare
MGVPPWAIWALLLLHPAARVLANTEGDALHSLRTNLNDPNNVLQSWDPTLVNPCTWFHVTCNNDNSVIRVDLGNAALFGTLVPQLGQLRNLQYLELYSNNISGTIPSELGNLTNLVSLDLYLNNFTGPIPDSLGNLLKLRFLRLNNNSLSGTIPKSLTAITALQVLDLSNNKLSGEVPSTGSFSLFTPISFGNNPALCGPGTSKPCPGAPPFSPPPPYNPPTPEQSPGSSSSSTGAIAGGVAAGAALLFAIPAIGFAYWRRRKPQEHFFDVPAEEDPEVHLGQLKRFSLRELQVATDTFSNRNILGRGGFGKVYKGRLTDGTLVAVKRLKEERTPGGELQFQTEVEMISMAVHRNLLRLRGFCMTPTERLLVYPYMANGSVASRLRERGPAEPPLDWQTRRRIALGSARGLSYLHDHCDPKIIHRDVKAANILLDEDFEAVVGDFGLAKLMDYKDTHVTTAVRGTIGHIAPEYLSTRKSSEKTDVFGYGIMLLELITGQRAFDLARLANDDDVMLLDWVKGLLKERRLEMLVDPDLQTNYIDVEVESLIQVALLCTQGSPMERPKMSEVVRMLEGDGLAERWDEWQKVEVSRQEVELGPHRNSEWIVDSTDSLHAVELSGPR

SEQ ID NO: 78890 - protein, 421 aa, Clostridium tetani E88
MNVEELNPFKNVQKIMKKICEDLNLNESVYELIKEPSRIVEVNIPVKMDNGSIKVFKGYRSQHNNSIGATKGGVRFHQGVNLDEVKALSIWMTLKCAIANLPFGGGKGGIIVDPKTLSKGELERLSRGYVEKLYEVLGEDLDIPAPDVNTNGEIIAWMADEYNKLSRQNAWGTFTGKPVELNGSKGRTEATGLGVAIVAREALKKLNRNIENSSVAVQGFGNVGSHAALCIENLGGKIVSVSEWDREKGFYAIYDEKGLNIKELISYFNENGTLLDFPRTSKISEEEFWSLSVDVLVPAALENSINTNNANLINAKLVCEGANGPVTPAADEILEKKGIEVTPDILTNAGGVIVSYFEWVQNLDNYYWNEKDVKTREEEFLVEGFNNVWFMKDKFNCTMRNAAYMYAINKLAKSMKARGWY

SEQ ID NO: 78891 - protein, 125 aa, Brassica napus
MALRNALLRHLRVPVQNLAVRGSNQSQIGFLGSIRAFSSHDDHLSKQDVVDRVLDVVKSFPKVDPAKVTPEVHFQKDLGLDSLDTVEIVMAIEEEFKLEIPDKEADKIDSCSLAIEYVFNHPMSS

SEQ ID NO: 78892 - protein, 514 aa, Oryza sativa Japonica Group
MQFMMPLDTNACAQPMRRAGEGAGTERLMERLNIGGMTQEKALRKRCFGDGVTGTARRVFTSDADRDTPHLRTQFSRKNYADASHVSAVILGGGTGVQLFPLTRTRATPAVPVGGCYRLIDIPMSNCFNSGINKNIFVMTQFNLTSLNRNIHHTYLVGGINLTDGSVQVLAATQMPDEPAGWFQGTADAIRKFMWILEDHIHKSIDNIVILCGDQLYRMNYMELVQKHVDTNADITISCAPIDGSRASDYGLVKFDHSGRVIQFLEKPEGADLESMVDTSFLSYAIDDKQKYPYIASMGIYVLKKDVLLDILKSKYAHLQDFGSEILPRALLEHNVKVACVFTEYWEDIGTIKSFFDANLALTEQPPKFEFYDPKTPFFTSPRYLPPARLDKCKCKIKDAIISDGCSFSECTIEHSVIGISSRVSSGCELKIYETEEETSKLLFEGKVPIGIGQNTKIRNCIIDMNARIGRNAIIANTQGVQESDHPEEGYIRSGIVVILKNATNATIKHGTVI

SEQ ID NO: 78893 - protein, 463 aa, Streptococcus pneumoniae TIGR4
MNIFRTKNVSLDKTEMHRHLKLWDLILLGIGAMVGTGVFTITGTAAATLAGPALVISIVISALCVGLSALFFAEFASRVPATGGAYSYLYAILGEFPAWLAGWLTMMEFMTAISGVASGWAAYFKGLLSQYGIAFPQALNGTFNPQAGTFVDLLPILVLVLVTSLVLLNAKAALRFNSILVILKFSALALFVLVGIWNIKFDNWSNFAPYGFGQIYGASTGIMAGASLMFFGFLGFESISMAVDEVKTPQKNIPRGIVLSLSIVTILYALVTLVLTGVVHYSHLNVDDAVAFALRSVGISWAANYVSLVAILTLITVCISMTYALSRMIYSLARDGLVPAAFKELTKTSKIPKNATILTGLASAVAAGMFPLASIAAFLNICTLAYLIMLAYGLIRLRKEKGMPKAGEFKTPLVPLLPILSIIICLSFMLQYNMNTWIAFLVALLVGSIIYFTYGYKHSTIEE

SEQ ID NO: 78894 - protein, 405 aa, Lentisphaera araneosa HTCC2155
MLDIAKIRADFPILEKQVHKKTLAYLDNGATTLKPNQVVSAVEKHYKEECSNIHRGIHWLSERATESYEATRGKVKELINADSTDNIVFTSGTTAGVNLVVQSYGRNKLNAGDEVIISAMEHHANIVPWQMLRDEKGIVIKVVPVFEDGSLDMEAYYSLISDKTKFISIMYVSNVLGTINPMQEICDKANELGIPVLVDAAQAIAHMPVDVQELNCTFMVFSAHKMYGPTGVGVLYGKTEYLEAMPPVTGGGDMILSVSFDKTVYNVAPYKFEAGTPNIAGVIALGAAIDYIQSFDWKEVEEREEELIEYAHEQLQEIPGLKIIGTAKNKSGAVSFTMKDIHPHDIGTIVDRSGVAIRTGHHCAQPLMESFGIVATARASFAIYNTKEEVDQLVKALKKVQEIFA

SEQ ID NO: 78895 - protein, 450 aa, Legionella pneumophila str. Paris
MKHQLVGTKLMKKIHIKTPIPGPKSQQLMELRRQHVARGPFHATPIFVKQAKGSFVEDVDGNVFLDFSSGFGVVNTGHCPDSVVNAIKLQAEKFIHTGFNIIPYESYIKVCAKLNDHTPGHFEKKSLLLNSGAEAVENAIKIARAYTGKQAVICFDHAFHGRTYMAMTLTSKNKPYKHGFGPFPSEIYRAPFPYEYRWKGTNCVEECFNEFTDLANFRVGVENIAAVIIEPVLGEGGFIQSPALFLQKLREFCTTNDIVFIADEIQSGFGRTGNLFAMNTLGVPPDLTISAKGLGGGVVLAGVTGKAEIMDAAMEGGLGGTFGGNPLSCAAALEVFYIFEEGSLLQNVTHLAKALQSRLSGFKEKYKVVGDVRGLGVMQAIELVKDKNTKEPNKEAAVQLAQFCLEHGLIILTCGTYGNVIRLHMPLSTGVKDLETGLSIIEEGLKRLSI

SEQ ID NO: 78896 - protein, 189 aa, Lentisphaera araneosa HTCC2155
MDLKYFTQPTPNPNAVKFILNLDVITKGRVSYSNAEDCHNNELAATLFSIACITQVHFFENVITVTQNGDMYWEELEDAVIALLQDGIDKHDPEFQVGEDEEERRAKLSPEVRQIEDILDRTVRPSLQGDGGDLMVMGYDLGSKILKVMYEGACNSCASSTTGTLMAIKSTLQAEFDPDIEVAVIGEEL

SEQ ID NO: 78897 - protein, 310 aa, Legionella pneumophila str. Paris
MSSKLLTIQLLEELVHAAELNQEGKTADYIPELANVNQELTAIAVQPLGEKTLAYSNNPLHPVTLQSTGKMIPLIGLLEEFGADQLFEWVKVEPSGDDFASITRLEQFGPKPSNPMLNAGAIALCSRIPGVGEQQFRWLEHWVQKLFNQRLSINPLVFASEKRTGNRNRALAYLLKSRSNLGADVHETLDLYFALCSYEAMLDQMLYLPAVLANKGQDPDTGEQILSIETCKITLAIMATCGLYDETGTHMVKTGMPAKSGVSGYTIAVVPGKAGIVVLSPRVNAKGNSIRGEIMLEGLSKAMNWHFALP

SEQ ID NO: 78898 - protein, 514 aa, Triticum aestivum
MANIDMAAVLADMDRDAAADARTPRTKLVCTLGPASRSVPMLEKLLRAGMNVARFNFSHGTHEYHKETLDALRQAMHNTGILCAVMLDTKGPEIRTGFLKDGKPIKLTKGQEITVSTDYDIKGDTNTISMSYKKLPQDVKPGHVILCADGTISLSVLSCDPAAGTVRCRCENTAMLGERKNCNLPGIVVDLPTLTEKDKEDILGWGVPNDIDMIALSFVRKGSDLVTVRQLLGQHAKRIKLMSKVENQEGIVNFDDILRETDAFMVARGDLGMEIPVEKIFLAQKMMIYKCNLAGKPVVTATQMLESMIKSPRPTRAEATDVANAVLDGTDCVMLSGESAAGAYPEVAVKIMARICVEAESSLDNDAVFKEMIKAAPLPMSPLESLASSAVRTANKARATLIVVLTRGGTTAKLVAKYRPRVPILSVVVPVLTTDSFDWTVSSEGPARHSLIYRGLIPLLAEGSAKATDSESTEEILQAALKSAVKKQLCKAGDAVVVLHRIGVASVIKICTVK

SEQ ID NO: 78899 - protein, 464 aa, Legionella pneumophila str. Paris
MILEFDTIILGGGKGGKTLAMDLAKSGQKIAMVENNQIGGTCINVACIPTKTLVQAAKVAHYCRKAKGYGLNTTLNPIDFKAIRARKDAVVNGMREANLKQFLDSGMDLMLGHGHFIGPKMIEVTLSSPRDNQKTLHITADKIIINTGALPYNPPIAGLDKVNYFTNDSLMNTDSVPQHLLIIGGGYIGLEFAQMFRRFGAEVTVIEASSEFLGREDKDIAEQVFQTLSNEGIQFAVDTKINAIRQEQTEVIIEANRQGQSEIIRGTAVLVAVGRIANTAGLHLDKTGVELDERGFIKVNEFLETTAAGIWALGDVKGGAQFTHLSLDDYRLVKHNLQNPQKKLSSQNRLIPYTVFLDPELARIGLTEAQARSQGRPIKIATIPAAAIPRAKTQGETTGVLKAVIDAETDLILGVSIFCAEAGEILGVIQLAMELRVPYQKLRDMMFAHPTLVEGINLWFAQII

SEQ ID NO: 78900 - protein, 327 aa, Brassica napus
MASCIANDVTELIGNTPLVYLNSVAEGCVGRVAAKLEMMEPCSSVKDRIGFSMISDAEKKGLIKPGESVLIEPTSGNTGVGLAFTAAAKGYKLIITMPASMSVERRIILLAFGVELVLTDPAKGMKGAIAKAEEILAKTPNGYMLQQFENPANPKIHYETTGPEIWKGTDGKIDGFVSGIGTGGTITGAGKYLKEQNPNVKLYGVEPIESAILSGGKPGPHKIQGIGAGFIPSVLEVDLIDEVVQVSSDESIDMARLLALKEGLLVGISSGAAAAAAIKLAKRPENAGKLFVAVFPSFGERYLSTVLFDATRKEAESMTFQACIVSP

SEQ ID NO: 78901 - protein, 169 aa, Sulfolobus solfataricus P2
MPIEEYLGKTPKVSQKAYIHPTSYIIGDVEIGDLTSIWHYVVIRGDNDSIRIGKESNVQENTTIHTDYGYPVEIGDKVTIGHNAVIHGAKVSSHVIVGMGAILLNGSQVKEYSIIGAGSVVTQGTVIPPYSVAVGVPAKVIKKLREDEILIIDENAEEYLKHTRRLLKL

SEQ ID NO: 78902 - protein, 101 aa, Zea mays
  misc_feature (38)..(38): Xaa can be any naturally occurring amino acid
  misc_feature (76)..(76): Xaa can be any naturally occurring amino acid
MATNRSVGTLVEADLQGNNVFVRADLNVPLDDAQKITXDDTRIRASDPTINTPLEKVAKAILATHLRRPKGVTPKXRLKPPVFFLSEPLGVYSAMATDCIA

SEQ ID NO: 78903 - protein, 463 aa, Oryza sativa
MHTRSRRLGFPPLNPSHLLLTPHLPPLSSDRARMAMSRAAAAAAGTPVARRRLMGAVAARSMASWFGHVEPAAKDPILGVTEAFLADPSPDKVNVGVGAYRDDSGKPVVLECVREAGRRIAGSMNMEYLPMGGSIKMIEESLKLAYGENCEFIKDKRIAAVQALSGTGACRLFADFQKRFLPDSQIYIPTPTWANHHNIWRDAQVPQKTFTYYHPESRGLDFAGLMDDIKNAPDGSFFLLHACAHNPTGVDPSEEQWREISHQFKVKKHFPFFDMAYQGFASGDPERDAKAIRIFLEDGHQIGCAQSYAKNMGLYGQRAGCLSILCDDEMQAVAVKSQLQQIARPLYSNPPVHGALIVSTILGDPELKSLWLKEVKGMADRIIGMRTALKENLEKLGSPMSWEHITNQIGMFCYSGMTPEQVDRLTKEFHIYMTRNGRISMAGVTTGNVAYLANAIHEVTKTK

SEQ ID NO: 78904 - protein, 282 aa, Mycobacterium bovis AF2122/97
MTGESGAAAAPSITLNDEHTMPVLGLGVAELSDDETERAVSAALEIGCRLIDTAYAYGNEAAVGRAIAASGVAREELFVTTKLATPDQGFTRSQEACRASLDRLGLDYVDLYLIHWPAPPVGKYVDAWGGMIQSRGEGHARSIGVSNFTAEHIENLIDLTFVTPAVNQIELHPLLNQDELRKANAQHTVVTQSYCPLALGRLLDNPTVTSIASEYVKTPAQVLLRWNLQLGNAVVVRSARPERIASNFDVFDFELAAEHMDALGGLNDGTRVREDPLTYAGT

SEQ ID NO: 78905 - protein, 127 aa, Glycine max
MEQTFIMIKPDGVQRGLVGEIICKFEKKGFTLKGLKLITVDRPFAEKHYQDLSAKPFFNSLVDYIISGPVVAMIWEGKNVVLTGGKIIGATNPAASEPGTIRGDFAIDIGRNVIHGSDSVESATRKL

SEQ ID NO: 78906 - protein, 130 aa, Triticum aestivum
NSLKDFFPTMEMHASAQCSNPACLERQKEYMQSKPARDAAAKAKMEAEASAAIEYPVHMDNEWNISVLDDSDTATSSVQRAATDILPEGLVRELPDEDTYVEPPAAPASCGAIDDDLEELQRQLDALNSS

SEQ ID NO: 78907 - protein, 312 aa, Xanthomonas campestris pv. campestris str. ATCC 33913
MTKKIPLLIDTDPGVDDALALLMAFNDTRHDVVGLTIAAGNVGLEHTVRNALKVCEVAGRADVPVYAGCPQPLLHPSVDAAHVHGIDGFGDVGLPPAARAADAEHAALAILRLSHVHAGELLLVALGPLTNLALALTLDPTLPQRVARLVVMGGALTGHGNITAAAEFNIGFDPEAAHIVFRGFPQFDVADWEATAAHGLLHRDVEQWLAADSPRARFYEEISRKTRLWSEDSRGEYWYAADALAMAFALQPDGAQRLEQRPVHIELSGTHTRGMTLVDWNRQGGAADNATLLLDYDRQRFYGLVGQALAAG

SEQ ID NO: 78908 - protein, 312 aa, Nocardioides sp. JS614
MSIEHTSHDPSKPDPAKARTLAAALPWLKRYHGKIVVVKYGGNAMTDETLKRAFAEDIAFLRFAGFKPVVVHGGGPQISTMLDRLGIRSEFRGGLRVTTPEAMDVVRMVLVGQVQRELVGLINEHGPLAVGCSGEDAGLFTAEPANTVIDGEEVDLGLVGEVARVRPESVLDLIEAGRIPVVSSVAPDADGQVHNVNADSAAAALAVALGAEKLLVLTDVEGLYLDWPSSDDVIGEISPEALEEILPTLASGMVPKMGACLQAVRNGVPRATVVDGREPHAVLLELFTNEGVGTQVLPGVETKTRKARDTQS

SEQ ID NO: 78909 - protein, 338 aa, Saccharomyces cerevisiae
MSLQHEKVTIAPLVLLSALDHYERTQTKENKRCVGVILGDANSSTIRVTNSFALPFEEDEKNSDVWFLDHNYIENMNEMCKKINAKEKLIGWYHSGPKLRASDLKINELFKKYTQNNPLLLIVDVEQQGVGLPTDAYVAIEQVKDDGTSTEKTFLHLPCTIEAEEAEEIGVEHLLRDVRDQAAGGLSIRLTNQLKSLKGLQSKLKDVVEYLDKVINKELPINHTILGKLQDVFNLLPNLGTPDDDEIDVENHDRINISNNLQKALTVKTNDELMVIYISNLVRSIIAFDDLIENKIQNKKIQEQRVKDKQSKVSDDSESESGDKEATAPLIQRKNKKN

SEQ ID NO: 78910 - protein, 411 aa, Nocardioides sp. JS614
MTDSTEAVSGGSKEGGAPLVGGAPLAERYAASLMNTFGPPKLVLTRGAGAHVWDADGNEYVDLLGGIAVNALGHGHPALVAAVTTQLQTLGHISNFFTSAPQVELAERLLALLGAGPGGGKVFFTNSGTEANEAAFKLTRRTGRTHVVVADGSFHGRTMGALALTSKAAYRAPFEPLPGEVTFVPYGDADALAAAVTDATAAVLLEPIQGEAGVVVPPEGYLAAARAIADEHGALLWLDEVQTGLGRTGRWFAFATSGITPDVVTVAKGLGGGFPIGACIGVGDAGNLLEPGNHGTTFGGNPVACAAALAVLRTIEDEDLLEHVTVLGEQLRDGLAADPRVSEVRGEGLLIGLDLTTDAAAAVVAAAQRAGFIVNNPTPSRIRLAPPLVLTPEDAESFLRAWPAILDEAMA

SEQ ID NO: 78911 - protein, 156 aa, Campylobacter lari RM2100
MKIIEGNLSLKGDEKIAIINARFNHIITDRLVEGAKDAFLRHGGKEENLSLILVPGAFEIPFALKQACESKKFDGICCVGAVIRGSTPHFDYVAAETTKGIASVGLGANVPVSFGVLTTDTLEQAIERAGSKAGNKGFEAMLTVVEMLNLIQKIKA

SEQ ID NO: 78912 - protein, 306 aa, Nocardioides sp. JS614
MTRHFLADDDLSPAEQARVLDLAAELKQAPYDAKPLAGPRTVAMIFDKQTLRTQASFAAGIAELGGHPMLVDGALAGIGVRESVHDVARVLGRQAAMIVWRTYAQARLEEMAEHAGVPVVNALTDDFHPCQLLADLLTIREHKQRLAGLTVAFVGDGACNMGNSWLLAGVTAGLHVRVSSPEGYAPDPAMVERAAAIAATTGGSATLEPDPVAAVTGADVVVTDTWTSMGKEEEAVARTVALAPYSLTTELLGRADPDAIVLHCLPAYRGKEIEAAVLDGPQSVVWDEAENRRHAQKAVLSFLLEA

SEQ ID NO: 78913 - protein, 308 aa, Oryza sativa Japonica Group
MSTCDSMKSPDFEYIDNGDSSSVLGSLQRRANENLRISEDRDVEETKWKKDAPSPMEIDQICDVDNNYEDPQLCATLASDIYMHLREAETRKHPSTDFMETLQKDVNPSMRAILIDWLVEVAEEYRLVPDTLYLTVNYIDRYLSGNEINRQRLQLLGVACMLIAAKYKEICAPQVEEFCYITDNTYFRDEDPALHLEFLANYVAELSLLEYNLLSYPPSLVAASAIFLAKFILQPAKHPWNSTLAHYTQYKSSELSDCVKALHRLFCVGPGSNLPAIREKYTQHKYKFVAKKPCPPSIPTEFFRDSTC

SEQ ID NO: 78914 - protein, 399 aa, Clostridium tetani E88
MLGVSKRVEELRFSEIRKFIPYSDGAKAKGVQVHHLNIGQPDIKTPEEFISAIKNFDEEIVKYEDSQGNKDLIDAFVKYYESINIDIDKEDVYITNGGSEAILYALLTICDLGDSVIVPEPYYTNYNTMAKMAGVDIISFRTYREDGFRIKSKEDIINSIKDNTKAIMITNPSNPTGVVYTKEEIRMISDIAKEKDLFIISDEVYREFVYDDLKFTSFMDMKDILDRVIIIDSISKRYSACGARIGALICKNRNVTENFMKMCQARLSVSSLDQVGAANLINVPKSYIEEVRIEYEKRRNILYEGLCDIPGVHCEKPSGAFYIIAKLPIDNSDDFTKWMLKDFQYNNKTVMVTPAEGFYTTEGLGKDEVRLSYCINSQDLKESMLILKKALEEYNKLRK

SEQ ID NO: 78915 - protein, 414 aa, Legionella pneumophila str. Paris
MSFKQLALIEPLNRAVSELGYTNPTSIQLKAIPLILNGHDLLGSAQTGTGKTASFVLPILQKASQQTQTSRNRAKVLILTPTRELAIQAHESIIQYGKYLTLRSAVIYGGVKSHNQIKQLDSGLEILVATPGRLLDLYQQGAVKFDEIDTLVLDEADRMLDMGFIHDIKKIIKLLPLKRQNLLFSATFTPEVRTLARNILNKAVEIDIAPRNTAVKTIKQTVYSVDGNHKLALLSHLLHKNNWGQTLVFSRTKHGANKLVKQLAESQIYSVAIHGNKSQAQRTKALADFKSGKVQTLIATDIAARGIDIEKLACVVNFDLPHVPEDYVHRIGRTGRAGASGLAVSLVSTEEIKLLLSIEKLINQKLERIKIKDFEFLHNFSDLVSAKIQKFAPPKAGYKGNISRKSRTAFNKSA

SEQ ID NO: 78916 - protein, 452 aa, Oryza sativa Japonica Group
MVLRRFAWPYGGQRASFCGSFTGWRECPMGLVGAEFQVVFDLPPGVYQYRFLVDGVWRCDETKPCVRDEYGLISNEVLVDNTHPVVQPETSIRVVSMDEGTILTTQMPPDQLSQNSGVQIAIFRHRVSEILLHNTIYDVVPVSSKIAVLDARLPVKQAFKIMHDEGLSLVPLWDDQQQTVTGMLTASDFVLILRKLQRNIRTLGHEELEMHSVSAWKEAKLQFYGGPDVAAIQRRPLIHVKDSDNLRDVALAIIRNEISSVPIFKPSTDSSGMPLLGLATLPGIVKFICSKLQEQPEGYSFLQNQIVSMPIGTWSPHTGKASNRQLRTSRPSTPLNSCLDLLLEDRVSSIPIVDDNGALLDVYSLSDIMALGKNDVYTRIELEQVTVEHALELQYQVNGRRHCHTCLSTSTFLEVLEQLSAPGVRRVVVIEPRSRFVQGIISLRDAFTFLIG

SEQ ID NO: 78917 - protein, 408 aa, Gibberella zeae PH-1
MTQSKNDIVALRAQFPALQQKQIFLDNAGGSQILGAAADSIRDYLITSNVQMGGSYDASQTASKKVNKGYEAGSRYINAQPDEIVYGASSTQLLRNLALGLTFAEGDEIIVSTLDHESNIAPWLDLAERQGLGIKFWNPEGQGNNPKLTVETLKPLLSNRTKLLAFTHTTNLLGSIHDVKAITAAAHEYPDVLVCVDGVAYAPHRSVDVKDLGVDFYCLSWYKVFGPHISMLYASREAQKQLRPLSHYFNPTQTLSDKASFAAGSYELIASIPTVVDHISEHGWEGSVKQETQIQTMLLDYLSKREDITIYGEPSSDSESRVPIVSFTVEGWNSRSVVAAIEANSNIGLKHGHFYSHRLITEVLDLDATDGVVRVSMAHYNTREEIETVISTLEDVIVKRGLLNKNGK

SEQ ID NO: 78918 - protein, 413 aa, Bacillus cereus E33L
MIKKYTCKNGVRIVMENIPTVRSVAIGIWIHAGSRNENEKNNGISHFLEHMFFKGTETRSAREIAESFDSIGGQVNAFTSKEYTCYYAKVLDEHAKYALDVLADMFFNSTFDEEELKKEKNVVCEEIKMYEDAPDDIVHDMLTKATYETHPLGYPILGTEETLNTFTGDTLRQYIKDHYTPENVVVSVAGNIDEAFLQTVEQYFGSYEGTTNREQVHSPIFHFNKVARKKETEQAHLCLGYKGLQMGHEDIYNLIVLNNVLGGSMSSRLFQEVREQRGLAYSVFSYHSSYEDTGMLTLYGGTGSQQLDTLYETMQETLETLKNTGITEKELINSKEQLKGNLMLSLESTNSRMSRNGKNELLLRKHRSLDEIIESVNTVTKENVDELIRNMFTDEFSAALISPDGKLPKGIKL

SEQ ID NO: 78919 - protein, 752 aa, Oryza sativa Indica Group
MAQGVMLWYDDFLAVLVLSVLVATSSTAANCGRKCGDVRIPYPFGIGVDCAWPGFDVTCNHSFTPPRPYYGNIEIMDISVAEGEMRVYTPVVSQCYNSSNTTDSNGFESLQLTVADSPFLVSPGRNEFTAIGCDTMALLQGRDDWSFLTGCITTCVSLDEAAHDGEQCSGLGCCQVPSIPPNLTTVALDWSNRTENLAWTYSPCSYAFVAEKGWYKFSRRDFSRAGSKSFMNRAGDRSVVTVLDWAISSNGSCSSTSRVAPACVSPNSYCVNTTNGQGYLCKCSTGYDGNPYVTGDNINECKLRREDPAKYRELYPCYGGSKCHDTEGDYRCKCRLGRRGDGKIDNGCQPIIPPPVIGILVIAGVVLFGLVFVCLRKKWKLKGCYDRNGGQMLEKTGVKIFTKQELDKITNNKSNKIGKGAFGVVYKGTHDDQPVAVKYSIEKSISRTRGKDEFVKEITVQLQVSHDNLVCLIGCCLEVDVPMLVFEFVPNGSLESVLHGPERCALPLLKRLDIAIGSAEALTYMHSHSRRCIFHGDIKPANILLDDNFMPKVSDFGSSESVLKTKHRSVCADMGYIDPVYMITGNFRLKSDVYSFGIVVLELITRKKAVYDGKSLPIEFTNCYEDDNARRNMYDQDILSAEALQPHCMECLDRMAGIAVQCLEYYIDKRPTMAEALQELIQLRAKVAAKMNAAAAGPDLARQGGNGQQTWANGPKSSINLDRTGNSRNLHTLKSYSLHFEIFDTIDFLVHV

SEQ ID NO: 78920 - protein, 152 aa, Prochlorococcus marinus str. MIT 9313
MAMERTFVAIKPDGVQRGLVGEILGRFERKGFKLVGLKQVTPSRDLAGEHYGVHRERPFFAGLVDFITSGPVIAMVWEGDGVIASARKLIGATKPLDAEPGTIRGDLAVNIGRNVIHGSDGPDTAQFEINLWFSAEELNAWTPSDQSWRIES

SEQ ID NO: 78921 - protein, 1165 aa, Gibberella zeae PH-1
MDLRNILDATDFYSNFTAALSTFSLDHLDSPTLNLQIIIQEGNSADGDRSGSLETNEEPILQSGHLLLSHKIPLRIGNGSCSIEPASPSLVSREPSPELRIPTNQRQVEIQRRTQSHKSHKRQGGLRLAAVNGDVPVEGDVDNANPRQMQVGQENFPKRVKVKHDGVFHPKESSLGKFVAGVWEQIHSGVILEPHVLTEQVQLTSRSSGNSPSGDLVSTAPSIRPDQTWESFNRSNIFCQRVTQASRTCRSIEVIVQARWVELFDSYVEYLASTNPNLSMTKCRMRAIAEACTDFGWTEKELRNKMGIWRGYKEIKDVLGWVALVFSGMGLYRLCKYRVDFDKDKFSRARTLGKRMEVAADTLHTNWRQLLAIVGESTEPRFAGHPHDWVVQQDGSDPVPLRSTYLAYDSNFTFEHLEESIIDTALWGADDPRWTPPSSAICLSGINVCDLCSEVQSNESAVNACKCFPNLFGVPRLPIAVQVFCTSNGRNNGLQALVAFERGTAIGEFVGLITKDIEEQDVMDSQAGGTRYQIWQGKQGNFTRFANHSCKPNAQFEKFVWLGTQHIVMNNTADIPLLFRFNMINRKIPLASYLFTRLKQAGTRRIYGVPGDFTLRALDHVPRSGIQFVGCCNELNAGYAADGYARAQRHRLQSGLGALITTYGVGELSAANAVAGSYAEHLPVVHIVGTPSQKARQVSTTSVGGRSPHLHIHHTLADSRIGVFREIAEKFTVAQLDLSGVDAEDVPTKVDEVLAKALYHSRPVYVELPSDAVETVVSSTLLERPIEERHTINDESSHLETREMADSLLQRLYAAKRPLILVDRGDGIETIRPDINEFVQKSGIPTLSLPSGASMVNNSLPNYFGVYSGSIGIVDLTSAVKSADLVLAFGCQFSDTQTLGWGVVPERNSMIMIGRNNIEDHQTGTGEILRMVTANLDKRSLAEQDTSSWGNFRHLPSQTVEPASPINQDEFYIHLNKYLKDDDNILLGNATPIIGGRDFVLPPSSQLIASGMWFSIGHMLPAAMGVSQAKADQGSSGRTILLDGDGSFQMTAQELSTIIHKRVNMVVFIINNSGYTYERYIHGMDEEYNDVAPWNYSLGPNLFGQAPDGYPIQSCRVHTWKELDSVLNSEGFSTGKGLTLVDIVIDKYDISERAKALFELVNKQL

SEQ ID NO: 78922 - protein, 473 aa, Burkholderia thailandensis E264
MNLTIIGSGYVGLVTGACLADIGHDVFCLDVDSKKIDILNGGGVPIHEPGLKEIIARNRSAGRLQFSTDVEAAVAHGDVQFIAVGTPPDEDGSADLQYVLAAARNIGRHMRGFKVIVDKSTVPVGTAERVREAVAHELKARGGDSMFSVVSNPEFLKEGAAVEDFTRPDRIVIGCDDDVPGERARELMKKLYAPFNRNHERTLYMDVRSAEFTKYAANAMLATRISFMNELANLAERFGADIEAVRRGIGSDPRIGYHFLYAGCGYGGSCFPKDVEALIRTAAEHGQALRVLQAVSAVNDEQKHVLAKKVVARFGEDLTGRRFGVWGLAFKPNTDDMREAPSRALIAELLSRGARVVAYDPVAQAEARRVIALDLGDRPDALERLAFADDEAQVAQDADALVIVTEWKAFKSPDFAALGKRWKTPVIFDGRNLYEPVAMRELGIEYYPIGRPGAAARTAAGGRNAARTARAGA

SEQ ID NO: 78923 - protein, 410 aa, Bacillus cereus E33L
MKIIVQKFGGTSVRDENGRKHALHHIKKSLDAGYKVVTVVSAMGRKGEPYATDTLLSLVNQEESHISNREQDLLLSCGELISAIVFSNMLNENGIKAAALNGAQAGFVTNDDFTNAKIIEMNCDRIHEELENIDVIVVTGFQGQTKKGDTTTLGRGGSDTSASALGVALHAEYIDIFTDVEGVMTADPRIVKDARHLQTVTYNEICNMAYQGAKVVHPRAVEIAMHAKVPLRVRSTYSDSEGTLIAAYDGATKGQDVEERPVTGIAHVSNVTQIKVLEKETAYDIQQHVFKEMANEGISVDLINISPTGVAYTVNDNVSARAVEVLKQLGYEPIVTEHCAKVSIVGAGMAGIPGVTAKIVTALAEKGIQILQSADSHTTIWVLVKETDLVEAVNALHSAFELSKEKQLEQ

SEQ ID NO: 78924 - protein, 130 aa, Triticum aestivum
VFLPPPPRKKTKAKSPQFPPLPSLRQPRLRPSADDPRSSTKTEGSQPPVPKNPAMTSCRKKKTDDDVTFLEDVKEHIDEFIHASMDEHKTCFKKTIQKMFGMSKVVAERSAAAKEAEVESALPLQTSVSQ

SEQ ID NO: 78925 - protein, 226 aa, Allium cepa
MEAVTKLDVEGTAFDSVIIPPGSSKTHFLGGAGVRGLEIGGKFIAFTAIGIYLETDSIPFLADKWKGKTGEELAGSLDFFRDICTGPFEKFTNVTMILPLTGEQYSEKVTENCVAYWKAIGIYTDAEASAVDKFKQAFKPESFPPGSSILFTHTPSGTLKIAFSKDGSVSKDEGVLIENKALTQAVLESIIGEHGVSPAAKLSIASRLSEIMNKVGNVEEKLPVLS

SEQ ID NO: 78926 - protein, 188 aa, Glycine max
MKATKELSEQVEENEVKVLVEEDDEEYESVDEVVDDAEDDEDEEEDDDDDEGDDNDDEEDDAPDGGDDDDDEDDEEEGDVQRGGEPDDDDNDSDDDSDDDEDEDEEDEEEQGEEEDLGTEYLIRPLETAEEEEASSDFEPEENGEEEEEDVDDEDCEKAEAPPKRKRSDKDDSDDDDGGEDDERPSKR

SEQ ID NO: 78927 - protein, 669 aa, Pseudomonas putida GB-1
MNDCHLICANRLDDGAVVWLDAGHEWVETLQQAGTFDAQALVSATLAAEAAVLANQVVAPTPCEAWLVDGRPEPKSLRERLRARGPSVRSDLGKQAAGTPPSSIARMRPVLPVEAGQAGVYRYDRFEREFLKDRARQFEQQVARRLSGELDEEAFKVYRLMNGLYLQLHGYMLRVAIPYGTLSALQLRQLAYVAHTYDKGYGHLTTRQNIQFNWPRLADTPEILSVLADADLHCIQTSGNCIRNVTTDHFAGAAEDEVLDPRVHAEILRQWSTEHPEFTYLPRKFKIAITGSPKDRAAVRFHDIGILAQRNAQGEVGFQVYAGGGLGRTPIVGTRVREWLPERELLRYVEAILRVYNALGRRDNLYKARIKILVRELKPGRFIEMIEEEFASLPADHQYLEPAIVQGIHARFVQPAFEALPGLCDSFLRARADDNAFASWVRTNTHPHKKRGYICAVISLKPPGGIPGDISAEEMLALADLAEAYSLNEIRVSHEQNVVLPHIRLVDLYSVWQALRQAGLATSNIGLLSDTIACPGMDYCSLATARSVPVAQRIAQRFDAARQQDIGELKLNVSGCINACAHHHVAHIGILGLDKAGHENYQITLGGSAEEDAAVGTILGRSVPFEEVPDIVEAIVAIYLQLREDDERFLDTYRRVGIEPFKEVLRDAR

SEQ ID NO: 78928 - protein, 188 aa, Chlamydomonas reinhardtii
MEGLVAQVVALSNPNDINQLLTTLKSSEAVFTQNYQHIAAALQTLDPVQHSLGFGYYLGKGNLQAPDVAFIDNAARFFTLCDPAQIQAAPDVFCAVAKKLKEHVLAAGSPRRGILPLRCGLRALQPAPEVLTPLHADFFQLCLLSRCYNAAAEVLGQDIYDVSPAATTCTPTDLFLYCYYGGMLAIGE

SEQ ID NO: 78929 - protein, 94 aa, Zea mays
GCTATSRAAHCSPQAVVPVQSTGKMVNAIKGLFISCDVPMAQFIVNLNASMPPSERFIVHMLDPTNMFVQPHVAHMIRSKIGEFRDQNSYEKPQ

SEQ ID NO: 78930 - protein, 546 aa, Shewanella sp. MR-7
MPCQTSGQPNSIWKFILITTANITMQFGSKPLFENISVKFGGGNRYGLIGANGCGKSTFMKILCGDLEPSSGNVSLDVNERLGKLSQNQFGYEEFTLIDTVIMGHRELWKVKQERDRIYSLPEMSEEDGIAVANLEMEFAEMDGYTAESRAGELLLGVGIGIESHFGLMSEIAPGLKLRVLLAQALFSDPDVLLLDEPTNNLDIDTIRWLQDVLNQRDSTMIIISHDRYFLNSVCTHMADLDYGELRVYPGNYDEYMQAATQARERLLADNAKKKAQISELQTFVARFSANASKAKQATSRARQIDKIKLDEVKASSRVNPFIRFEQEKKLFRNALVVENLAKGYDTPLFKDLNLIVEVGERIAILGENGVGKTTLLRTLIHDIPQDEGVIQWSENSNIGYYAQDHESDFENDMTLFEWMSQWRKPEDDDQAVRGILGRMLFSADDIKKSVKVLSGGEKGRMLFGKLIMQKPNILMLDEPTNHMDMESIESLNNALEKYEGTLLFVSHDRAFVSSLANRILEITPNGVNDFKGTYDEFLVSKGIEG

SEQ ID NO: 78931 - protein, 454 aa, Pyrococcus abyssi GE5
MELKPNVKEIPGPKARKVIEEHHKYMATTTNDPNEYFLVIEKAEGVYWIDVDGNVILDFSSGIGVMNVGLRNPKVIEAIKKQLDLVLHAAGTDYYNPYQVELAKKLIEIAPGDMERKVFLSNSGTEANEAALKIAKWSTNRKMFIAFIGAFHGRTHGTMSLTASKPVHRSRMFPTMPGVEHVPYPNPYRNPWGIDGYENPDELINRVIEYIEDYLFEHYVPAEEVAGIFFEPIQGEGGYVVPPKNFFKELKKLADKHGILLIDDEVQMGMGRTGRMWAIEHFDVVPDIITVAKALGGGIPIGATIFRADLDFGVSGVHSNTFGGNAVAAAAALAVIEELQNGLIENAQKLEPLFRERLEEMKEKYEIIGDVRGLGLAWGVEFVKDRKTKEYATKERNEIVVEALKRGLALLGCGKSAIRLIPPLIISEEEAKIGLDIFEEAIKVVSERHGYKIH

SEQ ID NO: 78932 - protein, 363 aa, Ralstonia solanacearum GMI1000
MTPQFHPLRVAEVRGETADTISLRFDVPDDLREAYRFTQGQFLTLRVPAGAAGQGELRRSYSICCAVQDYDAHGELRVAVKRVDAGVFSNHLHDRIRVGQTLDVLPPDGRFYVPLAAESARHYVAFAAGSGITPVLSLIKTTLAAEPHSRFTLVYGNRTVDSIIFAEALEDLKDRYLDRFALYHVLSRQPQEIALFNGRLDGDKARAFLDTLIPPDDIDAAFICGPSTMIDAVEAALLARGVPRERVHAERFGVPVGDASARPRKPAAVAGDVALTVVLDGKSHHVPMAGDGKVLDSALAAGLDLPYACKGGVCCTCRAKVLEGRVEMEKNFTLEDWEIRQGFVLTCQARPLTQRVVVSYDER

SEQ ID NO: 78933 - protein, 199 aa, Haemophilus parasuis
EEGDIIIDGGNSNYPDTNRRVKALTEKGIRFIGSGVSGGEEGARHGPSIMPGGNEEAWQYVKPIFQAISAKTDKGEPCCDWVGKEGAGHFVKMVHNGIEYGDMQLICEAYQFLKDGLGLSYDEMQAIFAEWKKTELDSYLIDITTDILGYKDTDGTPLVEKILDTAGQKGTGKWTGINALDFGIPLTLITESVFARCVS

SEQ ID NO: 78934 - protein, 175 aa, Zea mays
  misc_feature (88)..(88): Xaa can be any naturally occurring amino acid
  misc_feature (115)..(116): Xaa can be any naturally occurring amino acid
  misc_feature (133)..(133): Xaa can be any naturally occurring amino acid
  misc_feature (153)..(153): Xaa can be any naturally occurring amino acid
MASLSFVSSSHLTLRAPSPNNLRSSSPRPTSVSFSVKAQSVALSQDDLKKLAAEKAVESIKPGMVLGLGTGSTAAFAVDQIGKLLSSXQLHDIVGIPTSKRTEDQARSLGIPLVXXSNAPRIDLAIDGAERSXDPTLDLVKARGGALPEEKMXEAVAERFIVVAMIRTREGLRSG

SEQ ID NO: 78935 - protein, 145 aa, Zea mays
MEEEFQEAEILWPAGVSGNSQGVDGGGEAAPACSVRHRPRAATPVDISRQKRRCRPCPVSSSEHYYATTLDDQETDDVGDGAKGTTANHGSAVVPPHVLVARRRRLVRGRTAAYSMCAGKGRTLKGRDLRDVRNLVLKMTGFIEE

SEQ ID NO: 78936 - protein, 187 aa, Rhodococcus sp. RHA1
MALINTQIKPFAANAFKDGAFITVSADDIKDKWAVFYFYPADFTFVCPTELGDLADHHEELQRLGVEVFSVSTDTHFTHKAWHGSSDTIGKIKYAMIGDPTQEISKNFEVLRENEGLADRGTFLVDPDGVIQFTEVTAEGIGRNAAELVRKVKAAQYVRSHPGEVCPAKWEEGEETLAPSLDLVGKI

SEQ ID NO: 78937 - protein, 497 aa, Pseudomonas aeruginosa UCBPP-PA14
MTTLTRADWEARAKDLKIEGRAFVNGEYSNAASGETFDCLSPVDGRFLAKVASCDLADAEQAVKVARNAFDSGAWSRLAPAKRKQAMIRFADLLLENAEELALLETLDMGKPISDSLHIDVASAANSLRWSAEAIDKIYDEVAATPHAELGLVTREPVGVVAAIVPWNFPLLMSCWKLGPALATGNSVILKPSEKSPLTAIRIAQLAVEAGIPKGVFNVLPGYGHTVGKALALHMDVDTLVFTGSTKIAKQLMVYAGESNMKRVWLEAGGKSPNIVFADAPDLKAAAEAAAGAIAFNQGEVCTAGSRLLVERSIKDKFLPLVIEALKGWKPGNPLDPETNVGALVDTQQMNTVLSYIEAGHNDGAKLVAGGKRTLEETGGTYVEPTIFDGVTNAMKIAREEIFGPVLSVIEFEDAEEAVRIANDTPYGLAAAVWTSNLSKAHLTAKALRAGSVWVNQYDGGDMTAPFGGFKQSGNGRDKSLHAFDKYTELKATWIKL

SEQ ID NO: 78938 - protein, 477 aa, marine gamma proteobacterium HTCC2080
MSEVTQVRHAQFGRFTQRLEGLSEKLQAPNPVETGQLVHLSGMRLEVAGLRSPIGSRCLIQGKVPVEAEVIGFHGDRLVMMCEGSAEGLRPGARVEPLEGSDRIPVGPGLLGRVIDGAGRPLDGFSPPTSDITVPMQGEPLNPMDRGALQKPLDVGIRAINSLLTVARGQRIGLFAGSGVGKSTLLGMMTRFTEADVVVVGLVGERGREVREFVEDSLGPEGLKKAVVVATPADTSPLMRVAGCWRATAIAEYYRAQGLNVLLLVDSLTRFAQAQREIGLAAGEPPVSRGYTPSVFSLMPNLIERAGNLGSGSITAVYTVLTEGDDLQDPIADSARAILDGHVVLSRKMADSGLFPAIDIEASISRAMLQITDDAQQAHARKVRDVYATYQANRDLIAMGAYRAGTDPQIDLAIRHHNAVHQLIEQPLDQPASFDSSLSELAQVSEAMQQDNEPAAQMPFQQKPSQTMPAPLAPATR

SEQ ID NO: 78939 - protein, 662 aa, Hypocrea jecorina
MSWKLTKSMSLLFPLSPTFRPPTSPSPSPFDWQNETDWPCAELKDTHLGPLSAFSRSPSTSTITDKDEKGTSPGATTPTSENAIAASEALSQAPVVKKPGILVVTIHEGQGFSLPEQHRSAFASSHQSSRSSGGALAGSVRPDGQRVAGSYTNGARPHSSGGGFGSLPTNHGRISGKYMPYALIDFDKVQVFVNSVEGSPENPLWAGGNTQYKFDVSRVTELVIHLYMRNPAAPPGSGRSQDIFLGVARINPRFEERQPTTDDAKSSKKDREKAADAQRQKGEGHSGVEWVDVQYGTGRIKVGVEFVETRAGKLKIEDFELLKVVGKGSFGKVMQVRKKDTNRIYALKTIRKAHIISRSEVAHTLAERSVLAQINNPFIVPLKFSFQSPEKLYFVLAFVNGGELFHHLQKEHRFDVNRSRFYTAELLCALECSHGFSVIYRDLKPENILLDYQGHIALCDFGLCKLDMKDEDRTNTFCGTPEYLAPELLLGQGYNKTVDWWTLGVLLYEMLTGLPPFYDENTNEMYRKILSEPLHFSDVVPPAAKDLLTKLLNRDPKKRLGANGSAEIKAHPFFHDIDWRNVLQRKYEPTFKPSVTDAMDTANFDPEFTSEAPQDSYVEGPMLSQTMQDQFQGFSYNRPIAGLGDAGGSVRDPSFVGSLQDN

SEQ ID NO: 78940 - protein, 641 aa, Yarrowia lipolytica CLIB122
MSSLSTLLDILDSVRGKKYLILDRCLATQISLLCPFSVLTEHGVDKIFWLQDEESLPSNDVAVLNGAKIAYIVASRDPRSGAMLAKHQRSVAANVETHVISVPRSLSLEALHLDVFYHSWDIPYVALDPDLYTLGLGVVDHVPLLTREAKQTFPGATPDYVSVELASRALFALQQQFGFAGRLLARGNESSMSQQIIRQLQRLKDDFEVEAATSGSREAQFLLTNDALLVGEKVEQIILIDRQDDPLTPLLSQLTYSGLIDEFWGLSENGKVEIEELIPSQVTASSSSSAPVSQMFLNDTLYRDLRDINFSSVGSRLNACATSLQSDYGERHKAKTVSEIKSFVGRLSGLTDLHTNLKLHTHLSELIMKRLQKPEFNRVLEIQQNLVADSMDLTKLHNMLQDLIGGNAELDTVLRLLSIESLVNGGIKEKTLTSIKKEICQTYGYQHFLTFQNLQKMGLVVPKQNTSYFGYNAKSQDFALSTFSANFSALSKSLGVISDQQQEVDETDIASSYSGYAPISVRTVQCVVDKKSVISRATKQQLETYEKTGGWAGATELLPGLPLIDYSYTDTAKDGKEENEKKVKNFLSRDFVKKKTFVFFIGGVTWAEISALRLLGKSVKTELVVVATGVINGNDLVKPAY

SEQ ID NO: 78941 - protein, 226 aa, Yersinia pestis KIM
MSPFTLRNQVFNFMTDKAHQCVIIGIAGASASGKSLIASTLYRELREQVGDQHIGVIPEDGYYKDQSHLSMEERVKTNYDHPSAMDHNLLLEHLQALKAGKPVELPLYSYTEHTRKKETVHLEPKKVIILEGILLLTDIRLRQEMNFSIFVDTPLDICLMRRMKRDVNERGRSMDSVMAQYQKTVRPMFLQFIEPSKQYADIIVPRGGKNRIAIDILKAKISQFFE

SEQ ID NO: 78942 - protein, 650 aa, Aspergillus nidulans FGSC A4
MASAPTMANATTFNTTPMQTLLNPSDTALLETFIPGYSMASRILSTYLQIDLSSYIPYLIFMGLIAATARYIYSQLYNLFQEHCISTAEIRHDDEVYNYLMYWLAQQPFTNRTTHFVAGTRISGSSWCYEPDSDSDEEGFGGADEIDNEGNVVTDFDAYWAKATARDKLKKLRFTPSEGTHYFWFNGRPLAFIREKQDDKSSGGGYYGYGTKAPERLYISCIGRDPAVLKELLLEAQRYYVAKDKNNTVIYRGHKSGSYTEWSRCMARAPRALSTVVLDKAQKDAFIDDIKDYLHPRTRRWYNNRGIPYRRGYLLHGPPGTGKTSLCFAAAGLLGLELYLLNLSSKSLDEDELMALFTDLPTRCIVLLEDVDCAGMSQKRTPGSSSNDDNGNSASPELQEQGEGNSSGTTTGGTGVFEKQGVSLSGLLNVIDGVAACEGRILVMTTNHPEKLDPALVRPGRIDLSIAFGHSTTSDIKELFSAIYSTLEGDLRVSPAERLSPKLRARMAKRSSTSHSTNSTNANVVIHKETRKFSEEQIRLWAAEFAERVPAGEFTPAEIQGYLLNHKTDPERAIEEATRWVGEVKEKKAKTKAKSASANTAKVDGDQEEDKREVNGVKNEGKTQLTNGDAQAHTNMDKPCPTSICRETTN

SEQ ID NO: 78943 - protein, 482 aa, Oryza sativa
MVKICCIGAGYVGGPTMAVIALKCPDVEVVVVDISAPRIEGWNSERLPIYEPGLDDVVRQCRGRNLFFSTDVERHVADAGIVFVSVNTPTKTRGLGAGKAADLTYWESAARIIADVSRSDKIVVEKSTVPVKTAEAIEKILAHNSKGGNIRYQILSNPEFLAEGTAIQDLFSPDRVLIGGRETPEGRAAVAALKSIYARWVPDDRIITTNLWSAELSKLAANAFLAQRISSVNAISALCEATGADVTEVANSIGKDSRIGPRFLSASVGFGGSCFQKDILNLVYICECYGLPEVANYWHQVIRINDYQKSRFVNRVVSSMFNTVAGKKVAVLGFAFKKDTGDTRETPAIDVCKGLVGDKAVVSIYDPQVTEEQVQRDLVMNKFDWDHPRHLQPMSPSSAKHVAVSWDAYEAARGAHAVCILTEWDEFRRLDYQRMYDAMHKPAFLFDGRNVVDPDKLRRIGFVVYSIGKPLDHWLRDMPAVA

SEQ ID NO: 78944 - protein, 298 aa, Salmonella enterica subsp. enterica serovar Paratyphi A str.
MVRIACVGITVMDRIYYVEGLPTEGGKYVAKRYTEVGGGPAATAAVAAAKLGAQVDFIGRVGDDDTGNSLLAELESLGVNTRYTRRYTQAMSSQSAIMVDAKGERIIVNYPSPDLLPDADWLNDIDFSQWDVVLADVRWHDGAKQAFTLARQAGVMTVLDGDITPQDISELVALSDHAAFSEPGLARLTGMSEAIDALKKAQMLTNGHVYVTRGSEGCNWLEKAVVRHQPGFTVEVVDTTGAGDVFHGALAFGLASGYAIEEAVRFASGVAALKCTRPGGRAGIPDCEQTRSFLSLFV

SEQ ID NO: 78945 - protein, 171 aa, Dasypyrum villosum
MANPRVFFDMTVGGAPAGRIVMELYKDAVPRTVENFRALCTGEKGVGKSGKPLHYKGSAFHRVIPDFMCQGGDFTRGNGTGGESIYGEKFADEKFVYKHTKPGILSMANAGPNTNGSQFFICTVPCNWLDGKHVVFGEVVEGMDVVKNIEKVGSRSGTTAKQVVIVDCGQL

SEQ ID NO: 78946 - protein, 61 aa, Oryza sativa Japonica Group
MVKVATYFAMTFGAFLFWQSMDRVHVWIALHQDEKKERMEREQEIKRMQAELMAQAKESES

SEQ ID NO: 78947 - protein, 469 aa, Synechococcus elongatus PCC 7942
MLVPVILSGGSGSRLWPLSRESYPKQFHALLSDYSLLQETLLRLEGLPGLASPLLICNEQHRFLVAEHLRAIGQTAAAIVLEPEGRNTAPAVAIAALQAQSQGEDPLLLVLPSDHSIADPAAFRATVQTAIALATAGHLVTFGIVPEAPETGYGYIKAGSDLDLGGFAIDRFIEKPNLATAENYVASGCYYWNSGMFLIRASVYLSELARYAPEMFTACEAAWQKRQADLDFVRLDPATFAQCPSDSIDYAVMEHTQQGAVLPLQAGWTDVGSWSSLWQALEQDGAGNVTVGDSLALDCRNVYLRSEGRLVVGVGLEDVVAVETDDALLIAHRDRTQTVKQVVEALQREARRESRAHRKIYRPWGRYDSLDLGDRFQVKRITVNPGASLSLQMHHHRAEHWIVVKGTALVTRDNEEVLLTENQSTYIPVGCKHRLSNPGRVPLEMIEVQSGSYLEEDDIVRFEDHYGRS

SEQ ID NO: 78948 - protein, 199 aa, Haemophilus parasuis
EEGDIIIDGGNSNYPDTNRRVKALAEKGIRFIGSGVSGGEEGARHGPSIMPGGNSEAWQYVKPIFQAISAKTDKGEPCCDWVGKEGAGHFVKMVHNGIEYGDMQLICEAYQFLKDGLGLSYDEMQAIFAEWKKTELDSYLIDITTDILGYKDTDGTPLVEKILDTAGQKGTGKWTGINALDFGIPLTLITESVFARCVS

SEQ ID NO: 78949 - protein, 499 aa, Shewanella sp. MR-7
MTTQVKHYIDGEFTTGTGTSQIVVTNPANNEPIALINSATADEVHAAIASAKAAFKTWKEVPVSERARVMLRYQHLLKEHHDELATILAKETGKTFEDAKGDVWRGIEVAEHACNIASLLMGETVENVARSIDTYSYTQPLGVCAGITPFNFPAMIPLWMFPLAIACGNTFILKPSEQDPMTPQRLVELFVEAGAPKGVLQLVHGDKTAVDILLADPAVKAISFVGSVAVGQYIYKTGTDNLKRVQAFAGAKNHCVIMPDANKQQVINNLVGASVGAAGQRCMAISVAVFVGAAKEWIPELKEALAKVRPGLWDDKEAGYGPLISPAAKARVLKLIAQGKEEGAECLLDGSDFSVAGFESGNWVGPTMFTKVTTDMSIYKEEIFGPVLCCMESDSLEDAIELVNASPYGNGTSIFTASGGAARKYQHEIEVGQVGINVPIPVPLPFFSFTGWKGSFYGDQHAYGKQAVRFYTETKTITSRWFESDIAVAAGPNMSINLR

SEQ ID NO: 78950 - protein, 294 aa, Zea mays
  misc_feature (175)..(175): Xaa can be any naturally occurring amino acid
MGKDDVVESGAGGGGEFAAKDYTDPPPAPLVDAAELGSWSLYRAVIAEFIATLLFLYVTVATVIGYKHQTDASASGAGADAACGGVGVLGIAWAFGGMIFVLVYCTAGISGGHINPAVTFGLFLARKVSLVRALLYMVAQCLGAVCGVGLVKAFQSAYFDRYGGGANSLASGYSXRGAGLGAEIVGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKALGSFRSNA

SEQ ID NO: 78951 - protein, 223 aa, Arabidopsis lyrata subsp. petraea
FDRVSIQQWIDSGNRTCPITKLPLSENPSLIPNHALRSLISNFAHVSPKESSRPRTQQEHSQSQSQALISTLVSRSSSNASKLESLSRLVRLTKRDSLIRRKVTESGAVRAALDCVDSCNQVLQEKSLSLLLNLSLEDDNKVGLVADGVIRRIVAVLRVGSPDCKAIAATLLTSLAVVEVNKATIGSYPDAISALVYLLRVGNDRERKESATALYALCSFPDN

SEQ ID NO: 78952 - protein, 393 aa, Rhodococcus sp. RHA1
MRAVTWQGKRKVSVDTVADPKIEHPTDAIIKVTTTNICGSDLHLYETLGPFMGEGDILGHEPMGIVEEVGTAAGNLKVGDRVVIPFQISCGDCFMCNLQLYTQCETTQVREQGMGAALFGFSKLYGEVPGGQAEYLRVPQAQFTHITVPEGPPDSRFVYLSDVLPTAWQSVEYAAIPEGGSVTVLGLGPIGDMAARVAHHKGARVIAVDNVPERLARAKARGIETLNLDEHGGDLADVIRDATDGRGTDSVIDAVGMEAHGSPIGKLAQQIVGYLPDAVAAPLMQKAGVDRLGALYSAIDIVRRGGTISIIGVYGGMADPIPMLTLFDKQIQLRMGQANIKKWVDDIMPLLGDDDPLGVDTFATHELPLEQAPHAYEIFQKKQDGAVKIQLKP

SEQ ID NO: 78953 - protein, 223 aa, Arabidopsis lyrata subsp. petraea
FDRVSIQQWIDSGNRTCPITKLPLSENPSLIPNHALRSLISNFAHVSPKESSRPRTQQEHSQSQSQALISTLVSRSSSNASKLESLSRLVRLTKRDSLIRRKVTESGAVRAALDCVDSGNQVLQEKSLSLLLNLSLEDDNKVGLVADGVIRRIVAVLRVGSPDCKAIAATLLTSLAVVEVNKATIGSYPDAISALVYLLRVGNDRERKESATALYALCSFMDN

SEQ ID NO: 78954 - protein, 444 aa, Pseudomonas aeruginosa UCBPP-PA14
MTMNNEPQSSSLDNFWMPFTANRQFKARPRLLESAEGIHYIAQGGRRILDGTAGLWCCNAGHGRREISEAVARQIATLDYAPPFQMGHPLPFELAARLAEIAPPGLNKVFFTNSGSESADTALKIALAYQRAIGQGTRTRLIGRELGYHGVGFGGLSVGGMVNNRKAFSANLLPGVDHLPHTLDVARNAFTVGLPEHGAEKAEELERLVTLHGAENIAAVIVEPMSGSAGVVLPPKGYLQRLREITRKHGILLIFDEVITGFGRVGEAFAAQRWGVVPDLLTCAKGLTNGSIPMGAVFVDEKIHAAFMQGPQGAIEFFHGYTYSGHPVACAAALATLDIYRRDDLFQRAVELEGYWQDALFSLRDLPNVVDIRAVGLVGGVQLAPHADGPGKRGYDVFERCFWEHDLMVRVTGDIIAMSPPLIIDKPHIDQIVERLAQAIRASV

SEQ ID NO: 78955 - protein, 493 aa, Rhodococcus sp. RHA1
MTVTDDTAVITRPQIGPRQLFIDGQWREAGAGERFEIVDPSTGKPVTTVAEADADDLDSAVRAARTAFDDGRWSGLPGRERARILLRVAALVRERADEIVAVESVDVGKPVSLCRPVDVMTTAEQYEYCAALAQTAGGSNRETPLDAHAYTRREPLGVLGAITPFNFPLILSTSKIAPALAAGNTVVHKPAEDTPLSALLMAEILTEAGVPAGVVNVVTGKGSTVGEALLQHKGIDKIAFTGSTVVGRHAASVAGENLTPVTMELGGNAAHIVFEDADVDKAIGAIIKGFVFNTGQFCMGGPRLLVARPHYETVLGILGQAVPGVPVGDPFDPATVVGPMAGDKHVRKVEEYVQIARSDGGRIVAGGERLDLGGGYYYKPTVIADLPNTSRVVQDEIFGPVLTVQPFDTEDEAIALANSTEYGLASGLQTSNVARAHRVAARLQAGIVWVNDWAMLDPAVPFGGVKNSGFGREYGPEALESYSKVKSVVISLA

SEQ ID NO: 78956 - protein, 154 aa, Sulfolobus solfataricus P2
MQEKSIRLGIVVAEFNYDITQLMLQKALSHARFLNVEVKVVIKVPGTFDMPLAIKKLLEKDFIDAVVTLGAVIKGETKHDELVASQTARKIVDLSTEFNKPVTLGIIGHGATHEQAVERIEEYATRAVEAAIKLVQRTRKLDELKEIKETVIIE

SEQ ID NO: 78957 - protein, 439 aa, Pyrococcus abyssi GE5
MKCPKCGREYKAEIPPFCICGEELEITYDYSSVDTRKWKNRRPGVWRYKELLPKVKKIVSLQEGGTPLIKARISEQLNVDVFIKDETRNPTGSFRDRLATVAISYGLPYAKNGFIVASDGNAAASVAAYSARAEKECFVVIPRKVDKGKLIQMIAFGARIIRYGESVDDAIEYAKELAKLNGLYNVTPEENIVGLEGQKTIAFELWEEINPTHVIVPTGSGSYLYSIYKGFKELIEIGALEEMPKLIAVQTDRCNPIASEILGIKGECKETKALGLYVREPLMKPKVIRAIRESSGTAVLVSEEEIEKGERLLANEGIFAELSSAVVMPALIKLVNDGFIEKGDRVVLVVTGSGLKTGEGGREKFGIGGTKLEILKILKDGEKYAYEIWQALGKPVKYQAIHQHIKELQELGLIEEAYRRGKRIYYKLTEKGIRLVDNL

SEQ ID NO: 78958 - protein, 367 aa, Rhodococcus sp. RHA1
MPTSTTAAVVETGGAKFTVSTVDLDEPRSDEILVRLVAAGLCHTDLGVASGALPFPLPGVLGHEGAGIVEKVGAGVTTVDVGDHVLLSFSSCGSCGNCRDGHPAYCATWLPLNLIGGGRADGTSPVSRGGEAIGGHFFGQSSFAHHAVVDARSAVKVDPDDPLDILAPLGCGVQTGVGAVWNVLKPRPGQTVLVTGAGAVGLSAVMAAALTPASKVIVVDRVPARLDLARELGATQVINAAEVDTAEELAKILPDGVDGAVETTGNVGVLRTAIDALAPRGTAVIVGAPAFGTEVPVDVNAMIPGRTLVGLTLGDSETQTLIPVLVDLVKSGRLPIDRLITHYGFDDINTAVADMTSGASIKPVLRF

SEQ ID NO: 78959 - protein, 336 aa, Mycobacterium bovis AF2122/97
MKLAIIAGDGIGPEVTAEAVKVLDAVVPGVQKTSYDLGARRFHATGEVLPDSVVAELRNHDAILLGAIGDPSVPSGVLERGLLLRLRFELDHHINLRPARLYPGVASPLSGNPGIDFVVVREGTEGPYTGNGGAIRVGTPNEVATEVSVNTAFGVRRVVADAFERARRRRKHLTLVHKTNVLTLAGGLWLRTVDEVGECYPDVEVAYQHVDAATIHMITDPGRFDVIVTDNLFGDIITDLAAAVCGGIGLAASGNIDATRANPSMFEPVHGSAPDIAGQGIADPTAAIMSVALLLSHLGEHDAAARVDRAVEAHLATRGSERLATSDVGERIAAAL

SEQ ID NO: 78960 - protein, 219 aa, Sulfolobus solfataricus P2
MDFLSLRKDLESGIPILIYDFDGREEETDMVFYAGAISWKSIYTLRKEAGGLICYATAINEAKTLGLNFIAEELKQHETYSKLVKKPSYGDYPAFSVWVNHVNTKTGISDYDRYITISELHKIILKTKTNPEEARREFYENFMTPGHVPILIARDIRERRGHTELSITLLQKLGLERSAVIAEILDEKSSMNKDKAKMIAKNFGLHFIEGKDIFKEVII

SEQ ID NO: 78961 - protein, 223 aa, Arabidopsis lyrata subsp. petraea
FDRVSIQQWIDSGNRTCPITKLPLSENPSLIPNHALRSLISNFAHVSPKESSRPRTQQEHSHSQSQALISTLVSRSSSNASKLESLSRLVRLTKRDSLIRRKVTESGAVRAALDCVDSGNQVLQEKSLSLLLNLSLEDDNKVGLVADGVIRRIVAVLRVGSPNCKAIAATLLTSLAVVEVNKATIGSYPDAISALVYLLRVGNDRERKESATALYALCSFPDN

SEQ ID NO: 78962 - protein, 387 aa, Pseudoalteromonas tunicata D2
MSKGVKVFQSKLPSLGTSIFTQMSMLANQYQAINLSQGFPEFDTPDFLKQQITHAISVGLNQYSPSNGIAPLQQQIAGLIARRYGHALEPSAAITVTSGATEALFVAIHTLVRPGDEVIIFDPAYDSYQPAIELAGGLCQRIALTAPNYAIDWQYVTSKMHSNVRAIIINSPHNPTGKVLKEHDLQALKALLAQYPNCYLISDEVYEHMTFDGHQHLSILSVPELFKRAFVISSFGKTFHCTGWKIGYCVAPEQLTAEFRKIHQYVTFSSFTPAQHGLAAMLQHYPEHVDQLADFYQQKRDLLVSHLASSRFKVLPSEGTYFVLLDYSAISDLNDVDFCHWLTAEVGVAAIPLSVFYQDAPADKVVRLCFAKNDATLIAAAEKLCRL

SEQ ID NO: 78963 - protein, 426 aa, Methanococcus maripaludis
MDDSFDIYEIKARQVLDSRGNPTVEAEVLTAGGGYGHTIVPSGASTGTFEAVELRDKKEKYGGKSVLNAVSNVNDIIAQELIGEDARNQRLIDQIMLNLDGTENKGNLGANAILAVSLAVAKAAADTASLPLYKYIGGSNAYVMPAPMMNVLNGGQHAGNALDFQEFMIMPVGADSFAEAVRMCSETYQSLKKVVAEKYGKDAVNVGDEGGFAPPVKTIDEALAVLLEGVKKAGYEDEIVFTIDSAASEFYDEKSGSYMIAGEKVSTDKLIDIYKEMVEQYPIVSIEDPLFEEDFEGFKTATKELKGIQIVGDDLFVTNTKRLKKGIEMGAANSLLLKVNQIGTLSESIDAANMAFRNGYSLVVSHRSGESEDSTIADLAVALNAGQIKTGAPARGERTAKYNQLMRIEEELQISKYAGKDFKIPF

SEQ ID NO: 78964 - protein, 458 aa, Bacillus megaterium
TIKEMPQPKTFGELKNLPLLNTDKPVQALMKIADELGEIFKFEAPGRVTRYLSSQRLIKEACDESRFDKNLSQALKFVRDFFGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGI

SEQ ID NO: 78965 - protein, 402 aa, Rhodococcus sp. RHA1
MSTFVPAARVDQMRESPSVAAAQRVRELRASGREILDLTVGEPDFDTPDHIKAAAVAAMESGLTKYTPVNGIPALRDAISKRMLDRTGVEFTDNEITVGGGAKQVIFLALMATVEEGTEVIVPAPYWVSYPDMVTVHGGTPVVVDCQESDRFLLTADTLAAAITPSTKWVILNAPSNPTGAVYSERELAELAAVLDRNPHVNVLCDEIYDEIVFTDSPVPNLLSAAPHLRDRILVTNGVSKAYAMTGWRLGYGVGNKGLIAAINKLQSQSSSCPSSISQAAAAEALTGDQSFVATSVASYRARRDLIFELSSRIEGLEPVLPQGAFYLFVGCAGLVGKRTPDGTLLENDQDVVLFLLDHASVATIQGSAYGAESYFRVSFATSEDVLRNAAAAVEKAVASLS

SEQ ID NO: 78966 - protein, 396 aa, Micrococcus luteus
  misc_feature (112)..(112): Xaa can be any naturally occurring amino acid
  misc_feature (142)..(142): Xaa can be any naturally occurring amino acid
  misc_feature (161)..(161): Xaa can be any naturally occurring amino acid
  misc_feature (173)..(173): Xaa can be any naturally occurring amino acid
  misc_feature (207)..(207): Xaa can be any naturally occurring amino acid
  misc_feature (237)..(237): Xaa can be any naturally occurring amino acid
  misc_feature (242)..(242): Xaa can be any naturally occurring amino acid
  misc_feature (307)..(307): Xaa can be any naturally occurring amino acid
MRHPIPDYLASLVTELGAVNPGETAQYIPVLAEADPDRFGIALATPTGRLHCAGDADVEFTIQSASKPFTYAAALVDRGFAAVDRQVGLNPSGEAFNELSLEAESHRPDNAXINAGALAVHQLLVGPEASRKERLDRAVEIXSLLAGRRLSVDWETYESEXAVSDRNLSLAHXLRSYGVLQDSAEEIVAGYVAQCAVLVTVKDLAVXGACLATGGIHPMTGERMLPSIVARRVVSVXTSSGXYDAAGQWLADVGIPAKSGVAGGVLGALPGRVGIGVFSPRLDEVGNSARGVLACRRLSEDFRLHLXDGDSLGGTAVRFVEREGDRVFLHLQGVIRFGGAEAVLDALTDLRTGAEKPGTGWDAAVYPRWQEAAADRAALSAATGGGAVHEAAAAAA

SEQ ID NO: 78967 - protein, 539 aa, Leptospira interrogans serovar Copenhageni str. Fiocruz L1-130
MNRKSEISIRRGHPWIFGGNLSSATSHFVNGQWLNLVSTTNVPLATGIYSTTGLIRIRVIQFLPSFSKEKMRENLIYALKKRNELRKITNAYRILHGENDFFPGITIDRLNTTWVVRIYSSSLLVYGRWLVWNLFDICKNSKLGEPQPKRILFDPPEKTGEDKIGFKKKDPADHSQTFTPSKLDKSNFNQNLTSKKSNFKKISSSETLEKKILDNFNLENDLSTFSQNTNLSDNDSKEILKYPKQNSNLSNSDLFKTSQENIFYNSILKKQNLESTINLIHERLWRGNRQSTRNRSNFTKEKTKHSIQKEIYHSDKYKIRETIRLYEVNFPIELPGQKGGIFLDLRNLRRFLLEKKELSKNKNCLHLFSHTGLTSICMEIAGASSVISVDGSKEALDSFQRVLSLNKNKGNCKHRFLRKNIFKELEEILQNKSFGLIVIDPPNLTPDEKSKSNALKSYSYLFANSLSSLEESGTIILCSCSGRIKTQELESLAKNILQSKGWKFERFTSLKPEVDHPIRKNFPEGNYFKVHIYENCKKN

SEQ ID NO: 78968 - protein, 384 aa, Arabidopsis thaliana
  misc_feature (269)..(269): Xaa can be any naturally occurring amino acid
MTLPELPKDLVEEILSFVPATSLKRLRSTCKGWNRLFKDDKRFTRIHTEKAAKQFQPLTLTKNYRICPINVNLHGTTPSLEVKNEVSLLDPHSKNSAAQFNIDRVFHCDGLLLCTSQKDSRFVVWNPLTGVTKWIELGDRYNEGMAFILGYDNKSCNKSYKAMSFNYLDKDSEIYEFSSDSWRVIDDIIKPPHYMDYFRECFSLKGNTYWLGIDRRRRPPDLRITLIKFDFGTEKFGYVSLPPPCQVHGFEASNLSVVGDEKLSVLVQXGSTSKTEVWVTSKIGEANVVSWSKVLSLYPKPDVGFWHGLSFLLDEEKKVVLCCKSKGWMEEEDEENVYSVGEDTKFILLNFGVQTIGGYSPIIVNYVPSLGQIELAGSKRKRDY

SEQ ID NO: 78969 - protein, 215 aa, Xanthomonas campestris pv. campestris str. ATCC 33913
MSEAKRLAAEKAIDYVEDGMIVGVGTGSTVAYFIDALGRIGHRIKGAVSSSEQSTARLRQHGIEVLDLNHTGTLSLYVDGADECDPNRCLIKGGGAALTREKIIAEASERFICIVDPSKQVPVLGNFPLPVEVIPMARSLVARQILALTGGQPVWRDGVVTDNGNVVLDVHNLHITDPVALERNLNQIPGVVCVGLFARRPADVVIVGGETPRVL

SEQ ID NO: 78970 - protein, 274 aa, Zea mays
  misc_feature (236)..(236): Xaa can be any naturally occurring amino acid
  misc_feature (255)..(255): Xaa can be any naturally occurring amino acid
MALRRLLQGSVLPRVTGRVSAPAVAPFSTESGETIRATLFPGDGIGPEIAESVKQVFNVAGVPIEWEEHYVGTEVDPRTESFLTWESLESVRRNKVGLKGPMATPIGKGHRSLNLTLRKELGLYANVRPCNSLPGYKTRYDDVNLVTIRENTEGEYSGLEHQVVRGVVESLKIITRQASLRVAEYAFHYAKANGRERVSAIHKANIMRKTDGLFLKCCREVAETYPEIQYEEVIIXNCCMTLVKNPGLFDVLVMXPNLYGDIISDLCAGLIGGL

SEQ ID NO: 78971 - protein, 182 aa, Streptomyces coelicolor
MTEPTGITELLLSRIRDVADYPEPGVVFKDITPLLADPGAFAALTDALAEAAGRTGATKVVGLEARGFILGAPVALRAGLGFIPVRKAGKLPGATLSQAYDLEYGSAEIEVHAEDLTAGDRVLVVDDVLATGGTAEASLELIRRAGAEVAGLAVLMELGFLGGRARLEPALAGAPLEALLTV

SEQ ID NO: 78972 - protein, 341 aa, Glycine max
IISNLTLLVLKVLQLLSGAVCCENRDSEKGTPVDPSCSHNLVSEDGCSVAKECSEEYDGSDDDYASIQRPAFMVDGELNFDSGPPEDGWEYLRRVRWEAHQIPKVKVAKLDRGKLNKEQSAYMPQIPDIANCPEYLLPLKEWEDVFLAEFSALRRNFSCLDGSSAIHSENLHVHSSQLVGNNCGEFSSAMSRDVLLNNHLRIGKTNDQPSNSTAENNDRTLSPENPEAKSSADQTCSSSSPTLPLLSVILAMDSVARVSSLLKRIRLLEAAGTMTRNDCMWLFALCATVDAPLDADTCASLRSLLRKCASIRAGKAGLDEEVVMLNILATISGRYFGQSEN

SEQ ID NO: 78973 - protein, 171 aa, Dasypyrum villosum
MANPRVFFDMTVGGAPAGRIVMELYKDAVPRTVENFRALCAGEKGVGKSGKPLHYKGSAFHRVIPDFMCQGGDFTRGNGTGGESIYGEKFADEKFVQKHTKPGILSMANAGPNTNGSQFFICTVPCNWLDGKHVVFGEVVEGMDVVKNIEKVGSRSGTTAKQVVIADCGQL

SEQ ID NO: 78974 - protein, 171 aa, Dasypyrum villosum
MANPRVFFDMTVGGAPAGRIVMELYKDAVPRTVENFRALCTGEKGVGKSGKPLHYKGSAFHRVIPDFMCQGGDFTRGNGTGGESIYGEKFADEKFVHKHTKPGILSMANAGPNTNGSQFFICTVPCNWLDGKHVVFGEVVEGMDVVKNIEKVGSRSGTTAKQVVIADCGQL

SEQ ID NO: 78975 - protein, 320 aa, Leptospira interrogans serovar Copenhageni str. Fiocruz L1-130
MSKGSFFTFCRLMYYNHKNVLDTEQFSKPDLDFLIGKIRVMERLVEQNKAFGILTGKLLASLFFEASTRTRLSFEAAMERLGGRVISTVGFQFSSISKGETLYDTMKMVEAYADIAVIRHPVEGSSRIAAGAVKIPVINAGDGAGQHPTQAILDLYTIISEKGTLDGLKVAFIGDLKYGRTIHSLINLLRHYKVRLFLISPPELALPESYKKALQGYSLTLEETTDIKAVWDCDVAYVTRIQEERFPDHKEYERLKDLFKINKELILASKKETTVLHPLPRVNELSTDVDDLPNAAYFRQARYGVVSRMTLLCLSLGQDF

SEQ ID NO: 78976 - protein, 240 aa, Deinococcus radiodurans R1
MPRDFRPCPACPDGHADRAQDGPDDGPDGCATFGSKITAGVVGVFALSPPAPAPAPEAHMPLHTLEDLTPDIHPTAFVAPSADVIGQVKVEAGASIWFGAVLRGDTEQLRVGERSNVQDGAVLHADPGFPCTLHEDVTVGHRAVVHGATCEAGSLVGMGAIMLNGSRLGRGAVLGAGALLPEGKEVPDGMLAVGTPARVVRPVAATPNAASYVRNGERYRAGLRSQADPASPTGPAGDPT

SEQ ID NO: 78977 - protein, 566 aa, unidentified eubacterium SCB49
MKKVLFLIFILVIGCKNDNPISKIKKPQLGVITDSAMVVSARQEASKIGVYIMKEKGGNAFDAMIATEFALAVVYPYAGNLGGGGFMVFRTEYGEIGALDYREKAPMAASRDMYQDKNGNYISDKSKKGALAVGVPGTVAGMFAVHEKYGSLPMEEIIEPVIKLASDGFLLTKDQAGRFNKYAPIFEEITGTKSIYSKQWKENDRFVNKALAETFTRISSNGRSEFYEGETADLLIKFLASRNGIITKKDLLNYEAVWREPVTFDYKDLKIISMAPPSSGGICLAQILNAVEAYPIADYGHNNTKSMQVIIEASKRAYADRSEFLGDPDFVHIPTDSLISPFYLKGRMDNFSFDKATPSVAIAAGKPLGQESTETTHYSIVDSFGNAIAATTTLNAAFGSKLYSNELGFFFNNEMDDFSAKPGEPNMFGLIGGEANAIEAQKRMLSSMTPTIVEKEGEFWMSVGTPGGSTIITSVMQTILNVYEYNMTMQDAVNAPRFHHQWLPDEVMVEPRGFNKKVLDSLSQKGYIINQKDAPVIGKVDAILRLPNGKLEGGADYRGDDTAAGF

SEQ ID NO: 78978 - protein, 183 aa, Vitis vinifera
MEGLDFNRIDGEDAACLEGVFTEAEVFFALSDLNGDKAPGPDGFSLSFWQFSWDFVKDELTWARNKACRCHEQNNWLGQPRTCWSSATNYERQVQGLDNLEETVISTKHIALAVNEELDLHTRLIDTLDQHVDTTDSRLGRVQKNLAILNKRTKGGCTCFCMLLLVIGIVILIVVILVLIKYL

SEQ ID NO: 78979 - protein, 523 aa, Zea mays
MGMVVNSSAVPFSIALLAVVIAAVVITKAALGRRRRRRTAAANNPAPPPRNDVDTGRRRPPAAITGVTSAVRLVHALATKGFEATLYEQYAKLGSVFTVSLFGMKTTTFLAGPDVSAHFYQGPDSEISHGDLLEFTVPMFGEGVAFAVDAATRAEQHRFYLDALKPARLRCHVAPMLQEVEEFFARWGQQGTVDLKQELEQVLMLITARCLLGKEVRERMLHEVFSAYRDLTENSLHLTSLLFPYAPTPAARRRDRARATLSGIFSEIVRSRRRSGRRAGDDDGDVLQSLVDARYRDGRGTTEAEVTGLVIAILFAGKHTSSATSTWTGARLLRHAECLDAAVDEQRRVVAERGSGVDYDALAEMGFLHCCIKEALRMHPTAPLFLRRAHRGFTVRTREGAEYDVPSGQTVASPLLINHYIPYVYRDPHVYDPRRFGPGREEDRVGGRFCYNAFSGGRHACPGEAYAYMQVKVIWSHLLRNFELKLVSPFPRTDWMKLSPEARGKVVVSYKRRMVPVGSVLEN

SEQ ID NO: 78980 - protein, 435 aa, Burkholderia vietnamiensis G4
MIPVPSKTAGGFALNGRSAQPSDGAARAALEGRRTGVAALLPFVGPAVIASIGYMDPGNFATNIQAGAAYGYRLLWVVLAANAIAMLFQAMSAKLGIVTGRNLAELCRERFPAPVVWGMWIASEIAAMATDLAEFLGGALAFGLLCHLSLFAGMIATAFATCAILALEKRGFRPLEAAIATLVGVIGACYLGELLIAPQDWQAAAFHLVVPQIPDHAALTIAVGIIGATIMPHTLYLHSGLTQDRAAPRNDAERRRLVRFSNREVVIALGLAGFVNLAMVMMASSAFHATAPGMTDIGDAYHTLIPVLGPAAGALFLVALLTSGVSSSVVGTMAGQVVMQGFIRRRMSIWLRRAVTIAPAFLVVALGCDVTRAMVVSQVVLSFVLPMPMIALLMLSARTDVMGAYAMRMPLRIVAGAATVVIVGLNAYLVGAAFN

SEQ ID NO: 78981 - protein, 464 aa, Pseudomonas putida GB-1
MHTTTSTAHSPAHSPTPHAPTQPDASTGRLRKSMGMTALVLFGLAYMVPLAVFTTYGLVTQMTKGHLPTAYLLTLAAMLLTAYSYGRMVQAHPYSGSVYTYTRKAFGSHIGFITGWTLLLDYIFLPLLSYLLIGIYMSEYFPAIHAWVWVAGSIALVTFLNLIGIESITRVNWILVVVQLVFIIVFVALSVLKLSGQAEPVSLLAPFHHEGFSVPLIMTGAAVLCLSFLGFDAVSTMAEETSNPTYRIPVAILAVSLIGGLLFLVVSYCAQMVFPDWGSFADPDSASVDVMRRVGGELLVTAFTATYVAGCFASAMVSQASVSRVLFAMGRDGALPRAFGQLATKKRVPATAILVVSLVSMIALVITLDTVANMISFGALFAFSAVNLAVVKHYLVDQKLRGGRNYLLYGAIPGLGFLSTLWLWSSLTSLSFTIGLCWLGMGLVVLMGLTRAFRVKLPELQMAE

SEQ ID NO: 78982 - protein, 366 aa, Oryza sativa
  misc_feature (317)..(317): Xaa can be any naturally occurring amino acid
MAPSSLACSRKNKTKTNKLWFHHSALQVDPDEVNALAQLMTWKTAVAAIPYGGAKGGIGCAPGELSTSELERLTRVFTQKIHDLIGAHTDVPAPDMGTNSQTMAWILDEYSKFHGHSPAVVTGKPIVSLGGSLGRDAATGRGVMYATEALLAEHGKSISGSTFVIQGFGNVGSWAARIIHEKGGKVIALGDVTGSIRNKNGLDIPALMKHRNEGGALKDFHDAEVMDSSELLVHECDVLIPCALGGVLNRENAPDVKAKFIIEAANHPTDPEADEILAKKGVTILPDIYANSGGVIVSYFEWVQNIQGFMWDEEKVXNMELHKYMNNSFQHIKAMCKSHDCNLRMGAFTLGVNRVARATLLRGWEA

SEQ ID NO: 78983 - protein, 168 aa, Synechococcus elongatus PCC 7942
MARSLLRAFPIQQLLQQPQQTRSWELAEPVEGFESLTPVQGELTVRHGHSFLEVTATAETIVNLTCDRCLCCYNHRLQVNTRELIWLRGETPELMEWEPEDELEESLPPDGSFDPQQWLYEQLCLALPLRNVCAEDCPGPAQPESESPPSVVDDRWLALAKLRDRLGE

SEQ ID NO: 78984 - protein, 359 aa, Kluyveromyces lactis NRRL Y-1140
MKQCTRLFSQLDVKSLVMNTKVTSKEQIVNHDRQNTEIRKNRHAKRRDPDKVKTIINDLYQKLNKEYAPLKASDLSQVNFFFNKAKVKFEWSAPTFNDVPGEKVRRLMEKRQQAIQTIMDEENEFIASTTFKKGSMTLPVASEDVPQINSNKMYQGKTGGIPFELINQLPEIAFLGRCNSGKSTLLNSVTTEVTRNSLNEYANASKKAGFTKTINCFNVGGKFRIIDTPGYGTKGTVEQGKVTMDYLHKRRELRRSFLLISANNGFSEYDAQMIDLLVNDGIPFEIVFTKMDTIKDMAQVESIIEESNVLRLPTSPRFIFLNSMTNKRCQKRFGLDVLRYVVLEACGLLPGVRPSKIKK

SEQ ID NO: 78985 - protein, 223 aa, Arabidopsis lyrata subsp. petraea
FDRVSIQQWIDSGNRTCPITNLPLSENPSLIPNHALRSLISNFAHVSPKESSRPRTQQEHSQSQSQALISTLISRSSSNASKLESLSRLVRLTKRDSLIRRKVTESGAVRAALDCVDSGNQVLQEKSLSLLLNLSLEDDNKVGLVADGVIRRIVAVLRVGSPDCKAIAATLLTSLAVVEVNKATIGSYPDAISALVSLLRVGNDRERKESATALYALCSFPDN

SEQ ID NO: 78986 - protein, 162 aa, Lentisphaera araneosa HTCC2155
MLRVGTGFDVHQLVSGRDLIMGGVKVPHNKGLLGHSDADVLLHAITDAVLGALALGDIGQWFPDTKEEFKGANSVKLLQHVLDSKYLKDWHLVNLDCTIIAQEPKLAAYLPSMRQVIAKLFNVTINEVSIKATTFEKMGSLGRSEGIAAQANLMLQNTTLEK

SEQ ID NO: 78987 - protein, 157 aa, Coccidioides posadasii
FMHWPAAFAPGDDMFPKDSQGNSKTVDIDYVDTYKAMEKLVKSGKTKAIGISNFSKGEMERLLESCSIVPAVMQMELHPWLQQNDFVEWLKSKGIHVTQYSSLGNQNEVYSGRERYGRLIEDPALAAIGTKYGKTGAQVALAWGINKGHSVFVKSKT

SEQ ID NO: 78988 - protein, 337 aa, Shewanella sp. MR-7
MTILVTGGAGYIGTHTVVELLNAGSEVIVLDNLSNSSIEALNRVERITGKSVTFFQGDILNKALLQKVFSDHNIDAVIHFAGLKAVGESVAKPLKYYENNVTGTLILCQVMAEFKVKNLVFSSSATVYGDPASLPITEDFPTGATNPYGQSKLMVEHILADLHHSDPSWNIARLRYFNPVGAHASGLIGEDPNDIPNNLMPFIAQVAVGKREALSVFGNDYPTHDGTGVRDYIHVVDLALGHLKALEKLATKPGLVTYNLGTGQGYSVLDMVKAFEKACGKSIAYQIAPRRPGDIAACYANPDHAKTDLGWQATHSLEDMANSSWHWQSTNPNGYKG

SEQ ID NO: 78989 - protein, 496 aa, Aciculosporium take
MSLTVELKTPVTGTYKQPIGLFINNKWVEGVEKKKFDVINPATEEVITSVCEATEKDVDIAVAAARKAFETTWKQVAPQERCRMMIKLADLVDQNLELLAAVESLDNGKSITMARGDVGAVSGCVRYYAGWADKIEGKTIDIAPDMFHYTRPEPLGVCGQIIPWNFPLLMLAWKIGPALATGNTVIMKSAEQTPLSALVFANLVKEAGFPPGVYNLLSGFGNVAGVAISSHMDIDKVAFTGSTIVGRTIMKAAASSNLKKVTLELGGKSPNIVFKDADIEQAISWVNFGIYFNHGQCCCAGSRIFVQEEIYDEFLAAFKKRAQQNKVGDPFDEDTFQGPQVSQLQYDRIMSYIKSGKEEGATVEIGGERHGKKGYFIQPTIFSNVRPEMKIMQEEIFGPVCAISKFKDEEEAIRLSNQSNYGLAAAIHTEDLNTSIRVSNALKAGTVWVNCYNMLSHQLPFGGFKESGIGRELGEAALANYVQNKSVAVRLGEHVF

SEQ ID NO: 78990 - protein, 223 aa, Arabidopsis lyrata subsp. petraea
FDRVSIQQWIDSGNRTCPITKLPLSENPSLIPNHALRSLISNFAHVSPKESSRPRTQQEHSQSQSQALISTLVSRSPSNASKLESLSRLVRLTKRDSLIRRKVTESGAVRAALDCVDSGNQVLQEKSLSLLLNLSLEDDNKVGLVADGVIRRIVAVLRVGSPDCKAIAATLLTSLAVVEVNKATIGSYPDAISALVYLLRVGNDRERKESATALYALCSFPDN

SEQ ID NO: 78991 - protein, 223 aa, Arabidopsis lyrata subsp. petraea
FDRVSIQQWIDSGNRTCPITKLPLSENPSLIPNHALRSLISNFAHVSPKESSRPRTQQEHSQSQSQALISTLVSRSSSNASKLESLSRLVRLTKRDSLIRRKVTESGAVRAALDCVDSGNQVLQEKSLSLLLNLSLEDDNKVGLVADGVIRRIVAVLRVGSPDCKAIAATLLTSLAVVEVNKATIGSYPDAISALVYLLRVGNDRERKESATALYALCSFPDN

SEQ ID NO: 78992 - protein, 341 aa, Aegilops tauschii
MERYEVIKDIGSGNFGVAKLVRDVRTKELFAVKFIERGHKIDENVQREIMNHRSLRHPNIVRFKEVVLTPTHLAIVMEYAAGGELFERICGSGKFNENEARFFFQQLLSGVSYCHSMQICHRDLKLENTLLDGSEAPRLKICDFGYSKSSVLHSQPKSTVGTPAYIAPEVLSRREYDGKVADVWSCGITLYVMLVGAYPFEDPDEPKNFRKTITRILSVQYSVPDYVRISMECRHLLSRIFVANPEQRITIQEIKNHPWFLKNLPIEMTDEYQMSLHMVGVNAPPQTLEEIMAIIQEARIPGDGSKFAGQLSVPGLGSMELDDIDDVDVDVEDSGDFVCAL

SEQ ID NO: 78993 - protein, 257 aa, Rhodococcus sp. RHA1
MSSHGNFDVAGKIALVTGSSRGIGFALANGLAEAGAEVVLNGRDADALARSRDEIVRATGATVHTCAFDVTAPGEVAAAAQRVEDEIGPVEIVVNNTGVQHRSPLLEFGDDDFRRVLDTNLSSAFFVGREFARAMVRRGQGKIVNICSVQSELGRAGIAPYAASKGGLKMLTRGMCADWAPLGLQTNAIAPGYFDTQLTEALVNDADFSAWLTKRTPAGRWGRTEELVGALLFLSSPASDFVNGQILYVDGGLTAVV

SEQ ID NO: 78994 - protein, 285 aa, Spinacia oleracea
MEGKEEDVRLGANKYSERQPLGTSAQSKDYKEAPPAPLFEPGELQSWSFWRAGIAEFMATFLFLYITILTVMGVKRAPNMCASVGIQGIAWAFGGMIFALVYCTAGISGGHINPAVTFGLLLARKLSLTRAMFYMIMQCLGAICGAGVVKGFQPNIYEMQGGGANVVNHGYTRGDGLGAEIIGTFVLVYTVFSATDAKRSARDSHVPILAPLPIGFAVFLVHLATIPITGTGINPARSLGAAIIFNKDHAWDHHWIFWVGPFIGAALAALYHQTVIRAIPFKSRS

SEQ ID NO: 78995 - protein, 416 aa, Candidatus Kuenenia stuttgartiensis
MTVDIIMPQMGESVAEGTILKWLVNEGDYVEKEQPLVEISTDKIDTEIPSPSAGIIKKILYKEGAVLAVQTVIAQIEEGEIKAQAGTVKKEQEEKERIEISETAAIAGEREMHEKRYSPLVKKLAKEYNVSLTEIKGSGEFGRVTKKDIMEYISSKREITASKEKIVKEAERETLIPLHPKRKITAERMALSRQTAALVTTVFEVDMTPVTKYRELNREAMKREGIHLTYLPFIAFAVVQALKEHVALNSSWTDNGILQKNYINLGIAVALEDGLVVPVIKDADKKDMFQLAREIQEIAVNARSKKLKPDDVRGGTFTITNYGVNGSLFGTPLILQPQSAILGVGAVVKRPVILGDADAIAVRSMVYLSLSFDHRVMDGAHADAFLHKVKDILETWGESLYEQKKPNPPGGYGGVW

SEQ ID NO: 78996 - protein, 408 aa, Leptospira interrogans serovar Copenhageni str. Fiocruz L1-130
MANINENYLKLKAGYLFPEISKRVKIYSEKNPSAKIIRLGIGDVTLPIVPSVVDAMVEASKEMGTVGGFHGYGPEQGYSFLLKSIADHDYGSLGIKIDESEIFVSDGSKCDCGNIQEIFSTDSKIAVADPVYPVYVDTNVMAGRTGEIGPDGRYSNLIYMPATKENGFQPEIPKEKADIVYLCYPNNPTGTVTTKESLKAWVEYAKKNNSIILYDSAYEAFISEPGVPRSIYEVEGAKEVAIEFRSFSKTAGFTGLRCAYIVIPKELKGRTRSGEEVSLNSLWNRRHTTKFNGVSYVTQKGAEACYSPQGKKEIQTSIAYYMANASKIRDGLKKAGYEVFGGVNAPYIWLKTSDNLSSWDFFDKLLNKAQVVGTPGSGFGPAGEGYFRLSAFGKKEDVEEAIARITSL

SEQ ID NO: 78997 - protein, 468 aa, Burkholderia thailandensis E264
MSTLETAIAGSPAAAAAAGAATPGAIIARLERLPANAMQIRARVLIGTATFFDGFDVITIAATLPLLIHKWGLSPNQVGMLIASGAIGQLLGAFLFPALAEKHGRVRAIAWSSAVIGVTSIACGFASTFEAFVLLRIVQGLGLGGELPVAATYINEITRAHGRGRFVLLYEIVFPIGLLASMALGAWLVPRFGWEVMYFIGGMPLLLALVLVRLVPESPRWLASRGRLDDAGRALHVFESSVKGPLPPVAHASEFDALVRSHPKRRMIDLFGPAYLKRTLAVATLWATCGFIQYGLSTWLPTIYKDFYHAPLQLALNLAVIGSVMGVVGSLVSALAVDAVGRKPVIVWSFVLCALSLVFAGIYHASSVYVVATFCSFALGLMASGFITSYVYTPEQYPTSIRAAGCGLGSAWLKLASFVAPMVVPHAIVGGDLSPAFYLLAAVPLIAALTVHFVGIETKGQVLEKLEA

SEQ ID NO: 78998 - protein, 302 aa, Burkholderia thailandensis E264
MRNFSGKVAAITGAGSGMGRSLAVELARRGCHLALSDVNEGSLAQTVAICAAHGVKITSQRLDVASRDAVFDWARKTRDAHGKVNLVFNNAGVSLAAPAETARIEDFEWIMGINFWGVVHGTQAFLPYLRESGDGHVINTSSLFGLVAMPTQSAYNATKFAVRGFTEALRMELELEGAPVGVTCVHPGGVATNIATASRIDSSIATLTGQDVETHRRAANRLINATTPEAAARQIIASVERNARRVLVGADARRIDKLARLFGSAYQVFVLRFVRRSRERNFARQQAAARTAPPSSISKDPA

SEQ ID NO: 78999 - protein, 889 aa, Vitis vinifera
MASDVEGEKLWEEVLRKMLPVGAPLPDEEHLDYSIAVEYEGPPVPYRVPIVDPLDVDSLSIRSSSMVSVSASDLQSIPVAAPILPVVKVTNYSRFNRVRNGASLRELRSPVESGRSSSSVWRGQLGSRNSEVEDSDCGNGRGELFSSASSVQDPNSVSTSTLASLKPVAEGRRSTMVTFNVARESEIDEDEFSSPRSSVPDATDSPIMLRNQEKGTRKRGVCSRCGKRNRLKEREACIVCDARYCKNCLLKAMGSMPEGRKCVSCLGQPINESKRSSLGKYSRMLSKACSPLEVGQIMKAEKECLANQLRPEQLIVNGRQLRQEELAEVLGCSIPPQKLKPGRYWYDKDSGLWGKEGEKPDRIISSKLNIGGKLQLDASNGSTKVFINGREITKIELRVLKMANVQCPRDTHFWLYDDGSYEEEGQNNIKGNIWGKASTRFICSLFSLPVPPGIFQGPKEDPTAFSSRSVPEYLEQGRVQKLLLFGLEGSGTSTLFKQAKYLYGNKFTPQELQSIKLMIQSNMYKYLSLLLEGRERFEEEALMERKNNVSDAEGSDPGETGVDQSKPCIYSINQKFKHFSDWLLGIMAMGDLDAIFPAATREYAPLVDELWKDPAIQETYKRREELLFLPDVAKYFLDRAIEISSNEYEPSQKDILYAEGVTQSNGLAFMEFSFDDRSPMSETYNENLECPPPSSKYQLIRINSKGLHDGCKWLDMFEDVRAVIFCVALSDYDHMYTDSAGSLYNKMLASRDLFESLVRHPCFIDTRFVLLLNKYDAFEEKINRSPLAVCEWFWEFSPVRPHHNNQSLAHQAYYYVAMKFKDLYHSISSRKLFVWKTRAREPSSVDEAFKFIREVLKWEEDKDDNTYDITGDESFYSTEPSSSPYIRQE

SEQ ID NO: 79000 - protein, 871 aa, Neurospora crassa
MYSACAVALRGGARRVVRRVPKSARALPRAAAARRQISTTAARSTDLTTRGMIVQTLSSVGSKREVQQYLSLFTSVSSQRFAVIKVGGAILTDYLDELCAALKFLYTVGLYPVIVHGAGPQLNRLLEDAGVEPQFEEGIRVTDAKTLRVARDLFLQENLKLVNKLEEMGVHAQPLTTGMFRADYLNKEKWGLVGKVTGVNKQAIETAISNGYLPILTSMAETDDGQILNVNADVAAAELARALEPLKVVYLSEKGGLFDAGGQKISAINLDEEYEHLMSQAWVKYGTRLKIKEIKELLDTLPRTTSVAIIHPEELQKELFTDSGAGTLIRRGSKLQASTSLSEFKDLEALKSVLIRDREGPDAKETVEKYLDFLKENPFKAYFDSSMNALAIVLPASEGRQATLATLTITKSGWLTNIADNIFTALKKEHPSLVWTVKEDDENLGWFFDKADGSITRQGDVMFWYGIENGDEIVKLMKDFTENGRAMLGNSNLESRLRQAASKPAAQQVRGYSTLARRPALPKFSISNRRGYLTQTNPNPPVGKQNASMDRPARVALIGARGYTGQELIRLIDSHPNMELHHVSSRELAGKKLEGYNKQEVIYENLSPEDVRDMEKRGEIDCWVMALPNGVCKPFVEAVWEGRKASGHKSVIIDLSADYRFDNKWTYGLPELVQRSNIIQATQIANPGCYATAAQLGISPLVPHLGGMPHVFGVSGYSGAGTKPSPKNDVENLTNNIIPYSLTGHIHEREVSSQLGAEIAFMPHVAVWFRGIHHTISIPLNKSMTSRDIRQLYQDRYAGEKLVKVVGEAPSVKNIGGKHGVEIGGFEVDKSGRRVVICATIDNLLKGAATQCLQNMNLALGYAEYEGIPTM

SEQ ID NO: 79001 - protein, 308 aa, Rhodospirillum rubrum ATCC 11170
MTVMKTPRHFLELSDFDAPALRAMLDRGLAFKAERRAGVVSAPLAGKTLALIFEKPSTRTRVSFEVGMRQLGGSSITLSPTETQLGRGETIADTARVLSRYVDGIMLRTNDPAKLRDLSQNASVPVINGLTDAAHPCQIMADLMTFEEHRGSITGKVVTWVGDGNNVACSWIKASALFGFTMRLACPAELEPPQGVLDWARANGGAVEVLRDPQEAVAGADCVVTDTWVSMGCDGAAARHALLRPYQVTAPLMAAAAADALFMHCLPAHRGEEVTEDVIDGPQSVVWDEAENRLHAQKGILAWCMAGS

SEQ ID NO: 79002 - protein, 460 aa, Pseudomonas putida GB-1
MNAPFAPQRQTRDYQAADAAHHIHAFLDQKALNAEGPRVIVGGERLHLWDSEGKRYLDGMSGLWCTQLGYGRRDLTAAAATQMDQLAYYNMFFHTTHPAVIELSELLFSLLPGHYSHAIYTNSGSEANEVLIRTVRRYWQVVGQPSKKVMIGRWNGYHGSTLAATALGGMKFMHEMGGLIPDVAHIDEPYWYAEGGELTPAEFGRRCALQLEEKILELGAENVAGFIAEPFQGAGGMIFPPESYWPEIQRICRQYDVLLCADEVIGGFGRTGEWFAHEYFGFEPDTLSIAKGLTSGYVPMGGLVLSKRIAEALVERGGVFAHGLTYSGHPVAAAVAIANLKALRDEGIVRQVKDDTGPYLQRILREVFADHPLIGQVQGAGLVAALQFAEHKPTRKRFVNENDLAWQCRTFGFEEGVIIRSTLGRMIMAPALIANHSELDELVEKTRIAVDRTARLVGKL

SEQ ID NO: 79003 - protein, 497 aa, Pseudomonas putida GB-1
MYTLEFWQQRASDLYLPSQALINGKPVNAQDGATFAAINPATNKVLAQVAACGQTEVDLAVASARRAFEQGPWPRMAPGERKKVLLRLAELIMAHREELALLDSLNMGKPVMDAYNIDVPGSAHVFAWYGEALDKLYDQVAPTAPNALATITREALGVVAAVVPWNFPLDMAAWKLAPALAAGNSVVLKPAEQSPFSALRLAQLALEAGLPEGVLNVVPGLGEQAGQALGLHPDVDCLVFTGSTQVGKYFMQYSAQSNLKQVWLECGGKSPNLVFENCQDLDLAAEKAAFGIFFNQGEVCSANSRLYVQRAIHDEFVERLQAKARQWLPGNPLNPASRAGAIVDAEQTGRIEAAIARAGQEGARLVCGGRRLTLDGSDNYIEPTIFAGVEGRMKLAREEVFGPVLAVSAFDTEEEAVHLANDSIYGLAASVWSDDFNQVHRVARALKAGTVSVNTVDALDVTVPFGGGKQSGFGRDLSLHSFDKYSQLKTTWYQLRA

SEQ ID NO: 79004 - protein, 396 aa, Rhodospirillum rubrum ATCC 11170
MSTVPAVMPTYSRVDLSFDRGEGAWLLANDGRRFLDFASGIAVTGLGHAHPHLVEALTSQAAKLWHCSNLFRIPGQERLAQRLVDGSFADSVFFTNSGAEAIEAALKLARRHQHVVRGETARYRTIVTRNAFHGRTLATVTAGGQAKHVKGFEPLVEGFDRVDFGDLDAARAAVTEETAAILVEPIQGEGGIFPAPEGYLSGLRRLADEHGLLLILDEVQTGVGRTGKLFAHEWDGIIPDVVAIAKGIGAGFPMGACLAREPYASALVAGSHGSTFGGNPLAMAVGNAVLDIILAEGFLDGVSARGADLIARLDGLVHRHPTILAGVRGRGLMIGLVCAAPNGVVLNALREQGLLAVPAEAGVVRLLPPMIIGEAEVTAAEEMIDRACVHLEREAA

SEQ ID NO: 79005 - protein, 515 aa, Yarrowia lipolytica CLIB122
MPYIRCLGDCIGPINQLLNMSISISLPNGNKYEQPTGIFINNEWSEASDKGTIPVYNPSTGDEVVQVAAATAEDVDRAVVAARKAFQSWRDVPGEERAKLLDNFINLVSKNLDTVAAIEALDSGKPLQLNARGDIAGGLAVYKYYAGWADKVFGKTIVNTTKKLAYTLHEPHGVCGQIIPWNYPFLMAAWKIAPAIAAGNVVVMKLAENTPLSMLYLCNLFKEAGFPPGVINIFTGHGAKAGSRLAEHPDVDKIAFTGSTATGRIIMKLAATNLKAITLECGGKSPMIVLGDADLDQATKWAHAGIMTNQGQICCGVSRVLVHESIYDQFVDKYVEVVKQRSRVGDMFQDKILQGPQVSKVQQEKVLGYIEKGKEEGAKLVYSGAVAAEALEKGYFVPPTVFADVRDDMVISREEIFGPVVAIAKFSDVEDAINRANDSEYGLAASVYTKDLTEAHRISRRLESGQVFINMAHMGDYRMPFGGYKQSGIGRELGEYGLDTYTQCKAVHINMGMKL

SEQ ID NO: 79006 - protein, 188 aa, Zea mays
LRWLHHQQPVQRAHPDLADKCVLASSGFQGDIKALHKNLAARELLYQHQHNKRMSCPAMAQLLSNTLYYKRFFPYYAFNVLGGLDSEGKGCVFTYDAVGSYERTGYSAQGTGSTLIMPVLDNQLKSPSPLLLPAKDAVTPLSESEAIDLVKDVFASATERDIYTGDKLEIVVINKVGTKREYIDLRKD

SEQ ID NO: 79007 - protein, 282 aa, Candida tropicalis
MDSSSYWSYDNIVPSFRLDGKLVIITGGSGGLSAVVSRALLAKGADIALIDMNLERTQQAARDVLQWGEEQMKGKHESPIGQVSAWSCNIGDAEAVELTFKAINEHHGKVASVLINTAGYAENFPAEEYPAKNAENIMKVNGLGSFYVSQAFARPLIQNNMTGSIILIGSMSGTIVNDPQPQCMYNMSKAGVIHLARSLACEWAKYNIRVNTLSPGYILTPLTRNVISGHTEMKTEWESKIPMKRMAEPKEFVGSILYLASDSASSYTTGHNLVVDGGYECW

SEQ ID NO: 79008 - protein, 374 aa, Pseudomonas putida GB-1
MTTPLFRPIQAAVTRGKGAPFVLEQARIRAPQGDEVLVRIVATGMCHTDMIVRDQYYPVPLPAVLGHEGSGIVEAVGPLVQNLAVGDHVVMTYGYCGRCLACDAGQAAYCQDFFGRNFSGAGPEGEHALQDEQGHALNDHFFAQSSFATYALGRENNTVRVPKEAPIELLGPLGCGIQTGAGAVINSLRVTPGSAFAAFGGGAVGLSAVLAAQVAGAATIIAVDVVPSRLALALELGATHVVNSRETDPVAAIREITGGGVQFALESTGRPEVLRQAVDALGSRGALGVVGAPPLGTTAQFDVNDLLLGGKVIRGIVEGDSVPKKFIPELVNLYLQGRFAFDKLVRFYDFEQINQAAEDSEKGLTLKPIIRIQK

SEQ ID NO: 79009 - protein, 1375 aa, Cryptococcus neoformans var. neoformans B-3501A
MSVLAAISSLPATSYYHPIAQVPAGASKLNPYLPLPQSSTPTVLFTNANLLHSLPTASLSRTVIHVFDAEEIVTPKGANAVSLISRSSQGAYDHALLSLRLAQDKDAVVYHFIPSGLEGEIQTLEDAQAWLSGPLDAPDLSNGDDAEPSAEAKLIAAYESISLSLLKLTRRPQRPFIHSKAESSRLVVNFLPSPVKSENTIDVVLAIPAPKEKLSSSLSGVQEVVVVEAGSGKYGPAWASVVDALEGADVTIRSVLVGASASSEEIAAAITGDTPITRIGKPLSYNIPSNAVTVPSPESTYTELLASSPSPLEVLNDPSHLAANESTSPLYAFGKAVAIRKERARLVELAKKVLKAPNTKPEVHEALSAWLLVRDEKKGAVEAGKKVEAAIGAGKGDEKEIVELGQKGHWEKRALWIVISNSWAVDLASSGLHHALASGLDINLLVYETAASPFSPNAPAQPPKERKKDLALYALNMGDVYVASVAVYADYAGVLNAMREAENYSGPGLVLAYLPWGEKEDGQAVSDSENAGPLERLRETKRAVSGGWWPMFRWNPSLPDEKRFSLDSSHIKAALSEFLDRQSHLSQLTLATPAIDSSVTSSAGTELLAARKEKARKAYDALLNSLDGPGLLVLYASDGGNAEKLAKRLVGRAKMRGVSASLRVLDEVAGSIVETLSQEQNVLIVSSTAGQGESPLNGREFTKALSKLSPSDEFKETKVAVFGMGDSHYWPRPEDAGYYNKPARDLFPKLISLGCQELLPLGLGDDSDPDGVQTGYKPFEASLWRALGVDSVEVTEEKEEVVANEHIKIASDYLRGTILEGLADKSTGAISASDAQLTKFHGTYMQDDRDIRESLKAQGLEPAYSFMIRVRMPGGICSAKQWLDMDRISDEHGNGTFKLTTRQTFQFHGIIKSHLKKAMQAINKSLLDTIAACGDVNRNVQCTVNPSLSKTHATVYEFSKAVSEHLLPATNAYHEIWLDKKKISGDAVQPFDSDSEPLYGPYYLPRKFKIAIAVPPDNAVDVFTNDVGFIAIVENDEVIGYNVSVGGGMGVTHGNKKTYPRLGDVIGFITPEDGKKVAESIMLVQRDHGNRQDRKNARLKYTVDRLGLPKFKAFVEERWGKKFAPARAYHFDSNLDHYGWSQGHDGKWHFTMFIENGRVEDNSRHQFKAGLREIASVHKGTFRLTANQHLILSDIASEDLDEMKRLLAKWGLDNLDHSGVRLSSSACVAFPTCGLAMAESERYLPVLIDKVEKICEEAGVKSDDLVMRMTGCPNGCARPWAAEVAFVGKAPGSYMMMLGGSHLGTRLNKPFLESASEPEILAVLKPMIKRWALERHEGERFGDWTIRAGYIKPTTHGTNFWEDAFPAQAGTTVTA

SEQ ID NO: 79010 - protein, 489 aa, Pseudomonas putida GB-1
MLCVDTLLPNELWNERLFTGTWVPGELPATAVTSPGNGVALGALANAGAKQVEQSAREAATAQRSWYALPYDERAKVLRKAAAIAEQYQAEIANWIVRESGSTQAKAGFEASISIKALHEACALPSRSQGEVLPSTAGRLSIARRRPLGVIGVISPFNFPLYLAMRAVAPALATGNAVVLKPDPRTAVCGGHVIARIFELAGLPAGVLHVLPGGAEAGAALTASPSVAMIQFTGSTAAGRKVGEAAGRHLKKVSLELGGKNSLIILDDADLDLAIANATWGVYLHQGQICMSTGRVLVQRGIYDAFVARLVAKARSLTVGDPASGQVHLGPLINAAQRDNALRIVDAARAAGATLATGGAADGLFFQPTVLSDVQRDNPAFHEEIFGPVAVVVPFDSDEQAVELANDTDYGLSAAILSRDTGRALRLGEQLRTGLLHINDQTVNDEVINPFGGVGASGNGSSIGGAANWEEFTQWQWLTLKGQAPAYPL

SEQ ID NO: 79011 - protein, 1525 aa, Kluyveromyces lactis NRRL Y-1140
MDADSTSSLVEYQGFDHQVQEQIRDLARTLSRNSLKEQASQQESTGNVLASDDDGAKSIFSTRYEGVNPVFTDSDASGYDVRLDPNSDEFSSAAWIKNMVALANNDPEYYKHYTIGCCWKDLRAFGDSTDVAYQSTVLNLPGKIFSSVKRHFVKSKPEDVFDILKPMDGLLKPGDLLVVLGRPGSGCTTLLKTISSNIDGYNVDENSVISYNGLDPRTIKKHFRGEVVYNAESDVHFPHLSVYETLYNIALLVTPSNRIKGATREEFANHVTQVAMATYGLSHTRDTKVGNELVRGVSGGERKRVSIAEVTICGSRFQCWDNATRGLDSATALEFIRALKTSTDISGSTGVIAIYQCSQDAYDLFDKVCVLHEGYQIFYGNAKAAKAYFERMGYVSPSRQTTADFLTAVTNPAERIVNQEFVKEGRFIPSTAKQMEEYWRNSPEYKQLRGEIEEELNKDSTQTRQELIEAHIARQSKRQRKESPYIVNYGMQVKYLTMRNFLRIKKSYGITVGTIVGNTAMSLVLGSIFYKSMKDTTTNTFFYRGAAMFIAVLFNSFSSMLEIFSLYEARPIIEKHKRYSLYHPSADALASMLSELPAKIITAICFNLILYFMVNFRREAGPFFFYFLMNFLATLVMSAIFRCVGSATKTLSEAMVPASCLLLAISLYVGFSIPKKNLLGWSRWIWYINPLSYIFESLMINEFNGRDFPCAAYIPSGSGYENIGLYERVCNTVASQPGLSYVSGRAFIEEAYGYNPSHRWRALGIALAYFIFFTAFYLLFCEFNESAVQKGEILLFPKSVLKRAKKQKLIKAKHDVEAVQDSEGALTDQKLLQDSLVESNISSSSDKSVNVGLSKSEAIFHWRNVCYDVQIKKETRRILSNVDGWVKPGTLTALMGSSGAGKTTLLDCLASRVTMGVITGDMFVNGHLRDNSFPRSIGYCQQQDLHLSTSTVRESLRFSAYLRQPSSVSIEEKNNYVEDVINILEMQQYADAVVGVAGEGLNVEQRKRLTIGVELAAKPKLLLFLDEPTSGLDSQTAWSVCQLMRKLADHGQAILCTIHQPSALLMQEFDILLFLQKGGKTVYFGNLGEGCQEMINYFEKHGASKCPEGANPAEWMLDVIGAAPGSHATQDYHEVWRNSDEYQAVQKELDWMESELRKKPLDTSSEQSEFGTSLFYQYKVVTLRLFEQYYRTPSYIWSKLFLTIFSQLFIGFTFFKANLSIQGLQNQLFAIFTFTVIFNPACQQYLPLFVSQRDLYEARERPSRTFSWLAFIFSQITVEIPLNICFGTIAFFVFYYPIGFYNNASYAGQLNERGVLFWLFSVSFYVFISSMGQLCIAGLQYAEAAGNMASLMFTMSLNFCGVFGGSGVLPGFWIFMYRISPLTYFIDGVLSTGLANNPVTCANYEYVSFNPRSGETCGEYMADYIDKNGGYLLDSNATEDCNFCKISETNAFLTSFQSSYHRRWRNFGIFIVFIVFNWCGCVFLYWLARVPKKKNRVADERDPDHGKKIENVQKEKVEPQSNEQV

SEQ ID NO: 79012 - protein, 388 aa, Campylobacter lari RM2100
MLSQRSQNLGESLTLVMTDIAKTLKANGEKVISFSAGEPDFDTPEIIKKAAIEAIEKGCGAYTPVVGIKEVIEAIQYKFKNDNNLEYKASEIITNVGAKHSLFMAIECLVEEGDEVIIPSPYWVSYPEMVKFAGGTPVFIEGDAKNGFKITPEQLKQAITPKTKVLMFNSPSNPTGAIYSKDEIIALAKVLEGSKIVVLSDEIYEKLVYDGEFFAFAQASEDASNRTVTINGLSKCGAMPGWRFGYMASKMSEFNKAIKKLQGQSTSNICSIVQHAALPALLGKANDDIEMMRQAFLKRRNLACEILSKCEKIKLEQIPQGAFYLFISCKELDNDSMRFCKRLLEEQKVALVPGVGFGMEGYFRLSYATSENDIKEGCEKIINFVKNY

SEQ ID NO: 79013 - protein, 287 aa, Triticum aestivum
  misc_feature (263)..(263): Xaa can be any naturally occurring amino acid
MAKDIEAAPQGGEFSTKDYSDPPPAPIVDFEELTKWSLYRAVIAEFVATLLFLYITVATVIGYKHQSDPTVNTTDAACSGVGILGIAWAFGGMIFVLVYCTAGVSGGHINPAVTFGLFLARKVSLIRALLYIIAQCLGAICGVGLVKGFQSSYYVRYGGGANELSAGYSKGTGLAAEIIGTFVLVYTVFSATDPKRNARDSHIPVLAPLPIGFAVFMVHLATIPITGTGINPARSLGAAVIYNKDKAWDDQWIFWVGPLIGAXAIAAAYHQYVLRASARQARVYRSN

SEQ ID NO: 79014 - protein, 255 aa, Zea mays
MWLPFPYPPPASVYVTVMSVVSLLSAANAGLSELRGNHVSYSKFWHVAAAAGGDGSNKQRARGGGGAVLTGRDGMLVTYAPAFAAAAASFAVPGAVEGARARLLSAALTAHFLKRLLEVLFVHRYSGSMPLGTAVGGAANYLVATATMVYAQRLSRSVQDPPVDLRGPGVVVFAVGLAGNFYHHCLLSRVRADGGGSKGYKIPRGGLFGLVACPNYLFEIVGLFGVAMIAQTVYALAYATGAAAYLAGRSCATRR

SEQ ID NO: 79015 - protein, 382 aa, Cryptococcus neoformans var. neoformans B-3501A
MSDFHQAPHKLLVIPGPIEFSDPVLAANATPGTAHTSPAFIPVFGEALSLLRDVLLSAKESGSQPLLIAGSGTLGWDAVAANLIEKDEEAVVLNTGYFSDSFGECLEAYGAKVTHVKAEVGGIPTDDAIISALASKPKLLTITHVDTSTGVLSPADHIASLVKKHSPDTLIALDAVCSVASEEIKFDEWGLDVVLSATQKGLGVPPGLSVVLASKRAVETVEKRKTPIPAYYVSWKKWIPIMQNYESGKPSYFATPPVQLVYALHTSLKSITSAPLADRFKAHKAASAYVKDSLAELGLEFVPKSRDIAANGMTAVRFPKGVKAPDVLPKLAERDIVVAAGLHKAIVSEYFRIGHMGITAVDRQRGDLEKVVKGIKEVLGKA

SEQ ID NO: 79016 - protein, 223 aa, Arabidopsis lyrata subsp. petraea
FDRVSIQQWIDSGNRTCPITKLPLSENPSLIPNHALRSLISNFAHVSPKETSRPRTQQEHSHSQSQALISTLVSRSSSNAPKLESLTRLVRLTKRDSIIRRKVTESGAVRAALDCVDSGNQVLQEKSLSLLLNLSLEDDNKVGLVADGVIRRIVAVLRVGSPDCKAIAATLLTSLAVVEVNKATIGSYPDAISALVYLLRVGNDRERKESATALYALCSFPDN

SEQ ID NO: 79017 - protein, 223 aa, Arabidopsis lyrata subsp. petraea
FDRVSIQQWIDSGNRTCPITKLPLSENPSLIPNHALRSLISNFAHVSPKESSRPRTQQEHSQSQSQALISTLVSRSSSNASKLESLSRLVRLTKRDSLIRRKVTESGAVRAALDCVDSCNQVLQEKSLSLLLNLSLEDDNKVGLVADGVIRRIVAVLRVGSPDCKAIAATLLTSLAVVEVNKATIGSYPDAISALVSLLRVGNDRERKESATALYTLCSFMDN

SEQ ID NO: 79018 - protein, 769 aa, Sulfolobus solfataricus P2
MSTSQSRIVLMSKTYFKRFGKMNNMSQQLKLRVVEARQRDVGRKVARITDYTISRLGIENGDYVEIIGPSGSALAQALIGDGIADNEIRVDGYIRRSIGVGIGDEVTVKRAQVQDATKVVLAPTQPISFSQSFVEYVKDWLMDKPISRGETISVPTYVGSIDFVVVSTQPSQSVRITGRTSLEIRQEPVKESAAVPKVTWEDIGDLEDVKEKIREIVELPMRHPEVFQHLGIEPPKGVLLYGPPGVGKTLLARALANEIGAYFTSINGPEIMSKFYGESEQRLREIFEEAEKNSPAIIFIDEIDAIAPKREEVTGEVEKRVVAQLLTLMDGIKGRGKVIVIGATNRPDAVDPALRRPGRFDREIEIRPPDAKARKEILQVHTRNMPLAEDVDLDKISEQTHGYTGADLAALAREAAMNALRRFINERKINLEQEQIPVDVLKELKVTMQDFIDAMKFIQPTLLREVYVEVPKVKWEDIGGLEEAKQQLREAVEWPLKFPEMFEKLGIRPPKGILLFGPPGTGKTMLAKAVATESGANFIAVRGPEILSKWVGESEKAVREIFRRARQTAPCVIFFDEIDSIAPMRGFTHDSGVTERIVNQLLSEMDGIQSLNRVVVIAATNRPDILDPALLRPGRFDRLIYVPPPDEKARIEILKIYTRTLPIDSSVNLEELAKKLEGYTGADIEALARETTMKVLRQKYYDCLNKAKKECKDQECTDKTIKSCMSNLEIKITMQDFLDTMKIVTPSLTKADIMRYENMVKEIKRSVIG

SEQ ID NO: 79019 - protein, 174 aa, Triticum aestivum
MAPAVMASSATTVAPFQGLKSTAGLPVGRRSSGSLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 79020 - protein, 274 aa, Rhodospirillum rubrum ATCC 11170
MGCLTTDTPLAGVSLLLLGCGKMGGALLNGWLGRGLEPSAVHVVDPLADLPAGVTRLTAEQAVALPPPDVCLVAIKPQVVPEVLPAYAPLAQAGTVFLSVAAGKTIDGLSGLLGGDAAVVRAMPNTPAAVGRGASVLCANARVPAPTRALCETLMAAVGTVEWVDDESLIDAVTALSGGGPAYVFLLVECLAEAGRANGLPADLAMRLARSTVAGSGALLDGSAEDAATLRKNVTSHKGTTAAALAVLMAEDALQPMVTRAIAAAAERSRELAS

SEQ ID NO: 79021 - protein, 473 aa, Leuconostoc mesenteroides
MKKTKIVSTLGPSSSDVETIVKLIQAGANVFRFNFSHGDHEEHLGRMNAVHEAEKITGKTVGILLDTKGAEIRTTKQADGKIEFHTGDTLRIAMDENLEGTKEKIAVTYAGLFDDVKEGGQVLFDDGLLGTTVIEKDSATRELVVRVDNDGILGSRKGVNAPGVSINLPGITEKDADDIRFGLDHEINYIAASFVRKPEDVLEIRGLLKEKNMEHVQIIPKIESQEGIDNLDAILEVSDALTVARGDMGVEIPAENVPLVQKDMIRKMNKAGLPVITATQMLDSMEENPRPTRAEASDVANAVFDGTDATMLSGESANGDYPVESVATMAAIDEKAETSLRENGRHEDIFFDETDSTEAVAASVARIARNVNAKAVVVSTNSGYTARMVSKHRPDVNILAVTYSERVQRGLTLNYGVVPVVYDAPKTIDEMVDLAKKAVKDQGLANSGDTIVIAAGVPMSQSGTTNMLTVQTV

SEQ ID NO: 79022 - protein, 405 aa, Candidatus Kuenenia stuttgartiensis
MNMNMSANEQIQTPNGNTRVMILATLAFALCFAGWTLFAPLAIYFQREFNLSSTMVGILLATPVLLGSLAKIPMGIVTDKYGGRLVFTIMLLFGFVSLFFTGFARSYGSLLACGFFFGLIGSSFAVGIPHVSEWYPKKKQGFALGVYGVGNAGTALAAFGAPFIAESLGWSKVFIIYSFPLLLMAFIYWFFTSNAPKPANLKVSTLGDKLKLYKSSRLAWIFCFFYFMYFGFFVCFSVWLPTYLYDFYHISPVKAGSFTSIFVFLSSFTRILGGYLGDKFDGRKIMVLLTVAVLFIAVFLNFNLSLTTALAVFYIMGTCLGIGNGVVYKLVAEYYPKDTGAVGGLVGAAGGLGGFFLPIILGTIKDYTENYALGYIFVSLVCLMCLSFMEKKTLVNAHRKVATAM

SEQ ID NO: 79023 - protein, 181 aa, Chlamydomonas reinhardtii
MGLRFTKALSRLFGKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNLANKT

SEQ ID NO: 79024 - protein, 181 aa, Daucus carota
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEIIDKLGLHSLRQRHWYIQSTCATSGEGLYEGLDWLSNNIASKS

SEQ ID NO: 79025 - protein, 205 aa, Citrus unshiu
KLGDDEFGYMLANILKENNVDTSGVRYDSTARTALAFVTLRADGEREFLFFRHPSADMLLCESELDKNLIKQGSIFHYGSISLIAEPCRSTQLAAMNLAKESGSILSYDPNLRLPLWPSEEAARKGIMSIWDQADIIKVSDDEITFLTGGDDHNDDNVVLEKLFHPNLKLLIVTEGSKGCRYYTKEFKGRVPGVKTKAVDTTGAG

SEQ ID NO: 79026 - protein, 145 aa, Arabidopsis thaliana
  misc_feature (39)..(39): Xaa can be any naturally occurring amino acid
  misc_feature (123)..(123): Xaa can be any naturally occurring amino acid
  misc_feature (130)..(130): Xaa can be any naturally occurring amino acid
GPGRPTLTLDTVEDVTIFFSDEKVPILIAFLSNIYGPYXHYSCGTKEYKILMDQFHHVSAAFLELEKGYQEAIKEITRKMVPGMANFICQKVKTVDDYYEYSHYFAGLFGLGLPKLFLASGSXFFTPNLXAISNSMGLFLHKTNI

SEQ ID NO: 79027 - protein, 892 aa, Symbiobacterium thermophilum IAM 14863
MTKKWVYLFHEGRADMRMLLGGKGANLAEMTNIGLPVPPGFTITTEVCREYQKTKQLDPEVIEQVNAALTALEQQTGKKFGDPRNPLLVSVRSGAPISMPGMMDTVLNLGLNDETVVAMAELTGNERFAWDSYRRFIQMFSNVVLGIELHNFEAILEAHKKRNGFTQDIELQAEHFKAIVPEYKAVVEKHTGKPFPMDPREQLMAAIRAVFESWDNPRAQVYRKINKISDDLGTAVNVQAMAFGNMGDDSATGVCFTRNPNSGAKEFYGEYLPNAQGEDVVAGIRTPYPIAHLKETMPEVYQQLFDLCELLESHYKDMQDIEFTVERGKLYMLQCRAGKRTPIASIKIAVDLVKEGKISKEQAVLRVDPEQINNILHPAIDPKAKLDILAKGLAASPGAATGMCVFDPDRAAKLAGEGHKVILVRPETSPDDIHGMVVAQGILTSRGGMTSHAAIVSRGMGKPCVVGCEAIKVDLEAREFRVNGRVVKEGEVISIDGATGNVIYGEVPVVDPELSPEFRTLLSWADEIRTMGVRANADTPIDAAKAREFGAEGIGLCRTEHMFGQGGHHPERMAVAREMILAETTEERMVALEKLQEMQRQDFYEIFKAMNPFPVTIRLLDPPLHEFLPDAEDLAIEVAIMRERGETGSELQEKEALLKKVRALAEMNPMLGFRGCRLGMIYPEIYEMQVRAIFEAAAQCNKEGMVVEPEIMHPLVSIVTEFSFLREMTDRIAREVMEKHGVTFKYMVGTMIEVPRAAVTADEIAEHAQFFSFGTNDLTQTTFGFSRDDAEGKFLAQYVEQKVLPENPFVTIDRKGVGKMVEIACELGRKVRPDIKLGVCGEHGGDPSSIEFFQSCGLTYVSCSPYRVPVARLAAAQAAARAKGERATSSTV

SEQ ID NO: 79028 - protein, 172 aa, Herminiimonas arsenicoxydans
MKTSPVCAPDATSEPLYIVNTSTIHGTGIFARCMIAPGTCIVEYQGERIQWEQALDRADAQGPLNHTYFFSLNDGRIIDGGKDGNAARFINHSCEPNCEAIEHEDGRVYIYALQEIEAGEELSYDYALIYEERHTPTVKRAFACHCGAPGCSGSMLMPKRSARYRAQKALAK

SEQ ID NO: 79029 - protein, 246 aa, Glycine max
  misc_feature (209)..(209): Xaa can be any naturally occurring amino acid
MFPAGGRISPGPPPLEPLFRMPPYHTTTCPPPSSLSLSLSLSPSLQTYKQGKEEEEEEEEANMSSPSKRREMDLMKLMMSDYKVDMINDGMHEFFVHFHGPKDSIYQGGVWKVRVELTEAYPYKSPSIGFTNKIYHPNVDEMSGSVCLDVINQTWSPMFDLVNIFEVFLPQLLLYPNPSDPLNGEAASLMMRDKNAYENKVKEYCERYXKPEDISPEEEEEESDEELSDAEGYDSGDEAIMGHADP

SEQ ID NO: 79030 - protein, 314 aa, Dendrobium hybrid cultivar
MELLEGSQRSDAMAVLRDACENWGFFELLNHGISHDLMNRVETVNKEHYRRFREQRFKEFAAKTLDSGENVVADNLDWESTFFLRHLPTSNISQIPDLDEDCRSTMKEFALELEKLAERLLDLLCEDLGLEKGYLKRVFCGGSDGLPTFGTKVSNYPPCPKPELIKGLRAHTDAGGIILLFQDDKVSGLQLLKDGEWVDVPPMRHSIVVNIGDQLEVITNGRYKSVMHRVVAQTNGNRMSIASFYNPGSDAVIFPAPELVEKEAEEKKKEVYPKFVFEDYMKLYVRQKFEAKEPRFEAMKTMDTVVSSQPIPTA

SEQ ID NO: 79031 - protein, 382 aa, Mycobacterium avium 104
MQISGTLLLQLGALLATLAVLGAAARRFALSPIPVYLLAGLALGKGGLLPLATGGQFITTSAPIGVVLLLLTLGCEFSVAEFSSSMRHHLPSAAVDVVLNAAPGAIAGWLLGLDGVAILCLAGVTYISSSGVVARLLEDLRRLGNRETPAVLSVLVLEDFAMAAYLPLFAVLASGGGWLHAVVGMVVAVSALVAAFAASYRWGHHVQRLVEHPDSEQLMLRVLGITLIVAAMAESLHASAAVGAFLVGLTLTGETATRTRQVLAPLRDLFAAIFFLAIGYSVDPHELIPMLPAALILAAATAATKVATGIFAARHDGVARRGQLRAGTALIARGEFSLIIIGLAGSSLPAVAALATSYVFIMAIAGPVLARYTGPRPAAPAT

SEQ ID NO: 79032 - protein, 421 aa, Campylobacter lari RM2100
MNIETLKQDIILKKGIHYFDFTASALALKSVEKEIKKILTTYANTHSDSSLNSFITQQHYENARINLKKYLDLDDSFALIACGSGSSAAIKKFQELLGLYIPPLIKEKYFKNTDKNTLPLVIVGPYEHHSNELSFREALCECVRIPLDKKGELDYVFLEKLLKKSKNRQIIASFNAASNVTGILSDYKKIYTLIKQYNSIVAFDISTLAPYANLDPKFYDAVFISSHKLLGGVGSCGLLAIKKNLCGNTPSFAAGGTVGYVSRTSQQYLCEVENLEEGGTPGIIQLIRASLAFKVRNEIGLKNIEKKEKELCEYFLKQCINFPKMILYAKNITHRLPIFAFNIEGISPFDLAYKLSKTYKIETRAGCACAGPYGHDLLNLKDNQELNFKPGWLRVGFHYTHTKEDIEYFFKALKASIKALS

SEQ ID NO: 79033 - protein, 314 aa, Dendrobium hybrid cultivar
MELLEGSQRSDAMAVLRDACENWGFFELLNHGISHDLMNRVETVNKEHYRRFREQRFKEFAAKTLDSGENVVADNLDWESTFFLRHLPTSNISQIPDLDEDCRSTMKEFALELEKLAERLLDLLCEDLGLEKGCLKRVFCGGSDGLPTFGTKVSNYPPCPKPELIKGLRAHTDAGGIILLFQDDKVSGLQLLKDGEWVDVPPMRHSIVVNIGDQLEVITNGRYKSVMHRVVAQTNGNRMSIASFYNPGSDAVIFPAPELVEKEAEEKKKEVYPKFVFEDYMKLYVRQKFEAKEPRFEAMKTMDTVISSQPIPTA

SEQ ID NO: 79034 - protein, 66 aa, Glycine max
ADSYGLKWFFIISTPNPVFTPLAGSIGAWKALSPTVVQASFNVEAGLEQFFRSKKKAKAIFFPPPN

SEQ ID NO: 79035 - protein, 670 aa, Mycobacterium avium 104
MSTSEYRAVDAESDLPISAAELAALASQLYAASIRPGPDSPPQQAPVAPRGSVPDATAAISAGRTAAGTADVYPGPVPQVGGRDVYLPPPASPAPEAPPQAAPPAPRGSAPDATAATSAGRAAAGTSDVYSSWVPQLGVADIYLGAPTPAGPEAPPQSAPPAPRGQVPDTTAAATAYGADLSAFAVPTGIVSTAPGVQAGTVPPVPVVPRAATAPSWLPEAPSVADLGWSDAPAPDAPAGDEHDYHFLTKTDPVPQFRDEHEVFDVAAIRSDFPILKETVNGKPLIWFDNAATTQKPQVVIDRLSHFYAHENSNIHRAAHELAARATDAYEEARDTVAEFIGAPSSENIVFVRGTTEAINLVAHAWGAKHLQPGDEIVITHLEHHANIVPWQLISQKTGAILKVAPIDDAGNLLLSEFEGLLGPRTKLVAASHVSNALGTVVPVDKIVELGHRYGARVLIDGAQSIQHIPIDVAELGADFFVFSGHKIYGPTGIGALYGTEEALTETPPWQGGGHMIADVTLERSLYQGPPTKFEAGTGNIADAVGLTEALRYVQRLGVERIAAYEHALLEYATPRLADIPGVRLIGTAQEKASVLSFVLAGHEPLEVGKALNAEGIAVRAGHHCAQPALRRLGLEATVRPSFAFYNTFEEIDVFLRAVRRIAEGGANVG

SEQ ID NO: 79036 - protein, 304 aa, Triticum aestivum
  misc_feature (175)..(175): Xaa can be any naturally occurring amino acid
  misc_feature (186)..(186): Xaa can be any naturally occurring amino acid
  misc_feature (197)..(197): Xaa can be any naturally occurring amino acid
  misc_feature (212)..(212): Xaa can be any naturally occurring amino acid
  misc_feature (214)..(214): Xaa can be any naturally occurring amino acid
  misc_feature (226)..(226): Xaa can be any naturally occurring amino acid
  misc_feature (236)..(236): Xaa can be any naturally occurring amino acid
  misc_feature (240)..(240): Xaa can be any naturally occurring amino acid
  misc_feature (244)..(244): Xaa can be any naturally occurring amino acid
  misc_feature (249)..(249): Xaa can be any naturally occurring amino acid
  misc_feature (264)..(264): Xaa can be any naturally occurring amino acid
  misc_feature (281)..(281): Xaa can be any naturally occurring amino acid
MEQYEKVEKIGEGTYGVVYKARDRATNETIALKKIRLEQEDEGVPSTAIREISLLKEMQHGNIVKLHDVVHSEKRIWLVFEYLDLDLKKFMDSCPEFAKSPALIESYLYQILRGVAYCHSHRVLHRDLKPQNLLIDRRTNALKLADFGLARAFGIPVRTFTHEVVTLWYRAPEIXFLGARQYSTPXVDVWSVGCIFXQEMVNQETTVPWVIXRXDELFKIFRVPGXPNEQTWPSVXPLPXDYKXAFPKXWQAEDLATVVPNLEXLGLGLLSKMLRFEPNKXLRQASLDMLKAWWAMTPWNDNFD

SEQ ID NO: 79037 - protein, 338 aa, Ralstonia solanacearum GMI1000
MNLNKHPRHPLTFGPTPIQPLKRLSAHLGGKVELYAKREDCNSGLAFGGNKTRKLEYLVPEVLAGGYDTLVSIGGIQSNQTRQVAAVAAHLGLKCVLVQENWVNYADAVYDRVGNIELSRILGADVRLDAAGFDIGIRPSWEQAMEDVRRAGGKPFPIPAGCSEHPLGGLGFVGFAEEVRQQEAEFGFRFDYIVVCSVTGSTQAGMVVGFAADGRADRVIGIDASAKPEQTREQILRIARDTAKLVELGRDITEDDVVLDTRYGGPEYGLPNEGTLEAIRLCARQEGMLTDPVYEGKSMHGMIDRVRGGEFPEGSRVLYAHLGGVPALNAYSFLFRNG

SEQ ID NO: 79038 - protein, 229 aa, Pyrococcus abyssi GE5
MNIEEMKKIAAKEALKFIEDDMVIGLGTGSTTAYFIRLLGDMIKKGEVSDIVGVPTSYQSRLLAIESGIPVATLDQVDAIDVAVDGADEVDPNLNLIKGRGAALTMEKIIESRAGMFIVLVDERKLVDYLCQKMPVPIEVIPQAWRAIVEELSIFNAEAKLRMGVNKDGPVITDNGNFIIDAKFPRIDDPLDMEIELNTIPGVVENGIFADIADIVIVGTKEGVKTLER

SEQ ID NO: 79039 - protein, 389 aa, Pyrococcus abyssi GE5
MAMSDRLDLVNPSEIRKLFDIAAGMKDVISLGIGEPDFDTPQHIKEYAKEALDMGLTHYGPNIGLPELREAIAEKLKKQNNIEADPNKEIMVLVGANQAFLMGLSAFLKDGEEVLIPTPAFVSYAPAVILAGGKPVEVPTYEENEFRLNVDELKKYVTEKTKALIINSPCNPTGSVLKKKDLEEIADFAVEHDLIVISDEVYEHFIYDDVKHYSIASLDGMFERTITVNGFSKTFAMTGWRLGFVAAPSWIIEKMVKFQMYNATCPVTFIQYAAAKALRDERSWKAVEEMRKEYDRRRKLVWKRLNEMGLPTVKPKGAFYIFPRIKDTGLTSKEFSELMLMEAKVAVVPGSAFGKAGEGYVRISYATAYEKLEEAMDRMEKVLREKKLT

SEQ ID NO: 79040 - protein, 199 aa, Haemophilus parasuis
EAGDIIIDGGNSNYPDTNRRVKALAEKGIRFIGSGVSGGEEGARHGPSIMPGGNEEAWQYVKPIFQAISAKTDKGEPCCDWVGKEGAGHFVKMVHNGIEYGDMQLICEAYQFLKDGLGLSYDEMQAIFAEWKKTELDSYLIDITTDILGYKDTDGTPLVEKILDTAGQKGTGKWTGSNALDFGIPLTLITESVFARCVS

SEQ ID NO: 79041 - protein, 227 aa, Arabidopsis thaliana
MGDNGESIKWPKIKLKSNLNVSYLKNHDLFTVENCLTSDESKAFVKIAESLGFTHQGSRGPAYGEAYRDNHRISVNDPVLADTLWQSGLSNLFTDIKIRRKVAVGLNPNIRFYRYSAGQHFGRHIDESADLEDGNRTYYTLLIYLSGNSTKSKSKSSSSKTNDSSSAEPLVGGETVFYGSRNSIVAEVAPVEGMALFHIHGDKCMLHEGRNVSKGVKYVFRSDVVFA

SEQ ID NO: 79042 - protein, 254 aa, Gibberella zeae
PGVGFGTFANEGAKGETYKAVIAALKTGYRHLDCAWFYLNEGEVGQAVRDFLAEDNGVKREDLFICTKVWNHLHEPEEVKWSFENSLKNFGLDYIDLFLVHWPIAAEKGDDYQPKIGPDGKYVIKKDLTENPEPTWRAMEEIYASGKARAIGVSNWTIDGLKQLMAFAKVKPAVNQIEIHPFLPNEDLVKFCLENDILPAAYSPLGSQNQVPTTGETVRSNKTLNEVADRSGNTLAQVLIAWGLRRGTLFCPRA

SEQ ID NO: 79043 - protein, 513 aa, Synechococcus sp. WH 8103
MTIKNQVNPYFAEKKLNKIEKSKLEKDGLLVGSEIEKFAKIGWENMDETDLKLRLKWYGMFWRPKTPGKFMLRLRIPNGVLTSNQIRVVASIVERYGENGSCDITTRQNLQLRGILLCDLPEILRRLREAGLSSIQSGFDNPRNVTGNPLAGIDPNEIVDTRPYTTEVQNFLTNNCEGNSEYSNLPRKWNTAVAGSKDNFLLHNDIVFHPVENNGVMGFSIWIGGILSPQMNAYAFPMNVWVLPDEICNILDTVIRLWRDNGERENRTKGRFRMYLDEVGLVEFRSQVEKLYGTLTPDPGSIFENSPRSHFGINQQKQAGLYFAGIHVPVGRLTAEDLQDIATASLKYGNGEIRLTEDQNIIITGLTSERVEELKTDTLLQRFPLAPSNISAGTVSCTGNTYCSFALTNTKDQSLKAEKELDEELNLPEEIKVHWTGCPNTCGQAYMGAIGLTGTKAKNAEGVMGEGYTMTIGGSQGRNPTIGQVYRKAIPAAEIKAALKEVLISEFGATEER

SEQ ID NO: 79044 - protein, 139 aa, Triticum aestivum
  misc_feature (78)..(78): Xaa can be any naturally occurring amino acid
  misc_feature (109)..(109): Xaa can be any naturally occurring amino acid
MASGAVRPKLAYIVCYVEDVGKSAAFYAKAFNYSVRRVDDSHKWAELDTGSTTIAFTPRHQRETDALTGEVQLPKSLXERGPVEICFDYDDVDAAYRRAVENGAVPGEXAPEQKNWGQKVGYIRDCDGITVRLGSHVRE

SEQ ID NO: 79045 - protein, 480 aa, Triticum aestivum
MVKICCLGAGYVGGPTMAVIALKCPDIQVVVVDITKSRIDAWNSDTLPIYEPGLDEVVKQCRGKNLFFSNDIEKHVSEADIIFVSVNTPTKTRGLGAGKAADLTYWESAARMIADVAKSDKIVVEKSTVPVKTAEAIEKILTHNSNGINFQILSNPEFLAEGTAIQDLFNPDRVLIGGRETPEGQKAVQTLKAVYAHWVPEDQILTTNLWSAELSKLAANAFLAQRISSVNAMSALCEATGANVSEVSYAVGKDSRIGPKFLNASVGFGGSCFQKDILNLVYICECNGLPEVANYWKQVIKINDYQKSRFVNRVVSSMFNTVANKKIAVLGFAFKKDTGDTRETPAIDVCKGLLGDKAKISIYDPQVTEDQIQRDLAMNKFDWDHPVHLQPMSPTTTKQVSVTWDAYEATKDAHGICIMTEWDEFKTLDYKKIYDSMQKPAFVFDGRNVVDSEKLREIGFIVYSIGKPLDGWLKDMPAVA

SEQ ID NO: 79046 - protein, 328 aa, Aspergillus nidulans FGSC A4
MSAGGEHLKDEGTRRQVVLAGGIAGLISRFCIAPLDVVKIRLQLQIHSLSDPTSHAHITGPVYKGTLSTIKTILREEGLTGLWKGNIPAELLYVCYGGIQFTTYRTTTQLLAQLDPHRLPQPIESFISGALGGGIATAATYPLDLLRTRFAAQGSGDNRVYESLFASLRDIAKTEGTVGFFRGCSAAVGQIVPYMGLFFATYEALRPVMATAPELSPIPLPPGSGDAAAGIVASVLAKTGVFPLDLVRKRLQVQGPTRALYVHRNIPEYRGVFNTMGLIFRTQGLRGLYRGLTVSLVKAAPASAVTMWTYERALKLLREHEIAAGRDE

SEQ ID NO: 79047 - protein, 493 aa, Lactobacillus sanfranciscensis
MPTENPTRATFMLFGGTGDLALRKLYPAIFNLYKKGSLSTHFALVGLSRKALTDEEFRAKIIESISSETDDKAQAEEFASHFYWKSHDVTNTDHYKELGKIADELDQKYETDGNRIFYVSMAPRFFGIVAKNLKEQGVLSTNGGFNRLVIEKPFGRDYASAKELNDELTSAFNENQIYRIDHYLGKETTQAIPVIRFGNPIIEAIWNQNYIKDVQITLAEKLGVEDRAGYYDTAGALRDMIQNHTLQIVSYLAMDEPNSFVDTEIRREKVKALESMEIYDADGVKQNFVRGQYGAGDGTPAYRDEPGVPHDSNNNTYAAGKIVFNNPRWGKTPFYIRSGKKLATKTGRIDIEFKKPIVDIFAKGTHQPAELKSNVLTLLIDPKIGITLEINTKNSAQGMHTETVDLSYLQSDARAAEVPLPYERLFHDILKGDGTYFASWPEVAAAWKYVDPVQKLWDTTQPDFPNYESGSMGPKAADELLARDGNSWYFPNK

SEQ ID NO: 79048 - protein, 239 aa, Herminiimonas arsenicoxydans
MGNLVIVRHGESQWNRENRFTGWTDIDLTANGIQQARNAGRALAEAGFRFDLALTSMLKRTIRSQWLMLDEMDAMYIPIISHWRLNERHYGALTGQNRAETIARFGEEQVWKWRRGFDSQPPLMDADDPRAPWREPRYQGIPRDSLPLGESLKETVERVRVFWDEVIVPALKQDKNVIISSHGNSQRALVKLLEDMSEEEVARFDVPNSVPLVYKLDTGLRVLSRSSMSIPHPEVSAIL

SEQ ID NO: 79049 - protein, 515 aa, Ralstonia solanacearum GMI1000
MSAVASLSPVSTAGHPRTQPTVKLLIGGEFVESRSAEWREVVNPATQEVLARVPFATRDEVDAAIRSAHAAFATWKHTPVGARMRIMLKYQALIREHLPRIARTLTAEQGKTLPDAEGDIFRGLEVVEHACSVGSLQQGEFLENVAGAVDTYTLRQPLGVCAGITPFNFPAMIPLWMFPMAIVCGNTFVLKPSEQDPLSTMLLVELALEAGVPPGVLNVVHGGKEVVDALCTHELVKAVSFVGSTAVGTHVYRLAGEHGKRVQSMMGAKNHAVVLPDANREQTLNALVGAAFGAAGQRCMATSVAVLVGAAQQWVPELVEKARALKVNAGVEPGTDVGPVVSRAARQRILDLIESGVRQGATLALDGRGVRVAGYEDGNFIGPTVFTGVKTDMDIYRNEIFGPVLLVLTAPTLDEAIALVNRNPFGNGVGLFTQSGAAARRFQSEIDVGQVGINIPIPVPVPYFSFTGSRGSKLGDLGPYGKQVVQFYTQTKTVTARWFDDAIEAGGVNTTISLR

SEQ ID NO: 79050 - protein, 205 aa, Triticum aestivum
RWWAQLRVHATLHNTGKDIVMSFEQGGEPVMPGSINVTTADGTVKEFKLKMIHWHAPGEHTVNGKRFPLELHMVHVDDQDHKAVIGILYEIGNPDPFYDQLTEKLRELKTTPTVAAGVVELKSLQKRTGSYFRYMGSLTTPPCTEKVMWNILGKGRELSQEQLQLITAPLPHQDNRPPQPLNGRQVAFYNPPNTIISIQSLVLPP

SEQ ID NO: 79051 - protein, 605 aa, Ralstonia solanacearum GMI1000
MRMNHAPGLLLPNLPRRRFVQGLAAGGVIAGLGLGGIAPSAAAAGATALGTAPVLRGTEFDLVIDETPVNFTGKPAMATTVNGMLPGPTLRWREGDTVTLRVTNRLREPTSIHWHGILLPFQMDGVPGLSFHGIAPGETFTYRFQVRQSGSYWYHSHSGFQEMTGVYGGLIIDPAGSDPIRADRDYTVLLADWTDEDPMRILAKLKTQSDYYNYHQPTVADFFRDVASDGWQAALAKRRMWNQMRMSPTDLADLSGATLTHLANGITPAGNWTGLFAPGETVRLRFINGAGSTFYDVRIPGLKLKVVQVDGQDIEPVTVDEFRFGPGETCDVLVSPKDDAHTIFCQSMDRTGYARGTLAVRPGMQAPVPALDTPQWLTMTDMMGDMGGMGGMDHGGMTMMDAGDITPMAPADTDGMAMMDGSGGPDDLRVPSRKVRHARTEYGPGTDMRVDTPRTNLDDPGIGLRGNGRRVLVLADQHTLGGPLDRRGPQREIEMHLTGNMERYTWSIDGVEYGRSAPIHFRHGERLRVILHNDTMMTHPMHLHGMWSELEAPDGRFQVRRHTVPVQPAQRISFLVTADALGRWAWHCHLMLHMDAGMFREAVVA

SEQ ID NO: 79052 - protein, 459 aa, Mycobacterium avium 104
METYDLAIIGTGSGNSLLDARFAGKRTAICEHGTFGGTCLNVGCIPTKMFVYAADVATTIREAARYGVDAHLDGVRWPDIVSRVFGRIDPIALSGEEYRRSSVNIDLYRSHTRFGPVQSDGRYLLRTDAGEQFTAEQVVIAAGSRPVIPPAILESGVTYHTSDTIMRIPALPEHLVIVGSGFVAAEFAHIFSALGVHVTVVIRSGRMLRQYDDMICERFTRLAAAKWELRTQRNVVGGNNRGSGVTLRLDDGSTLDADVLLVATGRISNADLLDAGQAGVDVENGRVVVDEYQRTSARGVFALGDVSSPYQLKHVANHEARVVRHNLLCDWDDTESMAVTDHRYVPSAVFTDPQLATVGLTENQAIARGFDISVAIQNYGDVAYGWAMEDTTGVVKLIAERTSGRLLGAHIMGPQASSIIQPLIQAMSFGLTAAQMARGQYWIHPALPEVVENALLGLY

SEQ ID NO: 79053 - protein, 648 aa, Aspergillus nidulans FGSC A4
MELESSAFPKTLAEQDNTMVPRNEQSSLKRSRVTADHESQDQKKPRRSERISSQQQSQTPVIQSYLPTPLTHHDSTATDLRNEMTATPPSQALPRSPSDLGSPPGDTQALSQFVYPPRAFADDVEDEAAEGVWGYLIPLDDKVRDALVLRKRDGCDAKPTKERSSKERKSRESSTKHAANRRPGGYLIGRHPECDLSLNIPTVSNRHFLVFPENRRGDTVAILEDLSSNGTFINDAIVGRNKHRELEDGDEVTVLDEVRFVFRAPRTKNISGFRQQYRVLQQLGKGHFATVYLCVERTTGAKFAVKVFEKRADSKSQNDALMQEIGLLMSVSHPNLLCLKDTFDESDGVYLVLELAPEGELFNMIIRKQKFTEKETRHIFRQLFEGLKYLHDRGIVHRDIKPENILVADNKLTVKLGDFGLAKIIGEDSFTTTLCGTPSYVAPEILQESRRRKYTKAVDIWSLGVVLYICLCGFPPFSDELYTPENPYTLAQQIKLGRFDYPSPYWDSVGDPALDLIDRMLTVDVDKRITVDECLQHPWLTGELPSVTDSTDGLTGALGNLDFSKRKIARERTLLSGINDVRSSQQKTGDGASVKVYHKNIAGQRMHNQRATRQHEFPNKNSGPKDFVNLGECGDPVLFEEEPTSRHN

SEQ ID NO: 79054 - protein, 232 aa, Pyrococcus abyssi GE5
MIEDKRWKGVYSFEDSPFIMEILTQLRDKNTDSIEFRKGLVKLGRYMGYELTKTMEVEKVKVETPLEETEGIIVKDRRNVVIITVLRAAIPLMEGLIKVFEHARVGIVSAVRGKAPEFKIEMDYVKIPQIKPEDTVIVADPMIATGSTLTRVLGEVKKYGEPKRTIVLGVLAAPEGISKIKSEFPDVEIFVAKIDRELDHKGYILPGLGDAGDRAFGEPLKLSTLPQVHHIE

SEQ ID NO: 79055 - protein, 498 aa, Cephalanthus occidentalis
  misc_feature (1)..(3): Xaa can be any naturally occurring amino acid
XXXNPTTSGSGVSTLEKKNLGRIVQIIGPVLDAAFPPGKMPNIYNALVVKGRDTVGQSINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMENNLKK

SEQ ID NO: 79056 - protein, 106 aa, Brassica napus
MICTESNHQRISFSSDLGQSDNAPPPPPVIEPPALIRRDESLLDSSNSSFEFHISNNFDPGDSSPADEIFADGMILPFHVTPPSTSPKRLYKYELPPITSSLSPSP

SEQ ID NO: 79057 - protein, 248 aa, Catharanthus roseus
FAGFKAVGEGVQKPLMYYNNNLIGTITLLEVMAAHGCKKLVFSSSATVYGWPKTVPCTEESPICAANPYGRTKLFIEEICRDVQRADSEWKIILLRYFNPVGAHPSGYIGEDPRGIPNNLMPFVQQVAVGRRPALTVFGTDYSTKDGTGVRDYIHVVDLADGHIAALAKLSDPSIGCEVYNLGTGKGTSVLEMVAAFEKASGKKIPLLMAGRRAGDAEVVYASTEKAERELKWKAKYGIEEMCRDQWN

SEQ ID NO: 79058 - protein, 318 aa, Arachis hypogaea
VMHRDLKPESFLFANKKENSPLKAIDFGLSVFFKPGEKFSEIVGSPYYMAPEVLKRNYGPEIDIWSAGVILYILLCGVPPFWAESEQGGAQAILRGLIDFKREPWPSISESAKSLVKQMLEPDPKLRLTAKQVLEHPWIQMLRRAPNIPLGDAVKSRLKQFSMMNRFQKKALRVIADFLSNEEVEDIKDIFQKMDTDNDGIVSIEELKAEFQNFGSQLAESEIQMLLEAVNTNGKGTLDYGEFVAVSLHLKRMANDEHLRKAFSYFDKDGNGYIEPDELRNALMEDGTDDCADVANDIFQEVDTDKDGRISYEEFVAM

SEQ ID NO: 79059 - protein, 164 aa, Pseudoalteromonas tunicata D2
MVIFYIPGEWAYFGAAFVFWLASITDILDGYLARKLQQSTPFGAFLDPVADKVMVCVALVILVEHYQSLYVTVPAMIIISREIVISALREWMAEQGKRGNVAVSQLGKIKTAAQMLAIIGLIWQFEPWMTQLSFGLFYIATFLTFWSMVQYLTAAWSELQKSSS

SEQ ID NO: 79060 - protein, 108 aa, Leymus cinereus
KKMVMPTDPMLWHKVAAVSGVAALGLGTYGAHMFRPQNPRYKEIWQTASLYHLVHTAALLGAPMTKRPNIFGGLLTTGIVLFSGTCYSVAYLEDRKFSSPAPIGGFAF

SEQ ID NO: 79061 - protein, 420 aa, Microcystis aeruginosa PCC 7806
MTIIQEKTLAQKVRADFPILHQTVHDKPLIYLDSAATSQKPIQVLETLRNYYEKDNANVHRGAHTLSVRATEAYEGARDKVARFINAASRQEIVYTRNATEAINLVAYSWALNTLKAGDEIILSVMEHHSNLIPWQIVCQKTGAVIKYVQLTSDESFDLEQYKSLLSEKTKLVAVLHVSNTLGCINPVAEIVSLAHQVGAKVLIDACQSVPHLAIDVQSIDCDWLVASGHKMCAPTGIGFLYGKEAILEAMPPFFGGGEMIAEVYLDHFTCAELPHKFEAGTPAIGEAIALGAAVEYLMGLGMDNIHAYEEELTAYLFKKLGEIEGLRIYGPPPSLTGQGRASLAAFNVEGIHASDLATLLDHEGIAIRSGHHCTQPLHRLFDASGSARASLYFYNTREEIDSFIVALQETIDFFANCFS

SEQ ID NO: 79062 - protein, 176 aa, Neisseria meningitidis Z2491
MNAIRTFQNRTPEIHESCMIDEACVVIGEVSLAEDVSVWPCAVLRGDVNSITVGARSNIQDGSVLHVSHKTAAKPEGSPLVIGEDVTVGHKVMLHGCRIGNRVLVGMGTTVLDDAVIEDEVMIGAGSLVPPRKRLAGGYLYVGSPVRQVRVLTDEEKAFLKYSAAHYVKLSKQYGM

SEQ ID NO: 79063 - protein, 460 aa, Arabidopsis thaliana
MESDLGKLFIGGISWDTDEERLRDYFSNYGDVVEAVIMRDRATGRARGFGFIVFADPCVSERVIMDKHIIDGRTVEAKKAVPRDDQQVLKRHASPIHLMSPVHGGGGRTKKIFVGGLPSSITEEEFKNYFDQFGTIADVVVMYDHNTQRPRGFGFITFDSDDAVDRVLHKTFHELNGKLVEVKRAVPKEISPVSNIRSPLASGVNYGGGSNRMPANSYFNNFAPGPGFYNSLGPVGRRFSPVIGSGRNAVSAFGLGLNHDLSLNLNPSCDGTSSTFGYNRIPSNPYFNGASPNRYTSPIGHNRTESPYNSNNRDLWGNRTDTAGPGWNLNVSNGNNRGNWGLPSSSAVSNDNNGFGRNYGTSSGLSSSPFNGFEGSIGELYRGGSVYSDSTWQQQQLPSQSSHELDNLSRAYGYDIDNVGSDPSANDPETYNGSYNVGNRQTNRGNKKIHLNKTCNLDTF

SEQ ID NO: 79064 - protein, 588 aa, Capsicum annuum
MASFSVKFSATSSLTSSKRFSKLHATPPQTVAVPPSGAVEVAAERLEPRLEERDGYWVLKEKFRKGINPAEKAKIEKEPMKLFTENGIEDIAKISLEEIEKSKLAKDDIDVRLKWLGLFHRRKHQYGRFMMRLKLPNGITTSAQTRYLASVIRKYGKDGCADVTTRQNWQIRGVVLPDVPEILKGLDEVGLTSLQSGMDNVRNPVGNPLAGIDPQEIVDTRPYANLLSNLLSQYVTANFRGNLSVHNLPRKWNVCVIGSHDLYEHPHINDLAYMPATKDGRFGFNLLVGGFFSPKRCAEAIPLDAWVPADDVVPVCKTILEAYRDLGTRGNRQKTRMMWLIDELGVEGFRAEVVKRMPQKKLERESTEDLVQKQWERREYLGVNPQKQEGYSFVGLHIPVGRVQADDMDELARLAEEYGSGELRLTVEQNIIIPNIENSKIDALLNEPLLKQISPDPPILMRNLVACTGNQFCGQAIIETKARSMKITEEVQRLVSVTQPVRMHWTGCPNSCGQVQVADIGFMGCLTRKEGKTVEGADVFLGGRIGTDSHLGDIYKKSVPCEDLVPIIVDLLVNNFGAVPREREEAED

SEQ ID NO: 79065 - protein, 326 aa, Senecio squalidus
MEVYSHIRTPIILFVVIFAALTSLALGCKVGFYQATCPRAESIVQSVVKSAIRSNPTYAPGILRLFFHDCFVNGCDASVLLDGSTSEQTASTNSHLRGFEVISTAKARVETECPGVVSCADILALAARDSVVETGLPRWEVPTGRRDGLVSRAEDALKLPGSRDSAEVQIEKFAAKGLNIEELVTLVGGHTIGTSACARFVHRLYNYSNTNAPDPHIDQAFLPHLQTLCPEHGDRTIRVDLDTGSVNNFDTSYYENLRKGRGVLESDTKLWTHHITQNLVQQFISVGRPNQLTFSKKFARAMVKLSQVEVKTGNEGEIRRVCNRIN

SEQ ID NO: 79066 - protein, 326 aa, Senecio squalidus
MEVYSHLRTPIILFVVVFAALTSLALGCKVGFYQATCPKAETIVQSVVKSAIRTNPTYAPGILRLFFHDCFVNGCDASVLLDGSTSEQTASTNSHLRGFEVITAAKDRVETECPGVVSCADILALAARDSVVETGLPRWEVPTGRRDGLVSRAEDALKLPGSRDSAEVQIEKFAAKGLNIEELVTLVGGHTIGTSACARFVHRLYNYSNTNAPDPHIDQAFLPHLQTLCPEHGDITIRVDLDTGSVNNFDTSYYENLRKGRGVLESDTKLWTHHITQNLVQQFISVGRPNQLTFSKKFARAMVKLSQVEVKTGNEGEIRRVCNRIN

SEQ ID NO: 79067 - protein, 381 aa, Oryza sativa
MVKASMKPYFVAIIVQLIYTGMFVISKAAFNHGMNTYIFIFYRQAVGSLILLPAALLQRKSARQVMTLGVLIKLFFCALIGITLGVNLYHVSLKFTSATVASAVDSSLPAITFFLAVLLRTEYVKLRSSSGIAKVTSVALCLAGVFTIAFFTGPSISPINHHRAFASDAGSKNVVPRGVWIKWTFLMVIANMCWSLWIIFQAAVQKEYPDKMIVTLTQCLFSTVQSFVVAVVAERDFSKWKLRFDISLLAILYSGVMVTGVSYYLQTWCLEMRGPMFFASWTPLCFVFTIFCSSFFLGEIVHLGSILGGILLVGSLYTMPWPGETLERNHLQTPSPDSSLQRHGLTALDSRPPLWKPSPPPSAPRFEAPSAWVEEGADPLA

SEQ ID NO: 79068 - protein, 484 aa, Aggregatibacter actinomycetemcomitans
MSVKGDIGVIGLAVMGQNLILNMNDHGFKVVAYNRTTSKVDEFLEGAAKGTNIIGAYSLEDLANKLEKPRKVMLMVRAGEVVDHFIDALLPHLEAGDIIIDGGNSNYPDTNRRVAALREKGIRFIGTGVSGGEEGARHGPSIMPGGNEEAWQFVKPVLQAISAKTEQGEPCCDWVGKDGAGHFVKMVHNGIEYGDMQLICEAYQFLKEGVGLSDDELQATFNEWRNTELDSYLIDITADILGYKDADGSRLVDKVLDTAGQKGTGKWTGINALDFGIPLTLITESVFARCVSAFKDQRVAASKLFHKTIGKVEGDKKVWIEAVRKALLASKIISYAQGFMLIREASEHFNWNINYGNTALLWREGCIIRSRFLGNIRDAYEANPDLIFLGSDSYFKGILENAMSDWRKVVAKSIEVGIPMPCMASAITFLDGYTSARLPANLLQAQRDYFGAHTYERTDKPRGEFFHTNWTGRGGNTASTTYDV

SEQ ID NO: 79069 - protein, 626 aa, Mannheimia succiniciproducens MBEL55E
MSKQIQIPDIGADEVTVTEVMVKVGDTVTEEQSIINVEGDKASMEVPSPEAGVVKEILVKVGDKVTTGSPMFVLESADSAPASAPQAAAVAPAAAPTTSAVIEIHVPDIGSDEVNVTEIMVKVGDSVAEEQSIINVEGDKASMEVPAPQAGVVKEILIKEGDKVSTGSLIMKFEVAGGAPAAETPATTVQAAPAVSAVQDVNVPDIGGDEVNVTEIMVKAGDSVAEEQSLITVEGDKASMEVPAPFAGVVKEILVKSGDKVSTGSLIMRFEVAGSAPAVQAAAPAQAAPAPVAPAPQAAPAQSLAPVNQDSIATSASYAHATPVVRRLAREFGVNLDKVKGTGRKGRILKEDVQEYVKNALKALESGATASTGAASGAGLGLLPWPKVDFSKFGEVEEIELTRINKISGANLHRNWVMIPHVTHFDRADITDLEAFRKEQNVLAEKQKLGVKITPVVFIMKAAAKALEAYPRFNSSISEDGQRLTLKKYVNIGVAVDTPNGLVVPVFKDVNKKGIIELSRELMEVSKKARDGKLTASDMQGGCFTISSIGGLGTTHFAPIVNAPEVAILGVSKSEMAPVWNGKEFMPRLMLPLSLSFDHRVIDGADGARFISYINGVLSDLRRLVM

SEQ ID NO: 79070 - protein, 213 aa, Populus trichocarpa x Populus deltoides
MASISLPKHSLPSLLPTLKPITSSSQNLPILSKSSQSQFYGLKFSHSTSLSIPSSSSVKNTIFAKVNKGQAPPSFTLKDQDGKTLSLSKFKGKPVVVYFYPADETPGCTKQACAFRDSYEKFKKAGAEVVGISGDDPSSHKAFAKKYRLPFTLLSDEGNKIRKEWGVPADLFGTLPGRQTYVLDKKGVVQLIYNNQFQPEKHIDETLKLLQSL

SEQ ID NO: 79071 - protein, 475 aa, Mannheimia succiniciproducens MBEL55E
MSKEIKTQVVVLGAGPAGYSAAFRCADLGLETVLVERYSTLGGVCLNVGCIPSKALLHVAKVIEDAKHVEHHGIVFGEPTIDLDKVREGKNAVVGRLTGGLAGMAKMRKVTVVEGLAEFADSHTLVAKDREGNPTTIKFDNAIIAAGSRPVQLPFIPHEDPRVWDSTDALALREVPKNLLVMGGGIIGLEMGTVYSALGSQIDVVEMFDQVIPAADKDIVKIFTKRIEQKFNLLLETKVTTVEAKEDGIHVSMEAKDGKVETRVYDAVLVAIGRTPNGKLIGAEKAGIEVTDRGFINVDKQMRTNVPHIFAIGDIVGQPMLAHKGVHEGHVAAEVIAGKKHYFDPKVIPSIAYTEPEVAWVGKTEKECKAENLNYEVATFPWAASGRAIASDCADGMTKLIFDKDSHRILGGAIVGTNAGELLGEIGLAIEMGCDAEDIALTIHAHPTLHESVGLAAEVFEGSVTDLPNPKAKKK

SEQ ID NO: 79072 - protein, 348 aa, Herminiimonas arsenicoxydans
MPNSSTQQQIPVTLIPGDGIGPEIVDVVVRVFDALGNPFAWETQQAGVNALEKSGDLLPQVTLDSITRTGLALKGPLSTPIGGGFRSVNVRLRETFQLYANVRPARTIVPGGRYEKIDLVLVRENLEGLYVGHEHYVPIGDDAHAVAMATGINTRAGSRRISKFAFDYAVRNNRKKVTIVHKANVLKALTGLFLETAKQVGLNYANQVEFDDRIVDACAMQLVLNPWQFDVIVSTNLFGDILSDQIAGLVGGLGMAPGANIGERTAIFEAVHGSAPDIAGKGMANPTALLLAAALMLEHKGLNTQAGLLRDAIDSVLSTESGRTFDLGGTVSTSKYGDLLIERIRDAK

SEQ ID NO: 79073 - protein, 508 aa, Vitis vinifera
MVQLLLSEPSWSDGGDEDSVKLRISLLNKLESIICSLISSRARSEARVWLCNAMAGIRSIMPRHQRDLFVDLFRSKPWKRGLAAQLWRMIFEKMPHKAGKIIAKKSYMLENFFKGYSFNLVFVVARFSSGKYATRKGAKALSQFAFVNRDICWEELEWQGKHGQSPAMVATKPHYFLDLDVQRTVENFLEYVPEFWSSDEFAESLKDGEICSIDRKFFVDVFVDLMYKEDSRSVWEAIDEFLMEESFSSLCQHLLIVIEEPDFCLFLELIHKYINPKMEHKDFGRSSCWLEIILSKCSHFESIDHILLLNAVINQGRQLLRLVHDEDTQEEQAKIKDVVLQICTISSNANGLAPILKCFKTKTTEVIKWLGLQSWVLHYRLSEECLTPESWESLFLNNGISFHKSDKYALLHDDGFAEENGSDLDDRTSIRARRKKKEKSRKKRKKNFDHDDIYENELLGLGSHTGSWLLSTDGYSTSWSSVDLPEHLSKHCFSTWMSWIFTKASSVA

SEQ ID NO: 79074 - protein, 330 aa, Zea mays
  misc_feature (161)..(161): Xaa can be any naturally occurring amino acid
RSWRELPLCSSSRRLPWLPPQEPAGLDMNFYGSTCPRVEAIVKEEMVAILKAAPTLAGPLLRLHFHDCFVRGCDASVLLDSTPTSTAEKDATPNLTLRGFGSVQRVKDRLEEACPGTVSCADVLALMARDAVVLANGPSWPVALGRRDGRVSLANETNQLXPPPTANFTRLVSMFAAKGLSVRDLVVLSGGHTLGTAHCNLFSDRLYNFTGANSLADVDPALDAAYLARLRSRCRSLADNTTLNEMDPGSFLSFDSSYYSLVARRRGLFHSDAALLTDPATRAYVQRQATGLFTAEFFRDFADSMVKMSTIDVLTGQQQGEIRKKCNLVN

SEQ ID NO: 79075 - protein, 287 aa, Brassica napus
MAKDVEAVSGEGFQTRDYQDPPPAPLFDPAELTKWSFYRAVIAEFVATLLFLYITVLTVIGYKIQTDSTAGGVDCGGVGILGIAWAFGGMIFILVYCTAGISGGHINPAVTFGLLLARKVSLVRAILYMVAQCLGAICGVGFVKAFQSSYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWVGPFVGAAIAAFYHQFVLRASGSKSLGSFRSAANV

SEQ ID NO: 79076 - protein, 498 aa, Codonopsis pilosula
  misc_feature (1)..(4): Xaa can be any naturally occurring amino acid
XXXXPTTSGSGVSTLEKTSLGRIGQIIGPVLDVAFPPGKMPNIYNALVVKGRDTLGQPINVTCEVQQLLGNNRVRAVAMSATDGLMRGMEVIDTGAPLSVPVGGATLGRIFNVLGEPIDNLGPVDTRTTSPIHRSAPAFIELDTKLSIFETGIKVVDLLAPYRRGGKIGLFGGAGVGKTVLIMELINNIAKAHGGVSVFGGVGERTREGNDLYMEMKESGVINEQNFAESKVALVYGQMNEPPGARMRVGLTALTMAEYFRDVNEQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVSDEHYETAQSVKQTLQRYKELQDIITILGLDELSEEDRLTVARARKIERFLSQPFFVAEVFTGSPGKYVGLVETIRGFQLILSGELDGLPEQAFYMVGNIDEATAKAMNLEMESNLKK

SEQ ID NO: 79077 - protein, 498 aa, Cornus officinalis
  misc_feature (1)..(7): Xaa can be any naturally occurring amino acid
XXXXXXXLVLGISTLEKKNLGRIAQIIGPVLDVAFPPGKMPNIYNALVVKGRDTAGQPINVTCEVQQLLGNNRVRAVAMSATEGLTRGMEVVDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLASKGIYPAVDPLDSTSTMLQPRIVGEEHYEIAQRVKQTLQRYKELQDIIAILGLDELSEDDRLIVARARKIERFLSQPFFVAEVFTGSPGKYVGLAETIRGFQLILSGELDGLPEQAFYLVGNIDEATAKAMNLERESNLKK

SEQ ID NO: 79078 - protein, 164 aa, Dendrobium crumenatum
MVGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 79079 - protein, 209 aa, Brassica napus
MPGPVVEEVKIEEAIKEQMKLEKEDDVVVEDVKDGDEDDDVDDDDDDDDNVDGAGDNESSKQSRSEKKSRKAMLKLGMKPVTDVSRVTIKRSKNVLFVISKPDVFKSPNSETYVIFGEAKIDDMSSQLQAQAAQRFKMPDVASMIPPNAEAAAVAQEEDEDDDDVDETGVEAKDVELVMTQAGVSKAKATKALKANDGDIVSAIMELTT

SEQ ID NO: 79080 - protein, 50 aa, Zea mays
MYCRNAQPRLQIIGMNQRNTANVVEDLLGDCEYQLQAPYIMYRKAAQEGI

SEQ ID NO: 79081 - protein, 174 aa, Triticum aestivum
MAPAVMASSATTVAPFQGLKSTAGLPVSRRSSGSLGRVRDGGRIRCMQVWPIEGIKKFETLSYLPPLSTEALLKQVDYLIRSKWVPCLEFSKVGFVFREHNSSSGYYDGRYWTMWKLPMFGCTDATQVLNEVEEVKKEYPDAYVRVIGFGHLRQVQCVSSIGFRAPGCEESGQA

SEQ ID NO: 79082 - protein, 882 aa, Triticum turgidum
MYTKGPPLDVLRASISSAPSTSSHGSAQDDCDSLGDVYVWGEVVCDNSARTSSDTVIRSTGKTDFLLPKPLESNLVLDVYHVDCGVRHASLVTRNGEVFTWGEDSGGRLGHGTREDSVHPRLVESLAACNIDFVACGEFHTCAVTTTGELYTWGDGTHNVGLLGHGTDVGHWIPRRISGPLEGLQIAYVSCGTWHTALITSMGQLFTFGDGSFGVLGHGDLKSISCPREVESLSGLKTIAVACGVWHTAAIVEVIVTQSSATVSAGKLFTWGDGDKHRLGHGDKEARLKPTCVASLIDYDFYRVACGHSLTVGLTTSGKVWTMGNSVYGQLGNLNSDGRPCLVEDKIASEHVLQIACGSYHVAVLTSRSEVFTWGKGANGRLGHGDIEDRKVPTTVEALRDRAVRHIACGANFTAAICLHKWVSGADQSQCSSCRQPFGFTRKRHNCYNCGLVHCNACTSRKALRAALAPSPGKLHRVCDSCYSKLKNASSSANKKDLAPGESNGEARVGKSILSSNMDMIRSLDSKAAKQGKKTDALSFLRNPQVSSLLQLRDIAFSGGADLNRPAAPRAARTPAARSVTSSRAVSPFSRRSSPPRSTTPVPTTHGLSLSKSATDNLVKANELLSQEVERLRAQVDSLRNRCDHHELELHKSAKKVQEAMTLVAEESAKSKAAKEVIKSLTAQLKDMAERLPPEHGAYDFNEAKQVHVPNGVEPHVATYSSMNGKVHQARNELLNAPSTNSGRSPHSNGGISNQHKLLGNISENSEGSTHSLRITSPHGSDRPHRRAHSNSDEMLSASSRGDDNVSIDARSLQNGDDSYKPRGTISISSNQVQAEWIEQYEPGVYITLTTLRDGTRDLKRVRFRYFNYFLSCLLSSTPSVP

SEQ ID NO: 79083 - protein, 691 aa, Vitis vinifera
MGSSSEEEGDRFFDTREEFSDSASDGSVDFRSSNGVVDGDSDSFGYGLWIKNPQSVNERRDKFLKWMNLDMDQNRITSEESESESGDVCCDKIKIETDRATENSGAVLRNSVSEDRVSSIQCSMSFRSNGEELLEGVGSNRVVSMEEFQRTIGLSPLVQQHLQREVEEVSNSVDMKKKVKRGWLRRLGAVACVRDRQGEAGSTHATVGAKTRRVRVHPYRKRSKELSSLYKGREFAAHRGPILTMKFSLDGHYLASGGEDGIVRVWKIIEDGSSKEVDIQDIDPSSVYFTRNDSELTPLDVDKEKRGKKKRLKRSSDSTCVIIPPKVFRILEEPLHEFQGHSGDILDLSWSKKGYLLSSSTDKTVRLWQVGQEQCLRVFYHNDYVTCVDFNPVDDNYFISGSIDGKVRIWEVHRHKVVDWTDIRDIVTAVCYRPDGKGGIVGSMVGNCCFYDIIDNHLQVDAQIYLQGKKKLPGKRITGFQFSPSDPTKVMVASADSLVRILCGADVICKFRGVRNVGSHTSTSFTADGKHIVSASEDSNVHLWDYNNQDRASSRAKDIWSCESFLSHNATIAIPWCGMKTTTETCPSPTLTTSLPGFENGQEMASSPDCFSAAREFLLESLPRGSATWPEEKLPDSSPFSPSMRRSEYKFLKSACQNTASSPHTWGLVIVTAGWDGWIRTYHNYGLPHRL

SEQ ID NO: 79084 - protein, 198 aa, Acer saccharum
VTGLLDPPELIKPPKILVIEGLHPMYDERVRDLLDFSIYLDISNEVKFAWKIQRDMAERGHSLESIKASIEARKPDFDAYIDPQKQYADTVIEVLPTELIPDDNEGKVLRVKLIMKEGVKHFSPVYLFDEGSTISWIPCGRKLTCSYPGIKFAYGPDTYFDHEVSVLEMDGQFDRLDELIYVESHLSNISTKFYGEVT

SEQ ID NO: 79085 - protein, 793 aa, Lactobacillus reuteri
MEKREQMNVLWFDELHRSDVNLVGGKSSSLGEMTSAMKIPVPYGFATTTHAYRQFMAETGLNDQINKLLAEINDYENADELHRVCSHIRQMIVEAPMPSEIAMTIKKAYAALSEKMGETEPFVAIRSSATAEDLPNASFAGQQESYLNVRGAEMVLAKVQECYASLFTDRATYYRHKQHFPHEKVALSAAVQMMVFSKASGVMFSVNVANGNDAQIVIDTIWGLGEYIVLGKVTPDHFVINKNNLQVVERSVVPKAIELCQTPGGGVHEEPVPADRAIRPALTENQIHELAGYAKEIEKHYGCYMDMEFALDARTDRLWLVQARPETVWSNKNNKQATKESTVSMNKTKKILVKGLPASPGVSTGKVHVIADPKDIDEFEEGEILVTLMTSPDWVPAMKKAAAIITDNGGMTCHAAIVSREMQIPCIVGTKSCGQAVTEMLQDGEQVTVDAKNGVVYQGDLAEQFNGEKETTECHHAEYYAPTATRVMMNLGDPELAEKYAELPVDGIGLMREEFLWTTYIHDHPLYLIETGHPEKVVDMLADGIAKVARAIAPRPMVLRFSDFKSGEYRNLTGGDKYESHEPADLLGWRGASRYYDPKYIEAFKLELAAVKKVRREFQLKNLNVMIPFVRTVAEADKVTKLMAAAGLHRGPDFKVYMMAEIPSNIILADQFNKYVDGYSIGSNDLAMLILGCDRNNDTVAHLFDERNLAVKRAISHLIKAAHQDNKTVSICGQAPSEYPELASFLIQQGIDYISVNPDMVKETKQNVARIEQRIILDNATGKGRQAVENYAW

SEQ ID NO: 79086 - protein, 296 aa, Sulfolobus solfataricus P2
MSSNPFRIQNPQPQPQRQPRDLRKVNQQVQAVDLKVQMKMKNIKYKIGVVSGKGGVGKSFVSSNLAMAIAASGRKVGIVDVDFHGPSVPKMLGVRGQMLTADDKGINPVIGPFGIKVVSIDFLLPRDDTPVVWRGAIKHSAIKQFLGDVNWGELDYLIIDMPPGTGDEALSIAQLVPGITGFVIVTIPSEVSTLAVKKSINFARTVNTKILGVVENMSHFVCPSDGKVYYIFGEGKGKKMAEEMGVDLLGQVPLDPSIAEANDAGEPFFLKHPDSPTSKEFLNIADKVIKIVESNQ

SEQ ID NO: 79087 - protein, 455 aa, Physcomitrella patens subsp. patens
MVQRLGRESPPAQKPSVQARSVVSLILGGGAGTRLFPLTHRRAKPAVPIGGGYRLIDVPMSNCINSGINKIFILTQFNSASLNRHLARTYTFGNGVNFGDGFVEVLAATQTPGEAGMNWFQGTADAVRQFTWLFEDAKNKQVEHVLILSGDHLYRMDYMDFIQKHKDSGADITISCVPMDESRASDYGLMKIDDKGRVLYFNEKPRGVDLESMQVDTSVLGLSPEEAKKMPYIASMGIYVFRKDILLKLLRWRYPTSNDFGSEIIPAAAKEYNVQAYLFNDYWEDIGTIKSFFDANLALAAQPPKFKFYDATKPIFTSPRYLPPTKVEQCRIIHSIVSHGCFLRDCKVEHSLIGLRSRLESGVEVKNTMMLGADFYETDEERVALIAAGKVPMGIGKNTTIKNCIIDKNAKIGKNVVIANTDTVFEADRAKEGFYIRSGIVVIAKNATIKDNTVI

SEQ ID NO: 79088 - protein, 344 aa, Oceanicola granulosus HTCC2516
MQFKSDLADAVGNTPLIKLRKASEETGCTILGKCEFLNPGQSVKDRAALYIIRDAVERGELKPGGTIVEGTAGNTGIGLALVGASMGFRTVIVIPETQSQEKKDMIRLAGAQLVQVPAVPYRNPNNYVRYSGRLAEELRRTTEAGVIWANQFDNTANRQAHVEGTAPEIWEQTDGKVDGFVCAVGTGGTLAGVGMALQPKGVKVALADPGGSAVFDLLQNGEAKAEGTSITEGIGNGRITANLEGFTPDMAYKISDEEALPIVYDLLEQEGLCLGGSSGINVAGAIRMAKELGPGHTIVTVLCDYGNRYQSKLFNPDFLKSKDLPVPRWLEHGPTSIPGVFEDV

SEQ ID NO: 79089 - protein, 472 aa, Vitis vinifera
MGKIPPSFRTSTVPVTTLLKNPPAVLPKQSTVLETPQKPHHFPKKRPQPSGKTKKTRTPIEDPKSPVIFNSPNLLDAKKLFASITTTSTTPLDFRFHNALLQSYSSISTVNDSISFLRHMIKSQPSFSPERSTYHILLSQSCKSPNSDLSAVHQTLNLMVTHGFPPDRVTTDIAVRSLCSAGREEHAIELVKELSLKHSPPDSFTYNFIIRHLCKTRALSTVYNFIDELQNSFQLKPDLVTYTILIDNVCNGKNLREATRLLEVLGEAGFKPDCYVYNTIMKGYCILDKGSEAIGVYKKMKEEGVEPDLVTYNTLIFGLSKSGRVKEARKFLDIMAEMGHFPDAVTYTSLMNGLCREGNALGALALLEEMEAKGCSPNSCTYNTLLHGLCKLRMLERGIELYGVMKSGGMKLEKASYATFVRALCKEGRVAEAYEAFDYVVESKSFDDVTAYSTLENSLKWLRKAREQGLAS

SEQ ID NO: 79090 - protein, 373 aa, Acidobacteria bacterium Ellin345
MEAILALEDGRVFRGKGYGAASECIGEVVFNTSITGYQEIFTDPSYAGQIVVLANPQIGNYGTNPEDEEAVKPYIEGLIVREFSKVTSNWRSSDDANDYLERHNVPVLAEIDTRALVRHLRDNGVMRGVISTTEKDVAKLVAKAKSIPKMDGTDLAKVVTTPKLYNWAKGPIEIGKPTEIAQPRHKVVAYDFGIKHNILRMLTGSCCDVTVVPAQTSAEDVLAMKPDGVFLSNGPGDPEPVTYAQKSIQGLMGRVPVFGICLGHQLVGLALGGKTYKLKFGHHGGNHPVKNNTTGKVEITAHNHNFAVDPDSLKQSEVELTHVDLNDNTLEGLRHRSLPLFSVQYHPEASPGPHDSHYLFGDFVKMMDEWKGK

SEQ ID NO: 79091 - protein, 500 aa, Neisseria meningitidis Z2491
MAKVLIVPVSAGLDASAVAQAFAKALDAQIFQAVDATAETLLAQGKSDDWFDALVGKVAALDAANLVIEGIAPDADKIYLAGKNVELALSLDAAAVFAVRSDNADADELANRLNLAKQFFAAAPGVLEGFVVDGAAASVAEAAAEKTGLTFFGSSDALKDVSVLAGREAKRLSPAQFRYNLIDFARQADKRIVLPEGAEPRTVQAAAICHEKGIARCVLLAKREEVEAVAKERGISLPDSLEIIDPASLVEQYVEPMCELRKSKGLTPEDARKQLQDTVVLGTMMMAQNDVDGLVSGAVHTTANTIRPALQLIKTAPGASLVSSVFFMLLPNQVLVFGDCAVNPNPTAQQLADIAIQSADSAKAFGIDPKVAMISYSTVNSGSGPDVDTVIEATKLAQEKRPDLAIDGPLQYDAATVPGVGKSKAPGSPVAGQATVLVFPDLNTGNCTYKAVQRSANVLSVGPLLQGLRKPVNDLSRGALVEDIVFTIALTAVQAKQMEG

SEQ ID NO: 79092 - protein, 523 aa, Clitoria ternatea
MFLLREIGVSILIFMITHLVIRLVLKEKEQRKLPPGPKGWPIVGALPLMGSMPHVTLSEMAKKYGPVMYLKMGTNNMAVASTPSAARAFLKTLDLNFSNRPPNAGATHLAYDAQDMVFADYGSRWKLLRKLSNLHMLGGKALEEWSQVREIEMGHMLRAMYDCSGGGDGNNDNDGNKKKGTRHEPIVVAEMLTYAMANMIGQVILSRRVFETKGSESNEFKDMVVQLMTVAGYFNIGDFIPFLARFDLQGIERGMKTLHNKFDVLLTTMIHEHVASAHKRKGKPDFLDVLMAHHTNESHELSLTNIKALLLNLFTAGTDTSSSIIEWALAEMLINPKIMKKVHEEMDKVIGKDRRLKESDIENLPYLQAICKETYRKHPSTPLNLPRISSQACQVNGYYIPKNTRLSVNIWAIGRDPNVWENPLEFNPERFMGANKTIDPRGNDFELIPFGAGRRICAGTRMGIVLVQYILGTLVHSFDWKLPNGVVELNMEETFGLALQKKIPLSALITPRLPPTAYNVINS

SEQ ID NO: 79093 - protein, 494 aa, Candidatus Kuenenia stuttgartiensis
MKGKNYINGAFVDSASSEVFESRNPAYCDEVLGTFPLSSADDVNNAVLAAKTAYDTWRKISRIRRGEYLDELAQLLKKDREAISQLVSKECGKGIAEGRADVTEGIHMVQYIFGTTRMPHGDIIDSEIVEKDSFMRRRPKGVVAAITPWNFPFAIPLWLICPSVVEGNTVVLKPSRETPCVANKIAEYVHAAGFPPGVINVIHGGCGDALVRHSDTQVILFTGSCEVGEGIKKIAAESYNKMCACEMGGKNAIIVLDGANMEIAVNASILSAFKTSGQRCTSAGRLILHVNMLEEFEKRFVELAKRIKIGNPLDEEVFMGPVINQAATEKILRYNDFAKNEGAEVLLDGSRLTGGGYDKGYFMSPFVYRMKNNPKSRVLHEEVFGPHVAIIPVESIDEAINVYNDTEYGLSCAVITEDFRKARRIRDDCEYGLGYVNLPTIGAEVHLPFGGLKKSGTGLPSASTLIDAVTHRTAWTVNHDLEIKMAQGLSAKLS

SEQ ID NO: 79094 - protein, 479 aa, Mannheimia succiniciproducens MBEL55E
MSRRLRRTKIVCTMGPATDKGNNLEKIIAAGANVVRMNFSHGTPEDHIGRAEKVREIAHKLGKHVAILGDLQGPKIRVSTFKEGKIFLNIGDKFILDAEMPKGEGNQEAVGLDYKTLPQDVVPGDILLLDDGRVQLKVLATEGAKVFTEVTVGGPLSNNKGINKLGGGLSADALTEKDKADIITAARIGVDYLAVSFPRSSADLNYARQLAKDAGLDAKIVAKVERAETVETDEAMDDIINAADVIMVARGDLGVEIGDPELVGVQKKLIRRSRQLNRVVITATQMMESMISNPMPTRAEVMDVANAVLDGTDAVMLSAETAAGQYPAETVAAMAKVALGAEKMPSINVSKHRMNVQFESIEESVAMSAMYAANHMRGVAAIITLTSSGRTARLMSRISSGLPIFALSRNESTLNLCALYRGVTPVHFDKDSRTSEGAKAAVQLLKDEGFLVSGDLVLLTQGDASSSSGTNLCRTLIVE

SEQ ID NO: 79095 - protein, 326 aa, Senecio squalidus
MEVYSHLRTPIILFVVVFAALTSLALGCKVGFYQATCPRAETIVQSVVKSAIRSNPTYAPGILRLFFHDCFVNGCDASVLLDGSTSEQTASTNSHLRGFEVISAAKARVETECPGVVSCADILALAARDSVVETGLPRWEVPTGRRDGLVSRAEDALKLPGSRDSAEVQIEKFAAKGLNIEELVTLVGGHTIGTSACARFVHRLYNYSNTNAPDPHIDQAFLPNLQTLCPEHGDRTIRVDLDTGSVNNFDTSYYENLRKGRGVLESDTKLWTHHITQNLVQQFISVGRPNQLTFSKKFARAMVKLSQVEVKTGNEGEIRRVCNRIN

SEQ ID NO: 79096 - protein, 326 aa, Senecio squalidus
MEVYSRIRTPTILFVVIFAALTSLALGCKVGFYQATCPRAESIVQSVVKSAIRSNPTYAPGIPRLFFHDCFVNGCDASVLLDGSAPEQTASTNSHLRGFEVISTAKARVETECPGVVSCADILALAARDSVVETGLPRWEVPTGRRDGLVSRAEDALKLPGSRDSAEVQIEKFAAKGLNIEELVTLVGGHTIGTSACARFVHRLYNYSNTNAPDPHIDQASLPHLQTLCPEHGDRTIRVDLDTGSVNNFDTSYYENLRKGRGVLESDTKLWTHHITQNLVQQFISVGRPNQLTFSKKFARAMVKLSQVEVKTGNEGEIRRVCNRIN

SEQ ID NO: 79097 - protein, 326 aa, Senecio squalidus
MEVYSHIRTPIILFVVIFAALTSLALGCKVGFYQATCPRAESIVQSVVKSAIRSNPTYAPGILRLFFHDCFVNGCDASVLLDGSTSEQTASTNSHLRGFEVISTAKARVETECPGVVSCADILALAARDSVVKTGLPRWEVPTGRRDGLVSRAEDALKLPGSRDSAEVQIEKFAAKGLNIEELVTLVGGHTIGTSACARFVHRLYNYSNTNAPDPHIDQAFLPHLQTLCPEHGDRTIRVDLDTGSVNNFDTSYYENLRKGRGVLESDTKLWTHHITQNLVQQFISVGRPNQLTFSKKFARAMVKLSQVEVKTGNEGEIRRVCNRIN

SEQ ID NO: 79098 - protein, 306 aa, Hevea brasiliensis
MSVSGNSKSTQFDLKTYWMTLISEINQKLDQAIPIQYPEEIYEAMRYSVLAKRTKRAPPVMCIAACELFGGNRLAAFPTACALEMVHAASLIHDDLPCMDDAPSRRGQPSNHAVYGVDKAILAGDALFPLGFRHIVSNTPSDLVPEPRLLRVIAEIARAVGSTGMAAGQFLDLEGSLNSAEFVQEKKYGEMGECSAVCGGLLAGAEDDEIQRLRRYGRAVGVLYKVIDDVLEAKSMSKEDEENEKKKAKSYVSLYGVEKAVEVAEELRTKAKKELDGFEKYGESVQPLYNFVDYAADRGFSVLELN

SEQ ID NO: 79099 - protein, 289 aa, Neisseria meningitidis Z2491
MKPIRKAVFPVAGMGTRFLPATKASPKEMLPIVDKPLIQYAVEEAVEAGCTEMVFVTGRNKRSIEDHFDKAYELETELEMRHKDKLLEHVRNILPPNITCLYIRQAEALGLGHAVLCARAAIGDEPFAVILADDLIDAQKGALKQMVEVYERSGNSILGVETVEPSQTGSYGIVETEQLKQFQRITGIVEKPKPEDAPSNLAVVGRYILTPRIFDLLTGLPRGAGNEIQLTDGIAKLLDHEFVLAHPFEGTRYDCGSKLGYLEATVAYGLKHPETGEPFRRLLEKYRTE

SEQ ID NO: 79100 - protein, 534 aa, Rhodospirillum rubrum ATCC 11170
MLTSRLARRGMVSAPHHLAAQAGLDILREGGNAIEAMIAAASACAVLYPHMTGIGGDGFWIIHEPGRPPLSIDASGAAGAGASLAVYRERGLARVPIHGALAACTVAGALSGWQSALDVSSRWGGRLPLSRLLGEAVGYARDGFAVSHSQERALRRLLGGLKDQPGFAAQFLEADGRVPRAGALQRNRPLAETLETLAADGLDSFYRGEVGQKVAAALKAVGAPVTAGDLARHRSIRRRPLTLALESAVLHTTPPPTQGLTTLMLIGLFQRAGLRDAEGAAFVHAMVEAAKVAYRVRDAKICDPRHMGVHPATYLSAQVLDGLAGEIAQGGGTPTPALSAAGDTVWMGAVDGEGRAVSFSQSLCHAFGSGVMLGDTGILWHNRGVAFALGDQAVNPLVPGRKPIHALNPLLARLRDGRTLVFGTMGGDGQPQTLAAIFARHVLFGQDPQAAISAPRWLLTGGPGGRDGLPLAALRLESRFDPRVVEGLRALGHCVTLTDAFDEAMGHAGALIRHPDGTIEGAFDPRSDGGLAGW

SEQ ID NO: 79101 - protein, 326 aa, Senecio squalidus
MEVYSHLRTPIILFVVVFAALTSLALGCKVGFYQATCPKAETIVQSVVKSAIRTNPTYAPGKLRLFFHDCFVNGCDASVLLDGSTSEQTASTNSHLRGFEVITAAKDRVETECPGVVSCADILALAARDSVVETGLPRWEVPTGRRDGLVSRAEDALKLPGSRDSAEVQIEKFAAKGLNIEELVTLVGGHTIRTSACARFVHRLYNYSNTNAPDPHIDQAFLPHLQTLCPEHGDITIRVDLDTGSVNNFDTSYYENLRKGRGVLESDTKLWTHHITQNLVQQFISVGRPNQLTFSKKFARAMVKLSQVEVKTGNEGEIRRVCNRIN

SEQ ID NO: 79102 - protein, 396 aa, Mannheimia succiniciproducens MBEL55E
MFKNITPAPADPILGLGEAFKAETRENKINLGIGVYKDADGVTPIMTAVKKAEGQLFENEKDKNYLPIEGVAEYNAYAKELLFGKDSEIIASNRACTVQTLGGTGALRIAAEFVRRQTKAQNVWISKPTWPNHNAIFNAVGVTIREYRWYNPETKALDWDNLLADLNNANPGDVVLLHGCCHNPTGIDPTPEQWKALAEMSAKNGWLPLFDFAYQGLANGLEEDAVGLRTFAETHRELLVASSFSKNFGLYSERVGAFTLVADNADVAAVALTQIKSIIRTLYSNPSAHGARTVATVLANPELRKEWEDELTSMRDRIKQMRKQLVELLKEFGAQEDFSYIIDQKGMFSFSGLTAEQVDRLKEEFAIYAVRSGRINVAGITEANIRYLAESIVKVL

SEQ ID NO: 79103 - protein, 457 aa, Symbiobacterium thermophilum IAM 14863
MTQTTRYVRLVTEVPGPRSRELMARKERVVANALSIHVPVAIQEARGALVTDVDGNVFIDLAGGMGCMNVGHSHPRVVEAIQRSAAQFTHTDFSVIMYESYIRLAERLAALAPGDFPKKACFFNSGAEAVENAIKIARKYTGRRAIIALEGAFHGRTNLAMALTSKVKPYKEGFGPFAPEIYRVPTPYTYRRPAGMSEAEYVRFCADALERALITHVSPDEVAAIILEPVQGEGGFIPLHPDYLARVSQLARKHGFLIIADEIQSGFGRTGTFFASEQLGLVPDLICVGKSLAAGMPLSGVIGRAEVMDAPEDSTIGGTYVGNPVACDAAHAVLDIMEEEGLVSRARAIGDLMRRRFQELAVQLESIPGSRLQIGEIRGLGAMLGVELVTDRATRAPATAEAAEVVKRAWQRGVVVVKCGIYGNTLRMLLPLVITDDQLNEALDIIGQICTEIARGE

SEQ ID NO: 79104 - protein, 159 aa, Bacillus thuringiensis serovar konkukian
MNISIISIGKLKEKYLKQGIAEYLKRLSAYAKVEVIELPDEKAPENLSEAEMLIVKEKEGIRILDKISDDTHVIALAIEGKQKSSEEFAVSLDRLATYGKSKVAFVIGGSLGLSSEVMKRSNESLSFSKMTLPHQLMRLVLLEQVYRSFRINRGEPYHK

SEQ ID NO: 79105 - protein, 509 aa, unidentified eubacterium SCB49
MQNNVLILDFGSQYTQLIARRVRELNIYCEIHPYNKVPEDLSSFKAVILSGSPSSVRAEDAPTPDLSNIKGKLPLLGVCYGAQFMAHNFGGEVAPSNIREYGRAKLSMIKEGEALFSNIAQDTQVWMSHSDTIASLPTGGVRLASTADVANAAYRIENEDTYAIQFHPEVYHTTDGKQLLENFLVHMAGVEQSWTPAAFVDTTVAELQKKIGDDKVVLGLSGGVDSTVAAILLHKAIGKNLYCIFVNNGLLRKNEFTDVLHQYKDMGLNVKGVDASKRFLDALAGLTDPEAKRKAIGNAFIEVFDDEATSIEDVVYLAQGTIYPDVIESVSVNGPSVTIKSHHNVGGLPDFMKLKIVEPLRMLFKDEVRRVGAEMGIDPLLLGRHPFPGPGLAIRILGDITEEKVRILQEVDAVFIDGLRKWNLYDKVWQAGAMLLPVNSVGVMGDERTYEKVVALRAVESTDGMTADWVNLPYEFLQETSNHIINRVKGVNRVVYDISSKPPATIEWE

SEQ ID NO: 79106 - protein, 764 aa, Opitutaceae bacterium TAV2
MDSANLIKDLGTVLLAGGVAGVICKRMGLSAIVGYLLAGMVIGPHTPPFSLIAEEERIKELSEVGLVFVMFAIGLHLSLSKMGKMGLATIGATFLGAFFMLNFTLILGHFLDWTAMQSMFVAAMLMVSSSAVIAKLMQEYNLNHERAAQMALAITIVEDVVAVIMLTLLVSHETGGGGVGGVIGVLGAFVVLLIGGGLLLMPRVLRRLEARGDPELQTVIVAGLLLLLSFFTVKAGYSLALGAFLFGAIVAEMRQKHAVEKSFESIRFLFSSVFFVSIGMMIDLGQLKEVWLTVLILCTFSLVFRPIACGFALILVGIAPREARRGGLLLTPLGEFTFIIAAAGIGASILPQSFYPLAVSLSVLTVLITPILNRYADPILKFADEVEPRWVTKAITAYHGWLRQLQSRPPSTLAWKLLRGRAFQVALECMFVSGLLIFSKYILAWLETTVVAVWLEGTTLRYVFWSVMAVFVLIPVVAVWRNISAIALITAEAIGGADGDRRRLPKRLIESSIKALGGLGMLYWLYAVLPVAALPGWGWAVIAGAGVVLAVVFSNRLVYWHSSWENSLHEVLAEDARMPEEVRAEARVALDESLGAWKLRLEECVVPDAASYAGQSLAQLAIPSRFSCSVLEVERNGHLITVAGSDLRLYPGDKILLLGPSEKLEEAREFLHAVKKHEVGEGEFGGSVLETFVLPTAMPAGRSLADLQIARDTGVRIAGIRRAGDQIINPTGAHTIEPGDNLLVVGSLVQLRAFGQWVKTLASS

SEQ ID NO: 79107 - protein, 364 aa, Cryptococcus neoformans var. neoformans B-3501A
MSLWSNIWLWIRYQVNVIIHCGFPCFFWVQPTWSIDKIENQEGKVVLITGGNSGTGYATALALYNAGATVYIACRNLTRAKEAAEDIKKGGERGIWGVTYPSKELDKAGGNKKGRVEIIQLDLTDLASVEKCAEEFLNKEKKLDLLFANAGIMATPEGQYTKQGYTLQLGTNTLGHHRLITLLLPLLLSSPPSLPSRVILTSSAGHSMAPKGGVNIKSVVRDPSDTGSGQGKYELDKWTEYAQSKWGNIASAKYLEDTYGKEGRLIAVAVHPGLVATNLTNHLPFVGIFYRWVPWLRHLFTRDPSTGALNQLYAATLPLPDAWFLNGEYVVPYNTVGICRSDLLDKKRIEEVWNWCDEQGKKFA

SEQ ID NO: 79108 - protein, 523 aa, Perilla frutescens
MAATAVFKSTPGKTAIANYSSLEDVNSTSFKRLSFAASNVAGERITSPPRLRVRRSRAGGELERRSPVIVSPKAVSDSQNSQTCLDPDASRSVLGIILGSGAGTKLYPLTKKRAKPAVPFGANYRLIDIPVSNCLNSNISKIYVLTQFNSASLNRHLSRAYASNMGGYKNEGFVEVLAAQQSPENPNWFQGTADAVRQYLWLFEEHNVLEFLILAGDHLYRMDYERFIQAHRETDADITVAALPMDEKRPTAFGLMKIDEEGRIIEFAEKPKGEQLKAMKVDTTILGLDDKRAKEMPYIASMGIYVVSKDVMLNLLRDEFPAANDFGSEVIPGATAMGLRVQAYLFDGYWEDIGTIEAFYNANLGITKKPVPDFSFYDRSAPIYTQPRYLPPSKMLDADVTDSVIGEGCVIKNCKIHHSVVGLRSCIAEGAIIEDTLLMGADYYETDADRRFLAAKGGVPIGIGKNTHIKRAIIDKNARIGENVKIVNGDNVQEAARETDGYFIKSGIVTVIKDALIPSGTMI

SEQ ID NO: 79109 - protein, 520 aa, Perilla frutescens
MAAVASSSPMGFSKICGLNSVSELSGQCKPTVGFSKSELFGGAVCVKSISKNGGRGNARTRLPSARVVSPKAVSDTSSSLTCLEPDANFSELAFFLEWSGTRLYLLRKKRAKPAVPIGANYRLNDIPVSNCLNSNVSKIYVLTQFNSAFLNRHLSRAYASNMGGYKNEGFVEVFAAQQSPENPNWFQGTADAVRQYLWLFEEHDVLEYLVLAGDHLYRMDYEKFVQSHRETDADITVAALPMDEKRATAFGLMKIDDEGRIIEFSEKPKGEALKAMRVDTTILGLDDERAKEMPYIASMGIYVFSKNAMLNLLRDKFPGANDFGSEVIPGATSVGLRVQAYLYDGYWEDIGTIEAFYNANLGITKKPVPDFSFYDRSAPINTQPRYLPPSKMLNADVTDSVIGEGCVIKNCKIHHSVIGLRSCISEGAIIEDTLLMGADYYETDSDRRILAAKGGIPIGIGKNSHIKRAIIDKNVRIGENVKIINSDNVQEAARETDGYFIKSGIVTVIKDALIPSSTII

SEQ ID NO: 79110 - protein, 323 aa, Zea mays
MDGEEAPLGALNLAEYAPAGARTVDCYRRIRKIGEGTYGEVFEAVDIITGERAALKKIKLDDGKEGFPRQILREIKLLKKLDHENIIRLKEIVVSPGSAHGTGGSDDHIYRGDIYMVFEYMDHDLKKVLHHSAPSQVKVYMGQLLKGLQYCHANNVLHRDIKGANLLITGGKLLKLADFGLARLFTRDGTLTNHVITLWYRPPELLLGATSYAEPVDIWSVGCIFAEFLLKKPLFPGRTEQEQLSKIFELCGSPNEESWPGVSKLPLYKTMTIRPATPTKRSLRDILQNFDCPAVELIERMLILNPSQRISAQDALGAAYFIN

SEQ ID NO: 79111 - protein, 527 aa, Perilla frutescens
MDACCATLKSTSHLSNVSKSAFCGEKNGFWGEKIKGSLNNCARAYQFGKKLNLEKRGRKIKPGVAYSVLTKKNINETLMIPPPLFEKRGANPKIVAAIILGGGAGKQLFPLTSKAATPAVPVGGCYRLIDIPMSNCINSGINKIFVLTQFNSASLNRHISRTYTGNGVSFGDGFVEVLAATHTAGETGNQWFQGTADAVRQFTWVFEDAKAKDIDNILILSGDHLYRMDYMDFVQNHIDRNADITLSCAPVCDSRASEYGLVKIDSRGRIILFSEKPKEADRMAMEVDTSIIGLSPEEALKSPYIASMGVYAFKTDVLLKLLRWRYPTSNDFGSEIIPSSVKEHNVQAYIFRDYWEDIGTIKSFYDANLALTDEFPKFEFYDPKTPFYTSLRFLPPTKIDNCKIKDAIISHGCFLRECVCQHSILGERSRLDSGVELKDTLMMGADYYPTESEIASLLVQGKVPMGIGRNTKISNCIIDKNARIGKDVIIKNKDGVEEADRSEEGFYIRSGITIVVEKATINDGTII

SEQ ID NO: 79112 - protein, 907 aa, Triticum aestivum
MYTKGPPLDVLRASISSAPSTSSHGSAQDDCDSLGDVYVWGEVVCDNSARTSSDTVIRSTGKTDFLLPKPLESNLVLDVYHVDCGVRHASLVTRNGEVFTWGEDSGGRLGHGTREDSVHPRLVESLAACNIDFVACGEFHTCAVTTTGELYTWGDGTHNVGLLGHGTDVGHWIPRRISGPLEGLQIAYVSCGTWHTALITSMGQLFTFGDGSFGVLGHGDLKSISCPREVESLSGLKTIAVACGVWHTAAIVEVIVTQSSATVSAGKLFTWGDGDKHRLGHGDKEARLKPTCVASLIDYDFYRVACGHSLTVGLTTSGKVWTMGNSVYGQLGNLNSDGRPCLVEDKIASEHVLQIACGSYHVAVLTSRSEVFTWGKGANGRLGHGDIEDRKVPTTVEALRDRAVRHIACGANFTAAICLHKWVSGADQSQCSSCRQPFGFTRKRHNCYNCGLVHCNACTSRKALRAALAPSPGKLHRVCDSCYSKLKNASSSANKKDLAPGESNGEARVGKSILSSNMDMIRSLDSKAAKQGKKTDALSFLRNPQVSSLLQLRDIAFSGGADPNRPAVPRAARTPAARSVTSSRAVSPFSRRSSPPRSTTPVPTTHGLSLSKSATDNLVKANELLSQEVERLRAQVDSLRNRCDHHELELHKSAKKVQEAMTLVAEESAKSKAAKEVIKSLTAQLKDMAERLPPEHGAYDFNEAKLVHVPNGVEPHVATYSSMNGKVHQARNELLNAPSPNSGRSPHSNGGISNQHKLLGNISENSEGSTHSLRITSPHGSDRPHRRAHSNSDEMLSASSRGDDNVSIDARSLQNGDDSYKPRGTISISSNQVQAEWIEQYEPGVYITLTTLRDGTRDLKRVRFSRRRFGEHQAENWWNENREKVYEKYNVRSSERVSSAASTRSAY

SEQ ID NO: 79113 - protein, 263 aa, Vibrio vulnificus YJ016
MTQPSLNPLVIKLGGAALSCSQTLSQLFGAIASYQQKEQRQIVIVHGGGYLVDELMEKLQLPTVKKNGLRVTPYDQIPLIAGALAGTANKLLQGQAMADGLNAIGLSLADGGLCQVEELDPELGAVGKATPGDSRLLQTILNAGALPIISSIGLTAQGQLMNVNADQAAVAVAGALDAQLVLLSDVSGVLDGKGHLIKSLNQQEADALIAGKVITDGMIVKVQAALEAANDLGRAIEVATWRYPENLEKLFAGESIGTQFLPA

SEQ ID NO: 79114 - protein, 446 aa, Triticum aestivum
  misc_feature (393)..(393): Xaa can be any naturally occurring amino acid
MASRIASRLLRRSSPTLGLLRSYTHVRNYSSQLSGLIPVGPQSSKLTRRNNYFPNASPYQLWSRSFASDNGDKFEAVVPFMGESVTDGTLANFLKKPGDRVEADEAIAQIETDKVTIDVSSPEAGVIEKFIASEGDTVTPGTIVAIVSKSAAPAETHVAPSEEAPQKESPPAKAEEKSPKAEEKPTKVEPPKKQAPKPTPSKTSPTEPQLPPKERERRVPMPRLRKRIANRLKDSQNTFAMLTTFNEVDMTNLMKLRSDYKDEFVKKHGVKLGLMSCFVKAAVSGLQNQPIVNAVIDGDDIIYRDYVDVSVAVGTSKGLVVPVIRDADTMNFADIEKGINNLAKKATEGALSIDEMAGGTFTISNGGVYGSLISTPIINPPQSAILGMHSIVXQRPVVVDGSILARPMMYLALTYDHRLIDGREAVYFLRRIKDVVEDPRRLLLDI

SEQ ID NO: 79115 - protein, 341 aa, Pisum sativum
MDHAGDAMRTDLMTITRYVLNEQSKRPESRGDFTILLSHIVLGCKFVCSAVNKAGLAKLIGLAGETNIQGEEQKKLDVLSNEVFVKALTSSGRTCILVSEEDEEATFIEPSLRGKYCVVFDPLDGSFNIDCGVSIGTIFGIYMVKDFETATLEDVLQPGKNMVAAGYCMYGSSCTLVLSTGSGVNGFTLDPSLGEYILTHPDIKIPNKGKIYSVNEGNAKNWDGPTTKYVEKCKFPTDGSSPKSLRYIESMVANVHRTLLYGGIFLYPGDKKSPNGKLRVLYEVFPMSFLMEQAGGQAFTGKQRALDLIPTKIHERSPVFLGSYDDVEDIKALYAAQEKTA

SEQ ID NO: 79116 - protein, 93 aa, Glycine max
MVFFFATAGIMFQDITTLLLDPKAFKDTIDLFVERYKGKNISVVAGIEARGFIFGPPIALAIGAKFVPLRKPKKLPGKVISQEYILEYGRDCL

SEQ ID NO: 79117 - protein, 384 aa, Microcystis aeruginosa PCC 7806
MENKNMLMIPGPTPVPEAVLLAMAKAPIGHRTGAFSKVIAELTENLKWLHQTSGDVLMLTASGTGVMEAGIINFLSPGDRVLVGDNGKFGERWGKVAKAYGLNVDIIKAEWGKPLDPEAFTAKLTEDKEKAIKAVIITHSETSTGVLNDLESINKAVKDHGEALIIVDAVTSLGAYNIPIDEWGLDVVGSGSQKGYMIPPGLGFVSVSKKAWKAYETAKLPRFYLDLGKYKKATDEDSSPFTPPVNLMYGLQASLQMMRREGLAAIFARHQRLTQMTRAGMRALDLPLYAADSWASTAITAVAPTLVDAEKIRSTLNKKFDIAVAGGQDHLKGKIFRIGHLGFASERDILTVIAAIEATLIELGVEGVTPGAGVAAAASVMVQG

SEQ ID NO: 79118 - protein, 177 aa, Neisseria meningitidis Z2491
MADFNQILTTGDVDGGIINVVNEIPAGSNHKIEWNRKLAAFQLDRVEPAIFAKPTNYGFIPQTLDEDGDELDVLLVTEQPLATGVFLEARVIGVMKFVDDGEVDDKIVCVPADDRNNGNAYKTLADLPQQLIKQIEFHFNHYKDLKKAGTTKVESWGDAEEAKKVIKESIERWNKQA

SEQ ID NO: 79119 - protein, 184 aa, Physcomitrella patens subsp. patens
MAKSKRELSCKHCMLGLILVLLFPMHSLVFQGIQILERGASVLFAIHDARDVFLEIGKLAKYSGMNYVPEIALERVKYTLNLVALKLLSWFYYQHNHIYWWVLIWRMLLRQIQNSGKVPDDVRSGFLIDSSNSASSTGFEKSEHEFQSQISTASVGRLHILTIKNACSEMTFTTESEGVGYKLA

SEQ ID NO: 79120 - protein, 295 aa, Capsicum annuum
RVGFYSSTCPRAESIVQSTVRSHFQSDPTVAPGLLRMHFHDCFVQGCDASILISGSGTERTAPPNSLLRGYEVIDDAKQQIEAICPGVVSCADILALAARDSVVVTRGLTWSVPTGRRDGLVSRASDTSDLPGFTESVDSQKQKFSAKGLNTQDLVTLVGGHTIGTSACQFFSYRLYNFNSTGGPDPSIDASFLPTLRGLCPQNGDGSKRVALDTGSVNNFGTSYFSNLRNGRGILESDQKLWTDDSTKVFIQRYLGLRGFLGLRFGVEFGRSMVKMSNIEVKTGTNGEIRKVCS

SEQ ID NO: 79121 - protein, 517 aa, Opitutaceae bacterium TAV2
MAIDPALLERLRKHREIALNGGGADKLAARRAKGLLTARDRIDALFTPGTFMESGMHAQHQATHFGMADKVLPCDGVITGVGHIDGRPVAAYAQDFTVGGGSLGQIHAKKICDAMEYAMEAGMPVIGINDSGGARIQEGDDALSGYGQIFFKNVLLSGVVPQISIIAGPCAGGAAYSPALTDFIIMTKKNAQMFICGPDVIKAATGATVTMDEVGSAQAHASVSGNIHFIAEDGPDAFRIARKLLSFLPSNNIMDPPHQPTPSISLEPDPRMNELVPADPKAPFDVHKVISYLVDEGDFLEVQRDFAKNIVVGFGRIQGIVVGIIANQPAFKAGCLDIDSSDKAARFIRFANIFNIPIVNLVDVPGFMPGVAQERGGIIRHGAKMLFAYAAATVPKITVIMRKAYGGAYLAMCSRDLGADLVYAWPCAEIAVMGAEGAANVLFKKEISAAADPKAKAAELAAEYREKFASPYEAASKAMITDIIEPAQTRAVVSMALRNTLSKRETRPPKKHGNIPL

SEQ ID NO: 79122 - protein, 502 aa, Chorispora bungeana
MAIPMPTRQLFIDGEWREPILKKRIPIVNPATEEVIGDIPAATTEDVEVAVNAARRAFSRNKGKDWAKAPGALRAKHLRAIAAKVTERKSDLAKLEALDCGKPLDEAVWDMEDVAGCFEFYADLAEGLDAKQKAPVSLPMENFKSYVLKQPIGVVGLITPWNYPLLMAVWKVAPSLAAGCTAILKPSELASVTCLELADICREVGLPPGVLNVLTGYGAEAGGPLASHPGVDKIAFTGSFATGSKVMTAAAQLVKPVSMELGGKSPLIVFDDVDLDKAAEWALFGCFWTNGQICSATSRLLVHENIAPQFIEKLVKWSKNIKISDPMEEGCRLGPVVSQGQYEKILKFISTAKSEGATILHGGSRPEHQEKGFFIEPTIITDVTTSMQIWREEVFGPVLCVKTFGSEDEAIELANDSHYGLGAAVISNDTERCDRVSQAFEAGIVWINCSQPCFTQAPWGGVKRSGFGRELGEWGLDNYLSVKQVTLYTSNEPWGWYKSPSA

SEQ ID NO: 79123 - protein, 461 aa, Mycobacterium avium 104
MTIHAAEATGSASVITDLRRVFSTGRTGDLHWRLGQLRGIERFVDERETEIAAALADDLGRSPAEAWLGDVASTKGEAVYARKHLKKWMRRRRQSLPLAQLPGRAWVQYDPLGVVLIIGPWNYPLYLSLAPLVAAVAAGNCAVIKPSELAPATSALLARWLPQYVDPEAVRVVEGDADVTQQLLATGFDHVLFTGGTEVGKKIMAAAAPTLTPVTLELGGKSPVIVTADADIDVAARRIAWVKLLNSGQTCIAPDYVLADHRVVKELVGKLVANMRDFRADQRNPALPIVNQRQFDRLVSLIDVTDGKVVAGGRADATTLRIEPTVIVDPPPNDPVMAEEIFGPILPVLSVESLDDAVRFVNARPKSLALYIFATGKVGRDLVDRIPSGGAVINHVAMHCLVPALPFGGVGASGMGAYHGKWGFETLSHRRAVLSKSPRPDPRLVYPPYSQRALGVMRKLF

SEQ ID NO: 79124 - protein, 699 aa, Kluyveromyces lactis NRRL Y-1140
MTMASKNFAAKRKRTRTLEGINESSTLRSQYMDGHMSDPIMTAAAAAAAAAAADVSTSSASNTGRMQNPFIEEFMSSNNDPMTADSLRGTLLLDVDRQGQNSGSFVTGIAANNRNSKQNENGNGFDLVDLDDSAVEFVNSVNYTSAKKVKKQRTVSLPQLPHARLLYEPRNTDRRTQNDDELLHVSGTTTQTVDGNKLIKLPLIRSLSPVPVADFRLGKNGGMQNNNQDQNFDISNSASKSPSRFTKILKKSPLLGSHQDKLRSMDRFKTDEEGHYVYQENDIFAKNRFQAMQLLGQGTFGKVVKCKDYLNDITVAVKIIRAVDRYRQAAKTELRVLQTIKENDRSGQYQCLLLREFFDYKNHICLVTDLYGRSVYDFMTNNGYARFPGSHVQAIGKQLVRSVCFLHDLGIIHTDLKPENILICDETCVEQSLPMEIIDSLTERRKLASGGKRKILINPEVKLIDFGSAVFYNEYHPPVVSTRHYRAPEIVLGLGWSFPCDIWSIACVLVELVTGESLYPIHENTEHMAMMQRINNEKFPKKMVEKMFFKVENKYGSIPTDLQTSVVKYFDRQTGELRWPLRNSKGQVITKEKSWKRILATCDRLDVFISKKLQMDYGSWLEIHWDMQLEDNWRLILSKNIDSRNIDKNVFMFWYYFVDLCRKMFEFDPTKRITAKEVIEHEWFNIGILDEGISHYGRL

SEQ ID NO: 79125 - protein, 197 aa, Acer saccharum
VTGLLDPPELIKPPKILVIEGLHPMYDERVRDLLDFSIYLDISNEVKFAWKIQRDMAERGHSLESIKASIEARKPDFDAYIDPQKQYADTVIEVLPTELIPDDNEGKVLRVKLIMKEGVKHFSPVYLFDEGSTISWIPCGRKLTCSYPGIKFAYGPDTYFDHEVSVLEMDGQFDRLDELIYVESHLSNISTKFYGEV

SEQ ID NO: 79126 - protein, 386 aa, Vibrio parahaemolyticus RIMD 2210633
MEMKTFNLPDLGEGLAESEIVKWHVNVGDMVKLDQVILTVETAKATVDVPAPYAGRIVSRHGEEGDVINIGALLLEIDESGAENTVSAEKRQTADAATVVGSVSHQSHNVNVDDFWVGGSHNKSTDKLITALPSARLLAKKLGVDLKTMVGSGPSGLIVDADVYEEAGKQVPGTEVLKGARRTMVSTMAESHQNVAAVTITEEALLEDWLPNEDISIRLVQAIVYACQQEPALNAWFDAETMTRCVHPTVNLGVAVDSRHGLYVPVLRHADEYEPQDVRRWLDQTVKGIRDRKISREDLQHATITLSNFGAIGGIFATPVVSPPQVAIVGAGRIVDRVVIRNGQAVAVKAMPLSITFDHRACTGGEAARFTKVLAEHLQRPSVTKS

SEQ ID NO: 79127 - protein, 174 aa, Frankia sp. EAN1pec
MTRHTLSVLVENKPGVLARVSGLFSRRGFNIESLAVGPTEHADVSRMTIVVAVEDLPLEQVTKQLNKLVNVLKIVEMDTAVSVQRELMLVKVRADLSVRSQVLETVQLFRAKVVDVAPDAVTIEATGTRDKLDALIRMLEPFGIRELVQSGMVALGRGSRSITDRSLRAVERSA

SEQ ID NO: 79128 - protein, 80 aa, Hordeum vulgare subsp. vulgare
AAVSGVAALGLGTYGAHMFRPQNPRYKEIWQTASLYHLVHTAALLGAPMTKRPNVFGGLLTTGIVLFSGTCYTVAYLEDR

SEQ ID NO: 79129 - protein, 416 aa, Rhodospirillum rubrum ATCC 11170
MRKCPILGPPPPFGIVMTEPNSPSLPEIRLLAGHSKRLRQGHPWVFSNEIAMTPEAKAMTPGALVTLRDAGDEPLAIATFNPHSLIAARVLDRDLGASITKEWVFVRLQRALRLRDTLFDQPYYRLVHGEADGLPGLVVDRLGDVIAVQANSAGMDLLTPLILDAIENLLAPRAIVLINDAPVRLLEGLTQETALARGQIDGPVPVIENGFSYLADLQEGQKTGWFFDQRPNRAFVADLARGRSVLDVYSYAGGFGLLALARGATSATLVDRSDQGLLLAQQAAATAGLGGALTTHKAEGFAYLEQAEHEGKRFGVVVCDPPAFAKTRKDQASGAKGYRKVARLAAALVEPGGFLFVASCSHHMPIDRFQDETAHGIAQAGRTGRILRSGGAGPDHPVHPDLAESAYLKTLTWAID

SEQ ID NO: 79130 - protein, 334 aa, Dichelobacter nodosus VCS1703A
MTIKLAINGFGRIGRLSLRQALQHDDLEVVAINDLNPPDMLLHLFKYDTMQGRFTGEAKVVDGNLVVNGKTVKLLAISDAKNYPWGELGIDIVLDCTGAFTSKEKASAHLAAGAKKVIISAPAGNDVKTVVFNVNHDILRADDTIISAASCTTNCLAPMAKVLHERFGIVRGLMTTIHAYTGDQNTLDSSHRKNDKRRARAAAMNIVPNSTGAAKAIGLVIPELNGKLDGSAQRVPVATGSLTELVCLLEKEVSIADVNAAMKAAVNESFGYTEEELVSTDIIGMSEGSLFDATQTRVFGSGETQLVKTVAWYDNEMSYTNQYIRTARYFGSLV

SEQ ID NO: 79131 - protein, 295 aa, Xanthomonas campestris pv. campestris str. ATCC 33913
MGLPVALNVLVAHQVLAGAVAGRAAIVVPLRSWWRQQCDNPPMSESPYTSGTTHFGFRDVAAKDKQKLVGEVFTSVARNYDLMNDLMSLGIHRAWKRYFVATAQVKPGDRVLDLAGGTGDIAVLLKERVGNEGAVVLGDINAGMLSVGRDRLTNRGLVAGFDYVQCNAEALPFPDQSFDLVTISFGLRNVTDKDAALREMYRVLKVGGQARVLEFSEVTADWFKPIYDFHSFKILPKLGQLFARDADSYQYLAESIRKHPPQDSLKGMMGEAGFARCHYKNLTGGIVAIHSGYKI

SEQ ID NO: 79132 - protein, 426 aa, Neisseria meningitidis Z2491
MENSLKEAALKFHELPVPGKISVTPTKSLATDKDLALAYSPGVAAPCMEIHADPQNAYKYTAKGNLVAVISNGTAVLGLGDIGALAGKPVMEGKGVLFKKFAGVDVFDIEIDEKDPQKLVDIIAALEPTFGGINLEDIKAPECFYIERELRKRCKIPVFHDDQHGTAIITAAAVLNALRFTGRKIEEATLVCSGAGAAAIACLNQLLDLGLKRENVTVCDSKGVIYQTREDKDRMDESKQFYAIEDNGQRVLADAVKGKDIFLGLSGANLLTPEILNTMNEKPIVFAMANPNPEILPPLAKETRPDVVIGTGRSDFPNQVNNVLCFPFIFRGALDVGATTINEEMKRACVYALADLAMEEVTEEVVAAYGKKFEFGAEYLIPTPFDSRLLPRVATAAAKAAMESGVATRPIADLEAYAAKLSEWKL

SEQ ID NO: 79133 - protein, 231 aa, Rhodospirillum rubrum ATCC 11170
MADLPETPAFGAAFSDEEEAARALEAGRWLFSQTCSFVMGCVSLDTLPDHDLSEIAFAGRSNVGKSSLVNALTGRKTLARTSNTPGRTQELNYFRLGPEAQDPALMMVDLPGYGFAEAPKDAVKRWTRLIMAYLRGRPALRRVCLLIDSRHGIKENDRDVMRMLDEAAVSYQIVLTKADKLKAAEITDVLARVVAETAKHVAAHPDVIVTSSQSGAGIDLLRAQLAALASP

SEQ ID NO: 79134 - protein, 334 aa, Staphylococcus aureus
MKILITGTAGFIGSHLAKKLIKQGHYVIGVDSINDYYSVSLKEDRLKSIGKENFTFNKVKLENYDDLSKVFVDEQPEVVVNLAAQAGVRYSIENPRTYIDSNIVGFMNILECSRHFNIQNLIYASSSSVYGANTSKPFSTSDNIDHPLSLYAATKKSNELMAHTYSHLYNLPTTGLRFFTVYGPWGRPDMALFKFTKAIVNDQAIDVYNHGNMMRDFTYVDDIVEAISRLVKKPASPNKEWSGADPDPGSSYAPYKVYNIGNNSPVRLMEFVEAIENKLGKEARKNYMDLQPGDVPETYANVDDLFRDIDFKPETTIQDGVNKFVDWYLEYYKK

SEQ ID NO: 79135 - protein, 228 aa, Gossypium populifolium
  misc_feature (115)..(115): Xaa can be any naturally occurring amino acid
  misc_feature (178)..(178): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHXGSVAKINPAAPLDKVCILSCGISTGLGATLNVAKPAKGSTVAIFGLGAVGLAAAEGARIAGAXRIIGVDLNPNRFEEAKKFGCTEFVNPKDHNKPVQEVLAEMTNGGVDRSVE

SEQ ID NO: 79136 - protein, 228 aa, Gossypium populifolium
  misc_feature (195)..(195): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKXFGCTEFVNPKDHNKPVQEVLAEMTNGGVDRSVE

SEQ ID NO: 79137 - protein, 392 aa, Rhizopus oryzae
MVSFISISQGVSLCLLVSSMMLGSSAVPVSGKSGSSTTAVSASDNSALPPLISSRCAPPSNKGSKSDLQAEPYYMQKNTEWYESHGGNLTSIGKRDDNLVGGMTLDLPSDAPPISLSGSTNSASDGGKVVAATTAQIQEFTKYAGIAATAYCRSVVPGNKWDCVQCQKWVPDGKIITTFTSLLSDTNGYVLRSDKQKTIYLVFRGTNSFRSAITDIVFNFSDYKPVKGAKVHAGFLSSYEQVVNDYFPVVQEQLTANPTYKVIVTGHSLGGAQALLAGMDLYQREPRLSPKNLSIFTVGGPRVGNPTFAYYVESTGIPFQRTVHKRDIVPHVPPQSFGFLHPGVESWIKSGTSNVQICTSEIETKDCSNSIVPFTSLLDHLSYFDINEGSCL

SEQ ID NO: 79138 - protein, 197 aa, Gossypium populifolium
  misc_feature (42)..(42): Xaa can be any naturally occurring amino acid
IVESVGEGVTHLKPGDHVLPVFTGECGNCRHCKSKESNMCDXLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 79139 - protein, 536 aa, Zea mays
WKVAPAPAVRASHASDAPAVRKSATPRAVGGMFRAQGVRGPPYSFLSGCNREMRRMKAEADDGLRLDVRDHNYLPRVMPHFLAWKQQYGEPFLYWMGPRPRVCLFDYESVRQVLFNKSGHFFKDDAHPTILAMMGKGLVLVEGTDWVRHRRVVNPAFAMDKLKTMVSCAEPLIKRWEQLAAASRSSEDGGRGEVQVEFSKQFQDLTADVIAHTGFGSSYKEGKEVFHTQKQLLALAMATLLNVQLPGFKQVDLFLFLPLLGHQYLPTKNNRLKWALEKKMKTTLMAIIQLRVASNGRSSGYGDDLLGLMLEAWLTAERGGGERDESSLTMDEIIDECKTFFFAGHETTSHLLTWTMFLLSVYPEWQQRLRDEVLRECGQANPTADTLNKFNEMTMVLLETLRLYGPVMLMLRKPTSDIRLGSLSIPKGNGIAIPVPFLHRDREVWGDNANDFDPLRFQNGVTNAAKTPQALLSFSIGPRACIGQNFAMLEAKSVMAMILKKFSFTLSSSYVHAPVDYITLQPKFGLPIVLRPLPDV

SEQ ID NO: 79140 - protein, 542 aa, Ipomoea nil
MAFGLSSLLQNSDLFTSDHASVVSMNLFVALLCACIVLGHLLEENRWVNESITALIIGLCTGVVILLLSGGKSSHLLVFSEDLFFIYLLPPIIFNAGFQVKKKQFFVNFMTIMLFGAIGTLISCSIISFGAVKIFKHLDIDFLDFGDYLAIGAIFAATDSVCTLQVLSQDETPLLYSLVFGEGVVNDATSVVLFNAIQSFDMTSFDPKIGLHFIGNFLYLFLSSTFLGVGIGLLCAYIIKKLYFGRHSTDREVALMMLMSYLSYIMAELFYLSGILTVFFCGIVMSHYTWHNVTESSRVTTRHSFATLSFVAETFIFLYVGMDALDIEKWKFVKNSQGLSVAVSSILVGLILVGRAAFVFPLSFLSNLAKKNSSDKISFRQQIIIWWAGLMRGAVSIALAYNKFTTSGHTSLHENAIMITSTVTVVLFSTVVFGLMTKPLINLLLPPHKQMPSGHSSMTTSEPSSPKHFTVPLLDNQPDSESDMITGPEVARPTALRMLLRTPTHTVHRYWRKFDDSFMRPVFGGRGFVPFVAGSPVEQSPR

SEQ ID NO: 79141 - protein, 575 aa, Xenorhabdus nematophila
MEMLSGADMIIRSLIDQGVKHVFGYPGGAVLDIYDALHTVGGIEHILVRHEQGAVHMADGYARSTGEVGVVLVTSGPGATNAITGIATAYMDSIPMVVLSGQVASSLIGNDAFQECDMVGISRPIVKHSFLVKKAEDIPDTIKKAFYLAASGRPGPVVIDFPKDTVNPAFKFPYVYPDKVNMRSYNPTIHGHKGQVKRALKTFQDAKKPVIYVGGGAVNASCSAELLVLAERLHIPVVSSLMGLGAFPATHWQSLGMLGMHGTLEANKAMHHSDVIFAVGVRFDDRTTNNLEKYCPNATILHIDIDPASISKTVTADIPIVGDAKKVLGQMLELLDTLQDTQDPDALKDWWLAIEQWRSRKCLDYDRTTTKIKPQAVIETLYRLTEGKAYLTSDVGQHQMFAALHYPFDKPRHWINSGGLGTMGFGLPAALGVKLAKPDATVVCVTGDGSIQMNIQELSTALQYGLPVLVLNLNNRFLGMVKQWQDMQYGGRHSQSYMESLPDFVKLAESYGHIGISIEKNEELETKLAQALHDVNENNRLVFVNVIVDETEHVYPMQIRGGAMDEMWLSKTERT

SEQ ID NO: 79142 - protein, 318 aa, Mycoplasma pulmonis UAB CTIP
MNFNDYIISRVKKLKEKKRILLVDGNDPRSLEAAKELQKYPNIEVSLLVESKSDVKDGFNFVVLDQDQKQYESFCQDLFESRKGKDSLESVQKALKTRPFYAMMLLKKGFFDGVVGGLLYTTADILKAAFKVVGPKAGVKTISSLMIMSKGEDTKIFADISINVNPSADQLVDIAKNSVEFLEQMGIEAFPSFLSFSTQGSAVSDETKKVVEAKEKFNALALKAKALGEIQFDAAVDLKTRSSKYKNPEFSQESNLLIFPDLEAGNIGYKIAQRMGKYGAFGPIVTGTKLPINDLSRGASVEDVANTVLITALQSEGK

SEQ ID NO: 79143 - protein, 214 aa, Synechococcus sp. CC9605
MTDSSPQSNPNAVPGAADVPAAAEGQQQQEQRRGRGDRDGRRGDRRGGRRGQERDSEWQERVVQIRRVSKTVKGGKKMSFRAIVVVGNEKGQVGVGVGKAGDVIGAVRKGVADGKKHLVKVPLTRHNSIPTLSNGRDGAASVLIRPAAPGTGVIAGGSIRTVLELAGIKNVLAKRLGSKTPLNNARAAMVALSLLRTHKETAKERGISLEQIYS

SEQ ID NO: 79144 - protein, 320 aa, Oryza sativa Japonica Group
MDADRDPIFPVQQMPSLLFPPPPPRPLALDSTSSASSSFVPHHPSITSFPILVLTVLGILTTSVLLLTYYIFVIRCCLNWNSSSSSDTRTAGLISRRRRGAASSSLPAVAEPRGLEEAAIQSLPAFRYRKAIKDTTADSSECAVCISEFQEEERVRLLPSCLHVFHVDCIDTWLQGNANCPLCRAAIATNDSQLPLDQFVRPEVVVIQVITGAEEEGAQAPQQEANTAASDPAVDATSTNQQVSSKKTKNQNAWHVSISKGDECIAVRRDRNVLPLRRSFSMDSLGGAGEVHLQIQNILQRSTHFHRDISDSSSSSTGTL

SEQ ID NO: 79145 - protein, 80 aa, Hordeum vulgare subsp. vulgare
AAVSGSLLLDWAPMERTCSAPRTLDTRRIWQTASLYHLVHTAALLGAPMTKRPNVFGGLLTTGIVLFSGTCYTVAYLENR

SEQ ID NO: 79146 - protein, 616 aa, Zea mays
MNGKDYSSNSVHVFHIGKLRIKLQKGWSTKARELYSTTMKLCGSRGGGNAAARAVFWQARKGLSYTLAFETDRDRNAAIMIARKFASNCNIVFPIILENDMAYTFWWLCRSLSLAQVTKTPDEVIMRVLTETLYIIRRGTVLLAGNSYPLEQTFLGSNGAKDWIFILLLLLLILTTNISCHADLLLSLVRWSAGVPALGKTKAVPARPDALNRRPPLGDIGNLVSVRPATGNPQEQVNRPITRSFGAQLVKKAQAKAAIKNAAILPARHAPRQERKAPVKQHPPPEDIIVLSSDSEQSRAQSESSASSVRSRRKAINTLSSVLSARSKAACGIAGKPRQVVDDIDKLDVNNELAVVEYIEDIYTFYKIAQHERRPCDYIDAQLEINSKMRAILADWIIEVHHKFELMPETLYLTMYIIDQYLSLQPVLRKELQLVGVSSMLIACKYEEIWAPEVNDFILISDSAYSREQILSMEKGILNRLEWNLTVPTVYMFLVRFLKAATLGGKVEKEMENMVFFFAELALMQYDLVTRLPSLVAASAVYAARLTLKRAPLWTDTLKHHTGFRESEAELSECTKMLVIAHSTAPESKLRVVYKKYSSEQFGGVALRPPAEEICK

SEQ ID NO: 79147 - protein, 93 aa, Psathyrostachys juncea
MLWHKVAAVSGVAALGLGTYGAHMFRPQNPKYKEIWQTAFLYHLVHTAALLGAPMTKRPNIFGGLLTTGIVLFSGTCYTVAYLEDRKFSSPAP

SEQ ID NO: 79148 - protein, 342 aa, Frankia sp. EAN1pec
MRLAVIGGDGIGPEVVAEGLRVLRAVHPKVETTDYDLGARRWHETGETLPDSVLAELRGHDAILLGAVGDPGVPSGVLERGLLLRLRFELDHHVNLRPVRLYPGVTSPLAGDPAIDMIVVREGTEGPYAGAGGTLRRGTPQEVATEESLNTRFGVERVVRDAFARASRRPRAHLTLVHKTNVLTKAGDLWARTVAEVGAEFPAVSVDYQHVDAASMFFVTDPARFDVVVTDNMFGDILTDIGAAITGGIGLAASGNLDPSGANPSMFEPVHGSAPDIAGQGLADPTATVASVAMLLDHLGHADEAARVEGAVAASLAARAAAGGARRSTREIGDDLATRAAG

SEQ ID NO: 79149 - protein, 278 aa, Triticum aestivum
MDARGGDASAIALLLCACFLTALACDSNGAKFAYSGPLGPDHWGGLDPNFTRCAMGTYQSPVDIKTSDVVYNPMLGPLHREYTAANATLVDNIFNIALRCEDAAGTVQIDGVKYKLDNIHWHSPSEHTINGERFAVEQHMVHFSDDGNISVVSILYRLGRPDPFLMQLQDKLSELYVEACRAEKGAPIPTGVVNMWQLRRYANMYYRYVGSLTTPPCTENIIWNIHGRVREMALGQAAALIAPLEEGYRRNNRPTQPLNGRTVQFYRRFWKKKGSGKP

SEQ ID NO: 79150 - protein, 174 aa, Triticum aestivum
SSILCRSMLKFVNSFLHYLTFEVLEPNWHSMHGRLQTARSIDEVIQIHDFFLQKCLKECLLLLPELLMKVEKLKALCLQYATSIQLLIPSIEVAAPESKSKSGSSRARAKRSQDRDEQLKLASENVVMSQSILKFESEFNAELQSLVPTLSKSSQAEPYLTHLAQCILGVGIDQ

SEQ ID NO: 79151 - protein, 93 aa, Dasypyrum villosum
MLWHKVAAVSGVAALGLGTYGAHMFRPQNPRYKEIWQTASLYHLVHTAALLGAPMTKRPNIFGGLLTTGIVLFSGTCYTVAYLEDRKFSFTST

SEQ ID NO: 79152 - protein, 310 aa, Rhodospirillum rubrum ATCC 11170
MMTDSAPPEPIHAEIPEGWLHKAKTLSEALPYMRRFAGLTIVIKYGGHAMGDPELAKTFARDVVLLKQVGMNPVVVHGGGPQIGRMLDTLRIQSTFIDGLRVTDAATVDVVEMVLAGSINKAIVTEINQAGGCAVGLSGKDGRLIQARKMVRKRHDPESNIERVLDLGFVGEPVVIDPHVLIQFRDSDIIPVIAPIGIGEAGETFNINADTAAGALAAQMKAARLLMLTDVKGVLDKDKQLIQELSVDRARLLKQEGTISGGMIPKVETCIDAVERGVEAAVIVDGRVPHAVLLEIFTPRGAGTLIRASR

SEQ ID NO: 79153 - protein, 93 aa, Leymus triticoides
MLWHKVAAVSGVAALGLGTYGAHMFRPQNPRYKEIWQTASLYHLVHTAALLGAPMTKRPNIFGGLLTTGIVLFSGTCYTVAYLEDRKFSSPAP

SEQ ID NO: 79154 - protein, 165 aa, Mesembryanthemum crystallinum
MSTVFNGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 79155 - protein, 228 aa, Gossypium populifolium
  misc_feature (115)..(115): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHXGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 79156 - protein, 141 aa, Helicobacter acinonychis
CVVIEISKHSNIKYELDKESGALMVDRVLYGAQNYPANYGFVPNTLGADGDPVDVLVLSDMAFQAGSVVKVRLIGVLNMEDESGMDEKLLALPVDKVDPTHSYVKDVNDLSKHTLDKIKHFFETYKDLEPNKWVKVKGFEN

SEQ ID NO: 79157 - protein, 587 aa, Streptomyces avermitilis MA-4680
MHPCSPRLVGVPAPDRFGVLMGTQWNAVDGRIRTTARGHAVLNSPRLNRGTAFTRQERQELGLVGLVPPQVLTQDQQAARAYTQFRSQPNDLAKNVYLTALRDRNEVLFHRLLGDHLAEMLPIVYTPTVGTAIERYSYEYRRPRGVYLSVDAPEDIERTLRASGLGADDVDLIVATDGEAILGIGDWGVGGIDIAVGKLAVYTAAAGVDPARTLAVMLDVGTNRQELLDDPLYLGNRHPRVDRESYDAFIDAYVTAATELFPDALLHWEDFGPANARRILDRYREKVRTFNDDIQGTGAVNLAAVLSGVRAGGVPLRDHRVVLFGAGTAGIGIADQLRDALIADGLTPQEATDRIWAVDRHGLLAEDQQGLHDFQLRYVRRGAEIAGWRRDDALGGVPLAEVVDRVRPSVLIGASGQGGAFTEDIVRAMAAHTDRPIILPMSNPTRLAEAVPADLLTWTDGQALIATGSPFDPVEVDGVTHHIGQANNALVFPGLGLGAVVARAERITDGMLVASARAVAEQTDATAPGVPVLPLIDRLRDTSAAVAVAVARAAVEDGVARETVDDAVEERVRAAMWQPEYPPIEAV

SEQ ID NO: 79158 - protein, 141 aa, Helicobacter acinonychis
CVVIEISKHSNIKYELDKESGALMVDRVLYGAQNYPANYGFVPNTLGADGDPVDVLVLSDMAFQAGSVVKARLIGVLNMEDESGMDEKLLALPVDKVDPTHSYVKDINDLSKHTLDKIKHFFETYKDLEPNKWVKVKGFEN

SEQ ID NO: 79159 - protein, 163 aa, Xenorhabdus nematophila
MRRILSVLLENESGALSRVVGLFSQRGYNIESLTVAPTEDPTLSRMTIQTKGDAKVLEQIEKQLHKLVDVLRVNELTSGPHVEREIMLVKLQASGYGREDIKRSTDIFRGQIVDVTSTLYTVQLVGTSEKLDAFLDSVRDVAEIVEVARSGIVGVSRGDKIMR

SEQ ID NO: 79160 - protein, 514 aa, Symbiobacterium thermophilum IAM 14863
MIPPYRPEPLSDFRNPAVTAAFEQALAAVKTQLGKRYPMIIAGRRVESGESIVSVNPSQPDQVVGYAARGGVAEAEAAVQAALAAFPAWADTPADVRARILFKAAAIMRRRRHELSAWMCHEVGKNWAEADADTAEAIDFLEYYGRQMLKLAAPQPLTPYPGEENHLYYRPLGVGVVHSPFNFPLAILTGMTAAAIVTGNTVVVKPSTEAPVIAAKLFEILEEAGLPAGVANLLYADPVEMGDYLTTHKEVRFINFTGSRQVGCHIYELAAKVQPGQVFLRRVIAEMGGKDAIIVDGTADLDEAAAGIVTSAFGFSGQKCSACSRAVVTADVYDQVLEKVVARTRALKVGPATEKDTDVGPVAAERFQKKILEYIEIGKAEGRLVLGGNALPGGYYVEPTIFADVAPTARIAQEEIFGPVLAFIKARDFDDALRIANNTPYGLTGSVYSRSRENLEQARRRFRVGNLYFNRKSTGAIVGVHPFGGFNMSGTDSKAGGPDYLLLFTQAQAVSEKL

SEQ ID NO: 79161 - protein, 235 aa, Triticum aestivum
  misc_feature (100)..(100): Xaa can be any naturally occurring amino acid
MPERGGGDRGVRFAVTGGQGAGLPWRRPMSGADPLRRPGGLLPRPAGFLLLVPAAPRRRHPLLPSFVLVHLGSSHISPWIDPAVLDLKHQIGRCPFVYAXIPKAEYYDLYHEFDVKMLHPVRDDQLQVFSARFNEVFRKCQCPGNICFLHGISTHNGRLCVAMRFSEGSIGDRMPRLPGGRLPLSDVLRYGADLPLGVLELHYMGIFVQNLQSCNFLLDDNDQEAWFCFIPYIST

SEQ ID NO: 79162 - protein, 228 aa, Gossypium pulchellum
  misc_feature (178)..(178): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGAXRIIGVDLNPNRFEEAKKFGCTEFVNPKDHNKPVQEVLAEMTNGGVDRSVE

SEQ ID NO: 79163 - protein, 186 aa, Mycoplasma pulmonis UAB CTIP
MLHFIKSASNSQSWYNHDKVEICFIGRSNVGKSSLINSLSNSAVSKVSNTPGRTQLINFFEDDQKNVYVDLPGYGFAQMPKDKLEKMHQMIDEYLQNRKNLKTIVLLFDSRRGILDQDLDFINWAQQAKKNIILLATKIDKLNQAQKHKLLVSLKELNLEKSVLLVSSLKRTNIDNLKKLLASEFK

SEQ ID NO: 79164 - protein, 945 aa, Vitis vinifera
  misc_feature (561)..(562): Xaa can be any naturally occurring amino acid
  misc_feature (592)..(592): Xaa can be any naturally occurring amino acid
  misc_feature (605)..(607): Xaa can be any naturally occurring amino acid
  misc_feature (612)..(612): Xaa can be any naturally occurring amino acid
MHNKFEMDEVELFVEQVPIDLQMNSPIGNCTPLLLGENDEQANPGCVVISKTFSGNKRNKEVFQRVFWAFHPSIEGFKHCRPMLAINGTHLYGKYKGTVMIAMGNRVTQKRGLFVIFDRHSDIMATFADVYLGWSKPNAYHWICMRHLASNFMTPFKDKCLKQLLCRVALETERIATTPLAITTMDFYDPYMQWYRRIMRRLIAPILHRDHMRFHSTTSATELLYHPLEVEEEVVVELVNDMYLQHLLWYNPHIYLSHPPFLYFSHVSLESPLSPPNVSIPTPSPRPETTIPSTITLVEPYISLDLPFLPHVTFTQTFSPPLPSLPQPSISLDAPPPVIKSIAPSSVIKSFAPQPFLKGTSHAARLHVRVTKGHQVPCVRRVLTSSVSSDSTTHVNTRVSNSLVPDNLKRASSSPIALPLRLKFIHMADPTPLLSQSHLADPEPMLIPKHLPSLDETFERYIGDFGWAQLLQAFLVSFAWVFDAQQTFISLFTDAEPPWHCTELGTELCTSVSNICQLPKGSWAWDRAADTSIVSEWTLVCAGSIIKSLPASSFFMGCMVXXLVLATLADSSLGRKNMLFFSCLLMSATGIXTIFSPNVWIYSGXXXLSGFXRATIGTCAIVLSTELVGKRWRSQVGVCGFFLFTLGFCPTSHSLLKQRFLMEISLSVDFCAGIVVLCLVHFFVRESPRWLLVRGRKEEAVATLKSIGAVNNSSFTLSFSGLPFEDEETTNLHLCSVISILLEKRWALRRLSAVMTVGFGVGMVYYGMPLALGNLPFNLYWNVTFNALSELPASLIAFFFIERLNRKSSVLVFTMTSGVCSIMCVVMGEEWASLKIGLELVSFFSTCTAFDILLIYTIELFPTCVRNSAMAMVRQALVFGGVFCPVIVEIGMGNGYLSYGVFGVVIISCGLFVGCLPETKGGTLCDTMEEEENKERAAVASLISA

SEQ ID NO: 79165 - protein, 475 aa, Mycoplasma pulmonis UAB CTIP
MYSIKKKSKLIATIGPSSDNYEVLKELVENGVTCVRANFSHGDYQEQKRKFDLAKKVSHDLNTPLSLMLDTKGPEIRIGKMKDGVQKIEANQSLKIWVSEEKYKNLLGTSEDISVSYNMSQDLKKGNQVLLDDGKLDTIVEKVTPEYVQVRALNSHNLKTNKRINLPGVAFSLPFLSEKDKKDIAFGVENDINYVAASFVNSKENVLELRAILKSLNAEHVQIISKIESTLGIENIDEIIEHSDGIMIARGDLGLEIPYYEVPYWQKTIIRKCRNVGKVVIVATQMLDSMEHNTNPTRAEVTDVYFATELGADTTMLSGETAQGSFPVEAVKVMSKINQRAEKEFYSKLYYNAQLESNAKLATTKRAKIAYEVAKQTQSGDFKYTVVLSASGNLLKKVANFRPNTSIIGFVEDKKLINAFGIVSSVFVSLESVQKYFELKNNPLAAISTLKNYDARPGDRFLIVHNEKITQHVVE

SEQ ID NO: 79166 - protein, 228 aa, Gossypium rotundifolium
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPPKGSTVAIFGLGAVGLAAAEGARIAGASRIIGVDLNPNRFEEAKKFGCTEFVNPKDHNKPVQEVLAEMTNGGVDRSVE

SEQ ID NO: 79167 - protein, 771 aa, Mycoplasma pulmonis UAB CTIP
MKKLITDLNLNDKKVLIRLDLNVPLKGKKITSLKRIEESIPTIKYVQERGGKIILLSHLGRVKTKEDKEKKSLSIVVEALASLLNSPVKFVDQTRGKKLESAIEKLKPGDVLLIENTRFEDLNNNAESNNDPELGKYWASLGDVFINDAFGTAHRAHASNVGIASNIKESALGILVQKEVNALWKLMEQQEKPFVAILGGSKVSDKINVLEKIIDKVDRLIIGGAMAYTFLKAQGIGIGDSIYEQDKIEFATEFLKKYNHKIILPIDHALAKKFKNAKPIFNNENPLEIPQTFIGMDVGPKTIELIHKYIKGDTKLGISPAKTIFWNGPMGVTEFEEFQSGSLAVVEAISQLVGAYSVVGGGDSIAIIEKLNAQMLFSHISTGGGASLEFIESKVLPGIDAIQNYEQTYEQYDSQVQSQDFSQNFDSPLVEETFSQSTSENFSDFASSTQEHFATSENQNTLINNYENPGFDSQDMFKTEEQNDSTSSFLTSTNPFSSEFSNEFKTSDFQDLKQTQETETQETLIPHTFEYTTDDLRHTLEQYVRETSFQTRESTFPTEEASFETLEETSFQTLEESFPTQSFEQVEQTSEKNMEVSTENFENASSQTNSFTVSDIPKTTSTFEDLETPETQNTTLEEVALETSNFEAQNLETPNLQTSNFETSNLETSNFETSNFETSTFESFNTGNFSTPSSTFEDLDLQSATFQTNDESERSTQENFEPTEVIESDLLAMKTTELEQEITNNTSRDILSEDEVAAPHKKRFWFFGRKR

SEQ ID NO: 79168 - protein, 198 aa, Triticum aestivum
MEAKGAGERDALIDLESGNSVVISEHGHGMDANFAVSPPRTPPNGGLNRVMHTKDDGNQHMDCSSPAMETASKNGDDRKSEGEEKLGLLDSSGGEKAKKKRSSSKKPPRPPRPPTHLPLDASDQKLLNELNELALLKRARIERMKALKKMKNGKQGSSNSNFCPMIITIIFCLVILWQGFCSRLASGVSFHGSPGSSI

SEQ ID NO: 79169 - protein, 75 aa, Triticum aestivum
GVHVRGARRPPAPCRDCGGACSYRCSKSSRPNLCNRACNTCCRRCNCVPPGTAGNEDVCPCYAHMTTHDGRHKCP

SEQ ID NO: 79170 - protein, 198 aa, Acer saccharum
VTGLLDPPELIKPPKILVIEGLHPMYDERVRDLLDFSIYLDISNEVKFAWKIQRDMAERGHSLESIKASIEARKPDFDAYIDPQKQYADTVIEVLPTELIPDDNEGKVLRVKLIMKEGVKHFSPVYLFDEGSTISWIPCGRKLTCSYPGIKFAYGPDSYFDHEVSVLEMDGQFDRLDELIYVESHLSNISTKFYGEVT

SEQ ID NO: 79171 - protein, 317 aa, Coprinopsis cinerea okayama7#130
MDRDDEQTFAESSRHREGKGSDRHGGKGGKGKGKSSGGGGGGRGKPSRSTKLRGLEKDSPDVRISKTLSWLLRHGAAKEGLSIRPDGYVRVDQLLDYPKLKAVSLNFKNLQEIVKADAKRRYDLRFEFENATVATEAPTDEQPSAAGSWWIKANQGHSIKAVALDLKPINSVDDIPTGIAVHGTNQSAWKSIATQGLSKMSRNHIHLAQGVSGENVISGMRKSSQILIFINVQKALDAGIKFHLSDNGVVLTEGDSSGFLKPEFFARVENAKRQPLEGWGGSGPIVAKPIAEEQKGKQSGGGSLAVEPPAIDSLKIE

SEQ ID NO: 79172 - protein, 1472 aa, Yarrowia lipolytica CLIB122
MESTPPDYTGLDPTIDAEIRSIAESVHKDRVDDYDTEKGTVGNEKLLRSDTVQPNLDVNPYIDNSDPQLDPLSDEFNARKWIKTVLGLKQRFGATKHITAGVSFKNLAAYGYGGGSQYQKTFSNSVLAIGPMIMELFGGNKGTKVQILRHFDGLVRAGETCVVLGRPGSGCTTFLKSVACETYGFHIEDKTEWNYQGVPRKVMTKNARGEIVYNAEVDVHFPHLTVGDTLLFAALARTPHNRLEGVSREQFAKHTRDVTMATLGLTHTMDTKVGNDFVRGVSGGERKRVSIAESVVCGAPLQCWDNSTRGLDAANATEFIRSLRLSAEMMGSSMFVSLYQASQEAYDLFDKVCVLYEGRQIYFGLAKEAKQFFLDLGFECADRQTTGDFLTSLTNPIERIIQPGWENKVPRTPDDFEKCWMESQARQKLLQEIEEFNTEFQLGGESQDHFMELRKESQARHTRVKSPYTISWPMQTRLCLWRGFLRIKGDMSTDISIVVGNFIMALVLSSMFYNMQQTTDTFFSRGALLFFAILLNAFSSVLEILSLYEQRPIVEKQTRYALYHPFTEALASILTTFPTKILTLLAVNLTLYFMTYLRREPGPFFIFFLFSLLCTLAMSMIFRCMAAITKTLEQALAPASVIILALVIYTGFSLPITYMHGWARWINWLNPVAYGFEAVMVNEFRNRDYGCASYVPTGGEYDQIDLQYKSCSVVGSVPAESSVNGDRFLGLAYQYYNAHLWRNMGILFGFIFFFGFCYLVAVEYIQGAKSKGEVLVFRKSYLKKIKKHAANDEEAGAMMAGEKSEEPASEDSSINIQAQKGIFQWKDVCYDTKVKDGERRLLDHVDGWVKPGTLTALMGASGAGKTTLLDVLADRKATGVITGDMLVNGEPRDESFQRKTGYVQQQDIHTSTATVRESLEFSALLRQPSSISVKDKLAYVDEVIRILEMEAYAEAIVGVPGEGLNVEQRKRLTIGVELAAKPELLLFLDEPTSGLDSQTAWSIIKLLKKLAANGQAILCTIHQPSAILFQEFDRLLFLASGGRTVYYGDIGPESTILTSYFERNGADPCPKEGNPAEWMLEVIGAAPGSTAKRDWPVVWNESSERAAKRAELDEMAQTVERTQTNNTERDASGYSDSDQFAVGQWTQFKIVTKRLYQRFWRTPSYLWSKIFLCTASAIFIGFSFFKAPSDIQGMQNKMFSFFMLFLIFNTVVEQIIPQFDQMREQYEARERSSKTYSWQVFMASNMVVELSWQFLMGVIVFFCFYYPVGFQWTAEHNNSVHERGALFFLYVLLLFLYNSTFAHMMIAGIGNKDTAANIGNLLFSLMLLFCGVLATKEQMPGFWIFMYRVSPLTYFVGGMLATGIGRAPVTCSGNEIVRFQTFPGKSCGEYMQGFIQALGDNGGYLLNPAANELCEYCPMKSSDTYLSMVDVSYTQRWRNWGIIWAYPVFNVAMAFLLYYVCRVPKKSKAQKA

SEQ ID NO: 79173 - protein, 689 aa, Acidobacteria bacterium Ellin345
MSIIDSATKTVVRDYTVEELKDQAALMRGYNLVALCAAGSGHAGGTLSIMDITAALYLSVANHDPKNPNWAERDRILWSGGHKAPALYVGLAFAGFCNKEELVTLRKLYSPFQGHPHWLKLPGVEASTGSLGQGLSVAVGSALASRLDGRRNKVFCIMGDGEQQEGNIWEAVMEAAHYKLDNVIGIIDENRLQIDGPVCEVMNVAPLADRYRSFGWLVIECDGHDMEQVVNALNQAVRNEGSGKPTAIIGKTVKGKGVSFMENIAGWHGKVPNFDELVKSLKELGVEEKIPYLALLDKAKGYQTEVERKLDAKMPKFSKDYWWNTSTTMQAAMKPTRMGFGESLSENGKDERVVCLGLDISGSITISEFYAKHPERKNRWFSMGIAEQSATAAAAGLAREGKLPVLGTYATFAAARNLDQIRVSICYGNFNVMIAGAHGGVSVGPDGATHQALEDLFAMCGLPNMTVVVPADSVETRKATDFLLLKHVGPKYIRFAREATPIISTTDTPFEFGKANVIRLRNESKNFIEAFATELADDYRNENEDLSIVACGPMVPEAMRAAWILKQEFGYETRVINMHTLKPLDRRTILKAALDTRVVITAEEHQIGALAWQVSHAIISSPALFDVPVITGAIGVKDRFGDSGAPWELIKEFEVSAEHIAQQAAALVALKKQRIEATEKELEPTLSLR

SEQ ID NO: 79174 - protein, 478 aa, Oceanicola granulosus HTCC2516
MTDLFHSFETALVTGGAAALRAGQFGRGATVEGPLGPRPLIYADDTASGRALRQVEALLQEEVLPYYANSHTEASHCGARMTRLRRAARARVAAGCGAGAEHAVIFCGSGATAGLNKLVDLLGLRAARAAGRAVRVLIGPWEHHSNILPWRESGAEVIELPEGEAGPCRAALDAELARARADDALAVVALSGASNVTGALADVAALTRAVKRGGGLMVWDMACGAPYLPLTMNPGGAEADAMVLSPHKFAGGPGASGVLVLRRDATASTRPTAPGGGTVRFVGPTGHDYVADLEAREEAGTPNVLGDLRAALAFAVKGAMARLGMLETETDLARRGLAALVGAPGLRLLGDPDRPRLPVFALQVTAADGTPLHQQLATRMLSDLFGVQARGGCACAGPYVHRLLGIDTATSEALRARILAGEQLAKPGFVRCNLSPMMEETEVAATLAALTALPDAALAHRARYAADPARAIFDLHAA

SEQ ID NO: 79175 - protein, 326 aa, Streptomyces avermitilis MA-4680
MSDKIALSTWPTPLEPMPRLAAALGLGENDLWIKRDDLIGLGGGGNKVRKLEWTVGAALAAGADTLVTTGAAQSNHARLTAAAGARLGLDVVLVFPGTPDSATHGSGNLVLDSLFGARVHWAGDGGPSTMGDVADEVCRQLRRDGARPHLIPFGGSSPLGARGYVEGGEELRSQLPDVDHVVVALGSGGTMAGLVGALGEQRVLGVHCGAVAEPAATVADLAGPLTRRSITPESLRLRTDQVGAGYGVLHEPVLEAMRTAAGTEGIVLDPVYSGRAMAGLIAAVRDGDIRPAQRTVFLHTGGLPGLFGHTETVQRSVSTLRSYEVE

SEQ ID NO: 79176 - protein, 525 aa, Streptomyces venezuelae
MTTTSTAGGALADRLTELGRLRELAQEGPDPSGPPNASTAKGKLTARERIELLLDKGSFTEIEQLRRHRAQGFGLEAKKPYTDGVITGWGTVEGRTVFVYAHDFRIFGGALGEAHATKIHKIMDMAIAAGAPLVSLNDGAGARIQEGVSALAGYGGIFQRNTRASGVIPQISVMLGPCAGGAAYSPALTDFVFMVRETSQMFITGPDVVKAVTGEEITQNGLGGADVHAGVSGVSHFVYDDEETCLAEVRYLLSMLPQNNRDLPPVMPSSDPADRPGDRLLDLVPADGNRSYDVREVIEELVDDSDYMEVHAAWAPNLVCAFARLDGHVVGIVANQPAAMAGVLDIKASEKGARFVQFCDAFNIPIITLVDVPGFLPGVDQEHDGIIRRGAKLLYAYCNATVPRISVVLRKAYGGAYIVMDSRSIGADISLAWPTNEIAVMGAEGAANVVFRREIAAADDPEAMRAQKIQEYREELVHPYYAAERGLVDDVIDPRETRQVLCRSVAMLAAKHADLPRRKHGNPPQ

SEQ ID NO: 79177 - protein, 630 aa, Schizosaccharomyces pombe 972h-
MEAKETHSISDHEVELQDAKPEEKSENGNFVFEKAFSSDEEKGSGYNTNETYSKMDNSLQHRGVSKIEAVRDSIYQNKRGMYLAYAFGIAILACSWASAIQSSTTYSYQVYATASFNRTSMISTLEIATAIISSVCKPILGKFSDITSRPMTYTLVLLFYVIGFIVVASSSTISAYVIGSVFISIGSSGLDYLNTLVVGDLTSLKWRGFMTALLSTPYIATVWFTGFIVQGIIDSNWRWGYGMFAIIMPAVMTPAVIILMYLERQANKDENIKKIINYQTEEKNKNKQSKWQKLWKAVLEVDLFGLILLGVGWSILLLPFSLTSYAKNGWKNPSMIAMMVVGGVILIAYSGYEMFIAPYPSCPRRVMNRTFITAVIIDFFYYLAGYLQSMYFTTYTWILYDWSYRDWTYFNNTMTIALCVFGVFAGAMHRVFHRYKYLQIIGLVIKIVGYGILIRPNFAATGKVDLAWSLILIGMGGSFSVVGSQVSCQASVPHQDLAIASSLLPLYTNIGGAIGAAIASPIFSNKVPKYLREYLPSSINDTQVYNFYSDSSLIREYPVGTEIRDGAIKAYSRSMFFLLVPAVSLSFIPLAAAFWQSNFYLGNQQNAVEGDQDHKKKGDKETTQEEKIII

SEQ ID NO: 79178 - protein, 415 aa, Acidobacteria bacterium Ellin345
MFDLLKKILDGQNQFASGGLLLMILGSVGVFLRSLPSQLWSWIMRQSTMSITVKDDDQAFAWVKEWFLEQKFLKRVRRLDLDTSLRGAEAAMVPAPGRHWFMRGGRPYWVWFWRTENTKGYNQRRMESFMIETIGRDQQVLRQFVAEVVACHKKKLRTASYLYLYDDGWDRVESYWPRRLDSVLLKPGEKEHLIQDLERFRASRDRYRRLGVPYHRGYLFYGPPGTGKTSLVSALAARFGMSVYIVNLSELNDRTLKTAMNWVSDNSVILFEDIDCMNASTRRSQAGGAPRSETADDPKEKSAIDKMGVSLSGLLNVLDGFSAPENVVYAMTTNDISGLDAALLRPGRIDYKLYLGEACESQKVELYRRFFPESSEEEARAFAQANWAETMAEFQGLLLALEQEVGTTEVGVVQS

SEQ ID NO: 79179 - protein, 318 aa, Silicibacter sp. TM1040
MLIDGALTEKPKQGDGVFRRMSSGFRGWIEPHRDAEFPAEAGRYHLYVSMACPWSHRTTIVRALKGLEEIISVTQMDPLAGPDGWRIDTEAFDPAVGVPSDDYLYQVYQRAEPGQTGPVTVPVLFDKRSNRIVSNDSGQIMRMLNSAFDEFTYRAPDFYPPDLQQDIDRISDEIYAPINNGVYRAGFATTQAAYDEAITALFEKLDELDALLATRRYLTGERLTEADWRLFTTLVRFDPVYVTHFKTDRKRIADYGNLSPYLRDLYQVPGVAGTIDMNAIRQHYFLSHRHINPHGIVSAGPQLDLNRPHGRDIPVLGS

SEQ ID NO: 79180 - protein, 421 aa, Flavobacteria bacterium BBFL7
MAAAQPKHFSFYSIGLSYRKADAETRGQFSLSEEGIHNLLLEAKGEGIPSLAVISTCNRTELYGFAQHPFQLIRLLCEHSHGTVEEFQKIAYIHKNEDACNHLYTVGTGLDSQILGDFEIIGQLKMAFKRSKKLGLINAYMERLMNCVIQASKRIKTETELSSGATSVSFASAQYILENFPAGGPAKKILLFGTGKIGRNTCENLVKHTENKQITLINRTKDKAERIAGRFDLIVKDYAQLEEEIAQSDIIIVATGAQKPTVSKQIIHTNKPLLIMDLSIPKNVDDNVTELDNVQLIHLDELSKVTHKTLENRENFIPQAQSIISEVHADFKQWMVSRQFAPTMQALKTKLSTLKDAEIKNSRTKFSDFNHEQADVLADRIIQKIAGHFANHLRNEDESTEEAISLLNKVFKLEELSSYES

SEQ ID NO: 79181 - protein, 228 aa, Gossypium rotundifolium
  misc_feature (181)..(181): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIXGVDLNPNRFEEAKKFGCTEFVNPKDHNKPVQEVLAEMTNGGVDRSVE

SEQ ID NO: 79182 - protein, 594 aa, Schizosaccharomyces pombe 972h-
MTKDAESTMTVGTYLAQRLVEIGIKNHFVVPGDYNLRLLDFLEYYPGLSEIGCCNELNCAFAAEGYARSNGIACAVVTYSVGALTAFDGIGGAYAENLPVILVSGSPNTNDLSSGHLLHHTLGTHDFEYQMEIAKKLTCAAVAIKRAEDAPVMIDHAIRQAILQHKPVYIEIPTNMANQPCPVPGPISAVISPEISDKESLEKATDIAAELISKKEKPILLAGPKLRAAGAESAFVKLAEALNCAAFIMPAAKGFYSEEHKNYAGVYWGEVSSSETTKAVYESSDLVIGAGVLFNDYSTVGWRAAPNPNILLNSDYTSVSIPGYVFSRVYMAEFLELLAKKVSKKPATLEAYNKARPQTVVPKAAEPKAALNRVEVMRQIQGLVDSNTTLYAETGDSWFNGLQMKLPAGAKFEVEMQWGHIGWSVPSAMGYAVAAPERRTIVMVGDGSFQLTGQEISQMIRHKLPVLIFLLNNRGYTIEIQIHDGPYNRIQNWDFAAFCESLNGETGKAKGLHAKTGEELTSAIKVALQNKEGPTLIECAIDTDDCTQELVDWGKAVAPPTPVLLPLITRLKRTLFGKNMLHLDYKNYLDIRNT

SEQ ID NO: 79183 - protein, 538 aa, unidentified eubacterium SCB49
MLSVNNLSVQFGKRILFDEVNTQFVKGNCYGIIGANGAGKSTFLNILAGKMDPTSGHVHLEPGKRMSVLEQNHNAYDEFMVLETVVRGNKEMFKIKTEIDKLYEDYTDENAERIGELQIVFEEMNGWNADSDAASMLSNLGIDESLHYSLMADLDGVQKVRVLLAQALFGNPDVLIMDEPTNDLDYETISWLEHFLANYEECVIVVSHDRHFLDAVCTHISDIDFSKINHFSGNYTFWYESSQLAARQRAQQNKKAEDKKKELQEFIMRFSANVAKSKQATSRKKMIDKLNIEDIKPSSRRYPAIIFERDREAGDQILNIEGLSATQDGETLFTNVDINLSKGDKVVIYSKDSRAATAFYEIINNKRNADSGEYQWGVTTSQSYLPLDNHSFFESDLNLVDWLRQYATTEEEREEVFIRGFLGKMIFSGEEALKKCNVLSGGEKVRCMLSRMMMIRANVLMLDEPTNHLDLESITAFNNSLKNFKGTVLFTTHDHEFAQTVGTRIIELTPKGVIDRYMTFDEYMNDKKIKEQRDAMYS

SEQ ID NO: 79184 - protein, 435 aa, Mycobacterium avium 104
MFTMSGGPRNQTKSSASAQGLCEFIDASPSPFHVCATVAARLIAAGYTELDEAKHWPSQPGRYFTVRAGSLVAWNSTGADGPFRIVGAHTDSPNLRVKQHPDRTVAGWRVVALQPYGGAWLNSWLDRDLGISGRLSVRDGSGLSHRLVRIDEPILRVPQLAIHLAEDRKSVTLDPQRHVNAVWGVGESARSFVDYVAARAAVAPDDVLAADLMTHDLTPSTLIGASENGTADLLSAPRLDNQASCYAGLEALLATEPSGPLPVLVLFDHEEVGSSSDHGAQSDLLSTVLERIVLAAGGTREDYLSRLPASLLASADMAHATHPNYPERHEPGHPIAVNAGPVLKVHPNLRYATDSRTAAAFALACRQAGVTLQRYEHRADLPCGSTIGPLAAARTGIPTVDVGAAQLAMHSARELMGAHDVAAYSAAMHAFLSPG

SEQ ID NO: 79185 - protein, 249 aa, Mycobacterium avium 104
MGETATLVLLRHGESEWNSLNLFTGWVDVGLTDKGRAEAVRSGELLAEQGLLPDVLYTSLLRRAITTAHLALDAADRLWIPVRRSWRLNERHYGALQGLDKAETKARYGEEQFMAWRRSYDTPPPPIERGSTYSQDADPRYADIGGGPLTECLADVVVRFLPYFTDVIVPDLRSGKTVLIVAHGNSLRALVKHLDQMSDDDVVGLNIPTGIPLRYDLDARLRPLVPGGTYLDPEAAAAGAAAVASQGGG

SEQ ID NO: 79186 - protein, 524 aa, Cryptococcus neoformans var. neoformans B-3501A
MRPTITLRHLLPLGIRSKHIMPTHAKLNVPSLGEVEVPVGLFINNEWVESTSRETFSTVNPATGQKLLDFAHAKKEDIDKAVIAARKAFKTTWGNNILAAERGVLLNKLADLMERDSDKLAALESINSGKGIRIAREADVADSVACIRYYAGLADKIHGQTVSSFGKEKFVYTLHQPIGVCGQIIPWNYPIMMWAWKIAPALAAGCTVVMKPSELTPLSALALCDLVKEAGIPAGVINTVPGLGATAGDAISRHMDIDKVAFTGSVSTGRRISIAAAESNLKKVTLELGGKSPVIVFDSADVEEAADWAALAIWFNSGQDCCAGSRLYVQEGIFDKFLAAMKKRAEACAIGQPHDEKTSFGPLISEGQRDKVLNYIVSGKEQGARVVTGGQKWPESNDGYWIEPTILADTTPDMTIVKEEIFGPVVVAAPFKTEEEVLEVANDTSYGLAAAVFTNDTRQATRVSAALDAGTVWINQYALLHPGVPFGGFKQSGIGRELGTYGLEAYMQIKAVHNNLTQTSPWPV

SEQ ID NO: 79187 - protein, 731 aa, Ashbya gossypii ATCC 10895
MASMKVTAMLGCLRALLKTVIIICLFGAAISSRLFSVIRFESIIHEFDPWFNFRATQYLVSHSFYEFLNWFDDRTWYPLGRVTGGTLYPGLMTTSALIWHGLRKFGLPVDIRNICVLFAPAFAGLTALATYEFTKEIKDEKTGLLAAAFMAIVPGYISRSVAGSYDNEAIAITLLMVTFMFWIKAMKTGSILHSTLAALFYFYMVSAWGGYVFITNLIPLHVFILILMGRYKSKLYTAYTTWYAIGTVASMQIPFVGFLPIRSNDHMAAFGVFGLIQLVALGSYMKSHVSTDKFKIALLISAAVVGGIGVSGLCALTMLGYIAPWTGRFYSLWDTNYAKIHIPIIASVSEHQPTAWPAFFFDNQFLIWLFPAGVFLLFLDLKDEHVFVIVYSVLCSYFAGVMVRLMLTLTPIICVAAAYALSKLFDEYLDFSDLRRAAPDAKDAARPSRREAFLNLLAKLLVSGTFLFYLFLFVYHCTWVTSTAYSSPSVVLPSHNSDGSPALIDDYREAYYWLRMNTHPDAKVAAWWDYGYQIGGMADRTTLVDNNTWNNTHIATVGKAMASPQDKGYEILRAHDVDYVLVIFGGVLGFSGDDLNKFLWMVRIAEGIWPDEIRERNYFSASGEYRMDAAASPTMKNALIYKLSYHRFPELFGDTQATDRVRGQTISAADIGSLDYFEEAFTSENWMVRIYKLKQPDTLGRTLQEASAFDRELGAGVKKRLVKKPAVGLVL

SEQ ID NO: 79188 - protein, 317 aa, Flavobacteria bacterium BBFL7
MKIYENTGSKDTRSGFGDGLTELGKKNENVVALCADLTGSLKMNAFADNHPERFFQVGIAEANMMGIAAGMTVGGKIPFTGTFANFSTGRVYDQIRQSIAYSDKNVKICASHSGLTLGEDGATHQILEDIGLMKMLPGMTVINTCDYNQTKAATLAIADHHGPVYLRFGRPKVANFTPENGAFEIGKAVMLQEGTDVTIIATGHLVWEALEAAKTLNEKGISAEVINIHTIKPLDEAAIIASAKKTGCVVTAEEHNYLGGLGESVARTLAMHHPTAQEFVATQDTFGESGTPAQLLEKYGLNAENIALKAEKVISRK

SEQ ID NO: 79189 - protein, 481 aa, Synechococcus sp. CC9605
MLEAQAHHQIKTLLRQEESDWPHHLTLSRLVARSLRRRDTTLVQLPPSSSERWWLGLLVPLCLAPEAGALVLTPPQRRRLLQLELPRLRNQGLRLPCWQGSTPPEGPQLWLMDVGELIQAHRDGHLGTRQLLIPEMDQLSRRMRNALTFEIEHQHWDELRQASPQAESGLLELHDRMSRQLFADATRPGGAVRLEGSAGQALRDLLQLLPASPEPWNTLRSINPAEWSQWAELDHRLLQWRWKLAPLEPLQLLRGVLLDHPCLMFSSNGDNARLDLEFEQAGVVPDVRASLRERELNEPLPLYAPRRQPLPNTRIYAQHLLEESRRLILGQAGLTLVLINDDQLRRQLTSSLAAEFGRRVLHESTAPESNGVVTCNWDWWLEHQEQLPAPAQLIVAMLPIASLDNPLTSARVERLKQQGEDWFRTLLLPEALSLIPAAIAPLRRSGGRLAILDGRLRGRSWGDQVLHRLEPWIPLQRLLPD

SEQ ID NO: 79190 - protein, 295 aa, Synechococcus sp. CC9605
MNSELRRDLTAEDGPLAGAVITDVSPVGGGFIHQAWKLCLSDGQLLFAKSGGASALPLFEVEAEALETLHAQADASFLVVPQPIALAALRHGAVLLLPWLDCGGNDQTALGRGLALLHQSSMSSSPARFGWHRDGFIGAGPQLGGWRDDWGSAFVELRLRPQLEALDGLQQDSTDLNPLLLRLAEHLNEHQPHPALVHGDLWGGNAASLSDGRGSIFDPASWWADREVDLAMTRLFGGFGEAFRSGYRDVLPDAPGADGRVEIYNLYHLLNHANLFGGSYLSQCRASLRELARRF

SEQ ID NO: 79191 - protein, 262 aa, Oceanicola granulosus HTCC2516
MSADLSPIDKAKFAAARRATDYVEDGMRVGLGTGSTAAWLVKCLGEMVREDGLRLTGVPTSSRTAALAREVGIKVVSLDEARWLDLTIDGADEYDSNLNLIKGGGGALLQEKIVATASDQMVVIADISKQVDTLGAFPLPVEVIPFGWQTTKVLIEETLIGLDVLGRDTSLRLNGERPYVTDEGNYILDLHLNRIGNARQLSLVLNQIPGVVENGLFIDVCDAVVIGYGDGRVEVRDINEGTVEESRIDFLETENLFTDLAD

SEQ ID NO: 79192 - protein, 454 aa, Oceanicola granulosus HTCC2516
MGDYDYDLFVIGGGSGGVRAARQAAATGARVGLAESSRMGGTCVIRGCVPKKLMVFASGYRELVEDAKGYGWEIDEGRFDWPAFRQSLHGELDRLEGVYRKLLDNSGVEIHDTHASLEDGHTVRLESGGTKSARVILIATGGRPVRPAQLGDAEHGLVSDDIFDLEELPKELLILGGGYIACEFACILNGLGVKVSQFYRGAQILRGFDEEARGLIAESMKEHGIDLHVGTNIVEMDRTGDGRTWVKATNGAEHEFDAVLFATGRAPNTETLNLAAAGIETGRRGQIVVDEYSATSCPSVYAIGDVTDRLQLTPVAIREGMAFVDTVFRDKPTPVDHELVPSAVFTQPELGTIGMTEEQARDLEPVEVYCTSFRPMQTAFIGRPDRVLMKLIVSRATRRILGCHIVAPEAGEMIQLAGIAIKMGATKEDFDRTVAVHPTMAEEIVTMREPVRAG

SEQ ID NO: 79193 - protein, 399 aa, Acidobacteria bacterium Ellin345
MSLLMTKTMTELPLARRMARLGTETAFEVLVRARALEAKGKDIVHLEIGEPDFDTPRNVVDAGIDALNKGFTHYGPSAGLPILRQTIAEEVSKTRGVKVTPEEVVVVPGGKPIIFFTMLALADEGDEIIYPNPGFPIYESMINFVGAKAVPIPLREERDFRLDVNELKDLITDRTKMIIINSPQNPTGGVLTKQDIADIADAIGDRDIMVMSDEIYSRLIFEGQHHSIMSLPGMQERTILLDGFSKTWAMTGWRMGFGVMRADLAAHIARLATNSVSCTASFSQMAGVEAIKGDQSSVAAMNKAFLERRDFFIKRVNQIKGFSCRSPHGAFYTFPNITKTGWPSKKLADALLDEAGVAGLSGTAFGSFGEGYLRFSIANSIENIAKALDRIDEWTKHRL

SEQ ID NO: 79194 - protein, 218 aa, Dichelobacter nodosus VCS1703A
MNQQLLKEKVAAAVLEHVPENITLGVGSGSTVLCFIEALKQAKRQFRDIVAASETSSKALEAAGFRVRDLNACDPPDIYVDGADEINDDKIMIKGGGAALTREKIIASAAKEFICIIDESKKVAQLGRFPVAVEVIPMARSYVAREIVKLGAEPRWRQGVVTDNGHWILDVHYLDLTAAERMEARINTIAGVVECGIFAQRRADKVLMSQSDGEIVLW

SEQ ID NO: 79195 - protein, 458 aa, Zea mays
MPPTMLAPVPTRPRSNPFRRRRGAAPLLLDQTATAAAKRPAESSTSASSCFYSEVISNSSTSLAPYQHLEKRHRRQDTDAGEARPAGSECSEVIGGARVRPAEVEVSESSCPVSVLESDLACPKQLADDAEAIEKSSACDELTPSSEPDEEEVLSDPSHSGYSPSPLISSPLTEDDSDDAPSATFSLFLDFAKQFVPCLHPKPCTVTSSTLDLLTGRRFEDLDDEESYERFRRRERREAVARDFTEVCSSTSIPDSYRPLVVEQRVIMVNWIIQHSRLMKLQPVTMFMGIGLMDRFLTQGYMKGLRNLQLLGIACITLATRIEENQSYNCVLRKTFQVGINIYSQSEVVAMEWLVQEVLNFKCFVTTTHHFLWFYLKAANADDRVADLANYLAFISLRNHEQLSFWPSTVAAAVVVLACLATNKESSCHLVTETHIRTQDDDLPECLMSLEWLIKYVS

SEQ ID NO: 79196 - protein, 214 aa, Diospyros kaki
AFGADLVLTEPTKGMGGTVKKAYELLESTPNAFMLQQFSNPANTQVHFETTGPEIWQDTNGKVDIFVMGIGSGGTVSGVGQYLKSQNPNVKIYGIEPEESNVLNGGKPGPHDITGNGVGFKPDILDMDVMEEVLMVSSEDAVNMARTLALKEGLMVGISSGANTVAALRLARRPENKGKLIVTVHPSFGERYLSSVLFQELRKEAENMQPVAVD

SEQ ID NO: 79197 - protein, 262 aa, Gluconobacter oxydans 621H
MTDSAEHNASPFQSSAHAEDTTDFGYRSVPRGQKKTMVREVFESVAGKYDIMNDVMSLGIHRVWKRIFVGMLNPRPNMKLLDLAGGTGDITFGWLRAGGGPAILSDINAAMLSVGRDRAIKAGLIGKIEVCVVDAEAIPLPDCSVDRVTIAFGLRNCTDKDAVLREARRVLKPGGRFFCLEFSQVEVAALAPIYDMWSFQVLPKMGQIIAKDSESYQYLAESIRMFPDQETLAQMMRDAGLEQVQYRNLSGGIAAIHSGWRL

SEQ ID NO: 79198 - protein, 334 aa, Frankia sp. EAN1pec
MRRAAVLTAGSWGTVFAKVLADAGARVTLFARDRAIADAINGRHVNPRYLADVRLPDLVRATSSPERALRDADLVVLAVPSQALRSCLVEWAPLVGPGAVYVSLMKGMEAGSSRRMSEVIAQAAGVGPERIAVVSGPNLAREIAVEHPAATVVASASAATAHAVQAACWTPYLRPYTNADVLGCELGGAVKNVIALAAGMLEGMGFGTNSLASLITRGLAETARLGTALGADPMTFAGLAGLGDLVATCGSPLSRNRTFGEKLGRGMTLDQVLAEQRQVAEGVRSCRPLLALADGLGVSMPITRQVERVLYEGLPPLEAVKDLMSREPGPEYRL

SEQ ID NO: 79199 - protein, 631 aa, Glycine max
MKLRRSSLCVFLGFLVLFLSPPPSMAKFVVEKNSLTVTSPDDIKGTHDSAIGNFGIPQYGGSMAGNVLYPKDNKKGCKEFDEYGISFKSKPGALPTIVLLDRGNCFFALKVWNAQKAGASAVLVSDDIEEKLITMDTPEEDGSSAKYIENITIPSALIEKSFGEKLKVAISNGDMVNVNLDWREAVPHPDDRVEYELWTNSNDECGVKCDMLMEFVKDFKGAAQILEKGGYTQFTPHYITWYCPQAFTLSKQCKSQCINHGRYCAPDPEQDFSTGYDGKDVVIENLRQLCVFKVANETKKPWVWWDYVTDFQIRCPMKEKKYNKKCADAVIESLGLDIKKIERCMGDPNADSENPVLKEEQDAQVGKGSRGDVTILPTLVVNNRQYRGKLEKGAVMKAICAGFEETTEPAVCLSSDVETNECLENNGGCWQDKVANITACKDTFRGRVCECPLVDGVQFKGDGYTTCAASGPGHCKINNGGCWHEARNGHAYSACSDDGGVKCKCPAGFKGDGVKNCEDIDECKEKKACQCPECSCKNTWGSYDCTCSGDLLYIRDHDTCISKTASQEGRSAWAAFWVILIGLVVAAAGAYLVYKYRIRSYMDSEIRAIMAQYMPLDSQGEIVNHVSEERA

SEQ ID NO: 79200 - protein, 214 aa, Diospyros kaki
AFGADLILTDPTKGMGGTVKKAYELLESTPNAFMLQQFSNPANTQVHFETTGPEIWEDTCGTVDIFVMGIGSGGTVSGVGRYLKSQNPDVKIYGLEPAESNVLNGGKPGPHHITGNGVGFKPDILDMDVMEEVLMVSSEDAVSMARELALKEGLMVGISSGANTVAALRLARKPENKGKLIVTVHPSFGERYLSSILFEELKKEAENMEPVPVD

SEQ ID NO: 79201 - protein, 313 aa, Oceanicola granulosus HTCC2516
MARKIIIDTDPGQDDAVAILLALASPEDVDLLGITAVAGNVPLPLTERNARIVCELAGRPDVKVFAGCDAPLERPLVTAEHVHGKTGLDGPPMDEPTMPLQAQHAVDFITETLRREPAGSVTLCPLGPLTNIAAALQRAPEIAERVQEIVLMGGAYFEVGNITPAAEFNIYVDPEAADIVFHSGIPLTVVPLDTTHKALTTKPRIDAFRAMGTKVGDSVAAWTDFFERFDMEKYGAEGAPLHDPCVIAHLIDPTLMTGRHVNVEIETSSELTLGMTVADWWRVTDRAPNATFMGDIDAERFYALLVERIGRLG

SEQ ID NO: 79202 - protein, 228 aa, Gossypium herbaceum
FTSLCHTDVYFWEAKGQTSLFPRIFGHEAGGIVESVGEGVTHLKPGDHVLPVFTGGCGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQEVLAEMTNGGVDRSVE

SEQ ID NO: 79203 - protein, 174 aa, Silicibacter sp. TM1040
MPASFTPKTRGSETSDKKTSSQTLDTNMSAARATVGDVLASKNGELYWINPEDTVAKAVEVLRDRGIGALLVKNAQGDLVGILSERDIVRRLADTPGATLPQTVEGLMSRDVITATTDQSVVEVLRLMTDGRFRHMPVLEQEQLVGMITIGDVVNFRLTALEYEALQLKQLIVG

SEQ ID NO: 79204 - protein, 434 aa, Schizosaccharomyces pombe 972h-
MNALAKIKAFRSYVPLLQGNTKTIYLNQSFQAPMNMLVSTALQGYINEGLYNPHPKPMWKERTEETRSLLAKLLNASTKDSITFTRDTTEGLNLFQRSLKWKPGDNVVILDNEHPNQGFGWIALQNDGLEVRLVPNEGQYHANASTFAPYVDSRTKAIGLSSVMFHSGQKNDVKDIANAFRPKGIHVLADLTQQVGLSKIDVQDLNVSACAFSCHKGLGCPTGLGVLYVSPLAISELRSTPPFVGGGAVEDFKEDLKLKLNAKYHQSALRYEHTNNAYMLITALRAYLKFLLKVGISNVERYLQGLGKDLIKELESLNVSVIGYKDFDKHSSHSYVLKILNPEWFDFLRQQGVCVSRFESGIRVSFGLYNTSKDIIKFISVIRKGLALNIPLNIRPPQRIAVMDNPLVGISDEAIAAMKLPANTLSNRPLAANI

SEQ ID NO: 79205 - protein, 119 aa, Triticum aestivum
  misc_feature (72)..(72): Xaa can be any naturally occurring amino acid
  misc_feature (78)..(78): Xaa can be any naturally occurring amino acid
  misc_feature (85)..(85): Xaa can be any naturally occurring amino acid
VKIPRTLDNKFVQKSRLVPVRNSRDIVEPRVRAPVNGPRFGGKIGTTKGSLLTQYLMKEGGLIKENWMDEDXREAILXYADAARXPKVIAPAYAQTQPETVFAESDSDGEEKKYILIDY

SEQ ID NO: 79206 - protein, 458 aa, Lactococcus lactis subsp. lactis
MRKLSPTFIYFFGALGGLLFGYDTGVISGALLFIEKESWQVSSWAWMEGWITAAVLMGAVIGAVVIGPMSDRFGRKRLLLLSAVIFFVGALGSGLSNSAELLIISRVILGMAVGSASALVPTYLSELSPAKIRGGVSTMFQLMIMTGILLAYISNYALKGVSGNWHWMLGLATVPAALLFIGGLFLPESPRFLVRHDNEAGAREILGMINDDPNSIEAEISDIQLMAKEEKQGGLQELFGQMSRPVLIMAIGLAIFQQVMGCNTVLYFAPSIFVAVGFGASAALLAHIGIGIFNVIVTYIAMRVMDKVNRRWMLNFGAWGMGISLVLMSVGMILAENAHIGFGKYLAVIALTVYIAFFSATWGPVMWVMIGESFPLKIRGLGNSFGAAVNWAANWVVSLTFLPLLSFFGTGKIFLIYAACCFLSIWFTSKKVIETRGKTLEQIEAELLHRVHHLEEEG

SEQ ID NO: 79207 - protein, 727 aa, Ashbya gossypii ATCC 10895
MSSSKRIRIRAPGHVLNPKANDIETGWPVLANAIDMIYERRESTLSFEELYRLVYDLVLRKFGRELRTRILDTLQHKIWSAAKTEIPCTAQAAEFVDEMYALWKRQHSCLNAVWGVTMYIDSSAGHSHGNDIYSVALMKMQNLILAPVLPRIVRYMLDELNRARESGVQAVNMQTYLRAAALARSLWLPELGPSSDLTKQLLEDTHTFYSSWRKKHADNPMRYIMEVDTVLKTEVELLRELGYTDATIKTCRTMVIEVLVSENIGFILPICLQECIDAGDEENLDLLLSLCTTDQDASQFLVALSECVEKEGMAIPDVSVSKRKADAAVAWVKALTKLRTKYTSPFKKYTDSNGCYLKTIGDALAALLSNQPAKTVDYLVMSIDSVLRSNTTLEEEQQELLERCISFFILMRDKDLFELSYRQQLSKRLLQRKSPFHLEQWMVGKMTQEVGIHYTSNLEGMLRDVKLSQGYSAKFSAPAAAAGAAYQMDVLTPTFWPFQQVETLAQDITLSDELAAARSSYEGLYVSQHSGRRLKWEYNLGSVRIGHQFGQSYHELTMWTYGATIFLLFRDYAELTTEKIQDLTAIPDAELQRQLISLAVAPRTRILTKTPPSRTIAPSDHFAVNTAFTAPTTKVRVATVVVKSEQAAALPDVLAASRVQAISAAVVRQLKTERTMAHTELQDAAVRALQRHFAVSTSMFKRAIQSLLEKEYIQRDAHSPDRYHYLA

SEQ ID NO: 79208 - protein, 522 aa, Yarrowia lipolytica CLIB122
MYLENLKRQESLGHVISNRTFGTRTRTQTLRHSNPLKLTHSLITPRDTLSHVHHCLEADTRRPAETQTQTAKKKKLPYHMSAPPLLPPKRPVGARMKLPVLQIPTTSTESPSDQQRPQRPSLMLNTGNGNNGNNNGSAHNTHVVDSNLEPPSMLGNNRSVSPQSAAFSAEILAAVGSPAPDKHVTHEYPVHPSSHSNNSGDDDGMDETQDLTGLDVDDLDEEKWHSVARTGGIVELGKLGEGAGGSVTLCRLRTGSTVFALKSITANPNPELQKQIVRELRFNRTCSSPHIVKYYGTFLNDEAASIFIAMEYCGGGSLDAIYKRVKDRGGRIGEKVLGKVAEGVLKGLSYLHERRIIHRDIKPQNILLDKEGQVKLCDFGVSGEVVNSLATTFTGTSYYMAPERILGQPYSVTSDVWSLGLTIMEVAQHRFPFISAEQEAREEPITPIELLSIIVNAPAPELKDEPEEGIKWSNAFRHFLLCCLEKDQSKRASPRQMLKHPWMLGQMQKQVKMDKFVKEVWN

SEQ ID NO: 79209 - protein, 719 aa, Elaeis guineensis
EIPYNIGFLQVATLSLQGNRLTGKIPEVIGLMQALAVLDLSENELVGTIPPILGNLSYTGKLYLHGNKLTGPIPPELGNMTKLSYLQLNDNKLVGTIPAELGKLEELFELNLANNNLEGPIPQNISLCTALNKFNVHGNRLNGSIPLQFQKLESLTYLNFSSNNFKGKVPWELGRIINLDTLDLSNNHFSGPIPDSIGDLEHLLELNLSRNNLNGPLPTEFGNLRSGQTIDISYNKLSGPIPEELGQVQTIDTLILNNNDLYGEIPVQLTNCFSLSSLNLSFNNFSGDVPLSKNFSRFPQESFLGNPMLCGNWLGSSCGQDLHGSKVTISRAAVVCITLGCITLLSMMLVAIYKSSQPKQFIKGSNRTVQGPPKLVVLRMDMAIHTYEDIMRITENLSEKYIIGYGASSTVYKCVLKNSKPIAIKRLYSQYPHNLHEFETELETIGSIRHRNLVSLHGYSLSPHGNLLFYDYMENGSLWDLLHGPSKKVKLDWDTRLKIAVGAAQGLAYLHHDCNPRIIHRDVKSSNILLDENFEAHLSDFGIAKCIPAAKTHASTYVLGTIGYIDPEYARTSRLNEKSDVYSFGIVLLELLTGKKAVDNDSNLHQLILSKADDNTVMEAVDFEVRSPAWIWGCQKAFQLAICAQRSDRPTMHEVARVLVSLLPVPSLKPGLVPQKPMDYAHYLAAGPDVKIKRTHDDNSSSDGQWFLRFGEVISKNTL

SEQ ID NO: 79210 - protein, 528 aa, Coprinopsis cinerea okayama7#130
MGLDLVKLGFFLAVVPVATILLNVLRQLLFPTRAPNPPEVFHWIPIVGSALQYGNDPINFFFKCREKYGDVFTFILLGRRITVALGPKGNNFILGGKSTVFNAEDAYTHLITPVFGKDVVYDVPNEKFMQQKRFIKAGISTENLRAYVGMIEEEVEDFLEKDPSFATYQQRNPANEWGRFNAVKTMQEITILTASRTLQGREVRSSLTKEFAQTYNDLDGGLTPLNFLFPNLPLESYRRRDRAQKKMSDFYIDIIKKRKLAQVEEVEHDMIASLSEQRYRSGAPLPDHEIAHIMIALLMAGQHTSSATSSWALLHLAHNVEVAEALYNEQVEHFSNPDGSFRPLTYDELRALPILDSVIRETLRMHPPIHSIMRYVRDDVVVPGSLAAASEDKTYVIPKGNYVLASPVVSQMDPRIWRNPEKWEPARWSDPNGVAAQAYSTYVDGNGEKIDYGFGAVSKGTESPYQPFGAGKHRCIGEQFAYLQLGTLIATIIRKLELRVDKVPEHNYHTMILMPKAPDVISYRRRNV

SEQ ID NO: 79211 - protein, 315 aa, Aspergillus oryzae
MAANYWASTQRRHWLFTKERLADIRESFRERDKAAHSQFPLPDQRLLNIYFSQQLIKLGKRMSTRQQALATAQVYIKRFYTKNEIRHTNPYLVVTTAFYLACKMEECPQHIRFVVAEARNFWPEFIAPDVSKLGECEFALISEMNSQLIVHHPYRTLSELQPELSLTSDEVALAWSVINDHYLTDLPLLYPPHVIAVMAIIVAVVFKPSQTSFHGTAAPLAGAMRDGGMNILAALGDKNGAGPPPRIQKLVGWLAESEVDIRAVIECTQELVSLYEIWENYSEKHCKELLGRMVKSKNLDKIGAVCFCVAFREFG

SEQ ID NO: 79212 - protein, 187 aa, Oceanicola granulosus HTCC2516
MSPLNIQQGSTSHSAYNLRPTFSDVEERHTLAVLVENEPGVLARVIGLFSGRGYNIESLTVAEVDHTGHLSRITIVTTGTPQVIEQIKAQVGRIVPVHAVHDLTVEGASVERELALFKVAGQGDQRVEALRLADIFRANVVDSTLESFVFEITGTPEKIDAFAELMRPLGLVEVARTGVAALSRGSR

SEQ ID NO: 79213 - protein, 361 aa, Microcystis aeruginosa PCC 7806
MTQQYRITLLPGDGIGPEILAVTVEILKVIGKKFDLQFDFQTALIGGAAIDETGSPLPEATLSACKNSDAVLLAAIGGYKWDNLPRQQRPETGLLGLRSGLGLFANLRPATIFPQLIDASSLKREIIEGVDIMVVRELTGGVYFGQPKGIFETETGEKCGVNTMVYLESEVDRIAKVAFEIAQKRGKKLCSVDKANVLDVSQLWRDRMTKIAANYPDVELSHLYVDNAAMQLVRAPKQFDTIVTGNLFGDILSDEAAMLTGSIGMLPSASLGTAGVGVFEPVHGSAPDIAGQDKANPIAQILSAAMMLKYALNQPLAAAALEKAVEKVLEFGYRTGDIFSEGMTLVGCQAMGQVILKVLES

SEQ ID NO: 79214 - protein, 174 aa, Aspergillus oryzae
MLYYEFDDLLPANSSQKLLDLYPTSLRSEIDTSNEWIYNDVNNGVYKSGFATTQEAYQKNVTTLFSSLDKIEAHLQSNASPYFFGSALTEADIRLFTTIVRFDPVSGYPAIHRWLRNLYWDIPAFRETTEFEHIKFHYTKSHTQINQFAITPVGPVPDILPKDEEVRAAAAVKK

SEQ ID NO: 79215 - protein, 144 aa, Humulus lupulus
WLTFLLFPFGIHSSDPKSLLLISFFLLHYFNRTVFFPLRLLRQKNPGDFPVAIAATAFGFNLLNAYLQARSVSHYSDYDGDEWFWWRFFAGAVVFLAGMAINVASDRVLVRLKESGGGYKVPRGGWFERVSCPNYFGEAVEWLG

SEQ ID NO: 79216 - protein, 515 aa, Bacillus cereus ATCC 14579
MSLLKVESLSHSFIDKVLYENASFDLHKGEHMGIVGQNGAGKSTLMKILVGEIISDKGDIKWQPNIQIGHLDQYAEIDEGYTISQYLKRAFYDLYEMEKRMNKLYEESAMTGDENQLLKAAEIQGLLEAHDFYSVDSITNKVAAGLGIDVIGMNRVIGELSGGQRAKVILAKLLLEEPNILLLDEPTNFLDKEHVEWLANYLMNFEGAFIVVSHDFDFLEKVTSCICDVEFGTVKKYYGKYSDFVRQKEHLRKDYIRQYYAQQKKIEKTEEYIRRNIAGVNSKIAQGRRKQLQRMERIAPPSFTHKPSIHFQELPISVQTVLEVNNFEVGYDFALLPKLNFSVMGRQKIVITGFNGVGKSTLLKTIVGNIDSISGEFHFSEQIKIGYYEQDLNWSNDSLTPLQIISEQFPKLNMKEIRHHLAACGVKDTHVSQEIRTLSGGEQSKVKLCGLLLSPCNLLILDEPTNHLDAEAKEALQKALIKFKGSIILVSHEASFYLDWADSIFHIETGLVKGV

SEQ ID NO: 79217 - protein, 315 aa, Neisseria meningitidis Z2491
MNILSKISSFIGKTFSLWAALFAAAAFFAPDTFKWAGPYIPWLLGIIMFGMGLTLKPSDFDILFKHPKAVIIGVIAQFAIMPATAWLLSKLLNLPAEIAVGVILVGCCPGGTASNVMTYLARGNVALSVAVTSVSTLISPLLTPAIFLMLAGEMLEIQAGSMLMSIVKMVLLPIVLGLIVHKVLGSKTEKLTDALPLVSVAAIVLIIGAVVGASKGKIMESGLLIFAVVVLHNGIGYLLGFFAAKWTGLPYDAQKTLAIEVGMQNSGLAAALAAAHFAVAPVVAVPGALFSVWHNISGSLLATYWAAKAGKHKKP

SEQ ID NO: 79218 - protein, 404 aa, Flavobacteria bacterium BBFL7
MLDIQKIRADFPILNREVNGRPLVYFDNAATSQKPQQVIDKIVEYYTLYNANIHRGVHALSQEATDLFEASREKVRAFFNIPQTKQVIFTSGNTHSINAVASGAHVFVQKGDEVIVSAVEHHSNIVPWQMLCERVGATLKVIPVLDNGELDMKTYEELLNDKTAFVVVNHVSNALGVTNPVEEIIKGAHKHGAMTLIDGAQSCGHMKLDMQAINADFYTMAGHKMCGPTGIGILYGTEKALNALPPYQGGGEMIDQVTFEHTTYAGLPHKFEAGTPNIAGGIALGAAVDYLNDVGMDHIAAYEHELLVYGTQQLKTIEGLKIFGDVLNKAAVISFNVTTLHPYDIGTIVDKLGIAVRTGHHCAQPVMERYEVPGTVRASFAFYNTKEEIDIMVQALQRAVSMLS

SEQ ID NO: 79219 - protein, 455 aa, Lactococcus lactis subsp. lactis
MKTNKKISASFIYFFGAFGGILFGYDIGVMTGALPFLQTSWGLTNNATIIGWITSSVMFGAIFGGAVAGLLSDRLGRRKMILISSLIFMVGSLLSSISPHDGQYYLIIVRILLGLAVGAASALVPSYMSEMSPANIRGRLSGINQVMIVSGMLLSYIADYFLKNLSTDIAWRVMLGAAAIPALILFFGVLALPESPRFLIKSGKIDEAKQVLSFIRKPDEIENEIKSIQDTAKQESAALSSTSWGTLFKSRYRYLVVAGLGVAAFQQFQGANAIFYYIPLIVEKATGHSASEALMWPIIQGIILVIGALFFLVIADRFDRRTLLRLGGSIMGLSFILPAIINFIIPNSSPMMIVFFLCIYVALYSCTWAPLTWVLVGEVFPLAIRGRASGLASSFNWIGSFLVGLLFPIMTASMSQEAVFAIFGVICLLGVLFVQFFVPETRGRTLEEIEKHIKN

SEQ ID NO: 79220 - protein, 406 aa, Oryza sativa
  misc_feature (364)..(364): Xaa can be any naturally occurring amino acid
  misc_feature (376)..(376): Xaa can be any naturally occurring amino acid
  misc_feature (391)..(391): Xaa can be any naturally occurring amino acid
  misc_feature (399)..(399): Xaa can be any naturally occurring amino acid
MADYVYGPGRNHLFVPGPVNIPDQVIRAMSRQNEDYRSPAVPALTKTLLEDVKQIFKTTTGTPFLFPTTGTGAWESALTNTLSPGDKIVSFLIGQFSLLWIDQQQRLNFNVDVVESDWGYGADLAALDYKLRQDPSHSIKAICIVHNETATGVTNDLSAVRKILDKHRHPALLLVDGVSSICALDFRMDEWGVDVALTGSQKALSLPTGLGIVCASPKALEASKTAKSVRVFFDWKDYLKFYKMGTYWPYTPSIQLLYGLRTALDLIFEEGLENVIKRHNRLGTATRLAVEAWGLKNCTQKEEWFSDTVTAVVVPPYIDSAEIVKHAWKRYNLSLGLGLNKVAGKVFRIGHLGHLNELQLMGAXLSGVEMVLKDIXGYPVKLGSGVAAAAXAYLSNSTXPLIPSRI

SEQ ID NO: 79221 - protein, 287 aa, Triticum aestivum
MGGLSLQHPWAFAFGLLGNVISFMTYLAPLPTFYRIYRSKSTQGFQSVPYVVALFSAMLWIYYALLKSDECLLITINSAGCVIETIYIIIYLTYAPKQAKLFTAKILLLLNVGVFGLILLLTLLLSEGEKRVVMLGWVCVGFSVSVFIAPLSVIRLVVRTRSVEFMPFSLSLSLTVSAVVWFLYGLLIKDKYVALPNILGFAFGVIQMGLYALYRNATPRPAPKEVDAPVSDDGAVKPSEHVVNIAKLGPAATAIELNTHYPVDPPPSMKEGGAKENGVGLRQRREA

SEQ ID NO: 79222 - protein, 563 aa, Herminiimonas arsenicoxydans
MRVDFRRLLPFLHWPRPSADSLRRDIWAGLSVGLVLIPQALAYATLAGMPPQTGLYAALLPSVIGILWGSSALLAVGPVALTSILTFGSLSPMAAAGSADWVALAIWLSVYAGAIQFLLGACKMGKITYLVSQPVVMGFINAAAVIIVLSQLPGLLGLDLHAGSAMTQVGNLLAGAPAMLLTTAFGLGALFLLLALKRYAPHVPGMLIVTVLGIAASWAIDYAGHGGAIVGTLPVGLPPLSLPPAISWGAHQALWPAATILAIISFTEAMSSCRVLARKTNERWDENQELIGQGLAKITSGFSGAFPVSGSFSRSALNIYAGATSAWASLIAAACVLLSLYFLTTPIAYLPYSVLAAMIMVPVFRLLDFRAFPRLLRISRDDGLVAIVTFGVTLWCTPSLHYGVFAGVGITMVSFLYRHTHPRVIEVGVHKDGTLRDRKRFHLPPLAPDILAVRMDSTLNFLTAATLERFITEYRGRDKGIRRVLLCASGINDIDASGIETLESLRQSLRAEGLELYFTAVKKQVWDVLERAGLIAAMGPDHMFQTDREAIAVLHADAANTMN

SEQ ID NO: 79223 - protein, 328 aa, Cryptococcus neoformans var. neoformans JEC21
MASAAYSTIKLFSGSSHPELAALIAKRLRIPLARANISQPPSGETKVTIVESVRDCDVYILNTGAGAVNTNLMELCIMIHACKIASARRITAIIPHFPYARQDKKDKSRAPITAKLVANMLREAGCDHVITMDLHASQIQGFFDVPVDKLYAEPSMIQYMRNNIDVHDCVIVSPDAGGAKRATSIADRLNVEFALFHKERKKANEVSRMVLVGSVTGKIAILVDDMADTCGTLGLAAKNLLEAGATKVYAFATHGILSGNALKVISESGMEKLIITNTIPQSENCEKCEKIEVIDVSRVLAEVIRRSHFGESVSYLFHEVPYSNGVGA

SEQ ID NO: 79224 - protein, 315 aa, Opitutaceae bacterium TAV2
MARNARRNSRRRHCHQVRRLLRPKRRGAASPAPRILSHPRTPPPLRRGWTVRRNSPRRRMIPIKNKDGIARMRDACAIAATVLEELKKLVQPGITTYDLDQSARDTMTRLGAKSACYGYQIPGHRPYPAYTCLSVNEEVVHGIGSMRRVLQNGDIIALDVCVVYNGYIGDNAYTARVGTVSPAVEKLLRVTDEARTIGIAQARVGNRIGDISHAIQTYVEAHGFSVVRDMVGHGVGTSMHEEPQIPNYGRKNSGDKIKPGMTLAIEPMVNLGGYKIKTLGDGWTTVTCDGSPSAHFEHTVLTTENGPEILTIPRA

SEQ ID NO: 79225 - protein, 278 aa, Agrobacterium tumefaciens str. C58
MMVTYIDAASAPLKNTGVIRLYTPEDFDGMRKACQLTARCLDELAAIVKPGVTTDAIDRFVFEFGADHGALPATLNYRGYTKSVCTSINHVVCHGIPDEKPLRDGDIVNIDVTYVLDGWHGDSSRMYPVGQIKRAAERLMEVTYECLMRGIAAVKPGTRTGAIGAAIQAYAEAERCSVVRDFCGHGVGRLFHDTPNILHYGQPNEGPEIREGMIFTIEPMINLGKPHVKVLSDGWTAVTRDRSLSAQYEHAVGVTATGCEIFTLSPGGFDRPGLPPLA

SEQ ID NO: 79226 - protein, 319 aa, Arabidopsis thaliana
MASAWKKDKNQKLLSPKTLISLLVLSIIFLSSLFFFFSNSSLQYSNPNLSINSPYPIPPFDCFKCPQSKPIIANVVENLKYPFVYSLADLGNLPEKPHKNIVRLLKGKPFRKPDISATIQEVLDSMRASGKNGIVVDVGANVGMASFAAAVMGFKVLAFEPVFENLQRICDGIWFNRVSSLVTVFEAAASDRTGDITFHKLVGRLDNSAVSEVGARLAFKSNKEIAVQVKSIPLDKLIPPSQPVLLIKIDVQGWEYHVLKGAKKLLSRKPAEAPYLIYEEDERLLTASNSSSKEIRDFLKSVGYSKCSQHGTDAHCTKE

SEQ ID NO: 79227 - protein, 379 aa, Arabidopsis thaliana
  misc_feature (311)..(311): Xaa can be any naturally occurring amino acid
MDGSKHPSVFQKLHGQSYLINRLSPSVQARGYCVSGAYVNGGLQSLLQPTSHGVGSSLIPHGSFPVLAHAPSEKTGTGFLIYFLMGGVSAAVSKTAAAPIERVKLLIQNQDEMIKAGRLSEPYKGISDCFARTVKDEGMLALWRGNTANVIRYFPTQALNFAFKDYFKRLFNFKKEKDGYWKWFAGNLASGGAAGASSLLFVYSLDYARTRLANDAKAAKKGGQRQFNGMVDVYKKTIASDGIVGLYRGFNISCVGIVVYRGLYFGLYDSLKPVVLVDGLQDSFLASFLLGWGITIGAGLASYPIDTVRRXMMMTSGEAVKYKSSLQAFSQIVKNEGAKSLFKGAGANILRAVAGAGVLAGYDKLQLIVLGKKYGSGGG

SEQ ID NO: 79228 - protein, 132 aa, Chlamydomonas reinhardtii
MAGRGKGKTSGKKAVSRSAKAGLQFPVGRIARYLKKGKYAERIGAGAPVYLAAVLEYLTAEVLELAGNAARDNKKNRIVPRHIQLAIRNDEELGKLLGEVTIASGGVLPNIHAVLLPKKNKGGKAEDGSAAV

SEQ ID NO: 79229 - protein, 498 aa, Lolium perenne
MRTNPTTSRPGVSTIEEKSTGRIDQIIGPVLDVTFPPGKLPYIYNALVVQSIDTANKQINVTCEVQQLLGNNRVRAVAMSATDGLMRGMEVIDTGAPLSVPVGGATLGRIFNVLGEPVDNLGPVDSSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNIEESKVALVYGQMNEPPGARMRVGLTALTMAEYFRDVNKQDVLLFIDNIFRFVQAGSEVSALLGRMPSAVGYQPTLSTEMGSLQERIASTKKGSITSIQAVYVPADDLTDPAPATTFAHLDATTVLSRGLASKGIYPAVDPLDSTSTMLQPRIVGNEHYETAQRVKETLQRYKELQDIIAILGLDELSEEDRLTVARARKIERFLSQPFFVAEVFTGSAGKYVGLAETIRGFQLILSGELDGLPEQAFYLVGNIDEASTKAITLEEENKSKK

SEQ ID NO: 79230 - protein, 183 aa, Arachis hypogaea
MATRRYAFGRVDEATHPDSMRATLAEFASTFIFVFAGEGTGLALDRIYKDEAFSAGELLSLALAHAFALFAAVSASMHVSGGHVNPAVTFGALIGGRISVVRAIYYWVAQLLGSIVASLLLRLVTNNMRPGGFHVTSGLGAGHGLILEIVMTFGLMYIVYATAIDPKRGSIGAIAPLAIGLML

SEQ ID NO: 79231 - protein, 425 aa, Silicibacter sp. TM1040
MLNAEISIRRNAAISRGVGMQTQVYVSRAEGAEVWDVEGHRYIDFAAGIAVVNTGHCHPKVMEAVRSQSAAFTHTCHQVLPYESYIRLAERLNDKVPGNFDKKTAFVTTGAEAVENAIKIARAATGRSAILAFGGGFHGRTFMGMSLTGKVAPYKKGFGAMMPDVYHVPFPVDLHGISTADALGAIDRLFKADLDPDRLAAIILEPVQGEGGFYPAPKELMHALRELCDAHGILLIADEIQTGFARTGHLFAMEGYDVAPDLTTMAKGLAGGLPLAAVTGRAEVMDAAAPGGLGGTYGGNPLGIAAAHAVLDVIEEEDLCTRANALGARLKQRLSAIQERVPEIADIRGPGFMVAAEFNTTDGSAPNPEMANAIRTEALERGLVLLTCGVYGNVIRFLAPITIPDAVFSEALEILEASILAAKDA

SEQ ID NO: 79232 - protein, 489 aa, Silicibacter sp. TM1040
MSTPTSLSLRDPSLLETRAYVNGQWINGATTFDVIDPATGRLVAEVADLDVAAAAKAVDAAHAAGPSWAALAGKERSSILRRWHDLLVENADDLATILTAEMGKPWAEARGEILYGASFIEWFAEEAKRIYGDVIPGPQRDKRIMVLKQPIGVVGSITPWNFPNAMIARKVGPALAAGCTFVARPAELTPLSALAMAVLAERAGIPAGVFNVIPSNDAPGVGRELCTNPKVRKITFTGSTRVGRILMEQASGTIKKMSLELGGNAPFIVFDDADLDAAVEGAMIAKFRNNGQTCVCANRIYVQASVYDAFAEKLAGEVKSLQVGNGFDDATTAGPLINEAALRKVEAHISDAVGKGARIVTGGHRSDLGGTFFEPTVLRDVNPHMVVCHEETFGPLAALVRFDSEEEVIALANDSEFGLAAYFYARDLSRVWRVAESLESGMVGANTGLISTEVAPFGGIKQSGLGREGSKYGIDDFVELKNICLGGMS

SEQ ID NO: 79233 - protein, 477 aa, Glycine max
MGSLFSMANTKANQSESSATSPNETSKRQRMSPASVEECPRLIPNIPDELSLQIIARLPRICYYHVRLVSRRWKTTITSLELYKVRKELGTTEEWLYLLVRIGQNKLLWHALDPRSRIWQRLPIMPRVVDEEDSQKVSSRLWMWNMVEGIRIAEIIRGLLGQKDVLDDMPFCGCAFGAVDGCLYILGGFSKASTMKCVWRFDPIQNSWKKVNSMSTGRAYCKTGVLNNMLYVVGGVSQGQAGLIPLQSAEVFDPFKDTWSDVPSMPFSRAGVLPTAFLADMLKPIATGLSSYKGRLYVPQSLYSWPFFVDVGGEIYDPETNSWMEMPNGMGEGWPIKQAGTKLSVVVNGELYAFDPSNSVDSGRIKVYDQGEDAWKVVIGKVPVYDFTELEYPYLLAGFHGKLHFITKDANHDISVLQADLCSNLDSSQSTSTPQSPKSMEDELLQESTETDEVIWKLVASKGFGQAELINCQVIDI

SEQ ID NO: 79234 - protein, 496 aa, Ashbya gossypii ATCC 10895
MLRNVCRPAMRRSFHQTAWMSANKKHDVVVIGGGPGGYVAAIKAAQLGFDTACVEKRGRLGGTCLNVGCIPSKALLNNSHLLHQMQHDAKQRGIDVKGEVTVNMPQFQKAKDTVVKQLTGGIEMLFKKNGVTYYKGLGTFESESSIKVSPVEGLEGAVAEETILEAKNIIVATGSEVTPFPGITIDEERIVSSTGALSLKEVPKRLVVIGGGIIGLEMGSVYSRLGSKVTVIEFQPQIGATMDGEVASTTQKFLKKQGFDFHLWTKVLSAERNGYVVDIKAENVKTGKVESFQADVLLVAIGRRPYIEGLGAENIGLDVDKRGRLVIDEQFNTKFPHIKVIGDVTFGPMLAHKAEEEGIAAAEYIKHGHGHVNYGNIPSVMYSHPEVAWVGKTEEQLKEAGIAYKVGKFPFMANSRAKTNLDTEGFVKVLIDAETERLLGAHIIGPNAGEMIAEAGLALEYGASAEDIARTCHAHPTLSEAFKEANLAAFSKSINF

SEQ ID NO: 79235 - protein, 323 aa, Crocosphaera watsonii WH 8501
MPNLAMSSLSDNNRLSLFSGSSNIPLAQEVARYLGMDIGPLIRKRFADGELYIQIQESIRGCDVYLIQPCCNPVNDHFMELLIMIDACRRASARQITAVIPYYGYARADRKTAGRESITAKLVANLIVEAGANRVLAMDLHSAQIQGYFDIPFDHIYSTPVLLDYFATKDLSDIVIVSPDVGGVARARAFAKKLDDAPLAIIDKRRQSHNVAEVMNVIGDVKGKTAVLVDDMIDTAGTITEGAKLLREEGARQVYACATHAVFSGPAIERLSSGVLEEVIVTNTIPIPEEAHFPQLTVLSVANLLGEAIWRIHEDTSVSSMFR

SEQ ID NO: 79236 - protein, 181 aa, Xanthomonas axonopodis pv. citri str. 306
MTPIRSFLDHTPQLGARVYVDPACTIIGKVSLGDDVSIWPGTVIRGDVNHVQIGARTNVQDGTIIHVSHHSPFNKAGYPTVIGEDVTVGHGTILHACTIEDLCLIGMGACVLDGATVRRYGFVGAGAVVGPGKVVGEAELWLGNPARLARTLSDKEIESLHYSAQHYVRLKDQYLGASPAS

SEQ ID NO: 79237 - protein, 581 aa, Sinorhizobium meliloti 1021
MRSPCLKSLSITLIVALSTFAPRQGLAASPEPVKAEHGMVVTAQHLASDIGVEVLKKGGNAIDAAVAVGYALAVVYPTAGNIGGGGFMTIRFKDGKTTFLDFRERAPLAATKTMYLDDKGDLVKGLSTEGYLAVGVPGPVMGFEFARSRYGTKPLKELIDPAIELAREGFVLQQGDIESFDGETERLARDPAAAAIFLKPDGKPFAAGDRLVQTDLAASLSSIAEKGTDAFYKGAIADAIVKASADKGGILAKEDFERYQVRELEPVKCNYRGYDIVSSPPPSSGGLIICEILNILEGYPLSYLGYGSAETVHAMIEAMRHAYVDRNTALGDPAFVENPVAKLVDKSYAKEIRAKIDPFKAGVSQELMPAGFTESKETTHYSIIDDEGNAVAVTYTLNGSFGAGVVAPGTGILLNNEMDDFTAKPGTPNLYGLVQGEANAIEPGKTPLSSMSPTIISRDGKPFMVIGSPGGARIITITLEAIINVIDHGMNIQEAVDAPRVHHQWLPDKVFMEPYALSPDTRKLLSAMGHDVQVDENWMIWGQAAGILVGGENVAEIEAGGGARYNGAVDSRIGAGAARGY

SEQ ID NO: 79238 - protein, 400 aa, Rhodobacter sphaeroides 2.4.1
MSLAHGRPYLAIPGPSAMPDRVLNAMHRAAPNIYEGALHEMVASLWPDLKRIAGTEHQVALYIANGHGAWEAANANLFSRGDRALVLATGRFGHGWAESARALGVDVQLIDFGRAAPADPARLEEALRADPGHRIKAVLVTHVDTATSIRNDVAALRAAIDAVGHPALLAVDCIASLACDEYRMDEWGADVTVGASQKGLMTPPGLGFVWYSDRALERCRASDLRTPYWDWTPRSFGTEFWQHFCGTAPTHHLYGLRAALDMILDEGLPAVWARHEALARAVWTAFDHWGAGNPEIALNVADAACRGRSVTAARMGAPHATRLREWTETRAGVTLGIGLGMALPSEPAYHGFLRVAHMGHVNAHMTLGALAVMEAGLAALEIPHGEGALAAAAASLGAAA

SEQ ID NO: 79239 - protein, 393 aa, Hordeum vulgare subsp. vulgare
EFGTRLSPRVPRLPLAAHCAGAGAGILRCCGRLAASAARCQVTASGSVAAGSSSSSELEAIRWGSAKLQGAREEMEDEVVLRPESLLHGFSFAAVLDGHAGFSTVQFLRDELFKECAAALDGGAVLNTKNLEAITDSIRRAFATVDANLSTWLQQMDKEDDSGATATALFLRNDVLVVSHIGDSCLVISRGGRPQSLTNFHRPYGNNKTSLEEVKRIRAAGGWIHDGRICGDISVSRAFGDIRFKTRKNEMLVKGVKEGRWTEKFVSRIKFNGDLIISSPDVSLVELGPDAEFVLVATDGLWDYIKSTEAVAFVRDQLRQHGDVQRACEALGEKALDRRSQDNISIVIADLGRTNWQELAVPRPNVLLELSQAIATVGAVSVGIWISWLLTLQ

SEQ ID NO: 79240 - protein, 270 aa, Triticum aestivum
  misc_feature (105)..(105): Xaa can be any naturally occurring amino acid
  misc_feature (171)..(171): Xaa can be any naturally occurring amino acid
  misc_feature (180)..(180): Xaa can be any naturally occurring amino acid
  misc_feature (237)..(237): Xaa can be any naturally occurring amino acid
  misc_feature (250)..(250): Xaa can be any naturally occurring amino acid
MATTNWTLPDHPTLPKGKTVAVVVLDGWGEASPDQYNCIHVAQTPVTDSLKNGAPEKWRLVKAHGTAVGLPSDDDMGNSEVGHNALGAGRIFAQGAKLVDAALAXSGKIWEDEGFNYIKESFDKGTLHLIGLLSDGGVHSRLDQVQLIVKGASERGAKRIRLHILTDGRDXLDGSSVGFXVETIEKDLAQLREQGVDARIASGGGRMYVTMDRYENDWSVVKRGWDAQVLGETTYKXPKALKAVKTLRAXPKANDHYLPPFVKLKTLQTP

SEQ ID NO: 79241 - protein, 71 aa, Brassica napus
  misc_feature (37)..(39): Xaa can be any naturally occurring amino acid
MASSDGLASVDPWSFRQSFNIDSWLLPDPFSHDSDVXXXALHKSISDPLSFFYPPRFSISHLPQKPLTPPV

SEQ ID NO: 79242 - protein, 493 aa, Xanthomonas axonopodis pv. citri str. 306
MNALTSATAAATDTPAWHGCIFNGDWVPGRGGSLPIHEPATGALLHEVGKADLSDLAAAIAQAKQAQRAWSATPPRERAAVFHRAAQAMQARSAEAALLIARETGGILPKAQREVDESVVFYQQAAAMPLQASGQMLPTSAGQLSLARRLPLGVIGVISPFNFPLILSLRSVAPALAMGNAVILKPDPRTPYTGGVIIAQVLEQAGLPKGLLHVLHGDAQLGQALVESPDVPMIAFTGSTAAGRCIGEIAGRHLKKVSLELGGNNAVIVLDDADLDKAASAVAFGAYMHQGQICMATGRVLVHRSVAQALTQQLAEKARHLPVGDPVSGTVALGPIIDQRQLQRVVDIVNDSVAAGAVVEAGATHEGLFYAPTVLSNVRPGMRAFDEEVFGPVINITVFDTDDEAAELANQGEYGLAAGILSASVSRALALGEKLHTGLLHINDQTVADEVVNPFGGTGASGNGTSVGGPADWEQYTHWQWLTIKNEVPQYPF

SEQ ID NO: 79243 - protein, 263 aa, Oryza sativa
MAACCSSLATAVSSSSAKPLAGIPPASPHSLSLPRAPAAAARPLRLSASSSRSARASSFVARAGGVDDAPLVGNKAPDFDAEAVFDQEFINVKLSDYIGKKYVILFFYPLDFTFVCPTEITAFSDRYDEFEKLNTEILGVSIDSVFSHLAWVQTDRKSGGLGDLKYPLISDVTKSISKSFGVLIPDQGIALRGLFIIDKEGVIQHSTINNLAIGRSVDETMRTLQALQYVQDNPDEVCPAGWKPGDKSMKPDPKGSKEYFAAI

SEQ ID NO: 79244 - protein, 180 aa, Lotus japonicus
QAACKFLRRKCMPGCIFAPYFPPEEPQKFANVHKIFGASNVTKLLNELLPHQREDAVNSLAYEAEARVRDPVYGCVGAISYLQRQVQRLQKELDSANADLLRFAYNELPQVTLPPVPPTITTIQQMVPSQRQYGGRFGNFEGTGFYRQSATTFSFPYALPWTDISSGGEGGIGGEGGGNL

SEQ ID NO: 79245 - protein, 1527 aa, Aspergillus oryzae
MAPVSTAGEAVARVAYLTSDIVVSVQPSLQTDSWFSKPLKALKQEKARSILPKGVPDVVSVRYNEDPLLSAFHPLQTGDVVSVVSSSSVLLSSIPHLYRLANFPIVIHVALEPSPFPDYSVISSIRQCGFAFLHSETVQEAQDISITAHALARKSGKGVIHFFDPANSARDEPIAEEDVNVIQSVLNLGGHHATHSTGLGAQTLYTDSGRVATVTDEVVENTKTPEGAATPAQPSQTPSSVSVDNSSVGSSRRDSSVDSRATSSAATTVDASSVRAVSAADIFEWTSQIWRTLSVLVGRNYSAVEYTGPSDAKSALFIFGSTGVFVDALSKEDTASELKNIGLITARLYRPWVGGQIVNSIPASVEKIAVLEQVRKTTRWGPSFMDLLSSLTPTTAGGRAPQIVGYRLGYVEPSTAIQALRGIAQNLDTPSPIQNLEVGSSKVPTLETALEQPHLENAYLKILNQLFGERLHIANQLDSKHAGVSSTIAASPEYGFGSLIARMEHRRRFVREVEEASKAGTFATDAPKTSLSNWALSAGDAAKANRLAPDVIDHLSKDDSPLAKQLLESKKLFFDESRWLVGSDAWAYDLGNSGVHHVLASGANVNMLVIDSQPYSERTAADPTRRKKDIGLYAMNYGNAYVASVAVYGSYTQVLQAMAEAEQFKGPSVVVAYLPYNQEDDSALTVLQETKKAIDLGYWPLYRWNPGNEENNEPKFSLDSERIKRELEEFLRRDNQLSQLMNRHPKFSSVLSESYGTEVRALQKRKAKDSYEKLLEGLFGAPLTILFASDNGNAQNLAKRLGNRGRARGLKTMVMAMDDYPAEDLSTEENVVFITSTAGQGEFPVNGRGLWEFVKNSGDLDLSTINYSVFGLGDSHYWPRKEDKIYYNKPAKDLDARVAFLGGRKLTDIGLGDDQDPDAYQTGYSEWEPRLWQSLGVDKVEGLPEEPAPLTNEDIKIQSNYLRGTIAEGLLDESTGAISASDQQLTKFHGTYMQDDRDVRDERKAQGLEPAYSFMIRCRLAGGVATPTQWLQMDAISSSHGNETMKLTTRQTFQFHGVIKRNLRGAMRAINKALMTTIAACGDVNRNVMCSSLPELSFFHREAHTVAQKISDHLLPSTTAYHEIWLKDDDDKKIQVAGDAVVDHEPLYGPTYLPRKFKITIAIPPHNDTDVYAHDIGLIAIKGSDGHLEGFNILAGGGMGSTHNNKKTYPQTGRMFGYVPADQAHIVCEKIMLVQRDHGDRQNRKHARLKYTIDDMGVEVFKEKVEALLPDGLRFAEPRPFKFASNVDTFGWLKDEKGLNHFTFFIENGRIEDTADFQMRTGLRELAKLDKGEFRLTGNQHLILSSVKDEDLPAIKELMAKYKLDNTSFSGMRLSSSACVAFPTCGLAMAESERYLPVLISKLESTLEEVGLARDSIVMRMTGCPNGCARPWLAEAAFVGKAYGAYNMYLGGGYHGQRLNKLYRSSIKEDEILDIMKGLLKRYALERNTDGEEPERFGDWCIRAGVIKETTDGRNFHEGVAEDEDDE

SEQ ID NO: 79246 - protein, 198 aa, Aspergillus oryzae
MGLVYPAGAATVSLLVIGGYMLFHGDGEQFNVGQFLESVSPYAWANIGIAMCIGLSVVGAAWGIFLTGSSIVGGGVKAPRIRTKNLISIIFCEVVAIYGVIMAIVFSSKLNLVGDDEIFSGSNQYTGYALFWGGITVGMCNLICGISVGINGSSAALADAADGSLFVKILVIEIFSSVLGLFGLIIGLLVTQKANEFK

SEQ ID NO: 79247 - protein, 544 aa, Chlamydomonas reinhardtii
MLLQTCKRVAVIGAGAAGLVAARELRREGHVVTVLEQSGGVGGVWRFDARTEADALGLDEQRPPESRVHSSMYKQLRTNLPREIMSYSDFPFDAAVLGPRYSNDSRRFCGHQEVLGYLEAFADYYQLKPLVRHHTRVVAVEPTAPGAGAEGAAATGAGGMGGDAGAVEKEVLWSHEVYDAVVVCNGHYAEPRLPDPSQVRGLLPPGLFPGQQLHSHNYREPTQWAGKVRQGWAVLVVGASNSGEDVSRELSEGGAARVLLAARSWKNEAWGADAAPYGPRNNIYRYPMVTELHSDGFASFEGGQREGPIDAVIWCTGYKYSFPFLRGAAAEVAAVSDNCVGSPLWLHMVPPGPLAPGLCFIGLPWKVVPFPQMELQSKLIARLLSGRVPLPSVERMRADISAHLHSMQEQGLPTRYTHMQGTDQFAYNDTLAAMCGPDVAPLPAWREVLYQATSALKRSRPEDYRDGDIGEAGGPEAARAVEAAEADIRGQAARLGLGVALGAGKGQAGSAACSVSDWVERQASAMATADAPVAAAAAAAAAAR

SEQ ID NO: 79248 - protein, 505 aa, Zea mays
MDGVSAPPPHRRLPDFLQSVNLKYVKLGYHYLITHLLTLTLLPLIAVILLEAGRTDPDDLRQLWLHLQYNLVSVLVLSAVLVFGATVYALTRPRPVYLVDFACYRPPAHLRVRFDQFMRHSRLCGFSDDALEFQRKILERSGLSEETYVPEAMHALPPQPTMANARAEAEAVMFGALDALFRSTGVKPKDVGVLVVNCSLFNPTPSLSAMVVNRYRLRGNVRSFNLGGMGCSAGVIAVDLARDMLQVHRATYAVVVSTENITQNWYFGNRKSMLIPNCLFRVGGAAVLLSNRGADRRRAKYVLRHVVRTHKGADDRAFGCVYQEQDGEGKTGVSLSKDLMAIAGGALKTNITTLGPLVLPVSEQLLFFATLVAKKLLSAKTKPYIPDFKLAFEHFCIHAGGRAVIDELEKNLQLSPAHVEASRMTLHRFGNTSSSSIWYELAYMEAKGRVRRGHRVWQIAFGSGFKCNSAVWHALRNVKPSPDSPWEDCIDRYPVELVDGFPTQQ

SEQ ID NO: 79249 - protein, 147 aa, Zea mays
TGISQGSGLGQVRARGETGSWSWLRAAAAAAADAAVPSGHVAVCVGGASRRFVVRAAHLNHPVFRELLRQAEEEYGFPRAGPIALPCDEALFEHVLRHLSAPSKSSSRFVTLDDLQSAGATHCCCVAAAAGESLPLLRGFSADKAVW

SEQ ID NO: 79250 - protein, 187 aa, Scenedesmus vacuolatus
AGGIAEMAGMGEDIRERTDALDAAGNTTAAIGKGFAIGSAALVSLALFGAYITRAKIDLIQSSILDPKVFAGLLVGAMLPYWFSAMTMKSVGKAALAMVEEVRRQFNTINGLMEGTARPDYSRCVKISTDSSLREMIAPGALVMLSPIIVGMLFGTRTLAGMLAGGLVSGVQMAVSMSNTGGAWDNA

SEQ ID NO: 79251 - protein, 244 aa, Physcomitrella patens subsp. patens
IHTVRVSNVSSKATEHDIQDFFSFSGEIEHIKLLKDGELSQIAFVTFKEAQALETALLLSGATVVDQAVTIAPADESEKLARDVEQVSLDATTAEPTVSPLKFPSSAQEIFQNMLAKGYVLGNNTMSKAKAFDEKHQLSANASQIAANARANVVSIDNKIGITQKLSAGTAAINQQVKAVDEKYHFAEKTRAAVQATEQKLNAAGSAIAKNKYVLTGTTWVVGAYAKVAKAAEEVGQKTLEKVS

SEQ ID NO: 79252 - protein, 239 aa, Schizosaccharomyces pombe 972h-
MKLNISYPANGTQKLIEIDDDRRLRVFMEKRMGQEVPGDSVGPEFAGYVFKITGGNDKQGFPMFQGVLLPHRVRLLLRAGHPCYRPRRDGERKRKSVRGCIVGQDLAVLALAIIKQGEQDIPGLTDVTVPKRLGPKRASKIRRFFNLSKEDDVRQFVIRREVVPKKEGKKPYTKAPKIQRLVTPRTLQHKRHRFALKRRQAEKNREEAAEFAQLMAKRVAEAKQKREVVKARRASSLKK

SEQ ID NO: 79253 - protein, 344 aa, Bacillus halodurans C-125
MKVKVAINGFGRIGRMVFRKAVENKQFDVVAINASYPAETLAHLIKYDSVHGPFQGTVEIKNDALVVNGKEIKLVNSRDPRVLPWKDLEVDIVVEATGKFKTKETAGYHLEAGAKKVIITAPGKNEDVTVVVGVNENDYKPEEHHVLSNASCTTNCLAPVAKVLDEAFTIQSGMMTTVHAYTNDQKNIDNPHKDLRRARACGQSIIPTSTGAAKAISKVLPQLEGKLTGMALRVPTPNVSLVDLVVQVKEDVTPEKVNHVLKQAAAGSMKGILGFTEEPLVSIDFNGNEHSAIVDGLSTMVMEDTNQVKVLAWYDNEWGYSTRVVDLVELVAKELKKPAKVIAS

SEQ ID NO: 79254 - protein, 274 aa, Schizosaccharomyces pombe 972h-
MEDVDLGFLSQEKLDEKDYLDIECSRVGGAPLFIRKNDAAFLNESLENSFEFLMQLYAPKNSEISYHRILYIFINRDGDSQTAGWTRGVKVFREQARETDEIDFQLITSKVTKLIDSSEIEVDAEPKEENKKEIPEKLKNVKVDTENPSAEPYTKAKGDVSFLKFQKRLSRAPDQIMRYYHATSNEFPGLWCNNECIPSSIPNCACGAKRQLEFQILPTLISSMNIDHSAKNALDWGILSIYVCSASCDLANCGLAEELCWLQTFSEQGIIAPE

SEQ ID NO: 79255 - protein, 112 aa, Triticum aestivum
HPWPTAPGGGGAGRRAPQGVAVTKRRPLWSERFLFAAAVRLGDGAHAAAQAALPYEDADGLTKYFAVGDSLGCVFVFSAAGDALLELGLPPPGESSSSSPVTALLAYLSPRR

SEQ ID NO: 79256 - protein, 225 aa, Rubrobacter xylanophilus DSM 9941
MAFFGKLGDRVVGAPSILSADFAHLADEVERARRGGAELVHFDVMDNHFVPNLTVGPAVAASLVEATELPVDAHLQVENPDSLIPAFIEAGVASISVQVEAATHLHRTLKLIKSGGCEAGVALNPTTPPELLGWALPYLDYVLVMSVNPGFGGQRFIPEMVQKVRRIREMAPVPVEVDGGITAETAPLMVKAGAQVLVAGSAVYRGDPAAEMRRIIEAGRAARGR

SEQ ID NO: 79257 - protein, 181 aa, Methanococcus maripaludis S2
MEPEIKVVNVVVSTQIGTDIDLEYAADILDNAEYEPEQFPGLVCRLSEPKVALLIFRSGKLNCTGARCKEDAVIAINKIVKELKEAGMDLIDNPEVKVQNMVATTELGMEPNLDDISTLECTEYEPEQFPGLVYRLSEPKVVVLIFGSGKVVITGLKVIEDAYIAFDKISKTLKELEEELY

SEQ ID NO: 79258 - protein, 256 aa, Agrobacterium tumefaciens str. C58
MTPNVRPLVAGNWKMNGTRASLDQIKAMAEGVKGALSEKVDALICPPSTLLYVATALCDDSPLLIGAQDCHQNDTGAHTGDISAEMIADCFGTHVIVGHSERRTDHAETDHLVRAKASAAHQVDLIAIVCIGETADERKAGQTLDILKRQLAGSLPDEATAENTVIAYEPVWAIGTGLTPTTQDVREAHAFMRDELVKRFGDAGKTMRILYGGSVKPANALELMGVENVDGALIGGASLKAADFLSIYAAYEQLTA

SEQ ID NO: 79259 - protein, 501 aa, Xanthomonas axonopodis pv. citri str. 306
MYDLLVIGGGINGVGIARDAAGRGLSVCLCEQDDLAAHTSSASTKLIHGGLRYLEQYEFALVGKALAEREVLLRLAPHIIWPLRFLLPHQPHLRPAWMIRAGLFLYDHLGGSKRSLPRSRRLSLRTHPVGAPLQESLRTGFVYSDAWVQDARLVVLNAMDAARRGAKIHTRTRCVGAWRDAGFWYAELEDRQGRRRTVQARALANAAGPWAVSFLDTVASVPHEHALRLVKGSHIVVPKLFDHDHAYIFQQPDRRIVFAIPYEHDFTLIGTTDVDYEADPAAPKIDAAEVQYLCDAVNLYFQQQISPADVVWNYSGVRPLLDDAEDNAAEVTRDYQLEVVTEGAPLLNVFGGKLTTYRKLAEEAVDRLTHALGTRKPAWTARGEALPGGEQRDIASLLERVGRARPWLPAATAQRLVRNYGTCAEHLLGDAQSLTDLGTHFGADLYQAEVDYLRQHEWAVAADDILWRRSKLGLRIDAAGRQRLEDYLQTQSIRQRDVVSA

SEQ ID NO: 79260 - protein, 137 aa, Ashbya gossypii ATCC 10895
MTDQEDTPRDVRLLHLLLASQSIHAYEDQVPLQLMDFAHRYTRGVLKDAMMYNEYANNGSAPADLTVEDVRLAIGSRTQYQFKPTAPKELLLQLAQERNKKPLPQVMSMWGVRLPPEKYCLTAKEWQLDEELAEDPV

SEQ ID NO: 79261 - protein, 400 aa, Rubrobacter xylanophilus DSM 9941
MPFSPVEEIIEEIRAGRMVIVCDDEDRENEGDLTVAAELVTPEHINFMAKYGRGLICLPMAQELIERLEIPEMVRHNSSRMGTAFTVSIEAREGISTGISAADRAHTCRVAVSDEAGPEDIVMPGHVFPLKARKGGVLQRPGQTEAAVDLARLAGLKPAGVICEVMKDDGTMARVPDLERFSAEHGIKMVTVAQIIEYRRAYETQVRCAAQTRLPTPFGEFRLRAYENDVDELTHLALIMGEPEGKEDVLVRIHSACLTGDALHSLRCDCGEQLRASMERVAAEGEGVIVYMQQEGRGIGLLNKMKAYHLQDEGLDTVEANQKLGLAPDLRDYGIAAQILKDLGLERIRLLTNNLTKVVGLQGFGLTIGERIQIEVPPNGHNERYLRTKREKLNHLLREV

SEQ ID NO: 79262 - protein, 179 aa, Rubrobacter xylanophilus DSM 9941
MERSGRVRHIEGHLSAGGRSFGIVASRFNDFVVRRLLEGALEAIERHGGSLEAVDVAWVPGSYEIPLAAKRMALSGRYDAVICLGAVIRGATAHFDYVAGGAASGISSAALESGVPVIFGVITTETIEQAIERAGTKLGNKGFEAAVSAIEMADLMPRLAGEETLRPPRPAPAGRPSGP

SEQ ID NO: 79263 - protein, 648 aa, Rhodobacter sphaeroides 2.4.1
MTNPTPRPETPLLDRVCCPADMKALSDAELERLADEVRSEVISVVAETGGHLGSSLGVVELTVALHAVFNTPTDKLVWDVGHQCYPHKILTGRREQMRTLRQKGGLSGFTKRSESAYDPFGAAHSSTSISAALGFAMGRELGQPVGDTIAVIGDGSITAGMAYEALNHAGHLNKRLFVILNDNDMSIAPPVGALARYLVNLSSKAPFATLRAAADGLEASLPGPLRDGARRARQLVTGMPGGGTLFEELGFTYVGPIDGHDMEALLQTLRAARARTTGPVLIHVVTKKGKGYAPAENAPDKYHGVNKFDPVTGEQKKSVANAPNYTKVFGSTLTEEAARDPRIVAITAAMPSGTGVDIMQKRFPNRVFDVGIAEQHAVTFAAGLAGAGMKPFCAIYSSFLQRGYDQIAHDVALQNLPVRFVIDRAGLVGADGATHAGAFDVGFITSLPNMTVMAAADEAELIHMIATAVAFDEGPIAFRFPRGEGVGVEMPERGTVLEPGRGRVVREGTDVAILSFGAHLHEALQAAKLLEAEGVSVTVADARFSRPLDTGLIDQLVRHHAALVTVEQGAMGGFGAHVMHYLANSGGFDGGLALRVMTLPDRFIEQASPEDMYADAGLRAEDIAATARGALARGRVMPLRQTAKPRAV

SEQ ID NO: 79264 - protein, 202 aa, Helicobacter pylori 26695
MKKTFLIALALTASLVGAENTKWDYKNKENGPHRWDKLHKDFEVCKSGKSQSPINIEHYYHTQDKADLQFKYAASKPKAVFFTHHTLKASFEPTNHINYRGHDYVLDNVHFHAPMEFLINNKTRPLSAHFVHKDAKGRLLVLAIGFEEGKENPNLDPILEGIQKKQNFKEVALDAFLPKSINYYHLTALSPLLLAQRGWHGL

SEQ ID NO: 79265 - protein, 364 aa, Zea mays
MGSTAGDVAAVVDEEACMYAMQLASSSILPMTLKNAIELGLLEVLQKEAGGGKAALAPEEVVARMPAAPGDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDARFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAWAIEFIK

SEQ ID NO: 79266 - protein, 663 aa, Oryza sativa Japonica Group
MDPAPATPRWNLERPYLTGRFHQEAKVAAAAQGAGSKPYSLDSFSRGGGGGGGAESVIGSYAVSVQELLVIDDLLSALVGIEGRYISIKRVRGKEGYVVFQIDSSMDLALQELTRRIFPLCEDFVLVYHFVESRSHFKSGLVNHALAAALRAFLLDYQAMVAQLEHQFRLGRLSVQGLWFFCQRMMSSLNALAVLVEKAISNNTSGSATLNLLQSQAKAMAGDSAVRSLLEKMTECASAAYLRMLERWVYEGVIDDPYGEFFIAENKSLQKESLTQDYDAKYWQQRYSLKDGIPSFLTNVAATILTTGKYLNVMRECEYTVQVPLSESSKLMGFGSNHQYLECIKSAYDFASGELLTLMKDKYDLIGKLRSLKRYLLLDQGDFLVHFMDIAREELTKKPEEISVEKLQSLVDIALRSTAAASDPSHEDLTCCVERSSLLKKLSTLKDLDCAYPSDKLVAADVDHPMPLSVTGLETFCLSYKGFRSVKILGTPVLRSSILCRSMLKFVNSLLHYLTFEVIQIHDFFLQKCLKECLLLLPELLVVRLLALLYTEVFVAAKIEKLKALCLQYATSIQLLIPSIDVAKPENTSKSRMPRSKIKETKNRGQQLKLASENVVMSESILKFEAEFNSELQSLIPTLSNSSQAEPYLTHLGQCILGVGVDQ

SEQ ID NO: 79267 - protein, 496 aa, Yarrowia lipolytica CLIB122
MRRSKVFIGNSHTELGGLICNRLGVEPAPCTLKKFSNGETSVEIGVSVRDEDVYIVQSGSPSVNDHLMELLILISGCRTGSAHKITAVIPSYPYSKQSKMKKHRGAITARMIANLLTMAGADHVITMDLHANQMQGFFTVPVDNLHAGPTLAQWIRHNVPDYKDAVVVSKNPGGTKRVTALADALKINFAMIQTDRRRNHKPYSSMLNLAQAPIFSVASPRKKGARGAPPTVLPAPGSPLNGTARRASMKLQDGPNTTHGTVPSRRKSSNTRKPSQLGGRRPSLNPGEEGEDDVFDDEEDEGVHIVTAHGVQTARVVQGHVVGDDYLEEESESEAQSEAETRPRLQHTDSSVDLKHALGGSVDAEGSDDDDDEFQREKLITLVGDVRGRTAIIVDDMIDRHGSFVAAAEHCRLNCGAKRVVVIATHGIFNDDCLEQLQACPCIDSVVVTNTYPIPVERRIAATKLVVIDVSAIFAECMRRNHHGESISALFEQMTM

SEQ ID NO: 79268 - protein, 550 aa, Methanococcoides burtonii DSM 6242
MRTEQKVKNYFEESFLSDLKAGLITAVVALPLAIAFAIASGVEPVMGLYTAIIAGMLVSTFGGSRYSISGPTGAMTVIVLSTVNGYGVEGLLLAGVLAGVFQILFGIFRLGKVVKYIPLPVISGFTSGIGIIILIGQLSNVFGLVLPAREHVWETVYDVFTSIDAMNILALSMFAGTIILMLLLPKVLSNIKYLKNIPASIITLVLSVILTYHFDLKIPIVGEIPSIIPQIHMLDINIGLMYAVLPAAFTIALLGTIESLLCAVVCDAMTNTKHNSNKELIGQGIANVILPFFAGIPATAAIARSAVNIREGAKTRMSGVIHALVLLGILIFFGPIAQYIPKAYLAGILVLVSIKMVNVDEIRTTINISKMDTFVLLTTFALTVLTDLVFAIQAGMFLSIILLFIRLTNIIDVQSMEGYDPSEGINATILSDPYLKDNVAVYTINGPFFFGAMAVFENKVDEHIHMSKPHIIIRMRYVPFIDTTGIERLKSFITTRKGTGEKVYLTTVQPEVMRSINSDTVLSKLMQEKDVIVFKSTQEALGYLQEREGN

SEQ ID NO: 79269 - protein, 156 aa, Glycine max
  misc_feature (52)..(52): Xaa can be any naturally occurring amino acid
  misc_feature (142)..(142): Xaa can be any naturally occurring amino acid
ANLKISCSAVTAVHRANASMIAPFTGLKSMAGCPLAKTANHITSIASNGGRXHCMHVWPPLVKMKFETISYLPDHDDAQLAKEIEYLLTIGWIPYFEFELEHGIAYREHDMSPRYYQRRYWYTLTCQFLTALIATTVSYELXQARTEYSIGYIRII

SEQ ID NO: 79270 - protein, 539 aa, Magnaporthe grisea
MPSLGFLKKKRTRDGNNDNSSQPASPVTPTAAQSFEQAQVLGAPSAINNSHAHTQQQSYLVPQPGYSVGTEVQAQQPQMNSISQQQQQAFAPPAHTPSPGTIDPQQSLPSISNLMNPAVQQQNSQPSANFQPQSQSQSQSQSQFPLPPSHGNGDQSQQQNFQVQQQIQSQQDAMDIQPSQVQDQSHSQQAQPQHQPQHHVQHHVNHAHQGSQDQQTRVTKGKYSLTDFEILRTLGTGSFGRVHLVQSRHNQRFYAVKVLKKAQVVKMKQVEHTNDERKMLGEVKNPFLITLWGTFQDCRNLYMVMDFVEGGELFSLLRKSGRFPNPVAKFYAAEVTLALEYLHAKNIIYRDLKPENLLLDRHGHLKITDFGFAKRVPDKTWTLCGTPDYLAPEVVSNKGYNKSVDWWSLGILIYEMLCGYPPFWDSGSPMKIYENILKGKVRYPAYINPDAQDLLQRLITADLTKRLGNLYGGSQDVRNHPWFAEVTWDRLARKDIDAPYTPPVKAGAGDASQFDRYPEETERYGQTGHDEYGNLFPGF

SEQ ID NO: 79271 - protein, 183 aa, Zea mays
  misc_feature (117)..(117): Xaa can be any naturally occurring amino acid
MATSLSVSRLISSSAISVAKPVLSPTSAFTAPISFSRSLAPNLSLKSHTRRASISGVRSFSTTTISASISEGDKLPDSTLSYLDPATNDVKTVTVSSLTAGKKTILFAVPGAFTPTXSQKHVPGFVSKGGELRSKGVDVIACVSVNDAFVMEAWRKDLGIEDEVMLLSDGNGEFTGKLGVELD

SEQ ID NO: 79272 - protein, 486 aa, Pseudomonas putida
MRQIENFIAGEFVAAASGKRFDKRSPVDNRIICSISEAGRSEVDAAVSAARSALHGEWGSLSTDQRIELLLCVANEITRRFDDFVEAEMSDTGQPEHVMKHVFIPRGAANFKVFADVIKSVASESFKMDTPDGRGALNYSIRRPKGVIGVVCPWNAPFMLMTWKVGPALACGNTVVVKPSEESAQTAALLGEVMNAVGIPKGVYNVVHGFGPDSAGEFVTRHPQVDAITFTGETRTGTAIMKAASEGMRDVSFELGGKNAGIVFADADFEAAVESFSRSVFLNTGQVCLGTERVYVERPIFERFVQALKVKAEAVKYGRPDDHQANYGPLISQEHKQKVLSYYRKAVEEGATLVTGGGVPQMPGELAEGAWVQPTIWTGLPETAAVVQEEIFGPCCHISPFDSEDEVVEKANATDYGLSTTIWTSNLARAHRMAGRIDVGITWINSWFLRDLRTPFGGSKQSGIGREGGVHSLEFYTETRNVCVKL

SEQ ID NO: 79273 - protein, 74 aa, Zea mays
FFFFFFFFKQISSFINNGSVCCRKGIEVNLWDITSSSKTWSAKSPRANSLGIFTRPWFTAGTFLCKNDHRKIVA

SEQ ID NO: 79274 - protein, 427 aa, Pseudomonas syringae pv. syringae B728a
MKTQIQAIHAREILDSRGNPTVEVDVTLECGAMGRASVPSGASTGAHEAVELRDKDTQRYSGKGVLKAVSNVNTEILESLRGMNAIDQEQIDHLMIKLDGTSDKSRLGGNAILGVSLAVARAAASALNLPLFQYLGGEQAARMPVPMFNILNGGVHANWQGPDFQEFMIAPTGAGSFKEALRWGSEVYHELKAVLKDAGYSTAVGDEGGFAPALKKNSDAIELIIKAIERAGYTPGSQIEIAIDPASSGFYENGLYHLRSEGRKVDAQELINLYSSWVDKYPIAVLEDGLAEDDWSGWKLLNAALGDRIELVGDDLFVTNVERIQRGITENVANAVLIKPNQIGTLTETKAAIEMAYGANWGAMVSHRSGETVDSSIADLTVAMGTGHLKTGAPCRGERVEKYNQFLRIEEDLGSRAFYAGHDAFVR

SEQ ID NO: 79275 - protein, 349 aa, Schizosaccharomyces pombe 972h-
MAEFIRTQIFGTCFEITTRYSDLQPIGMGAFGLVCSAKDQLTGMNVAVKKIMKPFSTPVLAKRTYRELKLLKHLRHENIISLSDIFISPFEDIYFVTELLGTDLHRLLTSRPLETQFIQYFLYQILRGLKFVHSAGVIHRDLKPSNILINENCDLKICDFGLARIQDPQMTGYVSTRYYRAPEIMLTWQKYNVEVDIWSAGCIFAEMIEGKPLFPGRDHVNQFSIITELLGTPPMEVIETICSKNTLRFVQSLPQKEKVPFAEKFKNADPDAIDLLEKMLVFDPRKRISAADALAHNYLAPYHDPTDEPVADEVFDWSFQDNDLPVETWKVMMYSEVLSFHNMDNELQS

SEQ ID NO: 79276 - protein, 202 aa, Agrobacterium tumefaciens str. C58
MRETMQLVPMVVEQSSRGERSFDIYSRLLRERIIFLNGEVDDTVSALVCAQLLFLEAENPKKPIHLYINSPGGMVTSGFAMYDTMRYIRAPVHTLCMGTARSMGSFLLMAGEPGTRAALPNASILIHQPSGGFQGQASDMLIHAEEIRQTKHRMTRLYAEHCGRSYEEFETAMDRDRFMTVQEALEWGLIDRILEVREDAAA

SEQ ID NO: 79277 - protein, 399 aa, Ashbya gossypii ATCC 10895
MTSDEAKKARFCLHGGPSYEGYSFGAPVSVGGEVVFTTSLVGYPDSMTDPSYKGQILVFTQPLIGNYGVPDGSVRDQYGLLKYMESSKVHVSAIVVAEYAWEYSHWTAVQSLGDWCRKEGVAAIGGIDTRAVVQYLRESGSTMGRVDVEGAAASARVVDPSKVNLVAQVSTKSPFYIPGKPSRVNYDVALVDCGVKENILRCLVVRGVNVTVFPYDYDVCSIAHHFDGVFISNGPGDPIHYRNSTVANLRRLLQDPDLQQVPIFGICMGHQLLALAAGASTVKMKYGNRAHNIPALDLSTGQCHITSQNHGYAVDAATLPRDEFVPLFVNLNDKSNEGIIHVSRPIYSTQFHPEGKGGPMDCSFLFDEYVERMRCYRKLFRQEPFIRFPVIGLPKARVL

SEQ ID NO: 79278 - protein, 584 aa, Bacillus halodurans C-125
MRKTKIVCTIGPASESVEKLEQLMEAGMNVARLNFSHGDFEEHGARIKNIREAAKRIGKTVAILLDTKGPEIRTQTLEGGVAELKAGQELVISMKEVVGTSERISVTYPGLVHDVVPGAKILLDDGLIGLEVVEVRDQEILTKVLNSGTLKNKKGVNVPNVSVNLPGITEKDAADIKFGIEQGVDFIAASFVRRAQDVLEIRELLEQHGAEHIKIIPKIENQEGVDNIEEILEVSDGLMVARGDLGVEIPAEEVPLVQKSLIKKCNLVAKPVITATQMLDSMQRNPRPTRAEASDVANAIFDGTDAIMLSGETAAGDYPVEAVQTMSRIAERAEQALNYQEILSKHTKEARTTITSAISQSVGHTAFNLNASAILTATESGHTARVVAKYRPKSPIVAVTSNETVVRQLALVWGVYSILGEEAETTDDMLQVTVETALKSQLVKQGDLVVITAGVPVGETGTTNIMKVHVIGEVVAKGQGIGRDTVNGKVVIAANAEEANAKVEEGSILVTFSTDKDMMPAFEKAAAVITEEGGITSHAAVVGLSLNTPVIVGVQNASALFKDGEEITVDTSRGDIYRGQASVL

SEQ ID NO: 79279 - protein, 118 aa, Brassica napus
MFAAENGLKGDPRLEAISAAIRVVPNFPKKGIMFQDITTLLLDHKAFKHTIDIFVDRYKDMQISVVAGVEARGFMFGPSIALAIGAKFVPLRKPGKLPGKVISESYELEYGHDRLEIH

SEQ ID NO: 79280 - protein, 294 aa, Triticum aestivum
  misc_feature (107)..(107): Xaa can be any naturally occurring amino acid
  misc_feature (229)..(229): Xaa can be any naturally occurring amino acid
MAKDIEAAPPGGEYAAKDYSDPPPAPLFDAEELTKWSLYRAVIAEFVATLLFLYITVATVIGYKHQADPAGPNAADAACSGVGILGIAWAFGGMIFVLVYCTAGVSXGGHINPAVTFGLFLARKVSLVRALLYIIAQCLGAICGVGLVKGFQSAFYVRYGGGANELSSGFSKGTGLAAEIIGTFVLVYTVFSATDPKRSARDSHVPMDVLAPLPIGFAEFMVHLATIPXITGTGINPARSLGAAVIYNNEKAWDDHWIFWVGPFIGAAIAALYHQYVLRASATKFGSSASFGSR

SEQ ID NO: 79281 - protein, 473 aa, Crocosphaera watsonii WH 8501
MTKRTFGVIGLAVMGENLALNVESRGFPIAVYNRTASKTEEFMKTRAQGKDVKAAYSLEEFVKTLERPRKILVMVKAGAPVDYVIEDLKPLLEEGDMIIDGGNSLYEDTERRTRDLESTGLGFVGMGVSGGEEGALKGPSLMPGGTKAAYEELEPILTKIAAQVDDGPCVTFVGPGGAGHYVKMVHNGIEYGDMQLIAEAYDIMKNALGLSNEELHEVFKEWNTTDELNSFLIEITADIFKYVDPDSKKHLVDLILDSAGQKGTGRWTVVSSLELGVPIPTMYAAVNARVMSSYKEERESASHQLTGPAIKFDGDKKAFINKVRDALYCSKMCSYAQGMALIAKASAEYYGNQVSLPESARIWKGGCIIRAGFLDKIKKAFVDNPDLPNLLLAPEFKQSILDRQEAWREVLVLANQVGIPVPAFSASLDYFDSYRRADLPQNLTQAQRDYFGAHTYERVDKPKGEAFHTEWAA

SEQ ID NO: 79282 - protein, 501 aa, Arabidopsis thaliana
MAIPMPTRQLFIDGEWREPILKKRIPIVNPATEEVIGDIPAATTEDVDVAVNAARRALSRNKGKDWAKAPGAVRAKYLRAIAAKVNERKTDLAKLEALDCGKPLDEAVWDMDDVAGCFEFYADLAEGLDAKQKAPVSLPMESFKSYVLKQPLGVVGLITPWNYPLLMAVWKVAPSLAAGCTAILKPSELASVTCLELADICREVGLPPGVLNVLTGFGSEAGAPLASHPGVDKIAFTGSFATGSKVMTAAAQLVKPVSMELGGKSPLIVFDDVDLDKAAEWALFGCFWTNGQICSATSRLLVHESIASEFIEKLVKWSKNIKISDPMEEGCRLGPVVSKGQYEKILKFISTAKSEGATILHGGSRPEHLEKGFFIEPTIITDVTTSMQIWREEVFGPVLCVKTFASEDEAIELANDSHYGLGAAVISNDTERCDRISEAFEAGIVWINCSQPCFTQAPWGGVKRSGFGRELGEWGLDNYLSVKQVTLYTSNDPWGWYKSPN

SEQ ID NO: 79283 - protein, 245 aa, Oryza sativa Japonica Group
MDSDHWISRLMAAKRQYALQRAQNHHHATATATATAASHSHLDRYGYDDVEPEDEVRPDFPCPYCYEDHDITSLCAHLEDEHPFESKVVACPVCSARISKDLLDHITLQHSYLFRLQRHHRLRRVAVPSNHALSLGGRDLQETYLKVLLGNSSRSSGTNAASSVTDSLLSSLVLNLSSSEAEDTAKFSALAVVENNWFKRTLPSKTWKASSDSNLSQEERERRRRRAAVRSSFVQHLLVSTLFDD

SEQ ID NO: 79284 - protein, 354 aa, Thermoplasma acidophilum DSM 1728
MQIETEDPHETINNYKLRIDERISRFFDRKEAETKDDLSRRVIRMIREYTEGGGKRLRPIFLVLGYRLFADENNAIFDASISIELAQSYLLIHDDVIDDSDLRRGKPSMHIRLWRSFFPESEKGKKMGEGLAIVAGDLAETYAHESLINSDFDPSLLLLADMELTKTIEMTGYGQFLDVVSGTLNDFRENDLIRLHLWKTARYTLEGPLAMGALLSGRHDQIMDLRLFGRTLGIAFQLKDDILGLFGDEATTGKSIYSDVNEGKRTLLMIKAMEFSDRQDAEFIDRILRRGNVTQEEFERIRNIVMKSGSYDYSVKLMDSLVAKSKEYLNRIRGNSCAKTYLSWLSDYLVARDH

SEQ ID NO: 79285 - protein, 379 aa, Rhodobacter sphaeroides 2.4.1
MSALRPPARGGLGLSRLGVRLAGSRRFQLIAERVPFLRRIGRREGEELFDIVAGFVHSQVLYALVELRVLHLVAEGPQTVQALAAATGLAPERMQLLLQGGAALKLLTRRRDGQFDLAVRGAAFLAVPGLEAMVGHHHVLYRDLADPVAFLKGETEPELARFWPYVFGAGGATDPEVTAKYSRLMTESQGLVAEDALRLVDLMGVRRLMDVGGGTGAFLAAVGRAYPLMELMLFDLPVVAEAAPQRLTEAGLAGRFTVHGGSFRDDPLPLGADAISLVRVLFDHSDETVKLLLHRVREALPAGGRVIVAEAMSGGARPHRETDTYMAFYTAAMRTGRVRSAAEIAELLTGQGFSEIKIFPGLRPYVASAVTAVRPSDAP

SEQ ID NO: 79286 - protein, 322 aa, Xanthomonas axonopodis pv. citri str. 306
MSFDPDVVRLFAQLQEAAQPPMDTLPIEGARAMMRAVGAQFGFQRLEMAEVRDLQADAATGAVPLRVYRPTGLATGPAPTCLYVHGGGGLVGDLESHDDVCRQLAARAGCQVLAIHYRLAPEHPAPAGVEDVIATLHWLVAHPDTVGADVQRLAVCGDSIGGAMAAVAALAARDAGIALRCQLLVYPLTDARQDSGLYPSRSLNAGLPPLTAAAVEFFNRHLLPDMAVANDWRVSPMLAPDVAGVAPALVVVCDRDMLYDEGRAYAERLRAAGVEVTLHSFPGMIHGFINMGSVLRAAGETLDLAALTLRQRLLPAIERRAA

SEQ ID NO: 79287 - protein, 288 aa, Rhodobacter sphaeroides 2.4.1
MAFEQRIEAAMAAAIARGQGSEAPSKLATALDYAVTPGGARIRPTLLLSVATACGDDRPALSDAAAVALELIHCASLVHDDLPCFDDAEIRRGKPTVHRAYSEPLAILTGDSLIVMGFEVLARAAADQPQRALQLVTALAVRTGMPMGICAGQGWESESQINLSAYHRAKTGALFIAATQMGAIAAGYEAEPWEELGARIGEAFQVADDLRDALCDAETLGKPAGQDEIHARPNAVREYGVEGAAKRLKDILGGAIASIPSCPGEAMLAEMVRRYAEKIVPAQVAARV

SEQ ID NO: 79288 - protein, 211 aa, Thermoplasma acidophilum DSM 1728
MLVSPSIVAASPLKIQDQVRECENAGSVSFHLDVMDGNFVPNITVGPDYYEFLRSISRIRIESHLMVMRPDLYYRKFAKEGDLVLVHYESPVNTLALLKRMKDEGIDAGIVINPDTSFSKVSDLLEYAQILLIMSVYPGFSGQKFIDVSDKIHEASAFIKKNGLKTKIEVDGGINDNTARIVKNAGADIVVSASYIFGGNISERIRILSSI

SEQ ID NO: 79289 - protein, 269 aa, Oryza sativa Indica Group
MSSAAGEPSSSSAAAAAISCSSSNDDEKPPPSLEGKELRRVAEEEPAAAARPEKLTEASSRAAEAEEEEVVEDEEDDDEEDEGKVAEAIDLGPRVSIKEQLEMDKEDESLRRWKEQLLGSVDLNSVGESLEPDVRITSLCILSPGRPDVLLPLPVEPSNSKEPWFTLKEGSTYRLKFTFSVSSNIVSGLRYTNTVWKAGIRVDKTKEMLGTFSPQLEPYTYVTPEETTPSGVFARGSYSAKTKFVDDDRKCYLEINYTFDIRRDWPCKS

SEQ ID NO: 79290 - protein, 522 aa, Yarrowia lipolytica CLIB122
MGLADEILADFGSSDEENEEVDEVMEDATSQIPTEVIATETTEPLSPTPLNNINLDLLGSTNSAAMVPRLLPQLRSISLYESGATQSTLALTSNLEENPEYHVIVGANEYSVEIDNAVAELHNFIATRYSQRYPELRSLIANPLQHAQVVAILGNDPAAVAKSDSPHLKQVVHKSVMMTITMTVDQGGRRLSDVEMATINEACKLLIALDAAKRQITNYVSSKLNLVAPNTAILIGAHCAAQILGFVGGLNGLAKTPSCNIPSLGAKRETAVGFGQAQRQQGYLYYSDVVQQSPADIRKQAMRMLSAKLVLAARLDASRASTDGSFGSKMREEIEGKLQKLAEPPEIKGVKALPVPIDKPSKKRGGKRIRKFKEQFKQSEMAAAANRMAFGEAEKTVDVYGETVGLGMLDSAAGLGSARRVEADSKTRARMSKGARSRLEMLKNRPKPMIDGLQSSLSVTAQSMELSKPKGPKTATQDNKFFASGTFTQLERGSGLQLGPKRKADEQKDRGTTKKLKEGDGN

SEQ ID NO: 79291 - protein, 450 aa, Chlamydomonas reinhardtii
DFDQKYTLGRAIGAGTFGTVHLATDKATGQEVAVKVITKRVMGGYLEGNFVRRVQHEVDIYNHLGRSLNVAYLYGAWETPVHVQLVMELCTGGELWTRVQRGKYDEAAAAALCREILCTVAQCHAKGIVLRDVKPENFLFLTADADAPLKMIDFGLATYCKPGQLLSDRAGSPLYVAPEVLKQSYGQPCDVWSAGVVAYQLLTGRFPFEDEDCGLLLSSLDIFFAILYGDLDFRRPPWDEISELARDFVAHLLERDPAKRPSAEQALKHPWLRQFDASASGTSATSSTASRLQRFGTYGRLKQLALRCAFMATAETERIASLAAAFRSLDPAGRGVVPYDSVVALLNNGEWDLSRTEVSQLLATFDIDLEGNVDYNEWLAALIDWREVGTRGRGALVFDMFDQGHTGRLTPENIQRLDECPFDDVVPAAMREADEDHDGSISREEFVRFL

SEQ ID NO: 79292 - protein, 312 aa, Agrobacterium tumefaciens str. C58
MSKKIGVVGSNMVDLITYVDRMPGPGETLEAPTFEMGCGGKGANQAVAAARLGAEVMMVTRVGDDVFADNTIRNLASFGVDTRHVVKVSGKSSGVAPIFVEQSGENSILIVKGANADLLPVEVDKAAADLKECGLILMQMEVPVETVYHTIEFAAQNGIETILNPAPAAANLDPERIRQVTFLVPNESELALLSGLPTDTDEDIVRAARSLIARGIRTVIVTLGARGARMITSDEIVNIEPVKVTPRDTTGAGDAFIGSFARFYAETREVVSSLKKASLYAAHSITRPGTQKAYASIDEFEAFCRDHANGAA

SEQ ID NO: 79293 - protein, 409 aa, Yarrowia lipolytica CLIB122
MDTEARELPQTCEDDVTPKLSPEQLLSYENYRIWKKNAPQLYSLFMSQMLPSPALSFQWFPDLDTPKNASVTAHRFLTSSYTDTPEVIRLGEVKIPKNDETLSLQDYSALTEEIGGYQGHPHAGINVSQNISVLGEVNRVRYMPQNPNIIATIGADGSVLMFDKSKHPANPSNDECKADATLCHHNSEGWSLSWNTKDRGKLLTCSSDGTVALWDLVNDYKSRSDGKMVTIAPKQVFIHHQGSVNDVTWHPSEKTLFASVGDDQKLYVIDTTDNSTVYETDTRTASLSVAFSPFNNRVVATSGEDGIVNLWDIKSTSQTPIGRLVGHEGPVGSLDWSPHNPRLLVSGSEDKRAIIWDISKIGQKDGSEKLFVHAGHTEKVTEVGWNRSLEGVIGSVAFNSLLHVWKVKD

SEQ ID NO: 79294 - protein, 493 aa, Silicibacter pomeroyi DSS-3
MADIQSYRMLIDGAWVDASDGALFDSTNPADGKVWCRIPEATEADVNRAVEAAHRAFTSGPWARMTPTERGKLLRRLGDLLADRSEELGRIESVDTGKMLKETRWQAKYIAEFIHFFAGCADKVSGETLPIDKPDMFVFTKREPLGVVAAVVPWNSQLFLVAVKIGPALAAGNTVVLKASEHASAAMLEFGKLIEEAGFPPGVVNIVTGHGEPCGRALTGHPLVARVSFTGGPNAARHVLENAKRNFAEVSLELGGKSPFIVFEDANIESAVNASIAGIFGATGQSCVAGSRLYLHEDIAEEFLDRMVTQARAIVIGDPLAEETQMGPLCTDGQLAHIQREVAHAQAEGGTVLTGGKQPEGLGGLFYEPTIIDCPRQDLRIVDTELFGPVLSVQRFRTEEEVLALANDSEHGLAAGIFTRDSARSLRMAGAVRAGIVWVNTYRVVSPIAEFGGIKGSGYGRESGFQAIYDYTRPKTVWMNTSDEPMANPFVMR

SEQ ID NO: 79295 - protein, 180 aa, Arabidopsis thaliana
MQGTEYLACTRRETSVVQLRERQGWKESTDMGITKQGLVIQRRKKTEKSQATISHYSEKVSNVIGDSSESSNPSTAISSSNIGFQLLKKHGWKEGTGLGITEQGILVPLQAEPKHNKQGLGAEKPAKRKPAQPQDTAFEEVSKKSKKLSKKLVKMIEHEKRLAENEFERAFRREFWPDNV

SEQ ID NO: 79296 - protein, 390 aa, Methanococcoides burtonii DSM 6242
MTKETTLSKDYNSIVEKDSKYVMQTYTRQPLALESGQGSIVRDIEGREFIDCVAGIAVNNVGHCHPKIVEALSKQAGKLIHTSNLYYTDVQANFAEELVNISGMGRAFFCNSGTEAVEAAMKLARVATGKKEFIATENSFHGRTMGSLTVTYKSTYRKPFEPLIQGERFVPYNSAQAIRDTVTEDTAAVIVEPIQGEGGINVPSDEYLREVREICDENEMLLIFDEVQTGFGRTGKWFCKDHSKVKPDIMTMAKAIGGGFPMGAIVARDGISFEKSQHAATFGGGPLACAAALASINVIRDEKLVERSAEMGQYFMNELNSLDNDSIVEVRGRGLMIGVEINRACADIVDLARDNGILLNCTSEKVIRIAPPLIITKEQIDKVVEIIGQI

SEQ ID NO: 79297 - protein, 424 aa, Synechococcus sp. WH 7805
MTARSLPSTGAVTGLKETLDFFRDPQFAQKRFTAYGEVFETRLLNQRLVFIRGEQPIADLFAQGDALEGWWPESVRQLLGNRSLANRSGEGHKARRRVVGQLFSAAALSRYTPSIAALVEELAEELIQAKAPVQLVPCMRRFAFAVIATTVLGLDASDRQALFADFEIWTRALFSIPVAIPGTPFAKALEAKKRLLLRLQQVLAQTSTRRGGLDLLSGGLDEAGIPLTDDDLVEQLLLLLFAGYETTASSLSCLMRALLLNPEVEQWLLPELLDQSWPNLDARSCPRLDATVLEVMRLTPPVGGFFRRTKDTVQLGGVAIPPNRVIQVALSPDLGDGSCDLADIRPQRHLDGSFTATLLPFGGGERVCLGKALAELEIRLMAVGLLQRVRLELTPDQDLTLQQIPSPSPRGGLLVRASARDTSR

SEQ ID NO: 79298 - protein, 543 aa, Zea mays
METMVAAPAPQQRTGRIARRLARLLRHKSSPAGAGMAYSVAGDELDDSLDSSINSLSKLKLSGSLSAAYTLDVFFKNATEKNGAPPPQTQPAPSPAPAQHAAKHAFVATLFARASAVKAAYAQLQLAQHPYDAEAIQAADAGLVAELTKLSNLKRRYSRDPAAAARSAGALAAHADEQRHLLRTYEITSRKLEAELRARDAEAERARAALADELRAERGLEERARPGRTLAALDGLHLSGLNATHFHTALRHAVKSVRAFASAMLAAMRRAGWDPAAAAAAVHPAARLLNPAGDARFALESYVALKMFAGFHRKDLGLSSLSLHGRGSGSGSHDRRRFFEEFAEANAAGAAEFQVQRASDDARWGAALREFLRERYVSVVHERMEAAFFGRGGGDAPPRAAWYGEFAEMARRVWLLHCLFWAFGGTASVFQARPGERFSEVFMESVSDGTDGGGPTPAPAPSGHVAVVGFTVVPGFKLGRTVIRCRVYLSHPGAPAMRTVSASAMGGLVATHTGGGGTARHVWQRRGRSPTGGTERGRAWRGV

SEQ ID NO: 79299 - protein, 607 aa, Schizosaccharomyces pombe 972h-
MNRVNDMSPVEGDLGLQLSSEADKKFDAYMKRHGLFEPGNLSNNDKERNLEDQFNSMKLSPVASSKENYPDNHMHSKHISKLPIASPIPRGLDRSGELSYKDNNHWSDRSSTGSPRWENGSMNLSVEEMEKVVQPKVKRMATICQMFFLDHYFEQLHYLYTRKQRARLFEEQLLKEPDSRRDELVKRYNGRERVYLRKRRTRISHGDFQTITQVGQGGYGSVWLARKRDTKEIVALKIMNKSVLHKMDEIRHVLTERDILTTANSEWLVRLLYAFQDTSNIYLAMEFVPGGDFRTLLSNSGVLRDHHAKFYATEMFLAIDALHQLGYIHRDLKPENFLVGASGHIKLTDFGLSSGIISKKKIESMKIRLQEVNNVVVPERSMRERRQVFRTLLSQDPVYAHSVVGSPDYMAPEVLRGENYNHSVDYWSLGCIMYECLSGFPPFSGSNVNETWSNLKNWRKCFQRPHYDDPRDLEFNWRDDAWDFVCHCITDPKDRFCSLKQVMQHPYFSKIDWKNVRTAYRPPFVPDLNSEIDAGYFDDFTNENDMSKYKEVHEKQAAIANMVNTFNKPKRNAFIGFTFRHQKNSHPTSSSSALSSPLSAPSFGTLL

SEQ ID NO: 79300 - protein, 580 aa, Coccidioides immitis RS
MASVRAPSTKLLRSLRCALSSNAHLTLRQQRPNAFFVLRHSSRSISNYTHAHQASAISVLPTAVDTSSHDFKENAQQMNDLLAKMSELHSTIAKGGPQKAKDKHIARGKMLPRDRVTALIDPGTSFLELSPLAGHEMYGADQVPSGGIITGIGTVEGVSCMIVANDSTVKGGTYFPITVKKHLRAQAIAQENKLPCIYLVDSGGANLPHQADVFPDRDHFGRIFFNQARMSSLGIPQISVVMGPCTAGGAYVPAMSDETIIVENQGTIFLAGPPLVKAATGEVVSAEDLGGGKLHSSISGVTDYLAVDDAHALVLARRSISNLNYPKTSFPLLTSAQFKEPLYDPAELAGIVGTNLRRQIPAHEVIARIVDGSEFAEFKRDYGTTLVTGFARIYGTQVGIVANNGILFSESSLKGAHFIELCAQRNIPLVFLQNISGFMVGADAEKGGIAKNGAKLVTAVACADVPKFTVVFGSSAGAGNYGMCGRAYSPRFLYMWPNAKIGVMGSEQLSSVMAAVGKSADPSLKARIDAESEATFSSARLWDDGVIPPADTRKFLGLSLAASMGGRAEDAKTKFGVFRM

SEQ ID NO: 79301 - protein, 471 aa, Klebsiella pneumoniae
MLLPVIMAGGTGSRLWPMSRELYPKQFLRLFGQNSMLQETITRLSGLEIHEPMVICNEEHRFLVAEQLRQLNKLSNNIILEPVGRNTAPAIALAALQATRHGDDPLMLVLAADHIINNQPVFHDAIRVAEQYADEGHLVTFGIVPNAPETGYGYIQRGVALTDSAHTPYQVARFVEKPDRERAEAYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDEQGNVLSGDAWVHNSENCYINSDEKLVAAIGVENLVIVSTKDAVLVMNRERSQDVKKAVEFLKQNQRSEYKRHREIYRPWGRCDVVVQTPRFNVNRITVKPGGAFSMQMHHHRAEHWVILAGTGQVTVNGKQFLLTENQSTFIPIGAEHSLENPGRIPLEVLEIQSGSYLGEDDIIRIKDQYGRC

SEQ ID NO: 79302 - protein, 489 aa, Zea mays
MALSTTNTNAAESQLHCSTFASRYVRTALPRFKIPEQSIPKEAAYQIINDELMLDGNPRLNLASFVTTWMEPECDKLIQSSINKNYVDMDEYPVTTELQNRCVNMIAHLFNAPIGDDETAVGVGTVGSSEAIMLAGLAFKRKWQNKMKAAGKPYDKPNIVTGANVQVCWEKFARYFEVELKEVKLKEGYYVMDPEKAAEMVDENTICVAAILGSTLNGEFEDVKLLSDLLTAKNAETGWDTPIHVDAASGGFIAPFLYPELEWDFRLPLVKSINVSGHKYGLVYAGVGWVIWRSKEDLPDELIFHINYLGADQPTFTLNFSKGSSQIIAQYYQLIRLGFEGYKDVMQNCRDNAAVLREGINKMGYFDVVSKDSGVPLVAFSLKDSSKYTVFEVAESLRRFGWIVPAYTMPADAEHVAVMRVVIREDFSRGLAERLIADLGKTMADMDAHAGRKQAPEQPKKSVHDIEKEVTTFWRRLVANSKKKSSMVC

SEQ ID NO: 79303 - protein, 608 aa, Schizosaccharomyces pombe 972h-
MDKVQHVILVLSGKGGVGKSSVTTQLALSLHDSKVYSRPLKTGILDIDLTGPSIPRMFGKDAERNRIHQSSAGWVPVYTDETKEIGLMSLGFLLTSKNDSVVWRGPKKAAMIRQFISDVSWGELDFLIIDTPPGTGDEHLTIVESLLSETSTVRDVPIDGAVIVTTPQGIATLDVQKEIDFCKKASIKILGIVENMSGYICPHCADCTNIFSSGGGLTLSEKYKLPFLGSVPIDPKFGEMIENLTPDSNIVHLYSKTEMSKKFSFITNEFLNQLYGPRKLDTITTISGHTGRLWSVAAHPMLPLFATSSQDKSVRIYNSNTYNLVHVIDGFHTRSIRRVAWRPIERPVLAVASFDSVVSINEKIDDDWECTAALEGHENEVKCIAWSCNGNYLATCSRDKSVWIWEATEDDEFDCLAVLQEHTQDVKVVTWHPTEDLLVSGSYDNSICFWRDDGDDWALTCQLQGHTNTVWALAFSPNGNTLASADNDGNVFLWIKISSNEDVATIDSTNILRPALQEEWKQQTSLPHIHKGAVYTISWMNDATLCSAGGDGKIVVYQREKHDEALWHVAYEQDHAHGVYEINSLEYLRDDRLLSGGDDGECRVWSFK

SEQ ID NO: 79304 - protein, 410 aa, Bacillus halodurans C-125
MATTREEALHIHRENQGKLESKSKVPVRNARDLSLAYSPGVAEPCKEIFEDVETVYEYTMKGNMVAVVSNGTAVLGLGNIGPEASLPVMEGKAVLFKSFAGVDAFPICLRTTDVDQIVETVKLLEPTFGGVNLEDIAAPSCFEIEERLKKETNIPVFHDDQHGTAIVTLAGLINALKLTGKRMSEIKVVANGAGAAGIAIIKLMQRMGVRDIIMCDSKGAIYDGRPYGMNDMKAEVAKWTNRDKIDGGLGDVLKGADVFIGVSVAGALTKEMIENMNDDPIIFAMANPVPEIMPEEAKAAGAKVIGTGRSDFPNQVNNVLAFPGIFRGALDARATHINEEMKVAAVHAIADLVAEEDLDPDYVIPAPFDPRVAPAVAAAVAKTAMETGVARRKVDPAEVEAKTKKLAIIE

SEQ ID NO: 79305 - protein, 388 aa, Vibrio parahaemolyticus RIMD 2210633
MKIAVAGTGYVGLSNAMLLAQNHEVVALDIISEKVDLLNQRKSPIVDTEIEHFLAHKELNFVATTDKEKAYLSADYVVIATPTDYDPQTNYFNTSSVEAVIKDVMSINPDAVMVIKSTVPVGYTARIKEELGCKNVIFSPEFLREGKALYDNLHPSRIIVGERSERAEVFAGLLVEGAVKDDIQVLFTDSTEAEAVKLFSNTYLAMRVAYFNELDSYAEAHGLDARQIIEGVGLDPRIGNHYNNPSFGYGGYCLPKDTKQLLANYQDVPNNIIGAIVDANRTRKDFVAEAILKREPKVVGIYRLIMKAGSDNFRASSIQGIMKRIKAKGVEVVVYEPVLKEEDFFNSRVIKDLNEFKQSADVIVSNRMVEELADVADKVYTRDLFGSD

SEQ ID NO: 79306 - protein, 292 aa, Vibrio parahaemolyticus RIMD 2210633
MIKKCLFPAAGYGTRFLPATKSMPKEMMPVVNKPLIEYGVEEAIEAGMNGMCIVTGRGKHSLMDHFDKNYELEHQISGTSKEALLDDIRSLIDSASYTYIRQREMKGLGHAILTGRELVGDEPFAVVLADDLCVNEEQGVLAQMVELYKQFRCSIVAVQEVPETETHKYGVIAGEMIKDDIFRIDNMVEKPEPGTAPSNLAIIGRYILTPDIFELIENTEPGKGGEIQITDALMQQAQSGCVIAYKFKGQRFDCGSVEGYIEATNYCYENLYKKASSAELAKTPTVKVSEPA

SEQ ID NO: 79307 - protein, 256 aa, Vibrio parahaemolyticus RIMD 2210633
MRRPVVMGNWKLNGSKAMVTELLTGLNAELEGVEGVDVAVAPPALYIDLAERLIAEGGNKIILGAQNTDLNNSGAFTGDMSPEMLKDFGATHIIIGHSERREYHNESDEFIAKKFNFLKENGLTPVFCIGESEAQNEAGETEAVCARQINAVIDTYGVEALNGAIIAYEPIWAIGTGKAATAEDAQRIHASIRALIAAKDEAVAAQVIIQYGGSVKPENAEAYFSQPDIDGALVGGASLDAKSFAAIAKAAAAAKA

SEQ ID NO: 79308 - protein, 151 aa, Schizosaccharomyces pombe 972h-
MSTEQTFIAVKPDAVQRGLIGYIISKFELKGYKLRALKFLVPSRDLVEEHYAEHKGKPFYEKLVGFMASGPVCAMIWEGKQAVKTGRLMLGASNPLDSAPGTIRGDYGIDLGRNVCHGSDSIESANREIKLWFQPSEIQVYDRTIEPWIYE

SEQ ID NO: 79309 - protein, 81 aa, Rubrobacter xylanophilus DSM 9941
MDREEILQKIQEITADRLGVDESEVTPEASFREDLEADSLDLVELIMELEEAFGMEIPDEEAEKITTVEEAVDYVVEHQTA

SEQ ID NO: 79310 - protein, 430 aa, Amycolatopsis mediterranei
MTVQKAPSQLLAAKLQIPPIPYSHAAGSWVYASDGTRYLDGASGIVNVNIGHAHPTVVAALRDQVGICTYASPGTFAPDLMEQLAAAAARAVHRPDDRVMFTPTGTHATESAIALARLVQRARGEEGRHKILTSTLGYHGNSAFVLALSGHRSRRPHEDDSFGLAPAFNPPYPGQHLGCPFDACRVECVRAVRDAIVAAGPESVAAVLMEPVNGTTGGGYVPPAGYLRALREVCDEFGVLVIHDEVLTGLGRCGLPLASHHTPGSAADIVTLSKGLGAGYVPLAATMLSPDLAEDIMTSGKWLPLMGTMSATPLQGRAGLAVLSVLEELGALDRDEVRGAALGRLVADAVRGRQVVTDVRGLGYFYGIELAPGTLGDVMRITRSRGLLLYPYVGFRPDRTGEGLLVAPRSTRPTAISASSARRWARHWTS

SEQ ID NO: 79311 - protein, 261 aa, Magnetospirillum magnetotacticum MS-1
MIARNLTQAGWSVMGTTRSGEAVDCPGVEVLAFDRGHPLPPGCLTGVDAVLSSVPPDSQGDPVLDHMAESIRAAAPAWIGYLSTTGVYGDHGGAWVDEETAPHPNLDRSRRRLAAETGWRDLGAQIFRLAGIYGPGRSAVDTVREGQARRVVKPGQVFSRIHVEDIAAAVLASLDRPNAGAVYNLCDDDAAPPQEVIAYACALLGVEPPPEIAWEEAKATLSPMAQSFYADNKRVHNGKMKAELGVRLAYPSYREGLKSCL

SEQ ID NO: 79312 - protein, 139 aa, Methanococcus maripaludis S2
MACENELERTFVALKPDTVERKLVGRVIQRFEDRGFEIVEMRMLTLTMEMAEEYYGEHKGKEFYERLIKFMTSGRIVAMVIKGERAISTVRKMLGNTCPCDAEPGTIRGDFGLYTPANIIHASDSLESAEREIDLFFGR

SEQ ID NO: 79313 - protein, 173 aa, Camellia sinensis
MEQNETGCQVPPDAPMLCVNNCGFFGSAATMNPCSKCHKDLMLKQQQTELAASSIGSIANGGSGSPGKEPDSAITTVHVDAGSSDSMIVSMQASHESLLNENNVIVKEVPPNRCSACRKRVGLTGFNCRCGNLFCAVHRYSDKHDCPFDYRSAAQDAIAKANPVVKAEKLDKL

SEQ ID NO: 79314 - protein, 209 aa, Guillardia theta
MKFNIANPSTGVQHTIEIDDEDKLRILYGKKLTSKIDGKIIGKEWDKSIFIITGGQDKQGFPMKEGILSPSRVKILLKKGSTGCRGYKMKKGERCRKSVRGCIVSPEISVLNIKLLTNKNDDLLITNKNSEKTLTHKRSSNLRKVLCLTKTDDIRKHYIKIAKDFKNKVKIQRLITPIKIQKKKENIRKKLKRIENYRKSLLDYSLGLI

SEQ ID NO: 79315 - protein, 174 aa, Glycine max
  misc_feature (105)..(105): Xaa can be any naturally occurring amino acid
GHPWHDLYIGPRAPPIIHCEGEIGKGSKVKYELDKTRGLIEEDRILYSSADYPHKYGIIPITIWEDSDPMEELVLMQEPELTGSFQRARAIGLMPKIDRGERDDXIISDSADDPDFRYYTDITELPPHRLAEIRRYCEDYKNNDNATDDVGDYLTSETAIDAIKDSMDLYAAYI

SEQ ID NO: 79316 - protein, 519 aa, Yarrowia lipolytica CLIB122
MLTNLTIVLITLLVTYTVLTRTALRIQRARKAKQMGATLPPRVNNGILGWYGLWLVIQNARSMKLPHTLGKRFANGPTWLTPVAGNEPINTIDPENVKAILATQFKDFCLGIRHRALSPSIGDGIFTLDGEGWTHSRALLRPQFSRQQISRVHSLERLMQILFKLIRKENGEYFDLQNLFFMFTLDSATEFLYGASVDTLADLLGEPVEGDHGGVGEEVRKAYQQSINNAQDISAIRTRLQGLYWIAGNIYQRNLYQKSNKGVKDFSQFFVDKALNTSKEKLKEMEDSDNYVFLYELVKSTRNPVVIRDQLINILVAGRDTTASLLSFTFYTLGRRPDVLKKLRAAILEDFGTSPDEITFESLKRCDYLRYVLNEVLRLYPSVPINARSATRDTTLPRGGGPDGKQPVFVYKGQMVAYCVYWMHRDKKYWGEDALEFNPDRWDPKVQPQNKGWEYLPFNGGPRICLGQQFALTEAGYVVTRMLQEFDTVHCKNQKEEEHPPYALDLTMRHGEGVWVSMK

SEQ ID NO: 79317 - protein, 171 aa, Helicobacter pylori 26695
MLDLSYSLERVLQEDPAARNKWEVLLLYPGIHALLCYRLAHALHKRRFYFIARALSQLARFITGIEIHPGAKIGRGLFIDHGMGVVIGETTEIGDDVTIYHGVTLGGTGKFKGKRHPTLGNRVVVGAGAKVLGAICVGDDVKIGANAVVLSDLPTGSTAVGSKAKTITKDR

SEQ ID NO: 79318 - protein, 531 aa, Yarrowia lipolytica CLIB122
MLQLFGVLVLALTTALLAQLAYNKYEYNRKVKQFGCGELTVAKNGFLGWKGIRAVLHVLKTKKGPAALKERIDAYGRTYVFHIGPAPVISTMEPENIKAMLATQFKDFSLGTRYRSLAPTLGDGIFTLDGHGWTHSRALLRPQFAREQVSRLDSLEAHFQILKMCVDKEMREKGNDPRGFDIQNLFFLFTLDSATEFLFGSSVDSLVDFLDDPSVRTGDHGGVDEAARKGFNNSFNHAQELCALRSRLHTLYWIVGSVVKKEPFERYNKEIKTFVDFFAAKALKARKEKDMSLMDNDQYIFMYELVKETTNPVTLRDQMLNILLAGRDTTASMLSWIYFRLARDPKLYAKLRSAILEDFGTTPEAITFESLKQCDYLRYVLNEALRLYPVVPINGRTATRDTTLPRGGGPDQSQPIFIPKGQTVSYSVYWTHRDPRFWGEDAEEFIPERWDPRNGNIGRGWEYLPFNGGPRICLGQQFALTEVGYVLSRLVQTYETLETCDHKPLPPLYNHALTMCHEEGVWVKMYKGEKA

SEQ ID NO: 79319 - protein, 162 aa, Arachis hypogaea
MAPIAVGDVIPDGTLAFLDNDNKPQSVSIHSLAKGKKVIIFGVPGAFTPTCSLKHVPGFIERAEELKGKGVDEIICISVNDPFVMKSWANTFPENKHVTFLADGSAKYTHDLGLELDLSEKGLGIRSKRFALLVEDLKVKVANIESGGEFTVSSAEEIIKAL

SEQ ID NO: 79320 - protein, 246 aa, Aspergillus oryzae
MSPPAIIAPSILSADFASLGSECSTKMAQGSDWLHVDIMDGHFVPNITFGAPVVTKIRSHVDRPTQPHGRGTFDCHMMIMEEFKNAGCDLYCFHYEAAVASVAATEPADSTTTRKTSPKELIRYIHEEGMQAGIAIKPDTPVDVLWEILESKDEKERPDMVLVMTVYPGFGGQKFMASELPKVQALRERYPNLNIEVDGGLGLGTVDQAAEAGANVIVAGSAVFGAQDPADVIAKLREAVNKRQKL

SEQ ID NO: 79321 - protein, 645 aa, Arabidopsis thaliana
LLSKEPIPKLIYSFLFNYSFNFSDRRRLIGDGVMAGGIVSPASLLDLIADIVEIPLNTGMFKKDCADLTRRVCLLTHLLEEIRDSTPIDSAASSSSENDWWSDLVVGLQAAKRLLSTARFQARDSSDGAAKRISFQFQCVTWKLEKALSNLPYDLYDISDEVGEQVELARSQLRRAMQRYGSLNSNKFSSALSEPMERDGFSNVIKIKAEEKLESVSETLHFGEEEEKQSSPPLRRSSSISLAYYLSKDADTDRLDKMVNKNTDESKKSDKLTIPVDFLCPVSLELMKDPVIVATGQTYERAYIQRWIDCGNLTCPKTQQKLENFTLTPNYVLRSLISRWCAEHNIEQPAGYINGRTKNSGDMSVIRALVQRLSSRSTEDRRNAVSEIRSLSKRSTDNRILIAEAGAIPVLVNLLTSEDVATQENAITCVLNLSIYENNKELIMFAGAVTSIVQVLRAGTMEARENAAATLFSLSLADENKIIIGGSGAIPALVDLLENGTPRGKKDAATALFNLCIYHGNKGRAVRAGIVTALVKMLSDSTRHRMVDEALTILSVLANNQDAKSAIVKANTLPALIGILQTDQTRNRENAAAILLSLCKRDTEKLITIGRLGAVVPLMDLSKNGTERGKRKAISLLELLRKACQ

SEQ ID NO: 79322 - protein, 606 aa, Pseudomonas syringae pv. syringae B728a
MESRTSRRTFVKGLAAAGVLGGLGLWRSPSWAASGSAALSVLSGTEYDLSIGEMLVNITGKRRTAMAINGGLPGPLLRWKEGDTVTLRVRNRLDAATSIHWHGIILPPNMDGVPGLSFAGIEPGGVYVYQFKLQQNGTYWYHSHSGFQEQVGVYGPLVIEAKEPEPFKYDSEHVVMLTDWTDEDPVALMRTLKKQSDYYNFHKRTVGDFVNDVADKGWAATVADRKMWAEMKMNPTDLADVSGATYTYLLNGQAPNMNWTGLFRPGEKVRLRFINGSAMTYFDIRIPGLKMTVVASDGQYVNPVKVDELRIAVAETFDVIVEPTAEAYTVFAQSMDRTGYARGTLAVREGLVAQVPPLDARPLVTMDDMGMGGMDHGSMGSMDSGADDGMQTMSSMGGNSMPAMDHSKMSTMQGMDHGAMPGMDHDSMGGMVMQSHPASEKNNPLVDMQAMSPTAKLNDPGLGLRNNGRKVLTYADLKSTFEDPDGREPSRTIELHLTGHMEKFAWSFDGIKFADAQPLVLKYGERVRIVLVNDTMMTHPIHLHGMWSDLEDEDGNFRVRKHTIDMPPGSKRSYRVTADALGRWAYHCHLLYHMEMGMFREVRVEE

SEQ ID NO: 79323 - protein, 461 aa, Agrobacterium tumefaciens str. C58
MKASATDRQRSDVLVVFGATGDLAYKMIFPSLYAMVKRGALQTPIIGVAFDDWPREQLIARARDAVANHLDKIDEAVFEKFAAQLTYVSGDYRNEATFEKLRTALGGHQHPLYYLAIPPSLFETVVTGLNRAGIAASARLMVEKPFGRDLASAEALNEALHAVFAEDAIFRIDHFLGKEAIQNLLYFRFANAFLEPVWNRDHVESVQITMAEDFGIRGRGKFYDEVGCIRDVIQNHLINVLLLLAMEPPATSASDDLVDEKVQILKAMPPLTRDDVVRGQFRGYLDEPGVASASNRETFAAARFRVATWRWNGVPFFIRSGKNLPAHATEVVVRFKRPPIALFGDVETTPANYVRFRLGPDIAIGIGARRKAAGDGMRGEAVELGAVDDGIGDMAPYERLIGDAMAGERQLFTRQDAAELAWKIVEPILDDPAVPPVYEVGSWGPAEMAGFGPPGGWVDPE

SEQ ID NO: 79324 - protein, 479 aa, Arabidopsis thaliana
MVKICCIGAGYVGGPTMAVIALKCPDIEVAVVDISVPRINAWNSDQLPIYEPGLDDIVKQCRGKNLFFSTDVEKHVREADIVFVSVNTPTKTGLGAGKAADLTYWESAARMIADVSVSDKIVVEKSTVPVKTAEAIEKILMHNSKGIKFQILSNPEFLAEGTAIADLFNPDRVLIGGRETPEGFKAVQTLKEVYANWVPEGQIITTNLWSAELSKLAANAFLAQRISSVNAMSALCESTGADVTQVSYAVGTDSRIGSKFLNASVGFGGSCFQKDILNLVYICQCNGLPEVAEYWKQVIKINDYQKNRFVNRIVSSMFNTVSNKKVAILGFAFKKDTGDTRETPAIDVCKGLLGDKAQISIYDPQVTEEQIQRDLSMKKFDWDHPLHLQPMSPTTVKQVSVTWDAYEATKDAHAVCVLTEWDEFKSLDYQKIFDNMQKPAFIFDGRNIMNVNKLREIGFIVYSIGKPLDPWLKDMPAFV

SEQ ID NO: 79325 - protein, 386 aa, Vibrio vulnificus YJ016
MVTNNMSKRDFYEVLGVSRDASERDIKKAYKRLAMKFHPDRNQGDESAADKFKEVKEAYEILTDPQKKAAYDQYGHAAFEQGGGGFGGGFGGGGADFGDIFGDVFGDIFGGGRRGGGHARPQRGADLRYNMELSLEEAVRGVSKEIEVPTLVHCDTCEGTGAKKGTSAETCGTCHGHGQVQMRQGFFAVQQTCPTCHGKGKIIKDPCNVCHGQGRKQKTKTLNVKIPAGVDTGDRIRLSGEGEAGERGAPAGDLYVQVHVREHHIFEREGNNLYCEVPVSFAMAALGGEVEVPTLDGRVNLKVPSETQTGRMFRMRGKGVKGVRGGAIGDLIVKLVVETPVNLSSRQKELLKEFEESCCGEAATKHKPKSEGFFNGVKKFFDDLTS

SEQ ID NO: 79326 - protein, 56 aa, Oryza sativa
PRVRPRVRQDRFLAFPAKHHASVLQIGGTNLNNLTNATELANAYSYHQINLDWGCP

SEQ ID NO: 79327 - protein, 591 aa, Magnaporthe grisea 70-15
MPSKFAHLPLSTSGPLDCALSGTAILNHPFFNKGSAFTAAERRDFGLLGLLPQNIQTLEQQANRAYAQYSSRPDDLAKNTFLTSLKEQNEVLFYRLLHDNLPEMFGVVYTPTEGDAIQNYSRLFRRPEGCFLNVNDVDRVREDLQRWGRPEDVDYIVVSDGEEILGIGDQGCGGILISIAKLVLTTLCAGLHPNRTLPVVLDCGTDNQGLLDDPLYLGLRERRVRGEKYDSLVREFVAAARDLFPRAVIHFEDFGVTNARRILDTYRPRAPVFNDDVQGTGCVVLAAIMAGMHVAGLKIQDLRMVVFGAGSAGTGIADMVRDAIAEESGCGKDCAAEQIWLVDKPGLLTTATQNDTAQTPYAKKPWGEGHGTDLLAVVDEVRPNVLIGTSTVPGAFTEEIVRAMAKHAPRPIIMPLSNPTRLHEAVPADLMAWTDGKALVATGSPFAPVKLDGGREVEIAECNNSVVFPGIALGSVLSRARLVTDSMLVGAVKAVAAMSPALKDPAGSLLPGVDEVRNVSVAVASGVIRAAVQEGVATEEGIPRGKDDGDLEEWVREQMWNPVYRELRKVGGGDATREAKGELKQAGTLEG

SEQ ID NO: 79328 - protein, 137 aa, Zea mays
MDYRPSDSSGTDDDLPQFPHKSIRGSGRVSGNGRAVVPAGSYARAPTDMVAQVQQLEQEAYRSVLRAFKAQSDAITWEKEGLMTELRKELRVSDKAHRELLNRVNNDNIICSIREWRSTGGLQASLSNNPPLIHDSV

SEQ ID NO: 79329 - protein, 425 aa, Bacillus pumilus SAFR-032
MTNKYIEAQAHMSEAAERALEGKVKGFRRLLPFLGPAFIAAIAYIDPGNFATNIAAGSKYGYLLLWVILISNLMALLIQSLSAKLGIATGKNLPEIAREEFPKPVSIGLWIQGELVIIATDLAEFIGAALGLYLLFRIPLLEASIIAAIGSFAILELQRRGYRALEAGITGMLFVVVIAFAVQTFVAKPDIASVAGGLFIPKFDGADSVLLAAGILGATVMPHAIYLHSALTQRRVVGRTEKEKKQIFRFEFLDILIAMIVAGAINASMLIVAAALFYKNGLFVEDLDVAFQHFGTLAGPVSAILFGVGLLVAGLSSSSVGTLSGDIIMQGFIQYRIPLYVRRLITIIPPIAIIASGVNPTSALVMSQVVLSFGIAFALIPLILFTSKKRIMGELTNARWVTGISWVIAALVVALNLFLIVDTFM

SEQ ID NO: 79330 - protein, 426 aa, Glycine max
  misc_feature (293)..(293): Xaa can be any naturally occurring amino acid
SSQLRRPPPPRSDWSKEAVGMMALHETLRRVCLNSEWTYSVFWTIRPRPRVRGGNGCKIGDDNGSLMLMWEDGFCRGRGSGCLEDIDGEDPVRKAFSKMSIQLYNYGEGLMGKVASDKCHKWVFKEPTECEPNISNYWQSSFDALPPEWTDQFESGIQTIAVIQAGHGLLQLGSCKIIPEDLHFVLRMRHTFESLGYQSGFYLSQLFSSTRNTSSSTSVPSKPSTNIPIRPPLPLFNWGQRPLTSATSMLSSPNFQHAARLGFPKDEAHMFLMPHASPEGARIEDMMGEHEGXIKWPNGLSFFNALTGRTDDAKLLFNPESLGNKPGDQNQHHTIGQNRNSEGSNMQNASGGANPNEFLSLDSHQDDVRKMDKFKRSFTLPARVASSSSSTSMDQHHHHHHHHHQGVEYRNSEGGMYPDVMETFLE

SEQ ID NO: 79331 - protein, 515 aa, Pseudomonas aeruginosa PAO1
MSASTLSASKPLLAGYVESILAAPVYDVAVETPLQVAPQLSQRLGNRVLLKREDLQPVFSFKIRGAYTRVARLSDEQKARGVITASAGNHAQGLALAAQRLGVRAVIVMPRTTPELKVKGVLARGGEALLHGDAFPDALAHALQLAEREGMTFVPPYDDPDVIAGQGTVAMEILRQHSGRLDAIFVPVGGGSLIAGIAAYVKHLRPDIRVIGVEPEDSNCLQAALAAGERVVLGQVGLFADGVAVAQIGACNFEVCKDHVDEVITVGSDEICAAIKDIYDDTRSITEPAGALAVAGIKKYVARERTEGQTLVAIDSGANINFDRLRHVAERAELGEQREAIIAVTVAERPGSFKAFCAALGRRQITEFNYRYHSDRQAHLFVGVQTHPLTDSRADLLAGLREQGFPVLDLTDNEMAKLHIRHMVGGHGTEVRRERLFRFEFPERPGALLNFLDKLGSRWNISLFHYRNHGAADGRVLAGLQVPDEERGELEAALQAIGYPYWEETHNPAYRLFAG

SEQ ID NO: 79332 - protein, 151 aa, Emericella nidulans
MSTSARRRLMRDFKRMQTDPPAGVSASPVADNVMTWNAVIIGPADTPFEDGTFRLVMHFEEQYPNKPPGVKFISQMFHPNVYGTGELCLDILQNRWSPTYDVAAILTSIQSLLNDPNTSSPANVEASNLYRDNRKEYIKRVRETVEKSWEE

SEQ ID NO: 79333 - protein, 163 aa, Silicibacter sp. TM1040
MLKGSRAMTKSPKFAFIKAQWHADIVDQALIGFQDQLADFGLDAAVDVFDVPGAFEMPLLAQKLAATGEYDAIAAAALVVDGGIYRHDFVAQAVVSGLMEAGLKTGVPVLSVSLTPHHFQPSEEHQTFYHAHFVKKGREAAQAAVRMANLYRDLTPTPVEAVA

SEQ ID NO: 79334 - protein, 717 aa, Zea mays
  misc_feature (301)..(301): Xaa can be any naturally occurring amino acid
MAFMLAALLCEAISVRFVSTVLGLQWHRSTAPLPDTGQWMLLALSGKLPRTVVDLLKARIITLHHYLMMFIMLAFSALFDCIRGPGLGIGSRYMFTMAVGRLLRTATFLATILPSARPWCAEARYQIPDHPHPWAQKYYAPYASDPDMISRVMEEDMPYATLQDYPDEYRPDWGLMSFLVDILRPSTGEGPSWYHLLRKSSGGCNDLMYSGHMFVAVLTAMAWAEAYGGWSSVVIWFLVIHSAQREVRERHHYSVDCVVAIYIGILLWRMTAFLWSTMESNRSRRLSKLDEVQKRLFRAAXKDSDVLEIRSLLNEVELAAQPYAANSELMKDRIYDQRVNRRLATCERPRSRISSYARRSSEDDPPPAPLLPASMSAGRGFELIAICIEEKLAKELLFAKKGEEFFKLHRRLVTPQPSSASVCWEDLRASFLAAGDPEAEWAFFRQTHKSNSHSKSDPTLPPFPKFTQFELTQLRKGLNRNGPGYHSMGPLSKTWPARNPGMSYAQALMDGRGAVRDGKAMAWKEVDRRRHPRIEVKTEQQHLRGHRLSRGRGPSEDRGRRTWHSRGGRYGGRPFHGAFRAPQDFAESSEGGGSRVREEAEKKRAAVDGPPADDQGKKRKEKLCCEICEMDHTPQVCPTFNGPKPHALLCGFAGGDSGFFQIPTSGAKGMAPKKDNATTFITAMEGNITTDLVKAELARLIPVNWTWSVQQHADGFE

SEQ ID NO: 79335 - protein, 68 aa, Triticum aestivum
  misc_feature (26)..(26): Xaa can be any naturally occurring amino acid
  misc_feature (35)..(35): Xaa can be any naturally occurring amino acid
MDTSRRLVDRKTAKFREDITQEGSVXETTVKKGNXYPVGPLVLGFFIFVVIGSSLFQIIRTATSGGVA

SEQ ID NO: 79336 - protein, 280 aa, Solanum tuberosum
SLGSSTLLQSQISGFGGSQKLQKISFSNPNSLTFTRRRIQTVVNASSRVDKFSKSDIIVSPSILSANFSKLGEQVKAIEQAGCDWIHVDVMDGRFVPNITIGPLVVDSLRPITDLPLDVHLMIVEPDQRVPDFIKAGADIVSVHCEQSSTIHLHRTINQIKSLGAKAGVVLNPGTPLTAIEYVLDAVDLVLIMSVNPGFGGQSFIESQVKKISDLRKICAERGLNPWIEVDGGVGPKNAYKVIEAGANALVAGSAVFGAPDYAEAIKGIKTSKRPEAVAV

SEQ ID NO: 79337 - protein, 170 aa, Mycoplasma pulmonis UAB CTIP
MNLEKFIKDVKDFPKQGINFKDISPLLANGQALNYTIKKMAELAKDADIIVGPDARGFLFGTPTAAFLSKPFIMVRKKGKLPGEVIKHEYDLEYGKDILEIQKGVIKPGDKAIIIDDVLATGGTTKAIIDLLESQGAKVIKIILLLELTNLNGRSKFGSLQVESLVKVSV

SEQ ID NO: 79338 - protein, 568 aa, Oryza sativa Indica Group
MASAAAEAPAPSPSPTAAANSRPRRVLEELSWDDSFVRELPGDPRSDAIPREVLHACYTKVSPSAPVDNPKLVAWSQSVADILDLDHKEFERPDFPQLFSGANPLVGSSPYAQCYGGHQFGSWAGQLGDGRAITLGEVINSRGERWELQLKGCGKTPYSRFADGLAVLRSSIREFLCSEAMHGLGIPTTRALCLVETGKSVVRDLFYDGNSKEEPGAIVCRVAPSFLRFGSYQIHATRDKEDLEIVRHLADYTIRHHYAHLENIKKSEGLSFEAAIGDSPAIDLTSNKYAAWAVEVAERTAFLIARWQGVGFTHGVLNTDNMSVLGLTIDYGPFGFLDAFDPSYTPNTTDLPGKRYCFANQPDVGLWNIAQFTSPLTAAELISKDEANYVMERYGTKFMDEYQSIMTRKLGLPKYNKQLIGKLLNNLAVDKVDYTNFFRLLSNVKADHNIPEKELLVPLKAALLDIGPERKEAWISWVQTYIEELVSSGVPDEERKAAMNSVNPKYVLRNYLCQTAIDAAEQGDYDEVRRLLKVMEHPYDEQPGMEKYARLPPAWAYRPGVCMLSCSS

SEQ ID NO: 79339 - protein, 337 aa, Streptococcus equi subsp. zooepidemicus
MTQVFQGRSFLAEKDFTREEFEYLIDFAAHLKDLKKRGIPHHYLEGKNIALLFEKTSTRTRAAFTTAAIDLGAHPEYLGANDIQLGKKESTEDTAKVLGRMFDGIEFRGFSQRMVEELAEFSGVPVWNGLTDEWHPTQMLADYLTVKENFGKLEGLTLVYCGDGRNNVANSLLVAGTLLGVNVHIFSPKELFPAEDIVKLAEGYAKASGAHVLVTDNADEAVKGADVLYTDVWVSMGEEDKFEERVKLLKPYQVNMELVKKADNDNLIFLHCLPAFHDTNTVYGKDVAEKFGVEEMEVTDEVFRSKYARHFDQAENRMHTIKAVMAATLGNLFIPKV

SEQ ID NO: 79340 - protein, 103 aa, Prochlorococcus marinus subsp. marinus str. CCMP1375
MVGNPGRGPGGAAVVDKQTERVRKTSPRYKVLLHNDPVNTMDYVVTTLRQVVPQLSEQDAMAVMLETHNTGIGLVITCDLEPAEFYSESLKGKGLTSTIEPES

SEQ ID NO: 79341 - protein, 214 aa, Brassica napus
  misc_feature (197)..(197): Xaa can be any naturally occurring amino acid
MELFTKGEAVKLRSHLDRFLVADDDQETIRQSRKGDARRAVWTVETVEAKPNLIRLKSSHGTYLTASNKPLLLGMTGEKVTQTHSSNKPMDWQTQWEPVRDGFSVKLKSWCGKWMRANGGTPPWRNSVTHDEPHTSKTKNWLVWDVITVGGSDLENMSAGDESSVSSPVSSHISGSDLGSEPASPVSARSKKSIDRXASLGLSSMSPRWSSKRK

SEQ ID NO: 79342 - protein, 469 aa, Thermoplasma acidophilum DSM 1728
MSKEYDLLILGYGAAAFSAAIKASEITSGQASIAMVGTGPLGGTCVNVGCVPSKMLISAAKNLKYIAKPRYPGLKATYAVETGEVMDFIRMAVDEERHNKYEAVISGYENIDLYRSRAVFTGDRRVKLDDGQELFGYNVLIATGSRPSIPAVPGLANAGYITSNEFWALERIPESLVIIGSGPIGSEIGQAAARLGSRVHIVEIADQILPGISKDMAQMVMDAMASDGVEFSLSSMVKDVSVRNGKKIVRFEKNGVQHEIEADEILVATGRSPNADLDLEKTGVKYDRYGIEVDSTLRTSNRKIYAAGDVVKQRLKLETLASKEGVIAAENMFDHAGISVDLNSFPVAVFTSPEYASVGYTEDEALKAGLNYDVRSIYTTDVPKERILRNDRGMIKIVAEQGTGRIIGIQIVAENAADMINEASAILHAGMTVGDVIDTPHVFPTVNEGIKLAAQSFLRDISMMSCCME

SEQ ID NO: 79343 - protein, 408 aa, Prochlorococcus marinus subsp. marinus str. CCMP1375
MVQVNSNYLKLKAGYLFPEISRRVNAFCELNPTASLIRLGIGDVTEPLPQACCKAMKTAIEEMGSTSGFRGYGPEQGYLWLREAIAKNDFQSRGCQISADEIFVSDGSKCDSSNILDILGTGNKIAVTDPVYPVYVDSNVMAGQTGIAASSGHYEGLVYIPLNAENGFEAELPSEPVDLIYLCFPNNPTGAVASKVQLTKWVEYAKKNHALILFDAAYESFIQDPLLPHSIFEIDGATDCAIEFRSFSKNAGFTGTRCAFTVIPKSLKGKTLDGAEVDFWSLWNRRQSTKFNGVSYIVQRGAEAVYSLEGQSQTNKLVSFYMKNAEIIRKQLTLAGYKIYGGKHAPYVWLEAPTEMDSWQFFDHLLNKANIVGTPGSGFGVAGEGYFRLSAFNSRSNVEEAMRRITSI

SEQ ID NO: 79344 - protein, 315 aa, Triticum aestivum
  misc_feature (21)..(21): Xaa can be any naturally occurring amino acid
KKWGAPNNIDFLSLFYTRHAXDVRQAREFLSKLGDLIQTLILAKIENASGLNHFDEILEEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKRTVKYVGEPMTHLESIASSAVRAAIKVKASVIICFTSSGRAARLIAKYRPTMPVLSVVIPRLKTNQLKWSFTGAFEARQSLIVRGLFPMLADPRHPAESTSTTNESVLKVALDHGKASGVIKSHDRVVVCQKVGDSSVVKIIELDD

SEQ ID NO: 79345 - protein, 612 aa, Yarrowia lipolytica CLIB122
MFRTIRKPAWAAAAAVAAAGAGAVALSVPAQAQEELHKKHKFTVPPVAAEPPSRAAQLEKMKTEEFDLVVVGGGATGSGIALDAVTRGLKVALVERDDFSCGTSSRSTKLIHGGVRYLEKAVWNLDYNQYELVKEALHERKVFLDIAPHLTFALPIMIPVYTWWQLPYFWMGVKCYDLLAGRQNLESSYMLSRSRALDAFPMLSDDKLKGAIVYYDGSQNDSRMNVSLIMTAVEKGATILNHCEVTELTKGANGQLNGVVAKDTDGNAGSFNIKAKCVVNATGPFTDSLRQMDDKNTKEICAPSSGVHIILPGYYSPKKMGLLDPATSDGRVIFFLPWQGNTLAGTTDQPTKITANPIPSEEDIDFILNEVRHYVEGKVDVRREDVLAAWSGIRPLVRDPHAKNTESLVRNHLITYSESGLVTIAGGKWTTYRQMAEETVDACIAKFGLKPEISAKAVTRDVKLIGAKDWTPLTYIDLIQQEDLDPEVAKHLSENYGSRAFTVASLAEMPTPEPGVIPQSTLTKGKRILYPYPYLDAECKYSMKYEYATTAIDFLARRTRLAFLNAAAAYEALPEVIEIMAKELQWDEARKEQEFNTGVEYLYSMGLTPKDK

SEQ ID NO: 79346 - protein, 376 aa, Vibrio vulnificus YJ016
MTQDKFIKSRAAVAWGPKQPLSIEEVDVMLPRKGEVLVRIVATGVCHTDAFTLSGDDPEGVFPAILGHEGGGIVEMVGEGVTSVSVGDHVIPLYTAECGQCKFCLSGKTNLCQAVRETQGKGLMPDGTTRFYKDGKPIFHYMGCSTFSEYTVLPEISLAKVNKEAPLEEICLLGCGVTTGMGAVINTAKVKQGDTVAIFGLGGIGLSAIIGARMAGASRIIAVDINDRKFELAKQLGATDCINPKEHDQPIQEVIIEMTDGGVDFSFECIGNVNVMRQALECCHKGWGESVIIGVAGAGQEISTRPFQLVTGRVWRGSAFGGVKGRSQLPAIVEQYLAGEFGLQEFITHTMPLEGINDAFELMHSGESIRSVVHFE

SEQ ID NO: 79347 - protein, 280 aa, Prochlorococcus marinus subsp. marinus str. CCMP1375
MPTQVAYLGPKGTYAEQAAGYLAKLEKLSQPEFIPCCGLRSVIEHLVNKHCEAAVVPIENSVEGGVTTTLDSLWAHPNLFIQRALVLPIRHAFISSGSLNEITEVLSHPQALAQCTDWLSNNVPNAIQLPTNSTSEAVRMVKGSKFRAAIASKTSSEVEGLENIAYPINDVAGNCTRFVLLTNQKSDITGDIASFAFSLHANKPGALLKALTCIADLGLNMNRIESRPSKRELGEYIFFVDIDLQEKSIDTKDRLNKLLKPLCENIIYFGSYVTSEMTLD

SEQ ID NO: 79348 - protein, 320 aa, Oryza sativa Japonica Group
MYENCKVIDLGVTNCRVVESVGEHVEGFAAGDPVVPTFLGQCTECVDCASERSHVCSTYRFRFPLGIGMTGKGTSGFGKGHGAPIHQVLGLSGFSVYTVVHANQFVRVDPAVPPATASLLSCGATTGVGAAWKLAKVEPGSSVAIFGLGAVGLAVAEGARICGKKFGVTHFINPQELGDKPVSQAIIEMTDGGADYCFECIGLASVMSDAFRSSREGWGKTIILGVEMHGAPLSIPSLEILNGKCVMGSLFGGVKPKQDIPILADKYLNKIVDTNAMQELELDKFITHEVPLKTSTRHLTFCCRGRVSDAPFGWTSDVAK

SEQ ID NO: 79349 - protein, 1188 aa, Pisum sativum
MKPLYSTNTLLLLLALFLLHLGPSHSSSSSSSSTSSSQLLYFKQSLPNPSLLHDWLPYKNPCSFTGITCNQTTVTSIDLTSIPLNTNLTVVATYLLTLDHLQVLTLKSSNITSSPISLSHTKCTSSLTTIDLSQNTISSSFSDLAFLSSCSGLKSLNLSNNQLDFDSPKWTLSSSLRLLDVSDNKISGPGFFPWILNHELEFLSLRGNKVTGETDFSGYTTLRYLDISSNNFTVSIPSFGDCSSLQHLDISANKYFGDITRTLSPCKNLLHLNLSGNQFTGPVPSLPSGSLQFLYLAENHFAGKIPARLADLCSTLVELDLSSNNLTGPVPREFGACTSVTSFDISSNKFAGELPMEVLTEMNSLKELTVAFNEFAGPLPESLSKLTGLESLDLSSNNFSGTIPRWLCGEESGNNLKGLYLQNNVFTGFIPPTLSNCSNLVALDLSFNYLTGTIPPSLGSLSKLRDLIMWLNQLHGEIPQELSNMESLENLILDFNELSGTIPSGLVNCTKLNWISLSNNRLTGEIPSWIGKLSNLAILKLSNNSFSGRIPPELGDCPSLIWLDLNTNFLTGPIPPELGKQSGKVVVNFISGKTYVYIKNDGSKECHGAGSLLEFAGINQEQLRRISTRNPCNFTRVYGGKLQPTFTLNGSMIFLDVSHNMLSGTIPKEIGEMTYLYVLHLSHNNLSGSIPQELGKMKNLNILDLSYNKLQDQIPQTLTRLSLLTEIDFSNNCLSGMIPESGQFDTFPVGKFLNNSGLCGVPLPPCGSDSGGGAGSQHRSHRRQASLAGSVAMGLLFSLFCVFGLIIIAIETRKRRKKKEAAIDGYIDNSHSGNANNSGWKLTSAREALSINLATFEKPLRKLTFADLLAATNGFHNDSLIGSGGFGDVYKAQLKDGSVVAIKKLIHVSGQGDREFTAEMETIGKIKHRNLVPLLGYCKVGEERLLVYEYMKYGSLEDVLHDPKKAGIKMNWSVRRKIAIGAARGLAFLHHNCIPHIIHRDMKSSNVLLDENLEARVSDFGMARLMSAMDTHLSVSTLAGTPGYVPPEYYQSFRCSTKGDVYSYGVVLLELLTGKRPTDSADFGDNNLVGWVKQHAKLKISDVFDKELMKEDPNLEIELLQHLKVACACLDDRPWRRPTMIQVMAKFKEIQAGSGMDSQSTIATEDEGFNAIEMVEMSIKEVPELIKH

SEQ ID NO: 79350 - protein, 396 aa, Brucella abortus
MMFRTLDDANVQSKRVLVRVDLNVPMANGEVTDLTRIERIVPTIAELSRKGAKVILLAHFGRPKGVASDENSLKHVVKPLSKVLDHSVHFAEDCIGDKAKPAVDALKDGDVLLLENTRFHKGEEKNDPEFVQALAANGDLYVNDAFSAAHRAHASTEGLANVLPAFAGRAMQAELEALEKGLGNPARPVVAIVGGAKVSTKLDLLSNLIEKVDALVIGGGMANTFLAAKGLDVGKSLCEHELASTAREIMAKAETTKCAIILPVDAVVGWHFAADTPHQTYGVDSVPGDAMILDAGELSTDLIASAIDDAATLVWNGPLGAFELSPFDTATVKVARHVAKRTKEGKLVSVGGGGDTVAALNHAGVADDFTYISTAGGAFLEWMEGKPLPGVDVLKK

SEQ ID NO: 79351 - protein, 126 aa, Cicer arietinum
GRSGKPLHFKGSSFHRVIPNFMCQGGDFTAGNGTGGESIYGSKFADENFIKKHTGPGILSMANAGPGTNGSQFFVCTAKTEWLDGKHVVFGQVVEGLDVVKEIEKVGSSSGKTSKPVKIADCGQLS

SEQ ID NO: 79352 - protein, 514 aa, Escherichia coli K12 [sequence omitted]

SEQ ID NO: 79353 - protein, 437 aa, Kluyveromyces lactis NRRL Y-1140
MVVTAELNLSSAKTIEYEQEYSAHNYHPLPVVFSRASGAHVWDPEGKEYLDFLSAYSAVNQGHCHPHIIQALVDQASKLTLSSRAFSNDCFASFSKFVTEFFGYESVLPMNTGAEAVESALKLARRWGYMVKKIQPNEAIILGARGNFHGRTFGAISLSTDEEDSRMNFGPFLENVTAKIPGGSDDEFIRYGEIDDYKRAFESHGDKICAVIVEPIQGEAGIVVPRADFLTDLQELCKKHQVLLICDEIQTGIARTGKLLCYEHSPNCKPDIILLGKAISGGVLPVSCVLSSREIMDCFTPGSHGSTYGGNPLASRVAIAALEVVQNENLVERSARLGKFLQDELVKLQHESNGVISEVRGKGLLTAIVINPEKANGRTAWDLCLLMKDQGVLAKPTHEHIIRLAPPLVISEEDLLKGVDSIRVSLSKLPNVPKSHH

SEQ ID NO: 79354 - protein, 319 aa, Staphylococcus aureus subsp. aureus Mu50
MRRLFSIGEALIDFIPNVTNANLKDVQTFTKQIGGAPCNVSCTVQKLGQQAYMITQLGNDAFGDSIIETISSIGVDVSKVYRTNEANTALAFVSLTEAGERDFSFYRKPSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 79355 - protein, 225 aa, Oryza sativa Indica Group
MTSIVVINALETRKRPSTDFMETIQKDVNPSMRAILIDWLVEVAEEYRLVPDTLYLTVNYIDRYLSGNEINRQRLQLLGIACMLIAAKYEEICAPQVEEFCYITDNTYFRDEDPALHLEFLANYVAELSLLEYNLLSYPPSLVAASAIFLAKFILQPTKHPWNSTLAHYTQYKSSELSDCVKALHRLFSVGPGSNLPAIREKYTQHKILHAADVIDLNMVIQREA

SEQ ID NO: 79356 - protein, 120 aa, Pisum sativum
MAGSSEEGQVISCHSVDAWNDILHRGNESKKLIVVDFTASWCGPCRFIAPFLGELAKKFTNVIFLKVDVDELKSVAQDWAVEAMPTFVFVKEGTILGKVVGAKKEELQQTIERHVASSNA

SEQ ID NO: 79357 - protein, 362 aa, Pseudomonas aeruginosa PAO1
MKPLLHAFAPGVMALMLLLPQAAQAKEVAPQQKLSNVVILATGGTIAGAGASAANSATYTAAKVPVDQLLASVPQLKDIANVRGEQVFQIASESFTNENLLELGKTVAKLADSDDVDGIVITHGTDTLEETAYFLTLVEHTEKPIVVVGSMRPGTAMSADGMLNLYNAVAVAGDKSARGKGVLITMNDEILSGRDASKMVNIKTEAFKSPWGPLGMVVEGKSYWFRAPVKRHTVNSEFDIKQISALAPVEIAYSYGNVSDTAYKALAQAGAKAIIHAGTGNGSVPARVVPTLQELRKQGVQIIRSSHVNAGGFVLRNAEQPDDKNDWIVAHDLNPQKARILAAVAMTKTQDSKELQRIFWEY

SEQ ID NO: 79358 - protein, 557 aa, Pseudomonas aeruginosa PAO1
MQPVLFRTLSLGVAIAAASSSAFAATLDGGAVAAPDEYGAKVAAQILKAGGNAVDAAVATAFTLAVTYPEAGNIGGGGFMTLYMDGKPYFLDYREVAPKAASKTMYLDDKGEVIENLSLVGAKAAGVPGTVMGLWEAHKRFGKLPWSELLTPAIGYAQKGFKVADKQFQYRQDAVALFNGKTNFGDYFGHMKAGEAFLQPDLAKTLERIADKGPDEFYKGHTADLLVAQMQQDKGLITHQDLADYKVRWREPMRVDWQGNTLYTAPLPSSGGIALAQLLGIKENRAADFKGVELNSARYIHLLAEIEKRVFADRADYLGDPDFSKVPVARLTDPAYLKQRAAEVNPTAISPTEKVRPGLEPHQTTHFSIVDADGNAVSNTYTLNWDFGSGVVVKGAGFLLNDEMDDFSAKPGVANAFGVVGSDANAIEPGKRMLSSMSPSIVTRDGKVSLVVGTPGGSRIFTSIFQVLNNIYDFHLPLEKAVAAQRVHHQLLPKDTIYYDAYAPLAGKVAEELKAMGYTLEDQGWNMGDIQAIRVDGKALETASDPRGRGVGLVVKP

SEQ ID NO: 79359 - protein, 495 aa, Silicibacter sp. TM1040
MTDWKAAASALYDGGFRPMFINGKWCESQSGEVIEARNPASGALLATVPKGGAADVDAAVAAARAAFEGPWSKWTPFERQALLLRIADRFEAEWETLCLSDTLDMGMPIQRTLANSRRVLGMLRFYAGQAVTIHGHTIPNSFPGEIHSSTVREPVGVVGAIIPWNAPIAGSIWKIAPAIATGCTVVLKPSEEASLTVLMIARIMQEAGLPDGVLNIVTGYGAAAGAALAAHSGVDKIVFTGSTATGQAIARAATGNLKRVSLELGGKSPVIVCRDADIEKAVPVAAMAVFANSGQICIAGSRLFVAREIHDEFVRRVAEFAANLRIGHGIEESTDVGPIISARQAERIAGYLAAGPSEGAEILTGGARVKGAGFEGGHFIEPTVFGGVTDEMSIAREEIFGPVISALPFDSLDEVVERANATPYGLAAGVFSTHLGTAHKLAHRLKAGSVWVNMYHAIDPAVPFGGVKMSGYGREGGTEHMEEYLDTKAIWINTD

SEQ ID NO: 79360 - protein, 136 aa, Glycine max
GVVVPYNVTFDHSQAAKQVYERFQACLGTILTSGLPQANLSPAQLEDLPLFSIGHSNGALLQVLTGSLFSEKIPKANAIIAYNNRPATEAVPYFEQLGPAVSQMMPVVEATPFYSIARNASGDVWKMMLDAVRSTL

SEQ ID NO: 79361 - protein, 642 aa, Staphylococcus aureus subsp. aureus Mu50
MILLQLNHISKSFDGEDIFTDVDFEVKTGERIGIVGRNGAGKSTLMKIIAGVENYDSGNVSKIKNLKLGYLTQQMTLNSNATVFEEMSKPFEHIKRMESLIKEETDWLSKHANDYDSDTYKTHMSRYESLSNQFEQLEGYQYESKIKTVLHGLNFSEEDFNKPINDFSGGQKTRLSLAQMLLNEPDLLLLDEPTNHLDLETTKWLEDYLRYFKGAIVIISHDRYFLDKIVTQIYDVALGDVKRYVGNYEEFIQQRDLYYQKRMQEYESQQAEIKRLETFVEKNITRASTSGMAKSRRKILEKMERIDKPMLDAKSANIQFGFDRNTGNDVMHVKNLEIGYQTAITKPISIEVSKGDHIAIIGPNGIGKSTLIKTIANQQKALNGDITFGANLQIGYYDQKQAEFKSSKTILDYVWDQYPLMNEKDIRAVLGRFLFVQDDVKKIINDLSGGEKARLQLALLMLQRDNVLILDEPTNHLDIDSKEMLEQALQHFEGTILFVSHDRYFINQLANKVFDLTIDGGKMYLGDYQYYIEKVEEAEALKAHQEEQSVNVQAHKKSMEQSSYHNQKEQRREQRKLERQISECENEIETLETTILQIDEQLTQPEVYNNPQKANELAIQKQDSEQKLEHAMSKWEELQQKL

SEQ ID NO: 79362 - protein, 909 aa, Oryza sativa Indica Group
MKRVSSHVSIASEAEINLDLSRLLIDKPRLTLERKRSFDEQSWSELSHRQNDGFDSIMHSPAFPSGFDSPFSLGTLGDPHPLVNEAWEALRKSVVYFRGQPVGTIAAVDHASEEVLNYDQVFVRDFFPSALAFLMNNETDIVKNFLLKTLHLQSSEKMVDRFKLGAGAMPASFKGIYGYPIEIQALFYMALRCALQMLKPDGEGKDFIEKIGQRLHALTYHMRNYFWLDFPHLNNIYRYKTEEYSHTAVNKFNVIPDSIPDWVFDFMPCRGGYFLGNVSPAMMDFRWFALGNCIAIISSLATPEQSVAIMDLIEERWEELVGEMPLKICYPAIENHEWRIITGCDPKNTRWSYHNGGSWPVLLWLLTAACIKTGRPQMAKRAIELAESRLLKDGWPEYYDGKLGRFIGKQARKFQTWSIAGYLVARMMLEDPSTLMMISMEEDRPVKPTMRRQDHRGGLPLLVRPSRPRLPPPRVATGGVGAKLPLLTVRRLRIRSSSLPALDVRRRCPRRLRAPRDALPEGRVPTIRDRLLLLQCRRRRRGPTTAAAVVVALPTYQGTNTKPPRLRGGSTGLLVRRCGDDDDDELVVAALLTEEYRRRDTLEGAELVVLRSGEWSATPIAPIVHDDGKGEELSYWETDMAVPVGDRLLCYVDLYRGVILCGDDLFDEIPPRLQYVSLPVEAPAGAFDEEHFDRQGDNYRRCLLNTRTVVCAIDGGGAALKFVDISSRCCCGSLGKHTTCDRSSRAFVIRTWTLRIDGDGDDDMAWTMDAMIDAAELGPSTPTPPSHGAFHYTPYTQAFKMNTMKIACVATSKLGGAPQLFLGGGWNGGGAASPAKSTTGAEVGRALPKPMRRAAVERTLRKTLIATISGDIDGNCSSSVSWATAAQAAEVARNDGSLVKFPHFFCSRV

SEQ ID NO: 79363 - protein, 180 aa, Streptococcus pyogenes M1 GAS
MIKKENIPNLLTLVRIAMIPFFLFITSSSNKVGWHIFAAVIFAIASFTDYLDGYLARKWHVASNFGKFADPLADKMLVMSAFIMLVGLGLVPAWVSAVIICRELAVTGLRLLLVETGGKVLAAAMPGKIKTATQMLSIILLLCHWIFLGNVLLYIALFFTIYSGYDYFKGASFLFKDTFK

SEQ ID NO: 79364 - protein, 438 aa, Sinorhizobium meliloti 1021
MPLSIVHSGGIAVVATGNPLRYVFHAERAARHPPALAGIEPRPIRSAAVIGGGTMGTGIAAALLHAGLPLVLVERDEAAVERALARLRTIFDGAVKRGRISAGLAAERLAGVTGSTDYTAIAEADLIIEAVFEDLDVKRDVFRRLAAVCRADAILATNTSYLDPERIAADIGSRERFLGLHFFSPAQVMKLLEIVPTQATAPDVLATGFALARMLNKIPVRAGISDGFIGNRILKVTRAQAERLLLSGATPAAVDAAMRAFGLPMGPFEAQDLGGLDIAAFQRRAARARGETTFAPVADRLSAIERFGQKSGGGWYDYAPGDRTPRPSATVARIIAEEARGWPRRDWDEASIVGCILWPMVNEAARILEDGTALRASDIDLVEIHGYGFPRWRGGLMHHAEAHGLHKVAGALSGLAEAGLADPPCDPLLRAASRGSFL

SEQ ID NO: 79365 - protein, 375 aa, Agrobacterium tumefaciens str. C58
MDVRAAVAIQAGKPLEVMTVQLEGPRAGEVLIEVKATGICHTDDFTLSGADPEGLFPAILGHEGAGIVVDVGPGVTSVKKGDHVIPLYTPECRECYSCTSRKTNLCTSIRATQGQGVMPDGTSRFSIGKDKIHHYMGCSTFSNFTVLPEIALAKINPDAPFDKVCYIGCGVTTGIGAVINTAKVEIGSTAIVFGLGGIGLNVLQGLRLAGADMIIGVDINNDRKAWGEKFGMTHFVNPKEVGDDIVPYLVNMTKRNGDLIGGADYTFDCTGNTKVMRQALEASHRGWGKSVIIGVAGAGQEISTRPFQLVTGRNWMGTAFGGARGRTDVPKIVDWYMEGKIQIDPMITHTMPLEDINKGFELMHKGESIRGVVVY

SEQ ID NO: 79366 - protein, 719 aa, Vitis vinifera
MGFVQANNDGGGEGGLVNRENSTWDEGKEVRNGMVGEGQGLGSSEEDEPGSNEIIEDANKGSEEAIQVHDGLQNSQQQPQGSAINWDSFLPIRSLKVLLVENDDSTRHVVTALLRNCSYEVTAVANGLQAWKILEDLTNHIDIVLTEVVMPFISGIGLLCKIMSHKTFKNIPVIMMSSHDSMGIVFKCLSKGAVDFLVKPIRKNELKNLWQHVWRRCHSSSGSGSESGTQTKKSVKSKSNDESENNTGSSDERDNGSTGPSIRDGSDNGSGTQSSWTKRAAEVDSPQPLSPLDQLADAPDSTCPQVIHTKPGTLSNQWVHVIETKECQGKDEQPDNVAMGRDLELGVATNPAVQLEYQHEKFSTYPTCKRQNKLPESDSKPFDKEHLEHNSTSANCTDPQVESRTFENPNGLSDVSQIKDKGSCETTELPPLDLSLKRLRGAGDVGACVHDDRSILRHSDLSAFSKSNTTSSVKQAPTGNVGSCSPLDNSSVAMKTETMHNFPSHVDGIPPNQQSNGSSNNIDMVSTTKYAIPKSEAYNEKSESTSAFKCFHSSAFQPVTSGRMFPPQKVSSGKADDVEQQQTDNDDLFLKNMAAAAPQCGSSNVIGGPTEGNAGNYSVNGSASGSNHGSNGQNGSSTALNVGATNMEAGAISGKGGGNRVEEDRFAQREAALTKFRQKRKERCFEKKVRYQSRKKLAEQRPRIRGQFVRQNVYANTIP

SEQ ID NO: 79367 - protein, 365 aa, Oryza sativa Indica Group
MESSSPSVPFPLLQAPVESTYRACTIPYRFASDNPRKATPVEIQWIDLFLNSVPSFRQRAENDPTVPDAPAKAEKFAQRYTAMLEELKKNPESNGGPPDCILLCRLRELVLRELGFRDIFKKVKDEENAKAMSLFEGVVQRNDEIEDDGKRAENLIRGILAGNIFDLGSAQLAEVFAKDGMSFLASCQNLVSRPWVIDDLDAFQNKWTKKSWEKAVIFVDNSGADIILGILPFARELLRHGTKVILAANDMPSINDVTYPELVEIINKLKDENGKLAGVDASDLLVANSGNDLPVIDLSSVSPELAYLANDADLVVLEGMGRAIETNLYAQMKCDSIKIGMVKHPEVAQFLGGRLYDCVFKFDEA

SEQ ID NO: 79368 - protein, 1381 aa, Staphylococcus aureus subsp. aureus COL
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDSDSDSDRDSDSDSDSDSDSDSDSDSDSDSDSDSDSDRDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 79369 - protein, 174 aa, Populus trichocarpa
MSSSWSHALVRISPYTFSAVGIAIAIGVSVLGAAWGIYITGSSLIGAAVKAPRITSKNLISVIFCEAVAIYGVIVAIILQTKLESVPASQIYDPESLRAGYAIFASGIIVGFANLFCGLCVGIIGSSCALSDAQNSSLFVKILVIEIFGSALGLFGVIVGIIMSAQATWPARSV

SEQ ID NO: 79370 - protein, 1166 aa, Staphylococcus aureus subsp. aureus COL
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEPSTSEIQTKPTTPQESTNIENSQPQPTPSKVDNQVTDATNPKEPVNVSKEELKKNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDRGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 79371 - protein, 180 aa, Listeria innocua
QIQGFFDIPIDHLNAVRLLSDYFSERHLGDDLVVVSPDHGGVTRARKMADRLKAPIAIIDKRRPRPNVAEVMNIVGNVEGKVCIIIDDIIDTAGTITLAAKALREAGATKVYACCSHPVLSGPAMKRIEDSPIEKLVVTNSIALPEEKWIDKMEQLSVAALLGEAIVRVHENASVSSLFE

SEQ ID NO: 79372 - protein, 258 aa, Flavobacteria bacterium BBFL7
MEQLKVIKIGGHIINDQQALDDFLTTFNAVKGPKVLIHGGGKVATELAQKMNLEVKMIDGRRITDSETLDIATMVFAGKVNKTIVAKLQAKQCNAIGFTGADGNTILSKKRDVEEVDFGYVGDVVKVDTEIVEVLLSRKRTPVFCAITHDGHGQLLNTNADTLAAELAIALAKNYETELYYCFEKKGVLQNISDENSVIKNINLENYQDLKSQGIIADGMLPKMQNCFQAIQNGVQKVCVGLPEMLQNSNSLFTTISN

SEQ ID NO: 79373 - protein, 161 aa, Rhizobium leguminosarum bv. viciae 3841
MTIAIGDKLPAATFKEKTADGPVEITTDQLFAGKRVVLFAVPGAFTPTCSLNHLPGYLENRDTILGKGVDDIAVVAVNDWHVMGAWAQSSGGMGKIHFLADWDAGFTKAVGLDADLSAGGLGLRSKRYSMLVEDGVVKALNVEESPGQATVSGAAAMLEQL

SEQ ID NO: 79374 - protein, 312 aa, Flavobacteria bacterium BBFL7
MKKYTELKDIKDLSQLVNEAISLKQTPYEFQHLGKNKTLVMLFFNASLRTRLSTEKAAKNLGLEVQILNVNDSWKLEFDDGTVMNADTSEHVKEAAQVISQYADVIAVRAFPSLVDKEKDAQEVVLNSFIKYASVPVVNMESATAHPLQALADVITMEELKTKKKPKVVISWAPHPKALPQAVANSFIEVMLMANVDLTITHPLGYELSDEIVKDTPVIYDQEEALKEADFVYVKNWSSYTDYGKILSQDASWMMTQKKLGNAKFMHCLPVRRNVVVEDAVLDSENSIVIEQANNRTYAAQVVLKNILEYIE

SEQ ID NO: 79375 - protein, 461 aa, Arabidopsis thaliana
MVRTRGDSRRPTRAPANTRAVARTRSEARRAAPSAPATTPIVGRTRRDARRTAPTIISDDSDSSSDDAVPDPKAARSPVAVPSKQAAEAPPPPSHAPDDSPAPVSDLPPKTSTAPPINDPAPDLLRNAFSSRGRLPYDPSDRCSIHRHHQAERDAADPSIWTPPYEPLTIQFLTSQGVERYKDFKLRDPYEQRYVPRGPPEMRDMMKVIEDNHLLDTVAEIDPFVKEVIWEFYANFHIFNEETKKSKVFVRGKMYEFSPQMINKTFRSPAIKWHAKAEFERVTMSKHALAKYLSDGKVVTWKDLRTPVMPTHLAGLYLICCINWIPSKNNSNVTVDRAKMLYLLNERIPFNFGKLVYDQVEKAARSPGQIQNILPFPNLIYRVLMFQRVITLENYEKPGPHPKLFNPDVRGGIEHPKRRGEYLFGTSLPGDLRHVSTLLTTIATRIEGMISSLLLSVCFPC

SEQ ID NO: 79376 - protein, 374 aa, Flavobacteria bacterium BBFL7
MSLFEVYPLFNVTPVRAQDVYVYDHNDVEYLDLYGGHAVISIGHSHPEYVNNISEQVSKLGFYSNAVQNLLQEALAHQLVDFSGCKDYQLFMCNSGAEANENALKLASFHNKKHKVIAFKNGFHGRTSAAVAATDNAKIIAPINAQQEVEIIELGDLVAVEKALDKNNVCAVIVECIQGVGGLDEDTTVFYQGLQSLCRQYNTSFIADEVQSGFGRTGDFFAFQKHGLEPDIISMAKGMGNGFPVGGILIHPKIKASYGLLGTTFGGNHLACTAVSTVLDVIEKEQLMDNAKAVSAHFLKRAQELPQVKNVKGRGLMLGLEFDFPIATLRKNLLFNHHIFTGSAKSPNVIRILPPLTIKESHIDLFFNALKAEL

SEQ ID NO: 79377 - protein, 405 aa, Helicobacter pylori 26695
MLIVQKYGGTSMGSIERIHNVAQRVLESVTLGHQVVVVVSAMSGETDRLLEFGKNFSHNPNKREMDRIVSVGELVSSAALSMALERYGHRAISLSGKEAGILTSSHFQNAVIQSIDTKRITELLEKNYIVVIAGFQGADIQGETTTLGRGGSDLSAVALAGALKAHLCEIYTDVDGVYTTDPRIEEKAQKIAQISYDEMLELASMGAKVLLNRSVELAKKLSVKLVTRNSFNHSEGTLIVAEKDFKGERMETPIVSGIALDKNQARVSMEGVEDRPGIAAEIFGALAEYRINVDMIVQTIGRDGKTDLDFTIVKTQIEETKQALKPFLAQMDSIDYDENIAKVSIVGVGMKSHSGVASIAFKALAKDNINIMMISTSEIKISVLIDIKYAELAVRTLHAVYQLDQ

SEQ ID NO: 79378 - protein, 306 aa, Salmonella typhimurium LT2
MTASLHIILDTDPGIDDAAAIAAALFAPQLDLQLITTVAGNVSVEKTTRNALQLLHFWNSDIPLAQGAATPLLRPLRDAAYVHGESGMEGYDFVDHQRQPLAKPAFIAIRDVLMNAPEPMTLVAIGPLTNIALLLMHYPECACNIRRLVLMGGSAGRGNFTPNAEFNIAVDPEAAALVFRSGLEIVMCGLDVTNQAMLSPDFLNKLPALNRTGKMLHSLFNHYRSGSMRTGVRMHDLCAIAWLVRPELFTLQSCFVAVETQGQYTAGTTVVDIEGRLGQPANAQVALALDVDGFRQWVAEVFAYAP

SEQ ID NO: 79379 - protein, 859 aa, Ustilago maydis 521
MFRRTLSAAPRAGVRLASTSSTSSSAGQRRTLTNRSVLVAVALAGGAVATYSLTKPSLYAEAPDTVPGDTRPHPLWSPPTRAQMLEALKQSSAKSLRPIASKGRSDNSSLLPLAKDATSSSPSPAASEQLGGTAASRSGDEDGEGFDILVVGGGATGAGVAVDAATRGLSVAMVERDDFGAGTSSKSTKLVHGGVRYLQKAVFELDYEQYKMVREALHERKTFLKIAPYLSDHLPIMLPVYKYWQIPYYWAGTKMYDILAGSENMESSYVLGKGKALEAFPMLKSAGLAGAVVYYDGQHNDTRMNVALAMTAVHHGAVVANHTEVVAIHKKPAAGKPDQICGARVRDVLTGDEWDVKCKCLINATGPFSDTLRKLDAPTSQEIVAASSGVHITLPGYFSPRDMGLIDPQTSDGRVIFFLPWQGNTIAGTTDTAAPVEAHPRPKEEEIQWILDEVRNYLSPDIKVRRGDVLSAWSGLRPLVKDPAATDTQSLVRNHMINVSESGLLTIAGGKWTTYREMAEQTVDRAIADFKLKPQRGCVTKNTRLLGSHGWTKTMYVKLLQRFGLETDVARHLSNTYGDRAWSVCSIAEPTGQRWPVHGKRIDQLYPYIEAEIRYACRSEYAATAQDFIARRTRLSFLNAEATVDALPRVIDVMAEELGWDEQRKKHEWAEGVEFMASMGLQPARVQQLKETSLDQMRKQRQSQQQAFKVSSLGAASLDDKDALAISGCASFNSEEMDELRAKFKLLDVNRDGKLDSKDLKQVLQRIGYSDVDDSTLRGIVNEVDFTKTGALHFEDFLDVFAALKDARLENAFTHILSEMDSQGLQPPSHDPVGPAAKEQSQRRDASRTIPVEKSGGGW

SEQ ID NO: 79380 - protein, 371 aa, Streptococcus mutans UA159
MALTAGIVGLPNVGKSTLFNAITKAGAEAANYPFATIDPNVGMVEVPDIRLQKLTELIVPKKTVPTTFEFTDIAGIVKGASKGEGLGNKFLANIREIDAIVHVVRAFNDENVMREQGRESDFVDPIADIETINLELILADLESINKRYARVEKIARTQKDKDSVAEFNILQKIKPVLEDGKSARTIDFTEDEAKIVKGLFLLTTKPVLYVANVDEDKVADPDSIDYVQQIREFAATENAEVVVISARAEEEISELDDEDRAEFLEAMGLNESGVDKLTRAAYHLLGLGTYFTAGEKEVRAWTFKRGIKAPQAAGIIHSDFEKGFIRAVTMSYDDLIKYGSEKAVKEAGRLREEGKDYIVQDGDIMEFRFNV

SEQ ID NO: 79381 - protein, 316 aa, Bacillus cereus ATCC 14579
MPKKVLIFCDPGIDDTMALLLAFFIDEIEIVGIVADYGNVPKKMAVENAHFFNNETKNRNIKIFGGSERPLTGAPPAFFTDVHGKQGLGPIIPKVNVTNGEMENFFEVIPLIEQYKDELIIVSLGRLTSLAILFIMCKQLMKQIKSYYVMGGAFLHPGNVTPISEANFYGDPTAANIVLQSTANMYIYPLNVTQYSIITPEMAEYIEAKGKAPLVKTLFDHYYYGYYKDALPHLKGSPFHDTIPILALLDNSMFTYHKSPIVVMTESYAQGASIGEFRSLGESKPFIDWPSHQIAIDFDYNRFFKHFMSLMTGEQF

SEQ ID NO: 79382 - protein, 431 aa, Bacillus cereus ATCC 14579
MSTIIDVYAREVLDSRGNPTVEVEVYTESGAFGRAIVPSGASTGEHEAVELRDGDKSRYLGKGVVNAVNNVNEIIAPEIAGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEVAVYDGVKSFYNIKR

SEQ ID NO: 79383 - protein, 469 aa, Oryza sativa Indica Group
MSSNLAASRRSSSSSSVAAAAAKRPAVGEGGGGGGKAAAGAAAAKKRVALSNISNVAAAAGGGGGGGPPGKAGNAKLNLAASAAPVKKGSLASVRNVGTNRASAVKSASTKPAPAISRHESAAQKESVLPPKVPSIVPTAALAPVTVPCSSFVSPMHSGDSVSVDETMSTCDSMKSPEFEYIDNGDSSSVLGSLQRRANENLRISEDRDVEETKWKKDAPSPMEIDQICDVDNNYEDPQLCATLASDIYMHLREAETRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDEDPALHLEFLANYVAELSLLEYNLLSYPPSLVAASAIFLAKFILQPAKHPWNSTLAHYTQYKSSELSDCVKALHRLFCVGPGSNLPAIREKYTQHKIYAADVIDLNMMIQRDS

SEQ ID NO: 79384 - protein, 256 aa, Glycine max
MEHLEQWKQQFLRWWRVAVHTVPPIQLYAVAAVLILTTVLLLSIRFLKRAKSNTIVLTGLSGAGKTVLFYQLRDGSIHEGTVTSMEPNEDTFLLHSETVPKRKVKPVCVVDVPGHSRLRPKLDEYLPKAAAIVFVVDAVDFLPNCRAASEYLYDILTKGSVVRKKIPLLILCNKTDKVTAHSKEFIGKQMGKEIDKLRESRSAISPADIANEFNLGVPGEPFSFTQCPNKVRLQDASGLTGEISQLEQFIREYVKP

SEQ ID NO: 79385 - protein, 509 aa, Bacillus cereus ATCC 14579
MRKPTALIILDGFGLREETYGNAVAQAKKPNFDGYWNKFPHTTLTACGEAVGLPEGQMGNSEVGHLNIGAGRIVYQSLTRVNVAIREGEFDKNETFQSAIKSVKEKGTALHLFGLLSDGGVHSHMNHMFALLRLAAKEGVEKVYIHAFLDGRDVGPKTAQSYIDATNEVIKETGVGQFATISGRYYSMDRDKRWDRVEKCYRAMVNGEGPTYKSAEECVEDSYANGIYDEFVLPSVIVNEDNTPVATINDDDAVIFYNFRPDRAIQIARVFTNEDFREFDRGEKVPHIPEFVCMTHFSETVDGYVAFKPMNLDNTLGEVVAQAGLKQLRIAETEKYPHVTFFFSGGREAEFPGEERILINSPKVATYDLKPEMSIYEVTDALVNEIENDKHDVIILNFANCDMVGHSGMMEPTIKAVEATDECLGKVVEAILAKDGVALITADHGNADEELTSEGEPMTAHTTNPVPFIVTKNDVELREDGILGDIAPTMLTLLGVEQPKEMTGKTIIK

SEQ ID NO: 79386 - protein, 328 aa, Bacillus cereus ATCC 14579
MDLDVSGRNVFRAALNNSEVEVVAINDLTDAKTLAHLLKYDTVHGTLNAEVSANENSIVVNGKEIKVIAERDPAQLPWSDYGVEVVVESTGRFTKKSDAEKHLGGSVKKVIISAPASDEDITVVMGVNHEQYDAANHNVVSNASCTTNCLAPFAKVLNEKFGVKRGMMTTIHSYTNDQQILDLPHKDLRRARAAAENMIPTSTGAAKAVALVLPELKGKLNGGAVRVPTANVSLVDLVVELDKEVTVEEVNAAFKAAAEGELKGILGYSEEPLVSIDYNGCTASSTIDALSTMVMEGNMVKVLSWYDNETGYSNRVVDLAAYMTSKGL

SEQ ID NO: 79387 - protein, 605 aa, Neurospora crassa
MRFLPLLGGLLPLLGLVGAAPSCNHECNRACWTSRFNVNTDYENEWPVTGVTRKVSTCSHGTPQFDFEITEVDEWVGPDGHIKKGAMLINGGYPGPLIKADWGDRIEVTVTNKLKTNGTSMHWHGFHQLNSNNQDGVAGVTECLIVPGASKVYSFLATQHGTSWYHSHISSQYANGIVGPIQINGPSSYPYDTDLGVFPISDWYYDSAEHIVDRMMDPNDPFLKGVPGSPPPSNNILFNGMNIAPNGTGGEYARLKFTKNKRHRLRLVNTSADNTFVVSIVGHNMTVIETDFVPVEPYAVHQLYLTVGQRYDVVIKADQEVDNYWINATLSSTPLCGVSLNPYPAAIVSYEGSDESRLPTNRGPRAIDQFCEDDVSSKPLTSRTAPKADFSDTKVDTLSVTLDVKEVNKGISKVLWSVDGSAIDVQWDKPTLEYVVEGNFTFPRQANIIQLPEAVKWSFWVIQNNSPSPHPMHLHGHDFLILGRSRFPANPLVDPGQPILFDPVVDGPHLKFDNPTRRDTTVVPSFGWLVIAFEAGRNPGSWVFHCHIPWHMSQGLSVQFLERVDRINDGAIPNLMPDLQEKCDEWRRYADNDPEFRMKKVDSGI

SEQ ID NO: 79388 - protein, 217 aa, Cytophaga hutchinsonii ATCC 33406
MANVLIAPSVLSADFANLERDVKMINSSKADWFHIDIMDGVFVPNISFGFPVMQAINKHAAKPLDVHLMIVNPEKYIQTFKDSGAANISVHYEACTHLHRTIYQIKDVGCKAGIAINPHTPIHLLKDVIKDIDLVCMMSVNPGFGGQKFIEHTYQKVRDLKQLIQENNANVLIEIDGGVNEVTGPKLVQAGADVLVAGNYVFSAKDPVATIEQLKNI

SEQ ID NO: 79389 - protein, 402 aa, Streptococcus pyogenes M1 GAS
MKIAVAGSGYVGLSLGVLLSLQNEVTIVDILPSKVDKINNGLSPIQDEYIEYYLKSKQLSIKATLDSKAAYKEAELVIIATPTNYNSRINYFDTQHVETVIKEVLSVNSHATLIIKSTIPIGFITEMRQKFQTDRIIFSPEFLRESKALYDNLYPSRIIVSCEENDSPKVKADAEKFALLLKSAAKKNNVPVLIMGASEAEAVKLFANTYLALRVAYFNELDTYAESRKLNSHMIIQGISYDDRIGMHYNNPSFGYGGYCLPKDTKQLLANYNNIPQTLIEAIVSSNNVRKSYIAKQIINVLEERESPVKVVGVYRLIMKSNSDNFRESAIKDVIDILKSKDIKIIIYEPMLNKLESEDQSVLVNDLENFKKQANIIVTNRYDNELQDVKNKVYSRDIFNRD

SEQ ID NO: 79390 - protein, 503 aa, Acinetobacter sp. M-1
MHYVDPNQSGSKIHFKDQYENFIGGQWVAPVKGVYFDNISPVDGKSFTRIPRSSAEDIELALDAAHKAKKEWNKSSPTTRSNLLLKIADRMEANLEMLAVAETWDNGKPVRETLAADIPLAIDHFRYFAGCIRAQEGGISEIDEDTIAYHFHEPLGVVGQIIPWNFPILMAAWKLAPALAAGNCVVIKPAEQTPVGILLVAELIQDLLPAGVLNIVNGYGAEVGRPLATSPRIAKIAFTGSTQVGQLIMQYATENIIPVTLELGGKSPNVFFADVMDHDDDFLDKTLEGFAMFALNQGEVCTCPSRALIQESIADQFMEKAIERVKRIKLGHPLDTDTMVGAQASLEQQEKILRCIDTGRQEGAEVLLGGHGRQEVGNGYYIEPTIFKGHNNMQVFQEEIFGPVLSVTTFKDFDEAIQIANDTMYGLGAGVWSRSTHTAYRAGRAIEAGRVWTNCYHIYPAHAAFGGYKKSGVGRENHKMMLDHYQQTKNLLVSYSTKAMGFF

SEQ ID NO: 79391 - protein, 398 aa, Prochlorococcus marinus subsp. marinus str. CCMP1375
MTPERLGLLWGVTVFAGAGARLLSVITGFPGVVLLLLSGLLIGRSGLGLVEPLDLGQGLEIIVGLLVSLVLFDGGLNLRLPGDTIKTTVFRILVIRLFISFAAVWIAAHLLAGLAWNVSAVYSAIVLATGPTVVTPLVQQIRLAAPLGDVLEAEGLVLEPVGAVLALLLLELLVGDLHGWKELVFGLLARLGGGVAIGSFAGWILSEGLKRIKADSAIGIRLQITLGVLFLLYGICEWILPESGLPASVAAGFIVGRSPSIEVDKLDELIRELAQLAITMLFPLLAADVSWSELSPLGWGGVSCVLVLMLVVRPMAVSLATIGLPLDFKQRLFLGWLAPRGIVTAAVASLFAIRLEQAGVLGAGRLQGLVFLTILMTVGIQGLTAKPLAKKLGLLAED

SEQ ID NO: 79392 - protein, 152 aa, Carboxydothermus hydrogenoformans Z-2901
MQVFEGKLNGKGLKIGIIVSRFNEFITQKLLAGALDCLTRHEVENTNIDVIWVPGAFEIPLVAKRAVHKDYDAIICLGAVIRGATPHFDYVAAEVAKGIAAVGLEANKPVIFGVLTTDTIEQAIERAGTKAGNKGWEAALAAIEMANLFKKV

SEQ ID NO: 79393 - protein, 311 aa, Ashbya gossypii ATCC 10895
MSAIFGNSTVAAMVGQGQGLNYWQVLANVKTVQPQLNVLEQFWAAWYSYMENDVLATGLLFFVLHEFMYFARSLPWFIIDQMSWFRKYKIQPTKTPSAKEQWHCLKSVLLSHFLVEAIPIWTFHPLCQKLGISVEVPFPTWKTVATEIALFFVLEDTWHYWAHRVFHYGVFYKYIHKQHHRYAAPFGLCAEYAHPVETMLLGFGTVGMPVLYVLYTGKLHLFTLCLWITLRLFQAVDSHSGYDFPWSLNKFLPFWAGAEHHDLHHHYFIGNYASSFRWWDYTLDTEAGLEAKTTREERMKKRAELRGKKLN

SEQ ID NO: 79394 - protein, 304 aa, Streptococcus pyogenes M1 GAS
MTKVRKAIIPAAGLGTRFLPATKALAKEMLPIVDKPTIQFIVEEALKSGIEEILVVTGKAKRSIEDHFDSNFELEYNLQAKGKNELLKLVDETTAINLHFIRQSHPRGLGDAVLQAKAFVGNEPFVVMLGDDLMDITNASAKPLTKQLMEDYDKTHASTIAVMKVPHEDVSSYGVIAPQGKAVKGLYSVDTFVEKPQPEDAPSDLAIIGRYLLTPEIFGILERQTPGAGNEVQLTDAIDTLNKTQRVFAREFKGNRYDVGDKFGFMKTSIDYALEHPQVKEDLKNYIIKLGKALEKSKVPTHSK

SEQ ID NO: 79395 - protein, 348 aa, Staphylococcus aureus subsp. aureus Mu50
MTYNIVALPGDGIGPEILNGSLSLLEIISNKYNFNYQIEHHEFGGASIDTFGEPLTEKTLNACKRADAILLGAIGGPKWTDPNNRPEQGLLKLRKSLNLFANIRPTTVVKGASSLSPLKEERVEGTDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDAADELEQHIYNMIEHGQTTADLGGKLNTTDIFEILSQKLNH

SEQ ID NO: 79396 - protein, 167 aa, Vibrio parahaemolyticus RIMD 2210633
MAKEQQVQANDLQEKLIAVNRVSKTVKGGRIMSFTALTVVGDGNGRVGFGYGKAREVPAAIQKAMEKARRNMTTIALNEGTLHHPVKGRHSGSKVYMQPAAEGTGVIAGGAMRAVLEVAGVHNVLSKAYGSTNPINIVRATIDALGSMKSPEMVAAKRGLTVEAISE

SEQ ID NO: 79397 - protein, 278 aa, Prochlorococcus marinus subsp. marinus str. CCMP1375
MNKLFADLLASSSGSKNNQGPRIQKRRGVEIKSAREVQIMRKSSHIVATVLSEINKIVEPGMTTGGLDEYAERRIREMGAVPSFKGYHGFPASICASINNEVVHGIPDLKRVIKAGDLLKVDTGAFFDGYHGDSCITICVGDVSEEASKLSRVANEALMAGLSQIRANNTLLDIAGAIEDHVTKNNFSVVEDYTGHGVGRNLHEEPSVFNFRTNDLPNIRLREGMTLAVEPILNAGSKGCRTLQDQWTVVTKDGSLSAQWEHTILVTKKGFEILTDRS

SEQ ID NO: 79398 - protein, 442 aa, Xanthomonas axonopodis pv. citri str. 306
MLAEMPLLETALERELATLAFGRRYGKVVELVGTMLKVAGVQVSLGEVCELRQRDGTLLQRAEVVGFSRDLALLAPFGELVGLSRETRVIGLGRPLAVPVGPALLGRVLDGLGEPSDGQGAIACDTWVPIQAQAPDPMRRRLIEQPMPTGVRIVDGLMTLGEGQRMGIFAAAGVGKSTLMGMFARGTQCDVNVIVLIGERGREVREFIELILGADGLARSVVVCATSDRSSIERAKAAYVGTAIAEYFRDRGLRVLLMMDSLTRFARAQREIGLAAGEPPTRRGFPPSVFAELPRLLERAGMGESGSITAFYTVLAEDDTGSDPIAEEVRGILDGHLILSREIAAKNQYPAIDVLASLSRVMSQIVPSDHSQAAGRLRRLLAKYNEVETLVQVGEYRQGSDAVADEAIDRIDAIRDFLSQPTDRLSAYESTLEQLASVTDDA

SEQ ID NO: 79399 - protein, 420 aa, Rubrobacter xylanophilus DSM 9941
MGDPNIRRREFPGGLRVFTEPLEEATSVSLGVWIRAGSRDERDEVAGITHLMEHMLFKGTPRMDALGIAQAFESIGAQENAATGEEYTVLYARFLPEHLERALDIMSDMVLHPTLADLEREREVIVEEIRMYEDRPDQMADEHLSSLIFHGDPLGRPIIGYVDTVRGVDHERLRRFHAATYTAPNVFVVGAGRLEPERFEALVEERLGGLPGGEPFARAVRPKAPESRFLFKPKETEQYHVSLGSRGLPAGSEDRFAMAALNNVLGGGMSSRLFQEVREKRGLAYAVYSYHQGYSDAGALKVYVGSTTNNVEEAVRVIAEQLERLREEPVSEEELERTKQQLKSSTLLALESTAARMNRIGRGVVTGTELLAPEEMARRIEAVSAEDILRLAREHLDLKNMYLSAIGPREIDLGRYLEGA

SEQ ID NO: 79400 - protein, 375 aa, Vitis vinifera
MADNTRNSTGGQLSDFPAVPTHGGLFFQHNIFGNLFEITAKYRPPIMPIGRGAYGIVCSVLNSETNEMVAIKKIANAFDNHMDAKRTLREIKLLRHLDHENVIGIRDVVPPPLRREFSDVYIATELMDTDLHQIIRSNQGLSEEHCQYFLYQILRGLKYIHSANVIHRDLKPSNLLLNANCDLKICDFGLARPTAENEFMTEYVVTRWYRAPELLLNSSDYTAAIDVWSVGCIFMELMNRRPLFAGKDHVHQMRLLTELLGTPTESDLGFVRNDDARRYIMQLPQHPRQPLVNVFPHIHPLAIDLIDRMLTFDPTKRITVEEALAHPYLSRLHDTADEPVCPEPFSFEFEQQALVEEQMKDMIYQEALFFNPGYA

SEQ ID NO: 79401 - protein, 310 aa, Thermoplasma acidophilum DSM 1728
MSTSSYIDQIKNEISEKVKGRAIIAVSGGQDSSLLSVLASQVLGDRLLCVFVDTGLIRIGEVDRVRKFFEEHAMNYRIVDASKRFLEALKGITDPEEKRKIIGKMFIDVLNEEAENFHAEYLLQGTIAPDWIESGGQKRDTIKSHHNVGGLPKEMKLKLVEPLRDFYKDEIRAMSRELGLRTDLQPFPGPGLAVRIVGEITPEKLDLLRRATRIVEDKIESALKPEERPWQYFAVLLPVKTTGVHGDRRAYGYTVAVRMIDSIDAMTGTFTKPSWDLLEDIANTITDEIPDINRVVYDITNKPPATIEWE

SEQ ID NO: 79402 - protein, 265 aa, Magnetospirillum magnetotacticum MS-1
MIQSAATSRRITVQALLLGERLETKRLEEGVVLATAPLIIRAGREGYAVLFRYGVAVLFGLDPMEEAVFLASLGKLVADPLPVQGRDTAEVLIEPGCEDRVDQSGTVFLADPSPQHLQLIAEVLARDLVLSHYEKRIAKVFDSIEPLAVSLSKGSLRKLKTKQLLSQIGEVLLAEHRMVGRVELLESPEVLWIRPELERLFIRLEREYDLSGRNRALDRKLEVISDTAETLLDLIQTRSSMKVEWYIVGLILFEILISIYEMVSG

SEQ ID NO: 79403 - protein, 202 aa, Oryza sativa Japonica Group
MEVEASYSYGFLPSGRHQPYAPPPPHPAEEGELWEYFPCPFCYIEVEVPFICNHLQEEHCFDTRNAVCPLCADNIGRDMGAHFRVQHSHLLKRRKPSRPSSSWPTPSNNSDPYFEGPPQYMMNNRTYQDPAPDPLLSQFICSMAQTDTNSDNTNTEIAVSAVSHDQRLSQRVTLTDDASKLELKERLQRIEFVKEIIMSTIL

SEQ ID NO: 79404 - protein, 265 aa, Triticum aestivum
  misc_feature (128)..(128): Xaa can be any naturally occurring amino acid
MLPTRFPSRGAVNAAGLETLLPAASRAVLSEFIATAVFVFAAEGSVYGLWKMYKDTGTLGGLLVVAVAHALALAAAVALASGASGGHVNPAVTFGVLVGRRISFARAVLYWAAQLLGAVLAAALLRIXSGGVRPMGFTLGHGIHERHALLLEVVMTFGLMYTVYATAVDRNRGGNVGAIAPIAIGFVLGANILAGGPFDGAAMNPARAFGPALVGWTWRHHWVYWVGPLIGAGLAGALYEFVMAEQPEEPAAAARRELPVPAQDY

SEQ ID NO: 79405 - protein, 375 aa, Helicobacter pylori 26695
MVSLYLENGLFLQAQSFGASGTQAGELVFNTSMSGYQEVISDPSYKGQFVVFSMPEIGVVGANSKDDESFFSCAGVLARHYNEFFSNSRADFSLSAYLKERGVLGVCGVDTRSLIKTLRHHGCLMMVASTIEHDKNKLEEILKNAPKISHSPLVSSVSTPKITTHQRATFDFKTLDYKPFDEKTSHKIIAVLDFGAKGNILNELQNVGLKALIYPHHTKASELIKAYEKKEISGIFLSNGPGDPLSLQQEIGEIKQLINAKIPMLGICLGHQLLSIAQGYPTYKLKFGHHGSNHPVKNLKTNAVEITAQNHNYCVPEDIEEIAIITHRNLFDNTIEGVRYKNAPIISVQHHPESSPGPKESHYIFKEFVELLKDF

SEQ ID NO: 79406 - protein, 200 aa, Listeria ivanovii
TSNPVNQNLMELLIMIDALKRASAATINIVMPYYGYARQDRKARSREPITAKLVANLIETAGATRMITLDMHAPQIQGFFDIPIDHLNAVRLLSNYFGERHLGDDLVVVSPDHGGVTRARKMADRLKAPIAIIDKRRPRPNVAEVMNIVGNVEGKVCIIIDDIIDTAGTITLAAKALREAGATKVYACCSHPVLSGPAMK

SEQ ID NO: 79407 - protein, 471 aa, Streptococcus mutans UA159
MMTIFRKKNTNLDKTEMKRHFKVIDLIFLGLGSMVGTGIFTITGIGAAKYAGPALIISIIVSAIAVGISALFYAEFTSRIPANGGAYSYLYATLGEFPAWLAGWYIIMEFLTAISSVASGWGSYFKGLLSSYGIELPSLLNGTFNPAKNNYIDLLPALVIFLVTGIVLLNSKIALRFNSSLVVMKFSALALFIIIGLFYIKPENWSNFAPFGFGKIYGGQTGIMAGASLMFFAFLGFESISMAVDEVQKPQKNIPKGIIASLTIVTILYVSVTLVLTGIVHYSKLNVADAVAFALRQAGLVWAANYISVVAILTLITVCISMTFALARTVYSISRDGLLPKQLGIVTKHSKVPKNATLLVGFASMICAGVFPLSSIAEFLNICTLAYLIMLAIAIIKLRKDQGQPKIGEFKTPFIPFLPIVSIVICLSLMSQYKSVTWIAFGISTSIGFLIYFAYGYRHSTIFIKNNPKIR

SEQ ID NO: 79408 - protein, 168 aa, Listeria seeligeri
TSNPVNQNLMELLIMIDALKRASAATINIVMPYYGYARQDRKARSREPITAKLVANLIETAGATRMITLDMHAPQIQGFFDIPIDHLNAVRLLSDYFGERHLGDDLVVVSPDHGGVTRARKMADRLKAPIAIIDKRRPRPNVAEVMNIVGNVEGKVCIIIDDIIDTAG

SEQ ID NO: 79409 - protein, 273 aa, Vibrio campbellii AND4
MKHCEKQKVWDKIVSEARELSEQEPMLASFYHATIIKHDSLCAALSYILANKLNTASMPAMAVREVVEEAFAADPTITECAACDICATVNRDPAVLMFSMPLLYLKGYHALQGYRVANWLWKQGRHALATYLQNQISVACQVDIHPAACIGSGIMLDHATGIVIGETAVVENDVSILQDVTLGGTGKESGDRHPKIREGVMIGAGAKILGNIEVGQGAKIGSCSVVLQAVPPHTTVAGVPAKIVGRPKTDKPSLDMDQGFNGKSQSFIHGDGI

SEQ ID NO: 79410 - protein, 120 aa, Listeria welshimeri
KRRPRPNVAEVMNIVGNVEGKVCIIIDDIIDTAGTITLAAKALREAGATKVYACCSHPVLSGPAMKRIEDSPTEKLIVTNSIALPEEKWIDKMEQLSVAPLLGEAIVRVHENASVSSLFE

SEQ ID NO: 79411 - protein, 351 aa, Vibrio campbellii AND4
MTQANTNNAHVIDSAYGKDVAMTVIGAGSYGTSLAISLARNGANVILWGHDPEHMARLEADRANHAFLPDIDFPESLIIESDLEKAVQASRDLLVVVPSHVFGIVLSSCKPFLREDSRICWATKGLEPETGRLLKEVAFDIIGDSYSLAVLSGPTFAKELAMGMPTAISVASPDDIFVADLQEKIHCSKTFRVYANNDFIGMQLGGAVKNVIAIGAGMSDGIGFGANARTALITRGLAEMSRLGAALGAQPETFMGMAGLGDLVLTCTDNQSRNRRFGLALGQGKDVDTAQEEIGQVVEGYRNTKEVWILSQRMGVEMPIVDQIYQVLYQGKDAHQAAQDLLARDKKAEGK

SEQ ID NO: 79412 - protein, 193 aa, Escherichia coli
GIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQEYRD

SEQ ID NO: 79413 - protein, 124 aa, Zea mays
  misc_feature (81)..(81): Xaa can be any naturally occurring amino acid
MENGGGGGGDGGKSDVPADANEHCPGTQSEEAGKADACAGCPNQQICATAPKGPDPDLVGIVERMATVKHKILVLSGKGGXGKSTFSAQLSFALAEMDCQVGLLDIDICGPSIPKMLGLEGQDI

SEQ ID NO: 79414 - protein, 382 aa, Salmonella typhimurium LT2
MIKSALLVLEDGTQFHGRAIGATGSAVGEVVFNTSMTGYQEILTDPSYSRQIVTLTYPHIGNVGTNKADEESSQVHAQGLVIRDLPLIASNFRNTEDLSSYLKRHNIVAIADIDTRKLTRLLREKGAQNGCIIAGDSPDAKLALEKAKAFPGLNGMDLAKEVTTAETYRWTQGSWTLKDGLPEAKSEDDLPFHVVAYDFGAKRNILRMLVDRGCRLTVVPAQTSAEEVLKMNPDGIFLSNGPGDPAPCDYAITAIQKFLETDIPLFGICLGHQLLALASGAKTVKMKFGHHGGNHPVKDMDRNVVMITAQNHGFAVDEDSLPANLRVTHKSLFDGTLQGIHRTDKPAFSFQGHPEASPGPHDAAPLFDHFIELIEQYRQSAK

SEQ ID NO: 79415 - protein, 384 aa, Vibrio vulnificus YJ016
MSISVLALKLTGNIAMPISTPQEIIEDIRLGKMVILMDDEDRENEGDLIMAAEHITPEAINFMAKYGRGLICLTMTKERCQRLGLPPMVQDNNAQYTTNFTVSIEAAEGVTTGISAADRARTVQAAVAKEAKAADLVQPGHIFPLAAQDGGVLTRAGHTEAGCDLARLAGFEPASVIVEILNDDGTMARRPDLEVFAEQHGLKLGTIADLIEYRNNTETTIERVAECKLPTEFGEFDLVTYRDTIDNQIHFALRKGTVGDQTPLVRVHLQDTFTDLLRSDRNAERSWTLDKAMKRIGQEGGVLVILGNEESPELLIHRVKMFEAQDKEEAPKLAKKQGTSRRVGVGSQILADLGVHDMRLLSSSNKKYHALGGFGLNVIEYVCE

SEQ ID NO: 79416 - protein, 510 aa, Vibrio campbellii AND4
MSAKKPLALVILDGYGYREDTASNAIANAKTPVIDALIANNPNTLISASGMDVGLPDGQMGNSEVGHTNIGAGRVVYQDLTRITKSIADGEFADTAALAEAIDSAVKAEKAVHIMGLMSPGGVHSHEDHIYAAVEMAAARGAEKIYLHCFLDGRDTPPRSAENSLQRFQDLFTKLGKGRVASLVGRYYAMDRDNNWDRVQVAYDLLTQAKAEFTAETAVAGLEAAYAREENDEFVKATAIKAEDQEDAIMQDGDAVIFMNYRADRARQITRAFVPAFDGFERTVFPTINFVMLTQYAADIPLVAAFPPASLENTYGEWLSKQGQTQLRISETEKYAHVTFFFNGGVENEFEGEERQLVASPKVATYDMQPEMSSPELTEKMVTAIKSGKFDTIICNYPNADMVGHTGVYEAAEKAIEALDESVGKVVEAIKEVGGQLLITADHGNAEMMIDPTTGGVHTAHTSLPVPLIYVGDKAVEFKEGGKLSDLAPTMLSLAGLDIPAEMSGEVLVK

SEQ ID NO: 79417 - protein, 504 aa, Oryza sativa
LPRHPRLLKASPRVAPRRTTPPSPSPPRPTPPPRDLAMAALLHLQSSATAAAAPSFLLLRRRGGGVTAPAGSSRRRRACFRVEAKIREIFMPALSSTMTEGKIVSWTASEGDRLAKGDPVVVVESDKADMDVETFHDGFLAAVLVPAGESAPVGSAIALFAESEDEIPAAQSKAASLSSSSSSSPPPPPPQESTPPPPPPPPPAPVAAAVSAPAPPSPASQGGLRVVASPYARKLAKDLNVDLNSITGSGPGGRIVAKDVEAAAAAPKKAAPVAAARPDVPLGSTVPFTTMQGAVSKNMVESLAVPTFRVGYTFTTDALDALYKKIKPKGVTMSALLAKATAMALVQHPVINSSCRDGKSFTYNSSINIAVAVAIDGGLITPVLPDADKLDIYSLSRKWKELVDKARAKQLQPHEYNSGTFTISNLGMFGVDRFDAILPPGTGAIMAVGSSQPTLVGTKDGSIGIKNQMQVNVTADHRVIYGADLAAFLQTLSKIIEDPKDLTF

SEQ ID NO: 79418 - protein, 198 aa, Salmonella typhimurium LT2
MSYYAFEGLIPVVHPDAFVHPSAVLIGDVIVGAGVYIGPLASLRGDYGRLILEAGSNLQDGCIMHGYCDTDTIVHENGHIGHGAILHGCVVGRDALVGMNSVIMDGAVIGEESIVAAMSFVKAGFQGEARQLLVGSPARVLRQVTDQELHWKHLNTKEYQDLAIRCRTGLSETKPLTQAEENRPRLKGTTDVKPKSAQ

SEQ ID NO: 79419 - protein, 267 aa, Zea mays
PLSRQRPRPSRPRRGSNPPQFRAMATATSSRRVSVPALAAAAVLLLASVAAADDHNGVYDPCADASVQRGDGFTFGVVFSGRDSFSSGGVQLSPCDSRLGLANRAQVALFRPQVDEISLLTVNSSSFDPSSSGVYMVAFAGKKYAARSPPVFVGNISYTVTGFTLVLEFQKGTLQNLFWKAGGCSSCSGRSDFACVDGSCAVRTASCRGKGGQVECSPGIQLAFSGTDRHEAVLNSWYEVSKLRQYSLFGLFSNLKDSLTNQFSSFF

SEQ ID NO: 79420 - protein, 193 aa, Bacillus cereus ATCC 14579
MNLIPTVIEQTNRGERAYDIYSRLLKDRIIMLGSAIDDNVANSIVSQLLFLESQDPEKDIHIYINSPGGSITAGMAIYDTMQFIKPQVSTICIGMAASMGAFLLAAGEKGKRYALPNSEVMIHQPLGGAQGQATEIEIAAKRILFLREKLNQILADRTGQPLEVLQRDTDRDNFMTAEKALEYGLIDKIFTNR

SEQ ID NO: 79421 - protein, 583 aa, Ustilago maydis 521
MSRPFDAENVEHRDTSHDSHDHTDQLADKQIGVVAAEAGRTVADWTLWMGILGIALVAYLYGLDNNTMWAWQTYATTSFNDYPAYTAVSVVQAVIIAVGKFPIAKLADVFGRAQAYALSVFLWVLGFVIIAIAQNTRYVAGGTVIYAFGNTGVQIMQQIVLADYISTKWRGAAIGLVSLPYVINFWASAQIYPKIVAVNWRWGPGFFSICAPVAAFSIIFALAINQRRARAMGLVPSRPYKHMSFLAAVYNFLIDIDALGLFLICVGFLLILLPVNLAKLQPNGWSTGWIIAMLVIGGVMLISFCVWECVAPKPILNRRWRLNHDVHFATAIGFFDFFSFYASWVPAYYWSLIVMGYDNTGATYFSNCQSLALTVFGIAAGFLSLGTKNYKWIMISGACIRLLGIGLMIKYRSSGSSNVQAVFPQVLQGMGGGFLGITLQVAAQVSVRHQDVATVTAYFLLLTEMGGACGNALVGAVQTNVLPGYYEKYLPMLNATQRAAIYASPFTAVSQYPIGTPERTGMINAYNDYMHILLIVAIVLAVPPIILGLVVNDRKLNDNQNCVSNELAGMRRMSSENESTDNK

SEQ ID NO: 79422 - protein, 182 aa, Brassica napus
  misc_feature (40)..(40): Xaa can be any naturally occurring amino acid
MAYSMLSSAAVVTSPAQATMVAPFTGLKSSSAFPVTRKAXNNDITSIVSNGGRVNSMQVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 79423 - protein, 269 aa, Rhizopus oryzae
SDGGKVVAATTAQIQEFTKYAGIAATAYCRSVVPGNKWDCVQCQKWVPDGKIITTFTSLLSDTNGYVLRSDKQKTIYLVFRGTNSFRSAITDIVFNFSDYKPVKGAKVHAGFLSSYEQVVNDYFPVVQEQLTANPTYKVIVTGHSLGGAQALLAGMDLYQREPRLSPKNLSIFTVGGPRVGNPTFAYYVESTGIPFQRTAHKRDIVPHVPPQSFGFLHPGVESWIKSGTSNVQICTSEIETKDCSNSIVPFTSILDHLSYFDINEGSCL

SEQ ID NO: 79424 - protein, 189 aa, Colwellia psychrerythraea 34H
MNQSIINTKLLPFNATAFHNGEFVELSEKDLADKWSVVFFYPADFTFVCPTELGDMADHYDELQKMGVEVYSVSTDTHFTHKAWHDTSDTINKIKYPMIGDPTGAITRNFGVMIEEAGLALRGTFVINPEGEVKIAEVHDLGIGRSAAELLRKVKAAQYVAEHDGEVCPAAWQPGAETLAPSLDLVGKI

SEQ ID NO: 79425 - protein, 422 aa, Staphylococcus aureus subsp. aureus Mu50
MTVKTTVSTKDIDEAFLRLKDIVKETPLQLDHYLSQKYDCKVYLKREDLQWVRSFKLRGAYNAISVLSDEAKSKGITCASAGNHAQGVAYTAKKLNLNAVIFMPVTTPLQKVNQVKFFGNSNVEVVLTGDTFDHCLAEALTYTSEHQMNFIDPFNNVHTISGQGTLAKEMLEQSKTDNVNFDYLFAAIGGGGLISGISTYFKTYSPTTKIIGVEPSGASSMYESVVVNNQVVTLPNIDKFVDGASVARVGDITFEIAKENVDDYVQVDEGAVCSTILDMYSKQAIVAEPAGALSVSALENYKDHIMGKTVVCVISGGNNDINRMKEIEERSLLYEEMKHYFILNFPQRPGALREFVNDVLGPQDDITKFEYLKKSSQNTGTVIIGIQLKDHDDLIQLKQRVNHFDPSNIYINENKMLYSLLI

SEQ ID NO: 79426 - protein, 577 aa, Leptospira interrogans serovar Lai str. 56601
MKQITIRIFLILLLFSCRENSLLIEGKKISTDLLVVPSHQKTHTDYFSESKNLMISSDSPEATQAGIEVGALGGNVVDVVVATSFAISVTRPHSTGLGGGGFLILYLKEFPEPIAFDFRERAPNMSSRDMYKLKPKEDSLLGFRAVGVPGNVAGLVQIQRRFGKLPLKTVISPSIRLAENGFPVYPDLQSAIQKSSKDMSEEMKNIFLPKGKIPELNSILVQKDLANSLRLISETGDKEFYHGKIANSIVNAMKKNDGLITLQDLSGYKVVEKKTIHTTYHDYTIYTMPPPSSGVHLLTMLSMVETKPLKETYEKDPVLYYHFIVEAMRRGYADRAMLGGDPAFTKIPIERLVSKKYAEEKISDFNSKTASSSSSFLKTLNFGVESPQTTHISVMDREGNSVSTTQSINFRFGASVVAPGTGIVLNDTMDDFSRAPGEPNVYGLIGAEANSILPKKTPLSSMSPTIVFKNKEPFLVTGAPGGSYIVNAVLQSLIYNLDFNLTLYESVARGRIHHQFFPDAVFIEKSVNERNVFDGLSSKKHDLRIAPNFAKLFSVKRENGMLYGACDPRGEGATGGL

SEQ ID NO: 79427 - protein, 403 aa, Zea mays
MVCCRVVHFIYYSIGSSPFIVGTDDDLPPAQNRGLRGRSFSGNVVASAGAFPYMRANNDLESEIHRVEQDAYTGILRAFKVQSDAISWEKESLITELRKELRVSDEEHRELLNKVNEDGTIRRMRELRQAGGSPSGLHHGNMVLYGAEPGSTTKRQRASHSIPLQSAGLQSPMMPSHSVSSAKWGPLQARGTKARTPIPLALPSVDPSSLINHKVYTRWPEDNNFYEATITRYNPVTGEHGLVYDMGTQAESWESVRLCDMAPEDIRWGFDGHLSNRDVWSPSGPMLMRHMTNNGAMAGSIKGRGRLSINETIKDYAPPENGTNRNFDHVDIPNTGSVVMEVKRVLFNPNMPEIEKARKLLKDQEQSLLDAIARLDEASDSDNEDMAMEGRMGSAGERNGITT

SEQ ID NO: 79428 - protein, 539 aa, Streptococcus pyogenes M1 GAS
MLTVSDVSLRFSDRKLFDDVNIKFTAGNTYGLIGANGAGKSTFLKILAGDIEPSTGHISLGPDERLSVLRQNHFDYEEERAIDVVIMGNEQLYNIMKEKDAIYMKADFSEEDGVRAAELEGIFAELGGWEAESEASQLLQNLNIPEDLHYQNMSELANGDKVKVLLAKALFGKPDVLLLDEPTNGLDIQSISWLEDFLIDFENTVIVVSHDRHFLNKVCTHMADLDFGKIKLFVGNYDFWKQSSELAARLQADRNAKAEEKIKELQEFVARFSANASKSKQATSRKKMLDKIELEEIVPSSRKYPFINFKAEREMGNDFLTVENLSVTIDGEKIIDNISFILRPGDKAAIIGQNDIQTTALMRALADDIDYEGTIKWGVTTSRSYLPKDNSKDFATEESILEWLRQFASKGEDDDTFLRGFLGRMLFSGDEVKKSVNVLSGGEKVRVMLSKLMLLKSNVLILDDPTNHLDLESISSLNDGIKDFKESVIFASHDHEFIQTIANHIVVISKNGVIDRIDETYDEFLDNPEVQARVAELWK

SEQ ID NO: 79429 - protein, 159 aa, Streptococcus pyogenes M1 GAS
MKVKLICVGKLKERYLKDGISEYQKRLSRFCQFEMIELTDERTPDKASFADNQLIMSKEAQRIHKKIGERDFVIALAIEGKQFPSETFSELISGVTVKGYSTITFIIGGSLGLDSIIKKRANMLMSFGLLTLPHQLMRLVLTEQIYRAFMITQGSPYHK

SEQ ID NO: 79430 - protein, 269 aa, Prochlorococcus marinus subsp. marinus str. CCMP1375
MTNPIRNVTPGGSGGGAATLALIVSFTGILLLTQALFIVPAGQVAVVTTLGKVSGGARRPGLNFKVPFVQSTFPFNVQTQVRPEEFESLTKDLQVISATATVKYALKPSEAGRVFRTISYNDREIYNRIIKPSLLKALKSVFSKYELVTIASSWSDISSIVEKTVAEEISQFDYVDIQGLDLTGLEIAEEYRAAIEQKQIAEQQLLRAQTEVKIAEQEAIRYDTLNRSLDDQVLFKLFLDKWDGKTQVVPALPGTNGSNTPVIVGGRRN

SEQ ID NO: 79431 - protein, 231 aa, Glycine max
MIELFLSEPNWNDVVNDDDSTRSRISILNDLETVIWSTVGRSEARLWLCNTVAGLNCVTSLDQRDLFRNLLRTSGVKRDLASQLLHLMFDTAPHKPGSVLARRSHVLKKFFQGNPKRVLQWFSCSSSGGGLEQGKGFRALSQFAFKNRDICWEELEWKGKHGQSPAVVATKPHYFLDLDVLQTVENFLENVPEFWSSEEFAESVKDGDIFFVDRSFFVRYFINLMYKEEFR

SEQ ID NO: 79432 - protein, 427 aa, Arabidopsis thaliana
MRTTMSNLPKELVEDIVSRVPLHCLRAMRLTCKNWNALLESQSFKKMHIRKEEEAARELGENRMIVMMDYNVYLMGIIVNENLSIKSLGKLTCLHGSKQVKISQVFHCEGLLLCILKDDDTKIVVLNPYLGQTRWIQTRKYHRTSEWEGRDVYNYALRYETNSGNRSPKILRFIDDFHHHPENPALRYETYDFDTDLWTTLDVSPHWRIISRCGGVSLNGNTYWGAVERNASAYIGHMICFDFTRGGFGPLIPLPFKARGLVFAPLSSDRAEKIAALFRTSKKVVIWITTKIDATNVTWSNFFTIYISNLERNLSCKSFFTIYISNLERNLSCKSFFIDMEKKVAMVFDKEKGKKVAHNIINIIGEAGCVRKLVLKESGDKSCWPLVCSYVPSTVQIKQHNRGKRQKKVIRKGIDIDMRHDKRIKVD

SEQ ID NO: 79433 - protein, 222 aa, Vitis vinifera
MGKSWADDMILSYNDVVLRRSDLDILSGPHFLNDRLIEFYFSYLTSCYPSPDISLVPPSIAFWIMNCPDTGSLRDFIEPLKLSEKKLVIFPINNNDDVEQAEGGTHWSLLAFEENANVFVHHDSCGGLNEAHARKLYKAVVGFMGNSNSSRAQYLECKDSPQQANCYDCGLYVAATAKAICCWYGSGQPGEGLWFSVVKEQLTSSVVADLRSEMLGLIRNLQ

SEQ ID NO: 79434 - protein, 436 aa, Rhodobacter sphaeroides 2.4.1
MNRDAMPNAFRPGAVDLPPREADLVARRQALLGPAYRLFYERPLHIVRGEGVWLYDADGTAYLDAYNNVASLGHCHPRVVDAVARQAGQLATHTRYLHEGVLELAERLLATLPTELGHAMFTCTGSEANDLALRLAFAATGGTGVIVTENAYHGVTMGVAALSPSLGPGVPLGVHVRTVPAPDQDKGADVTFGAAVAAAAADLARHGIRPAALILDTVFSSDGVFTHPTDTLAPAAAAIRAAGGLFIADEVQPGFGRTGEAMWGFLRHGVVPDMVSMGKPMGNGYPVAALALRPELAERFGAGARYFNTFGGNAVAAAAALAVLDTLEAEGLQAHALNVGGQFRADLSALSARDPRLGAVRGAGLFLGVEVLEPESRAPDARMAARIVNGLREARVLISATGPHGHVLKIRPPLVFSDANAAFFLERFESVLAALR

SEQ ID NO: 79435 - protein, 351 aa, Oryza sativa Japonica Group
MENGHAKNLVAVIGSGNWGSVASRLIASNTAKLPSFHDEVRMWVFEEILPTGKKLSESINQANENCKYLPGIKLGANVIADPDLENAVKDANMLVFVTPHQFVEGICKKLVGKLRPGTEGISLIKGMEVKMEGPCMISKLITNILGINCCVLMGANIANEIAVEKFSEATIGYKKDKEVATRWAKLFTTPYFLVSVVEDIEGVELCGTLKNVVAIAAGLVDGLDMGNNTKAAIMRIGLREMRAFSKLLSPTVRDNTFFESCGVADLITTCLGGRNRRVAEAFARNGGKRSFDELEAEMLHGQKLQGVSTAKEVYEVLTYRGWQELFPLLSTVHEICIGQLPPTSIVEYRIH

SEQ ID NO: 79436 - protein, 494 aa, Staphylococcus aureus subsp. aureus COL
MEKKNKQIDRGDLKQNLSEKFVWAIAYGSCIGWGAFIIPGDWIKQSGPIAASIGIVIGALLMILIAVSYGALVERFPVSGGAFAFSFLSFGRYVSFFSSWFLTFGYVCVVALNATAFSLLVKFLLPDVLNNGKLYTIAGWDVYITEIIIATVLLLVFMLVTIRGASVSGSLQYYFCVAMVIVVLLMFFGSFFGNNFALENLQPLAEPSKGWLVSIVVIVSVAPWAYVGFDNIPQTAEEFNFAPNKTFKLIVYSLLAASLTYVVMILYTGWLSTSHQSLNGQLWLTGAVTQTAFGYIGLGVLAIAIMMGIFTGLNGFLMSSSRLLFSMGRSGIMPTMFSKLHSKYKTPYVAIIFLVGVSLIAPWLGRTALTWIVDMSSTGVSIAYFITCLSAAKLFSYNKQSNTYAPVYKTFAIIGSFVSFIFLALLLVPGSPAALTAPSYIALLGWLIIGLIFFVIRYPKLKNMDNDELSRLILNRSENEVDDMIEEPEKEKTK

SEQ ID NO: 79437 - protein, 538 aa, Zea mays
MADTADAPLLTSHGQAKQLAKAPSIDDTIETYIGATGSMQLLKAVLLAFAWAFDAQQVFISVFTDAEPQWHCTGASASCEPATPPASPCALPSGAWAWDRPAHTTVVSEWALKCAGPAPALVSLPASSFFAGCLAGGFLLTTLADSLLGRRKMLLTSLVSMSVAGVLTAFAPNVWAYAALRFVCGFGRSMVGTCTLVLSTELVGKRWRETVSMAGFIFFTVGFLSLPALGYTLREASWRNMYLWTSVPSLCYSVLLYFLAQESPRWLLVRGRKQDAMETLRQIASLNGNSITSSFSMLHACNMQEDDGAAGGAGGVFSTMRAMWERPWALRRLAAIMTASFGVGMVYYGMPLNVGSLGTNLYLSVTYNALAELPSAILSLIFIGRVNRRSSVVALTVAAGAFSLACVVIPEGSAARMAAELLSFFSTITAFNLILIYSIELFPTSVRNSAVGLVRQALVLGGVVAPVLVALGRERSFWSFGVFGLCIGCLGLFAACLPETRGRSMSDTMEEEEHKEAAAAACTGATDIATKDDTDLLV

SEQ ID NO: 79438 - protein, 602 aa, Agrobacterium tumefaciens str. C58
MAVEANGNDLAQVVVLLAAGVIAAPIFKRIGLGSVLGYLAAGLVIGPYGLGFFSDSQAILHVAELGVVMFLFIIGLEMQPSRLWSMRQDIFGLGALQVLVCMGGLTLVGVSLGFPVIMSFVAGTGFVLTSTAIVMQMLQERNSMSSLKGQRIIAILLFEDLAIVPLLALVAFLGSGGEHVTASERWLSIGIALAAVGALILAGRYLLNPFFRLLAASGAREVMTAAALLVVLGSALLMQVSGLSMAMGAFLAGVLLSESSFRHQLEADIEPFRGILLGLFFLGVGMAIDLAVIASNWQLVVVSVAGYMLLKAFLIYGVARALGTTRRESLERAVLMAQGGEFAFVLYSAAVSAGILDREANAILTATIIISMVLTPLMVILHDRLVPAAVPNTDDLDVPENVEGSILLIGFGRFGQIVSQPLLARGYTLSLIDKDADFVRDAAEFGFKVYYGDGSRAEILHAAGASTARAVLICVDDKDAAVRIAEIVKHEFPLVPVLARAYDRGHAIDLLKAGVDYQIRETLESALNFSEEVLGAMGEEREDAARLVEEFRDRDEERFAMEVVGGIYAGRSLIRGNAQPADLVAARTARERAEREKAEAEE

SEQ ID NO: 79439 - protein, 185 aa, Rubrobacter xylanophilus DSM 9941
MNITERTIQVIRNRIRSVPDYPSPGVVFRDITPLMEDGPSLHAAVDALAEATRSLDYDRVISAEARGFVFGTALAYRSRKGLVLARKPGKLPREVISVSYELEYGTDSLEVHADAIPPGTRVLVADDLLATGGTARAMCELVEKSGGSVAGCAFLIELGFLEGRKKLLAGYDVISLINYHDPAAE

SEQ ID NO: 79440 - protein, 322 aa, Streptococcus mutans UA159
MSYSNLKLFALSSNKELAEKVAKTIGISLGKSTVRQFSDGEIQVNIEESIRGNHVFILQSTSSPVNDNLMEILIMVDALKRASAETVSVVMPYYGYARQDRKARSREPITSKLVANMLAVAGVDRLLTVDLHAAQIQGFFDIPVDHLMGAPLIADYFVRRGMCGSDYVVVSPDHGGVTRARKLAQFLQTPIAIIDKRRNVNKMNTSEVMNIIGNVSGKTCILIDDMIDTAGTIAHAADALAEAGATAVYASCTHPVLSGSALDNIQNSAIEKLVVLDTIDLPEEKLIDKIEQISITDLISEAIIRIHEKRPLSPLFEFTTFN

SEQ ID NO: 79441 - protein, 391 aa, Streptococcus mutans UA159
MDLSKRFNKNLNKIEVSMIRQFDQSISDIPDVLKLTLGEPDFATPKHIKEAAKRAIDADESHYTGMAGLLALRQAASAFVKEKYHLTYNPDNEILVTIGATEALSASLTAILEPGDKVLLPAPAYPGYEPVVNLVGAEVVEIDTRSNDFVLTPEMLEEAILKEGEALKAVILNYPTNPTGVTYSRQQIKNLAEVLKKYPIFVISDEVYAELTYTGESHVSIAEYLPDQTILISGLSKSHAMTGWRLGLIFAPAVLTAQLIKSHQYLVTAATTSVQFAAIEALTNGKDDALPMKEEYIKRRDYIIEKMEAMKFKIIKPDGAFYIFAKIPVAQGQDSFKFLQDFAKEKAVAFIPGVAFGKYGEGYLRISYAASMETIKEAMKRLKEFMEQYAD

SEQ ID NO: 79442 - protein, 551 aa, Spinacia oleracea
MQASTFMVKGNLGFEVQNRRVAGLAGLKGLSSIRSNNLSFVNVNDNNYKSNPCKLSCGSLSMGAGFARLGLDHVMKSSPKYRSVKAQAASGGDLEDATPVKYQGKSSASVLPYVGVACLGAILFGYHLGVVNGALDYLSADLAIAGNTVLQGWVVSILLAGATVGSFTGGSLADKFGRTKTFQLDAIPLAIGAYLCATAQNVQIMMIGRLLCGIGIGISSALVPLYISEISPTEIRGALGSVNQLFICIGILAALVAGLPLAGNPLWWRTMFGIATVPSVLLALGMGFCPESPRWLFQQGKIVEAEKAVAALYGKERVPEVINDLRASVQGSSEPEAGWFDLFSSRYRKVVSVGAALFLFQQMAGINAVVYYSTSVFRSAGIASDVAASALVGASNVIGTAVASSLMDKQGRKSLLMTSFSGMAASMLLLSLSFTWKALAPYSGTLAVVGTVLYVLSFSLGAGPVPALLLPEIFASRIRAKAVALSLGMHWASNFVIGLYFLSVVTKFGISKVYLGFASVCVLAVLYIAGNVVETKGRSLEEIELALSPAV

SEQ ID NO: 79443 - protein, 432 aa, Rhizobium leguminosarum bv. viciae 3841
MTVECTRLKSGLTVVTETMPHLESVALGVWIKSGSRNETDNEHGIAHLLEHMAFKGTARRTARQIAEEIEDVGGEVNAATSTETTSYYARVLKDYVPLAVDILADILTESAFEEEELEREKQVILQEINAANDTPDDVVFDRFSEAAYRDQTLGRAILGTPETVVSFTPQQIRGYLGRNYTTDRMFVVATGAVEHEEFLRMVEDRFASLPTAPSAPPVMEPARYIGGSVREPRDLMDAQILLGFEGKPYHARDFYCSQILANILGGGMSSRLFQEVREFRGLCYSVYAFHWGFSDTGIFGIHAATGGENLPELVPVIIDELHKSADAIHQKEIERARAQIRAQLLMGAESPAARAGQIARQMMLYGRPISNPEMMERLEGITIERLTDLAGRLFYDTVPTLSAIGPLEQLAPMEDITASLTVPASKTLQASR

SEQ ID NO: 79444 - protein, 621 aa, Vibrio vulnificus YJ016
MTLDISKYPTLALAETPDELRLLPKETLPTLCDELRTYLLNSVSQSSGHLASGLGTVELTVALHYVYNTPFDQLIWDVGHQAYPHKILTGRREQMPTIRQKGGLHPFPWREESEYDTLSVGHSSTSISAALGMAICAEKEGQNRKVVSVIGDGAITAGMAFEAMNHAGDVHSDMLVILNDNEMSISENVGALNNHLARVLSGNLYTSIREGGKKVLSGVPPIKELVRRTEEHLKGMVVPGTLFEELGFNYIGPIDGHDVVELVKTLKNMRELKGPQFLHIMTKKGKGYEPAEKDPIGYHGVPKFDPAHTSLPKSSGGKPSFSNIFGDFLCDMAAQDPKLMAITPAMREGSGMVRFSKEYPEQYFDVAIAEQHAVTLATGMAIGGYNPIVAIYSTFLQRGYDQLIHDVAIMNLPVMFAIDRAGLVGADGQTHQGAFDLSYMRCIPNMVIMAPSDENECRQMLYTGHKHQGPSAVRYPRGNGMGTPIESEFTALEIGKGRLVRQGEKVAILSFGTFLANALEAAEALNATVADMRFVKPLDEALIRQLANEHDVLITIEENAIAGGAGAGVIEFMMQEKIMKPVLNLGLPDKFIHQGTQEELHEELGLDAKGIEQAIRHYLAK

SEQ ID NO: 79445 - protein, 298 aa, Vibrio vulnificus YJ016
MDNSMIDVLASFQQRNNQQLNLWLDKLPHQNQALIQAMRYGLVLGGKRARPFLVYATGEMLGCSQEQLDTPASAIECIHAYSLIHDDLPAMDDDELRRGQPTCHVKFDEATAILTGDALQTLAFTILAEGTLSPDGETQRVAMIQALAQASGAQGMCIGQALDLAAENRAVTLEELEEIHRNKTGALIRCAVRLGALAAGEKGLAILPQLEKFSTAIGLAFQVQDDILDIISDTETLGKPQGSDQELNKSTYPSLLGLEGAMEKAHTLLHEALQALEAIPYNTQHLEEFARYVVERKN

SEQ ID NO: 79446 - protein, 395 aa, Bordetella pertussis Tohama I
MRKFSRIERLPPYVFNITGELKMAARRRGEDIIDMSMGNPDGATPQHIVDKLVEASTRPDTHGYSVSKGIPRLRKAICDWYMRRYAVEFDPDSEAIVTIGSKEGLAHLMLATLDRGDTVLVPNPSYPIHIYGAVIAGANIRSVRMTPGIDFFEELERAVRESIPKPKMMILGFPSNPTAQCVDLSFFERVVALAKEHDILVVHDLAYADVCFDGYVAPSIMQVPGARDVAVEFFTMSKSYNMAGWRIGYMVGNRELVGALARIKSYHDYGTFTPIQVASIAALDGPQDCVNEIVAQYQRRRDVLARGLHEAGWNVEIPKASMYIWAQIPEPYRAMGSLEFAKRVLSDAKVAVSPGIGFGEYGDEYVRFALIENEQRTRQAVRGIKDMFRKDGLLK

SEQ ID NO: 79447 - protein, 377 aa, Vitis vinifera
  misc_feature (8)..(8): Xaa can be any naturally occurring amino acid
  misc_feature (97)..(97): Xaa can be any naturally occurring amino acid
MCDCAPSXLLLNSTVRIRNLGFTTRDWNPRNHAKPSTFCNSHLIFHRNGGSRLISAEIDALNSTTCVRAIPNRGELGFKDEGKRDFGFETKGVDSSXSSAFDFLELEEQEGRTGEKSAGNPEDEDLVRVGGGSELEGAEKVDERLGLRSGRQVMRRSNMLAKQVISIRSALSLGFVSQLWVDTTSWMVLVIEVRPNLLSGELERFLLEDVSRVGDVVLVQDESVMDNEYKMLGLETLVGYNVVTPGRRNIGKVRGYTFNINSGAVESLELDSFGISLIPSSLVSTYALFVEDVLEVVSDTVIVHEVAASRIQRLTKGFWDARKGGTSIDEPGEYSDFASKRVRSDHSQSTRRNFRNKKFRPKVREMEDDWELPMDYL

SEQ ID NO: 79448 - protein, 455 aa, Pseudomonas syringae pv. syringae B728a
MSVSERRVSRLFDPGSFKEDLEGQNTHFICGAGTIHSIKTYVAMSRGRDCEFQSSRQWSTAQQIIKTVGLARAAEAPLIYIQDKIGGNNDTEGFDTARVFSSDMSSLLLSPSGMGSVSASLAELAKLNLLMSVILGPTSGPLALPVMLADLVLMTRRGALCMGRPDMVKAMLAQQTDLYSLGGSDIHSTASGSVHLVFDDEADLFADLRKLLLYLIAGKSSTYGEFSTPLEVDFNRLLPPSHNIPFDVQHLVRSFVDSDSLIEIGASHAPEVLVGLASLQGQVFAVVANNSAHGGGVIYKRTARKMIHVIDLAGKMSLPILFIADIPGIMIGEEAERDGIFAAVADLFRAHTRCKVKKLLLVARKAYTGGVYAMSGPGFEPVAVLAYPDANIGVFSTLTMEKIIKSSSMTDAQRAVVSALDEEIRSPLLLKDKGLITDVISVRDTRQAVFKYLFH

SEQ ID NO: 79449 - protein, 479 aa, Colwellia psychrerythraea 34H
MSTATKILAETAEDTNALNKSSGGTGHLKRVLGLRSLLSVAIGLVVTQGVMVLALQGLGIAGIGFFIAMAIAFVLALFAAFSFAELSLMMPRAGTLSTYTQVAIGQFPAIVATFSGYVVVAMFAVAAELQLIGLILSEIFPNFLSPMALGLLILGIFAVLNIVGVDIFAKLQTVLAFTMVVSISVLGAAAILGTNEPQLSNLDLFSDWNPIGTEVFSLIALAIWLFVGAEFVCPLVEETKNPEKNIPKAMFYGLFTILGVYLLFCIGAFFYMPLEQMASSSLPHLDYAVAVFGDSGLEVLAIVAITATCSTVNTTLASVPRMLYGMAKNKQAFPIFKRLDSRFNTPAIAILFMAAIIGAPLIILGDKPDTVVILLIAASTCWLLAYIISHIDVIVLRKRMPDANRPFKTPFYPIPQVLGIIGMGYAAYYNSPSPELTQQVFLTAGAVLAVVSVIAALWVKLYMKKDLFQPESMEDVLKG

SEQ ID NO: 79450 - protein, 178 aa, Brassica napus
MIQRLVVTALQLAELSVSSVVHMMYGLYIFSSAVAGDLTQRLSESIFKSKTTGEVKRSTTQVNDLPPIVLVHGIFGFGKGRLGGLSYFAGAEKKDERVLVPDLGSLTSVHDRARELFYYLKGGRVDYGEDHSKACGHSQFGRFYEKGEYQEWDEDHPIHFVGHSAGAQVVRVLQQMLS

SEQ ID NO: 79451 - protein, 379 aa, Bacillus pumilus SAFR-032
MAVEVVMPKLGMSMKEGTVSVWNKEVGETVNKGESIASINSEKIEMEIESPAEGTILDIKVPEGEGVPPGTVICYIGEGNEQVEEKKEKGLPPKQKKERIKISPVARKIAQSANLDIHTLVGTGPDGRITKADVLRALPDEKEKQKQQNEPTKHQPVSMMRKTIASRMMESLQTSAQLTITMKADVTKLTNLQQQLNETAIARYETKLTITDFIAKAAILSLLEHPAMNSQYHNGVVETFENVHLGIAAALDNGLAVPVIQHAERLTLIELAKSIKLYGKKAREGKLLHDEIRGSTFTITNLGAYGVEHFTPILNPPEAGILGIGTMYDTPVYREDELCKGTILPLSLTFDHRVLDGAPASAFLSTVKAHLEEPISILL

SEQ ID NO: 79452 - protein, 188 aa, Zea mays
KFGVKKGGPFPRKVKVGIFGHPGVSWVILGHFEKKTLLGDQNEFVETKVAYALSQGLKVIACVGETLEQREAGSTMEVVAAQTKAIAEKIKDWSNVVVAYEPVWAIGTGKVATPAQAQEVHASLRDWLKTNVSPEVAESTRIIYGGSVTAANCKELAAQPDVDGFLVGGASLKPEFIDIINAATVKSA

SEQ ID NO: 79453 - protein, 459 aa, Bacillus pumilus SAFR-032
MTLVIIGGGPAGYVAAITAARFGREVVLIDQGQLGGTCLNEGCIPTKALLQSADMYEHVKSAVHFGIELPEHEPTIHWHVVQKRKQSVVKQLTDGVRYLMNKNKITVVNGKASFLSAHELFIESEGKSEIIQAKQIIIATGAAPAALPFAPFDGEWIIHSKDAMSLSSIPDSLCIIGGGVIGCEFASIYCRMGSKVVMIERALHILPEEDREIAQCLHEQLEETGVDILTAAAVKQLDSTSRRVVVENNQGERCDIQSDLCLVAIGRTPQLEELNLDQIGIEFDRNGIYVNEHMQTNLPHIYACGDVTGGIQLAHTAFHEGMVAASHAAGEHIKVNEQVIPRCIYTSPEIASVGLNEESARKQYEEIRIGTCAFSANGKALILNQPAGQVKVIVEPQYQEIVGVSIIGPHATELIGQAAVMMHTELTADTLEQFIAAHPTLSEAIHEALLQTIGRAVHC

SEQ ID NO: 79454 - protein, 276 aa, Chlamydomonas eugametos
MTSHAANPKEEQDQRLPFKSDISGPIAPSQAPAHTVQAHDSQPKPSDDSSDEHLSFYEAKARIVRAFAASRAPQPAAPAAKALEGDASVIVPGKLILSSCEVEESSELLTKLGVTHILQVGEELKPSHPGRFTYLSLPILDMEGQDIVALLPSCFQFLQQAQASGGVCLVHCLAGISRSASVVIAYLMWTQGMPYTEARAMVRRARSKVYPNTGFTLQLQELDRLRESGAIQWGDTPSLASSLEQHRQPWNLIRYLEVKEKQAQEEGWTWGRTLVI

SEQ ID NO: 79455 - protein, 460 aa, Leptospira interrogans serovar Lai str. 56601
MKEYDIIVIGTGGGTKLVTPPSKIGYKIAVIEKENPGGTCLNRGCIPSKMLIYPAEILSLTKHSEKFQISFPKKPEVDFKTLIERISKTVDDESASILPAYDKNPNITYISGTASFISDKVITVNGEQLTAKRIFIASGARPAIPDIPGLAGTPFMTSRETLRRTDLPKSMIVIGGGFIALELGFAYSSFGSEVTFLVRNRMLKNEDKDIVDEFERIFTKEHNVLLHTNIHKIEYNKNLFYVEAISQGKTILLQSEALLVATGIRPNTDLLNLQNTNIQTDKNGYIVVNEYLETTSPGVYALGDITGKYFYRHSVNFEGEFLFRTLYQEKKRTPIEYPPVPHAVFTHPQIAKVGKTEEELIQEGIDYVAAKNSYSASATGMARLSDSGFVKILIDKKSKKVLGAHVIGDEASNLIHLFILLMTMKGTLDDLLKMIYVHPALPEIARNAARKAKELLQSKK

SEQ ID NO: 79456 - protein, 459 aa, Vibrio parahaemolyticus RIMD 2210633
MSKQTFDQVGLNPALLETLDSLNYTHMTPIQALSLPAILNQRDVIGQGKTGSGKTAAFGLGVLSNLNVKRFRVQALVLCPTRELADQVAKEIRTLGRGIHNIKVLTLCGGMPMGPQIGSLEHGAHILVGTPGRILDHLEKGRINLEELNTLVLDEADRMLEMGFQDALDAIINAAPKQRQTLLFSATFPEKIEKIAQRIMKSPEMIKVESTHDTSSIAQYFYKVEGTEARDEALANLLLTYQPESAVVFCNTKKEVQNVADELHHRGFSVIDIHGDLEQRERDQALVQFANKSVSILVATDVAARGLDVDNLDAVFNFELSRDPEVHVHRIGRTGRAGSKGLAFSFFGEKDGLRVARIEEYLEMDVVPATLPAKSNQQPYQAKMVTINIDGGKKQKVRPGDILGCLTGKNGIPGAQVGKIHLFPVRSYVAVEKSAAKKALQIISTGKMKGRQFRARLLK

SEQ ID NO: 79457 - protein, 195 aa, Prochlorococcus marinus subsp. marinus str. CCMP1375
MANLDKAPSRSMPNLLHVLPAFADEGSLRVNTIVELNSNTINKYELITETGHLKLDRVGYSSLAYPFAYGCIPRTWDEDGDPLDIEIVGVTEPLIPGSIVEARIIGIMTFDDGGEVDDKVIAVIADDKRLDHITSYELLGEHWINETTYYWEHYKDLKKPGTCTVNGFFGIEKAVEIIKTCERRYLSEIEPQLVD

SEQ ID NO: 79458 - protein, 403 aa, Neisseria meningitidis MC58
MAFLKLTEQNVQGKTVLIRADMNVPFKDGKISDDTRIRASLASIKYCVDNGASVIVMTHLGRPTEGEFHPEDDVAPVAAHLGSLLGKDVKVLNDWRENKPALNAGDVVMLQNVRINKGEKKNDLELGKAYASLCDVFVNDAFGTAHRAQASTEAVAQAAPVACAGVLMAGELDALGKALKQPARPMVAIVAGSKVSTKLTILESLADKVDQLIVGGGIANTFLLAEGKAIGKSLAEHDLVEESKKIMAKMAAKGGSVPLPTDVVVAKAFAADAEAVVKDIAADAEAVVKDIADVAEDEMILDIGPKSAAALADLLKAAGTVVWNGPVGVFEFDQFAGGTKALAEAIAQSKAFSIAGGGDTLAAIAKFGVTEQIGYISTGGGAFLEFLEGKELPAVAALEKRGA

SEQ ID NO: 79459 - protein, 181 aa, Brassica napus
MASVMLSSATMTSSLAHATMVAPFIGLKSSAAFPVTCKANTEITSITSNGGRVNCMKVWPPVGKKKFETLSYLPDLTDVEIAKEVDYLIRNKWTPCIEFELEHGFVYREHGNIPGYYDGRYWTMWKLPLFGCTDSTQVLKEVKKCKQEYPNAFIRIIGFDNNRQAQCISFIAYKPPSFTDA

SEQ ID NO: 79460 - protein, 110 aa, Zea mays
MESSRGQGGIQQLLAAEQEAQHIVNAARTAKMARLKQAKEEAEKEIAEYKAKIEQDFQRKLEETSGDSGANVKRLEQETDAKIEQLKNEASRISEDVVAMLLKHVTTVKN

SEQ ID NO: 79461 - protein, 833 aa, Rubrobacter xylanophilus DSM 9941
MKAVIMAGGQGTRLRPLTSEQPKPMIRIANVPCMEHIVNLLKRHGFTDIAVTLQFMPDEIRDYFGDGSDWGVNIRYSVEDSPAGTAGSVKMAERQLGLEGERLLIISGDALTDVDLGELLAYHEQKGGEATMVLKSVENPLDFGIVITGEDGRISRFLEKPAWGQVFSDTVNTGIYLLEPSVLREIPDPEEGEYDFSKDLFPRLLEQGRPLYGMVTDAYWEDIGTLEQYASANRDVLEGRVRGVRPPGTRLRENIYVGRRVQVDDEELEGPVVIGDNVRIDEGARISPYSVIGNNVVVASGAHIERSIVADGTYVGEGAELRDTLVGRSCYIQERARILERSALGDDVIVGEGATIAPDVKVYPHKTVESGASVTQSLIYETMGLRTIFRGGRVSGKFNVDVTPEFVIRLASSFGTTLSPGSIVTLGRDSSAAAQVVKRAMTAALLATGVNVRDLRAAHAGVVRHDVLAGKSSAGCHTRAGEDSDEVEVLFFSSDATPMTEGEQRAIEKVFVREEYRRAHEGDIGQLIFPGRAVEQYVERLERAVDRSRVSGGSVVVDFCGGVAGLVASRVFSRLGISAVVMEGFANANVVGGAPRMDLEEGLERVGRIVPTVEAAFGCVVNPTGEQVHFVDDAGEYVPPDVMLACLIRGLEPREVVLPINLSSRYAELVESYGGTVHYARTGMGNVAIRAAERAADLGGLEDGQYIFPAFLPAPDCFMTLARALELFRDRPLSKVRREFGERFGNVVRERLECPWSAKGRVMRGLAERFGGDPDAILTEGVKLMVDGGWVLMLPDPDNPLFYVYAEADDGRRPEALMQDYVRLVRELIESGD

SEQ ID NO: 79462 - protein, 133 aa, Wolbachia endosymbiont strain TRS of Brugia malayi
MSNVTNDLVDKILSLNLLEASELVKVLEEKIGLPAGSFVDGAVSSSAPTSDNAASSVAQEKTECKVVIKEIDASKKMEIIRTVRKIDPTLGLKEAKELVESLPKDLTASVPRGEAEKIKQQLIDAGATKVELE

SEQ ID NO: 79463 - protein, 319 aa, Vitis vinifera
MAIAYPHFIGSQKSAMETGMISSPSSSSPSRPPVILTQDELKKIAAYKAVEYVESGMVLGLGTGSTAKHAVDRIGELLRQGKLKNIVGIPTSKMTHEQAVSLGIPLSDLDSYPILDLAIDGADEVDPYLNLVKGRGGSLLREKMVEGACKKFVVIVDESKLVNYLGGSGLAMPVEIVPFCWKFTAQRLQMLFEESGCVAKLRTYQNGEPFVTDNMNYIVDLYFKREIGDLKVASDAILRLAGVVEHGMFIDMATTLIVAGECGVIGCSLHSSNSSGSSSLTTYFGGGYLLWLPVGFFADLIGATVGAGAAVLLGRTANA

SEQ ID NO: 79464 - protein, 448 aa, Oryza sativa Japonica Group
MAAGVTFNWIKTPLDIRRFHDFSSLSFRCRNTFGSIQPSWLTTDQEPSFSKVRVAADYSDSVPDSKYTRDRGYHPLEEVKERPKKKDLSLTDVETARTVVEANSKGLLVFPARVHNEPHGHVAWSDFQYIVDDYGDIFFQVPDSENILEDDAANNPVTVLIGMDGPIIGETSVVTSDFSDYMDVENFIDMPDENDSKIDTEITDILIEWGMPATMRAIHPIYFAKCLTKAVHDKHREKMDSPSNGVSIVGYLRPAFIEEESYLRSLFHGECNGDGYSSDWRDECKREPAPASGTNGLIDDDKSRFDFTNVGSSTDSTIYKLEIMTVELFSIYGKQLMIDPQDFQDAEPDILANSASEIINRIKENDDQCAMALRSLCHRKKGLTVEEASLISIDSLGIDVRAFSGLEARTVRFSFNAQALSERSAEKKIRRMLFPRRKNVKPSTEDEC

SEQ ID NO: 79465 - protein, 285 aa, Glycine max
MKVPAVVDGRFKLFERHRFCAMAEERQVIGVHTGDAWKGNSRMQKTPKNCTGRGKTFDMRNDRERTTGCGGGSGSGKDKIDSLSRLLTRILRHMAYELNLNMRSDGYVKVNDLLKLNLKTFANIPLRSHTIDHIREAVRKDNKQRFSLLEENGELLIRANQGHTVKVVETESLLKPILSAEEFPVCVHGTYRKNLESILGSGLKRMKRLHVHFSCGLPTDGEVISGMRQDVNVLIFLDVRKALEESMKLYISDNKVILTEGFDGVVPPKYFERIESWPSRQPISF

SEQ ID NO: 79466 - protein, 191 aa, Zea mays
  misc_feature (16)..(16): Xaa can be any naturally occurring amino acid
MSSPSKRREMDLMKLXRMLDLSWMMSDYKVEMVNDGMQEFFVEFKGPAESIYQGGVWKVRVELPDAYPYKSPSIGFINKIYHPNVDEMSGSVCLDVINQTWSPMFDLVNVFEVFLPQLLLYPNPSDPLNGEAAALMMRDRPVYEQKVKEYCEKYAKPEDAGITPEDKSSDEELSEEEDDSGDEAILGNPDP

SEQ ID NO: 79467 - protein, 308 aa, Vibrio angustum S14
MRQLTTLLDQWLNSFNKVMDETIASGIPFTVPTVREGLANITRELVTEIPNIALIENLTIKDKVPIRIYHPQPETALPVLVYFHGGGHMSGSVEVYDPICRKLAQHSQFIVVSVEYPLAPEHPYPAAIDDSYLVLQSLFQTLIRAELNFIPQLSIAGDSAGGAICATLARMAQFDDDVEIAKQVLIYPSLDYTLSFPSVSQNGMGYLLQQSRIEWYFSNYFQHNEDRRKASPVWGPYSMALPESLVITAEFCPLKDEGIAYVEALKKQGVETEHIHFEQMIHAFLNMENIVKKECELSYKTIGVFLNK

SEQ ID NO: 79468 - protein, 211 aa, Prochlorococcus marinus subsp. marinus str. CCMP1375
MTETKAKSKSKENSSSPVPAAAEGQQQEQKRGNSRGGERRGRRSDRRNQDRDSEWQERVIQIRRVSKTVKGGKKMSFRAIVVVGNEKGQVGVGVGKAGDVIGAVRKGVADGKKNLVRVPLTPNSSIPTLSNGRDGAASVLIRPAAPGTGVIAGGSIRTVLELAGIKNVLAKRLGSKTPLNNARAAMVALSLLRTHKATAKERGISLEQIYS

SEQ ID NO: 79469 - protein, 356 aa, Physcomitrella patens subsp. patens
MTSGTRLPTWKERENNKRRERRRRAIAAKIFAGLRLYGNYKLPKHCDNNEVLKALCVEAGWTVEEDGTTYRKGSKPPAQPMEVCTSPSEVSPTNSYPGATDGTSLIPWLKGLSSNGGSGAATPSSSAGLPPLHVMHGGSSSAPVTPPLSSPTHRGPPVKPDWDHIKETDHHPHGFPPTGTPTWNHHPFLAAAAAAAQAAASNQSHLRPGYCDTPDGARTPIEEGDSEISPEAALEFATVCGSNSSKWANGVRVRTSSEGRLLSGMAGLGPFPSANSDSPLETFSHPWRNPMQKSISMPVSPVSSRMKGSFGDRLGRCPSELEFPGAVQGLGSLWDGLAPEVGGKMKLPADDLELKL

SEQ ID NO: 79470 - protein, 620 aa, Salmonella typhimurium LT2
MDSHTLLQALIYLGSAALIVPIAVRLGLGSVLGYLIAGCIIGPWGLRLVTDAESILHFAEIGVVLMLFVIGLELDPQRLWKLRASVFGGGALQMGVCGGLIGLFCMFLGLRWQVAELIGMTLALSSTAIAMQAMNERNLTVSQVGRSAFAVLLFQDIAAIPLVAMIPLLAASGASTTLGAFALSALKVAGALALVVLLGRYVTRPALRFVARSGLREVFSAVALFLVFGFGLLLEEVGLSMAMGAFLAGVLLASSEYRHALESDIEPFKGLLLGLFFIGVGMSIDFGTLVENPLRILLLLAGFLAIKIVMLWLVARPLGVPAKQRRWFAVLLGQGSEFAFVVFGAAQMADVLEPEWAKALTLAVALSMAATPIFLVLLTRMEKTATGEAREADEIDEEQPRVIVAGFGRFGQIAGRLLLSSGVKMVVLDHDPDHIETLRKFGMKVFYGDATRMDLLESAGAAKAEVLINAIDDPQTNLQLSELVKSHFPHLQIIARARDVDHYIRLRQAGVAMPERETFEGALKSGRQALEALGLGRYEARERADLFRHFNTRMVEEMAKGENDPLSRAAAYKRTSAMLSEIITEDREHLSLIQRHGWQGTAEGKHSGEVADEPEVKPSI

SEQ ID NO: 79471 - protein, 459 aa, Zea mays
MSLKCSVGSSNFSISMEEVFKMVEEKCLHSYKMLPSDLSIGKLLSEVCQSVVQLGTMHSEVNRDSGSLHNEVVAPFVKPISCEAAVGISDDVAGGSSVLESSEPCLQNSLVAWDPEFAHCKQKTTHDTTDISKGEERVRIPIVNEFGSEKCPPSFYYVPRNLVFQNAYVNISIARIGDEDCCADCSGNCLSSLVPCGCARVTGGEFPYTPEGLLKTEFLDECTSVNHFPQEHHRFYCTVCPLERSKNKASPGPCKGHLMRKFIKECWSKCGCGMQCGNRVIQRGITCKLQVFFTREGKGWGVRTVEDLPKGSFVCEYVGEVLTSSELHERAIENARNGKHKHQVLLDAGWGSGVLRDEDALSLDGSFYGNVGRFINHRCYDANLVQIPVEVETPDHHYYHLAFFTNKKVEAFEELTWDYGIGFDDTEGPSKPFRCMCGSRYCRDPNNLRRMARAAAKRK

SEQ ID NO: 79472 - protein, 620 aa, Bordetella pertussis Tohama I
MTTELLDRILSPADLRQLDRRELKRLADELRGFVLESVSRTGGHLSSNLGTVELSLALHYVFDTPHDRIVWDVGHQSYPHKILTGRREGMAHLRQQGGISGFPKRSESEYDAFGTAHSSTSISAALGMAVASRNAGVQRQHIAVIGDGAMSAGMAFEAMNNAGVTPNINLLVVLNDNDMSISPPVGALNRYLARLMSGQFYAAAKNVGRAVLQHVPPVLELARRLEEHAKGMVTPATLFEEFGFNYVGPIDGHDLDALVPTLQNLRALPGLQFLHVVTRKGQGYKLAEADPVLYHGPGKFDPAVGIQQAKAPARKTFTQVFGQWLCDMAERDERLVGITPAMREGSGLVEFEQRFPQRYFDVGIAEQHAVTFAAGLACEGQKPVVAIYSTFLQRGYDQLVHDVALQNLDVTFALDRAGLVGADGATHAGNYDIAFLRCVPNMVVAAPSDESEARLLLSTCYEHPGPASVRYPRGAGCGAAVGEGLATVPLGKGLVRREGRRIAILGFGTLVQAALGAAGQIDAMVADMRFVKPLDRELVLELAARHDALVTVEEAAIMGGAGSAVLETLAEAGVTLPVLQLGLPDAFIDHGDQAALLAGLGLDAAGIERAIRARFGALLA

SEQ ID NO: 79473 - protein, 303 aa, Bordetella pertussis Tohama I
MKQSHLACADWLRERAQHVEHVLDELLPGADIAPTRLHEAMRYAVLGGGKRVRAALVYAAGQACPVNGSTLAVGASMDRAAAAVELIHAYSLVHDDLPCMDDDTLRRGRPTVHVQFDEATAMLAGDALQPLAFELLAGMPIAPALVVQAAQVLARAAGSQGMAGGQAIDLHSVGRMLTRDELQTMHSMKTGAMLACSVTLGGIVAGASSTARQALDSYAQAIGLAFQVVDDILDVTADTASLGKTAGKDAADNKPTYVSLLGLEQARALAQELRQAAHQALAPLGESGARLGQLADFIVLRDR

SEQ ID NO: 79474 - protein, 81 aa, Brassica napus
MAEFHLPAEIENKAEDFEDNTNFIDEEYLNYLHYLPSRSSHGHETFGSYDEVFGRVLRNSSSTRRQETAEELPVVELQAEE

SEQ ID NO: 79475 - protein, 360 aa, Cytophaga hutchinsonii ATCC 33406
MYGKQGEKYIDLISGIGVSNIGHCHPKVVQAIQEQSQKYMHLMVYGEFVQAPQVRLATKLIETLPPSLDSVYLVNSGSEATEGALKLAKRYTNRREIISCKNAYHGSSHGALSVMGNEFFKQSYRPLLPGIKHIRYNHTEDLDVITEQTAAVIIETIQGEAGVRIADKPYMQALRKRCDYTGTLLILDEIQCGFGRTGTFWAFETYGIVPDILLAAKGMGGGMPIGAFISSKKIMQTLSSDPVLGHITTFGGHPVSCAASIACMEVIQEEKLMDTVLKKESLIRKQLNHPGIKEIRSAGLMMAVEFESYSVLKRIIDQAIEKGVLTDWFLFCDNSMRIAPPLIISDDQIEQACSIISSCK

SEQ ID NO: 79476 - protein, 506 aa, Staphylococcus aureus subsp. aureus Mu50
MQNFKELGISDNTVQSLESMGFKEPTPIQKDSIPYALQGIDILGQAQTGTGKTGAFGIPLIEKVVGKQGVQSLILAPTRELAMQVAEQLREFSRGQGVQVVTVFGGMPIERQIKALKKGPQIVVGTPGRVIDHLNRRTLKTDGIHTLILDEADEMMNMGFIDDMRFIMDKIPAVQRQTMLFSATMPKAIQALVQQFMKSPKIIKTMNNEMSDPQIEEFYTIVKELEKFDTFTNFLDVHQPELAIVFGRTKRRVDELTSALISKGYKAEGLHGDITQAKRLEVLKKFKNDQINILVATDVAARGLDISGVSHVYNFDIPQDTESYTHRIGRTGRAGKEGIAVTFVNPIEMDYIRQIEDANGRKMSALRPPHRKEVLQAREDDIKEKVENWMSKESESRLKRISTELLNEYNDVDLVAALLQELVEANDEVEVQLTFEKPLSRKGRNGKPSGSRNRNSKRGNPKFDSKSKRSKGYSSKKKSTKKFDRKEKSSGGSRPMKGRTFADHQK

SEQ ID NO: 79477 - protein, 449 aa, Carboxydothermus hydrogenoformans Z-2901
MYLVVVGVNHRTAPVEVREKLSFSDHQLKDAFSALLSYPSIDGSVILSTCNRTEVYVASLDVDTGLKVVREFLANWAGLSLSDIKNYTYNYTLYDAVHHLFRVASGLDSMILGETQILGQVRDAFLKASSLKASNKILNTLFQHAITVGKKVRTETGIDKNPVSISYAAVQLACSFFGSLKDKKALLIGAGKMSSLTAKHLSYYGIKEIIVANRSFEKAEQFAREFNGIAVPFAKIYDILAEVDLVISCTGAPHLIIHKEQLELVIGNRQHPLYLIDIAVPRDIDPEIAKLPNVFLYDIDKLQNVVTKNLEERKKLAEMAENIIETELKAFIEWHSTQFVVPTIVALKKKAEEIKQKELTKALNKLGNISEREKNIVCALAHTILNQLLHTPIVKLKQYALTPQGHLYTEILQNLFDLQVEGERPKNFTHPREEMEESDEKRSYCGESR

SEQ ID NO: 79478 - protein, 482 aa, Neisseria meningitidis MC58
MNGDIGVIGLAVMGQNLILNMNDCGFKVVAYNRTTAKVDEFLNGAAKGTNIIGAYSLQDLVDKLEKPRKIMMMVRAGSVVDEFIEQLLPLLEEGDILIDGGNANYPDTTRRTHYLAEKGILFVGAGVSGGEEGARRGPSIMPGGDKRAWDAVKPIFQAIAAKTSQGEPCCDWVGKDGAGHFVKMVHNGIEYGDMQLICEAYQFMKDGLGLSYDEMYRVFAEWNKTELDSYLIEITAAILGYKDEGGEPLVEKILDTAGQKGTGKWTGINALDLGIPLTLISEAVFARCVSSFKEQRVQTGKLFARTVTPVEGGKQEWVEALRQALLASKIISYAQGFMLIREAGESYGWDLDYGNTALLWREGCIIRSAFLSNIRDAYENNPDLVFLGADPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 79479 - protein, 304 aa, Prochlorococcus marinus subsp. marinus str. CCMP1375
MKSNNLATEGINSLPLDHGENDAIRVSVLSEALPYIQKFAGRRIVIKYGGSAMSKESLKEAVFRDIALLSSVGAQPVIIHGGGPEINHWLTKLEIKSEFRDGLRITDSNTMDIVEMVLIGRVNKQIVNGINKVGASAVGLCGIDGKLIEARPWGDGSYGLVGEVARVNADVIEPLIANGYIPVISSVASSVEGINYNINADTVAGEIAAAIGAEKLILLTDTSGILKNKSDPLSLIQNIRLSDMRELIDKEVVNGGMTPKAECCIRALAQGVNAAHIIDGRIPHALLLEVFTDKGIGTMIVSRS

SEQ ID NO: 79480 - protein, 244 aa, Erwinia carotovora subsp. atroseptica SCRI1043
MSFEGKIALVTGASRGIGRAIAETLVARGAKVIGTATSEKGAEAISSWLGENGKGYMLNVADAASVESVLAEIRAEFGEIDILINNAGITRDNLLMRMKDDEWHDILDTNLTSVFRMSKAVMRAMMKKRFGRIITIGSVVGTMGNAGQANYAAAKAGLIGFSKSLAREVASRGITVNVVAPGFIETDMTQALTEEQRAGILTSVPANRLGDAKEIASAVVFLASDEAAYITGETLHVNGGMYMI

SEQ ID NO: 79481 - protein, 78 aa, Erwinia carotovora subsp. atroseptica SCRI1043
MSTIEERVKKIIVEQLGVKQEEVVNNASFVDDLGADSLDTVELVMALEEEFDTEIPDEEAEKITTVQAAIDFIQANQQ

SEQ ID NO: 79482 - protein, 338 aa, Zea mays
  misc_feature (272)..(272): Xaa can be any naturally occurring amino acid
MGKIKIGINGFGRIGRLVARVALQSEDVELVAVNDPFITTDYMTYMFKYDTVHGQWKHSDITLKDSKTLLFGEKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPXLKGIMGYVEEDLVSTDFTGDSRSSIFDAKAGIALNDHFIKLVSWYDNEWGYSNRVVDLIRHMFKTQ

SEQ ID NO: 79483 - protein, 383 aa, Wolbachia endosymbiont strain TRS of Brugia malayi
MQDTVLVLQDGKCFLGKSIGKKGKCIGEICFTTGITGYQHTITDPSFADQIIMFTFPHVGNVGINDKDNEGKKIFASGVIMRELSPASHPSSYVSLSDWLEKSNLVGISGVDTRALTRHLRKHGPQNGIICPLIHSNVTTVCNTCTYDDQAILVIKGLLDELKKHKPVNGIEITDRVSLNNNFKSDLNAKYKVAVVDFGIKASIVSRLIELDCAIELIKPDRGFAQKILSMCPDGIVLSNGPGDPQEIGKSVTPEIDVIVKSKIPILGICMGHQLLAITLGAKTIKMNVGHRGSNHPVYNVSSDKVEITSQNHGFVFDPSSLPNNVEVTHISMFDNSIEGIMAKDYPVFSVQYHPEEAPGTHDSHYLFRRFIDNIALYKVKSA

SEQ ID NO: 79484 - protein, 180 aa, Alkaliphilus metalliredigens QYMF
MNFPNILTTLRFGLVPLFIVTFFSDSPNNVLHSAYIFIFAGFTDVLDGYIARKYNAITKWGQAMDPLADKAMQLTVLLCFTIRGIIPMWAITIIGIKELLMIGGAAFLYIQKDKIVVPSNSYGKLATILFYVAILAIVFGFSYGRELMMMVIIITAYAFVRYLMEALKQMKANKEKINLN

SEQ ID NO: 79485 - protein, 326 aa, Magnetospirillum magnetotacticum MS-1
MLLVTGGAGYVGSHTLHHLIRNGYSPESIIVVDNLCRGSRDAVPHGVHFAEVDLLDTEVLVELFRRHDVSAVIHFAGFAYVDESMADPTAYYRTNVVAGLSLLEAMVRVGCRAIVFSSTCATYGTPSSVPIAESEPQIPINPYGETKLVFERALEWYERCHGIRHVILRYFNAAGAAYGVGSYGNHDVRMIPAAVLAAMGRRPPVKIFGTDYETSDGTCVRDYVHVADLAEGHCLALEHLREDGASTALNLGSGRGSSVLNILEAVHRIGGRPVPNEKSPRRLCDPPTLIADTRLAQRILGWHPAYTLDDIISSVWHWHQSMVMAR

SEQ ID NO: 79486 - protein, 374 aa, Carboxydothermus hydrogenoformans Z-2901
MSGRSCKGPFKILVLPGDGIGPEIIKEAVKVLKALGEKKGITFNFQYGLIGGAAIDERGVPLPEETVELGKQCDAILLGAVGGPKWDNLPPEIRPELGGLLKIRKVFDLYANLRPVMFFPELKNASPLKPDIIEGVDILMVRELTGGLYFGEKKRFTTEQGEQAVIDTLIYTEKEVERVVRLGFELAQKRRGKLTLVDKANVLESSRFWREITGEIKKEYPDVELSYMYVDNCAMQLIRNPRQFDVIVTENMFGDILTDEGSVLAGSIGLLPSASLNGKFGLYEPIHGSAPDIAGQNKANPLATILSAGMMLRYSLDCPEEALLIEKAVKAVLQKGYRTGDILEPGTTLVTCEEMGDLVAEEILGGVYDEGLPL

SEQ ID NO: 79487 - protein, 573 aa, Neptuniibacter caesariensis
MRPLAEYFPLLGWLKDYQRETFISDLMAGVIVAILLIPQAMAYALLAGLPAEYGLYASIVPLYLYSLLGSSRSLAVGPVAIASLMVSTAISQVAEQGSADYLNAAINLSFLVGIILLVLRSLRLGSVVNFISHSVLSGFTSAAAIVIAVSQLKHIAGLDTPRASTLDQNIENLLQHSQDTNLTTVLLAGFAFFTLWYCKNSLCCHLQRMAMPDWLVQPICKAGPMFAVLFGTLIVWQLDLKTQAGVTTVGMIPQGLPGLKGIHLDLELWKQLFTPALLIALIGFLESVSVGTALASKRQERIDPNKELIALGAANIGSALSGTYPVAGGFGRSMVNHSAGAQSTVASLVSATLVAITVAFFTPLFYYLPNTVLAAIIIMAVIPLVDLQAFKTSWTFNKADALTLSTTFLMVLFLGVELGILMGIAISIALLLYRSSQPHIAVVGRVGASEHFRNVTRHDVVTDTSTLALRVDESLYFANTRFVEEFILKHCADNPEIKHVVLICTAVNFIDASALETLEQLVKNLRDDEVVLHLSEVKGPVMDQLNSTRFVEQMGQGKIYFTTDQAMRELAGI

SEQ ID NO: 79488 - protein, 511 aa, Glycine max
  misc_feature (484)..(484): Xaa can be any naturally occurring amino acid
  misc_feature (492)..(492): Xaa can be any naturally occurring amino acid
MAQPTTRIGLAGLAVMGQNLALNIAEKGFPISVYNRTTSKVDETVERAKQEGNLPVYGYHDPEAFVHSIQKPRVIIMLVKAGAPVDQTIKTLSAYMEKGDCIIDGGNEWYENTERREKEVAELGLLYLGMGVSGGEEGARNGPSLMPGGSFEAFKYIEDILLKVAAQVPDSGPCVTYIGKGGSGNFVKMIHNGIEYGDMQLIAEAYDVLKSVGKLSNEELQSVFSEWNKGELLSFLIEITADIFGIKDDKGDGYLVDKVLDKTGMKGTGKWTVQQAAELSIAAPTIEASLDARFLSGLKEERVEAAKVFKSGGIGDIVTDQPVDKQKLIDDVRKALYAAKICSYAQGMNLIRAKSIEKGWDLKLGELARIWKGGCIIRAIFLDRIKQAYERNPNLANLLVDPEFAKEIIDYQSAWRRVVCLAINSGISTPGMSASLAYFDTYRRERLPANLVQAQRDYFGAHTYERVDIEGSYHTEWFKLAKQXKKLDYCIXANQDFPNKCNIFCSDCMLS

SEQ ID NO: 79489 - protein, 221 aa, Guillardia theta
MNTKNVMNNDNWLPVTKLGRLVKQKKIKSIEEIFYFSIPIKEHQIIDFLIKNLSDDVLKVMPVQKQTRAGQRTKFKAIVAVGNYDGILGLGVKSSKEAGNAIKGAIITAKMAVVPAKKGHWNIDKGIPYTIPVKVTGKSGSVRLRCIPAPKGSGIVAGKIPKKLLSMAGYKDIFTSSRGHTRTIGNFAKATYNAVYLSYCFNAPEYWIKHRLIKNPLADVE

SEQ ID NO: 79490 - protein, 195 aa, Vibrio campbellii AND4
MLLIIDNYDSFTYNLYQYFCELGADVKVVRNDEIDIQGIEALNPTHLVISPGPCTPNEAGISLQAIGYFAGKLPILGVCLGHQAIAQVFGGQVVRARQVMHGKTSPIRHNGRSVFKNLNNPLTVTRYHSLVVKSDTLPDVFELTAWTELPDGTKDEIMGYQHKTLPIDAVQFHPESIKTEQGHALLANFLARKAI

SEQ ID NO: 79491 - protein, 671 aa, Galdieria sulphuraria
EMVQPSSFVTNLVHSSSHWKGTKRQSVSRKNNVAHFCPKETSRFSQASGRTKCCHKHGSETFYRNEAASNNELSGTARVELSEHNERLALSSYPAVPFPQHLSSNQTSLSLLATAIVATLGQWFGKLVRSKAKDVDLLSPQFLQANGSAGSTDGSASVGADGIAKALPPKNELKKILPLGVMFFMILFNYTILRDTKDVLVVTTTGAEIIPFLKTYANLPGAVLFTIAYSKLSNMFDRETLFYVCIVPFILFFLSFAFVLYPLRHALHPYAFVDWIAGYLPASFFAPLGIIRNWTFALFYTLAELWGSVVVSLLFWGFANEVTSVDEAKKYYPLFGLVANVALIFSGQYVRFVSDIRRKLPPGVDGWGVSLKYLMTMIGVAGSVIILAMLYIQKNVLTDPNCVDMSKRKNTKQKTKLGLKESAVYLAKSAYIRNLALLVIAYGMSINIVEVSWKSKLKEAFPDPNSYSTFMGWFSTCTGSVTLIMMLLGRFIFRKFGWGFAALITPTVLGITGFLFFCLTLFSRQLHPVVGMLGTTPLMLAVLVGAAQNILSKSSKYSLFDPCKEMAYIPLDAEQKSKGKAAIDVIGNPMGKSGGSFIQQGLIFAVGSLAASTPYLAFILFVIVGMWIAAARSLDKQFQEAMKRSEVAEVMAKTGIQDPIEAAKVAKESKQ

SEQ ID NO: 79492 - protein, 403 aa, Vibrio campbellii AND4
MTMENKVERGLFDEVMVPCYNPMEMVPVKGKGSRVWDQNGNEYIDFAGGIAVSCLGHCHPVMVNALTEQGNKLWHLSNVMTNEPALRLAKKLTEVSFAERVFFANSGAEANEAALKLARRYAADVHSNEKSEIIAFKQGFHGRTFFTVTVGGQAAYSDGFGPKPGDVTHLPYNDIEALQAHMSERTCAVMMEPLQGEGGIIPPTPEFAQAVRELCDKHNALLIFDEVQTGNGRTGHFYAYQGLGITPDILSTAKSLGGGFPIGAMLTTAKLAEHMKVGTHGSTYGGNPLACAVAEAVVDEVTKPEVLAGVLERETMFREGLEKINAKYHIFSEVRGKGLLLGAALNEDWQGRARDVLVAAGKQGLMVLVAGANVVRFTPSLVITPQEIEEGLAKLDKAIATLV

SEQ ID NO: 79493 - protein, 902 aa, Rhizobium leguminosarum bv. viciae 3841
MTKWVYRFGDGQAEGRARDHEVLGGKGANLAEMCALGLPVPPGLTIVSDACNTYYKNGRHIEDQVKAEVRAGIAAIEAITGRRFGSVSQPLLLSVRSGARVSMPGMMDTVLNLGLNDETVQALGHDAGDARFAWDSYRRFIQMYADVVMGLGNDAFEEILEDEKAKLGHEFDTELSASEWQHIVSLYKKLIEEELEQEFPQDPEVQLWGAVGAVFASWMSARAVTYRHLHNIPEGWGTAINIQAMVFGNLGNASATGVAFTRNPSTGERALYGEFLVNAQGEDVVAGIRTPQSITEEGRISSGSEKPSMEKLMPEAFRELCRICTELEIHYRDMQDIEFTIERGKLWMLQTRSAKRSTRAAMKIAVDMVDEGVITEDEAVLRIEPSSLDQLLHPTIDPRVTRQVIGSGLPASPGAATGAIVFTAEEAVEAESEGRKVILLRVETSPEDIHGMHAAEGILTTRGGMTSHAAVVARGMGIPCVVGAGTMRIDVRNERLLGVGVTLKKGDIITIDGSAGQVLKGEVPMIQPALSGDFGRIMGWADRARRMTVRTNADTPADALAARSFGAEGIGLCRTEHMFFEGERIHVMREMILAVDEKGRRVALDKLLPMQRLDFTGLFTVMHGLPVTIRLLDPPLHEFLPKTDDEVAEVAFAMGMEASVLRQRVDALHEFNPMLGHRGCRLAISYPEIVEMQARAIFEAAVAAAKETGAAVVPEIMVPLVGLRTELDYVKARIDEVAGAVMNEAGMKIDYLVGTMIELPRAALRAHVIAEAAEFFSFGTNDLTQTTFGISRDDASAFIPTYQRKGIIEHDPFISLDFDGVGELISIAAERGRRTRNDMKLGICGEHGGDPASIRFCETIGLDYVSCSPFRVPIARLAAAQAVIAGSLEDVRRGPKDLRASV

SEQ ID NO: 79494 - protein, 263 aa, Vibrio campbellii AND4
MTPDVLFESLWQDYIQRLCPSAAKVHQLLQEDEPLINDHIALRTFNVEPLGIETLAKPFLAVGYKACGDYVFESKKLVAKHFEHPDPKQPKVFISELKVDECSSELQTIVHRLVEQIKVSKLQGSDFLYGGRLWDLSYADFQTLAKESEYASWLAAHGYGANHFTVSVNQLDQYQEVKQVNDYLRTTGFTINENGGEVKGTPEVLLEQSSTMADKVPVTFTEGIEVIPGGFYEFAKRYPMDNGELYPGFVAASADKIFESTNG

SEQ ID NO: 79495 - protein, 371 aa, Candida albicans SC5314
MTTSPYPIETPFKVCIVGSGNWGTAVAKLVAENCAEKPNIFQRDVKMWVFEEEIEGRKLTEIINTEHENVKYLPEIKLPTNLVANPDIVDTVQDADLIVFNIPHQFLGRIVKQIEGKVKPTARAISCLKGLDVSPEGCKLLSTSITDTLKIYCGVLSGANIANEVAKGNWSETSIAYTVPEDFRGAGKDIDPFILKEAFHRPYFHVRVIEDVVGASIAGALKNVIACSVGFVEGAGWGDNAKAAIMRIGIKETIRFASYWELFKIKALSPPNPKTFTEESAGVADLITTCSGGRNVKVARYMIKNNVDAFEAEKIVLKGQSSQGILTAKEVHELLTNFNLQDEFPLLEATYKVIYENGSVDDFPQLLEGDQ

SEQ ID NO: 79496 - protein, 382 aa, Bacillus pumilus SAFR-032
MNVTKWLGAVLLSVLLLLTAACANTSTQEKNQNENETASNESKDKTTAVETGNKSLSNIKVLATGGTIAGSSDSDTDTTGYKSGALGIDKVIASVPQLKDIANVTGEQVANVGSENVDDALLLKLAKRVNKLLNDDQVDGIVITHGTDTLEETAYFLNLVVKSDKPVVVVGSMRPASAISADGPLNLYHAVKIASTKAAKGKGVMVTLNDRIASARFITKTNTTTTDSFKSLEHGYIGEIAGEVVSFYNEPTRKHTSESEFDVSNIKELPQVDILYGYQNDQKYMYDAAVKAGAKGIVVAAAGNGTMSTEAIKGATDAVKKDVVVVRSSRAGNGIVTHEKMDDEHHFVSSDSLNPQKARILLMLALTKTKDPSKVQTFYEKY

SEQ ID NO: 79497 - protein, 404 aa, Leptospira interrogans serovar Lai str. 56601
MDLSAKRLNVIEPSPTLVITAKANELKKKGEDIVSFGAGEPDFETPSHIRDAAKNAIDRGMTRYTAVSGTVELKEAIVHKFKRDNGLDYDKSQVIVGTGGKQVIYNYFLATLNAGDEVIIPAPYWVSYADIVRLAEGVPVIVNTTPEANFQITSEQLKKVITPKTKCLILNSPSNPTGAGYSKKDIEALGEVVLSTGIQVMSDDIYEKIVYDGFVFSNLAMLSPELKKQTFVINGVSKTYSMTGWRIGYGAGDLNIVKNMETIQSQSTSNPSSISQAAAQAAIAGDQSCVEEMRKAFQVRRDLIVSLLNAIPGVKCNNPQGAFYVFPYLTDVYKTTGFIKLKQGFSETSLSKIFCSTLLEKYKVAAVPGIAFGEDQALRLSYAMGENDIRRGVERIAEMIRDLN

SEQ ID NO: 79498 - protein, 289 aa, Vibrio campbellii AND4
MSAKHPIIAVTGSSGAGTTTTSEAFRKMFNMMNVKPAWVEGDSFHRFTRPEMDVEIRKAREQGKHISYFGPQANDFSGLETFFRQFGEDGRGSVRRYLHTFDEAVPYNQMPGTFTPWQDLPENSDLLFYEGLHGGVVDGDVNVARHVDFLIGMVPIVNLEWIQKFVRDTRDRGHSREAVMDSIVRSMDDYLNYITPQFSRTHINFQRVPTVDTSNPLDAKGIPSLDESFVVIRLRGIKNVDFPYLLAMIDGSFMSRHNTIVVPGGKMSFAVELIVRPILQQLIETGKIG

SEQ ID NO: 79499 - protein, 138 aa, Brassica napus
  misc_feature (18)..(18): Xaa can be any naturally occurring amino acid
  misc_feature (39)..(40): Xaa can be any naturally occurring amino acid
  misc_feature (46)..(47): Xaa can be any naturally occurring amino acid
  misc_feature (61)..(62): Xaa can be any naturally occurring amino acid
  misc_feature (69)..(69): Xaa can be any naturally occurring amino acid
  misc_feature (76)..(76): Xaa can be any naturally occurring amino acid
  misc_feature (83)..(85): Xaa can be any naturally occurring amino acid
  misc_feature (87)..(87): Xaa can be any naturally occurring amino acid
  misc_feature (89)..(90): Xaa can be any naturally occurring amino acid
  misc_feature (93)..(93): Xaa can be any naturally occurring amino acid
  misc_feature (99)..(102): Xaa can be any naturally occurring amino acid
  misc_feature (104)..(104): Xaa can be any naturally occurring amino acid
  misc_feature (106)..(107): Xaa can be any naturally occurring amino acid
  misc_feature (110)..(110): Xaa can be any naturally occurring amino acid
  misc_feature (116)..(117): Xaa can be any naturally occurring amino acid
  misc_feature (119)..(121): Xaa can be any naturally occurring amino acid
  misc_feature (124)..(124): Xaa can be any naturally occurring amino acid
MASSMLSSAAVATSPAQXTMGAPFTGLKSSAAFPVTRKXXTDITSXXSNGGKVNCLKGGPXXEKKIENXFFFLTYXGELAQKXXXLXPXXKGXPWGEFXXXXRXFXXREXGNTPGXXKXXXWKXGKFGPGGPPPFFFP

SEQ ID NO: 79500 - protein, 331 aa, Bordetella pertussis Tohama I
MDKHHAVATKYLAAGPNSPWLRNALRAWAYTWAMQTSAQRSPASATLDLGAAVDAAVTAAHAGAAILQSYAHHRSDLVIDRKARNDLVSQADRESEAAVISVLRERTPQFGIVAEETGGAAQGPATTWYIDPLDGTTNYLHGIPHYAVSIALVAHAGTRVVAGADLQEDTPVIGVVYDPSSEELFTAVHGIGSWLNGHRISCSRTSTLDDAVLATGFPFRDFSFAHQYMPMLHDAIRRTRGVRRMGAAALDLAWTACGRYDGYWEMGLAPWDVAAGTLLVREAGGVCTDMMRQQSWPSGGRVVAGNRHIHGALFDMVSPHLDAPAPDSSQA

SEQ ID NO: 79501 - protein, 227 aa, Zea mays
  misc_feature (15)..(16): Xaa can be any naturally occurring amino acid
EKAGSWVELISVSRXXTKWGLFPAYCYQSRLDGTEHIAVVKGDIGDGEEVLVRVHSECLTGDILGSARCDCRNQLELAMQPIQKAGRGVLLYLRGHEGRGIGLGQKLRAYNLQDEGHDTVEANVELGLAVDAREYGIGAQILRDIGVRTMRLMTNNPAKFIGLKGYGLAVVGRVPVISPITKENQKYLETKRTKMGHVYGSDLPGSLPEFANPQEAPTEQDDDDNQN

SEQ ID NO: 79502 - protein, 337 aa, Pseudomonas aeruginosa PAO1
MRVLVTGGAGFIGSHVLVELLGQGAKVVVLDNLVNGSSESLKRVERITGHPVGFVLGDVRDSLLVERLLIDEKVDAVIHLAGLKAVGESVDDPLEYYESNVQGTISLLRAMQRVGVFKIVFSSSATIYQMPGTLPISESSKVGGVASPYGRTKLTAEHMLDDLARSDTRWSIAVLRYFNPIGAHESGLIGEDPCGTPNNLLPYIAQVAVGRLSRLTVHGGDYPTIDGTGVRDYIHVCDLAAGHTRALEYLGQGHGYHVWNLGTGTGYSVLQVIEAFERVSGRRIPFTVSGRRPGDVAECWADVSKAERELGWKAGLGLECMIADAWRWQVSNPSGYS

SEQ ID NO: 79503 - protein, 539 aa, Vitis vinifera
MASIQEALASLRQEIGTEKKKKKKHKQSKIASNEVVEIGRKKKNEDYIIEEETEANRKRKLEETPTVTEAKKKKKEKEKKEKKEKEGEEEGLKDEDDKESRGACVAVTGKDAKESKYAAFKSFAESKLPDDVLECCRNFSQPSPIQSHAWPFLLDHRDFIGIAATGSGKTLAFGVPAMMHVLSKRKSKTSKGVNPLCLVLSPTRELAQQISDVLCEAGKHCGVKSVCLYGGTSKGPQISSLKSGVDIVIGTPGRLKDLIEMGVCCLTEVSFVVLDEADRMLDMGFEPEVRSILSQTCPARQMVMFSATWPLPVHQLAQEFMDPNPVKVVIGSEDLAANHDVMQIVEVLDDRSRDERLLTLLGKYHKSQRNRVLVFVLYKKEAARVENMLQRRGWNVVSIHGDKAQQARTAALSLFKKGSCPLMIATDVAARGLDIPDVEVVINYSFPLTTEDYVHRIGRTGRAGKKGVAHTFFMQENKGLAGELVNVLKEAGQIVPADLLKFGTHVKKKESKLYGAHFREIAADAPKSKKITFDDSDED

SEQ ID NO: 79504 - protein, 176 aa, Prochlorococcus marinus subsp. marinus str. CCMP1375
MDLTPLSPSPSLGLVNLVVEIPAGSRNKYEYFAEAGTMALDRVLHSSVRYPFDYGFIPNTLAEDGAPLDAMVIMEEPTFAGCLIKARPIGVLDMHDSGAYDGKLLCVPVADPRQKGITSIRQIAPNQLEDVAEFFRTYKSLEGRVVVIDGWRDHDVVDDLLQTCIDARKMDSRKSI

SEQ ID NO: 79505 - protein, 176 aa, Vibrio parahaemolyticus RIMD 2210633
MSLNHVPAGKSLPEDIYVVIEIPANADPIKYEVDKDSGAVFVDRFMSAPMFYPCNYGYVNNTLSLDGDPVDVLVPTPYPLMPGSVIRCRPVGVLKMTDESGEDAKVVAVPHSKISKEYEHIQDVGDIPELLKAQITHFFERYKELESGKWVKVDGWADVEAAKAEILQSYERAQNK

SEQ ID NO: 79506 - protein, 338 aa, Vibrio parahaemolyticus RIMD 2210633
MSGMRTLGEFIVEKQADFPHASGDLSSLLASIRLAAKIVNREINAAGLGDITGAVGTENVQGEAQQKLDVYANDKFKAALEARDQVCGVASEEEDEAVAFNKELNQNAKYVVLMDPLDGSSNIDVNVSVGTIFSIYRRVSPIGTPATEEDFLQPGHKQVAAGYVIYGSSTMLVYTTGNGVNGFTYDPSIGSFCLSHENMMIPEDGKIYSINEGNYIRFPQGVKKYIKYCQENVPEDGRPYTSRYIGSLVADFHRNLLKGGIYLYPSTQSHPQGKLRLLYECNPMAFLIEQAGGIASDGVNRIMDIKPTELHQRVPFFVGSKNMVRKVEEFLELHRDEE

SEQ ID NO: 79507 - protein, 519 aa, Brassica rapa subsp. pekinensis
MATMAAIGSLKVPSSSSNHTRRLSSSSQRKTLSFSSSSLTGEKLNPTQEIIISNLPRWQREKNAIDSPKAVSDSQNSQTCLDPDASRSVLGIILGGGAGTRLYPLTKKRANRAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEKRSTAFGLMKIDDEGRIIEFAEKPKGEQLKAMKVDTTILGLDDERAKEIPFIASMGIYVVSKNVMLDLLRDQFPGANDFGSEVIPGATDLGLRVQAYLYDGYWEDIGTIEAFYNANLGITKKPVPDFSFYGRSAPIYTQPRYLPPSKMLDADVTDSVIGEGCVIKNCKIHHSVIGLRSCISEGAIIEDTLLMGADYYETDADRTLLAAKGRVPIGIGENSHIKRAIIDKNARIGDNVKIINTDNVQEAARETDGYFIKSGIVTVIKDALIPSGTVI

SEQ ID NO: 79508 - protein, 383 aa, Carboxydothermus hydrogenoformans Z-2901
MKFSTGIFDELSMLIKKVSKERDVINLSIGSPDLPPHPKIIEVLAKEVQDFQNYGYTLNPGLEELREGLIAWYQKKYGVNLKIDETLVLLGSQEGLAHLPLSFLNPGDLVLVPNPGYPIYEAAAKLAGAKIYYYPLLEENNYRLDIEKIPYDILRTAKIIFLNYPNNPLTAMANYEFFEKLVFYAKKYGFILVNDLAYGELTFDETRSISLLEIPEAIDVAVEFYSVSKSFNLAGIRVGFAAGNQKVISALTILKSNIDYGVFKPLQKAALEAFKLREVIIPDLVKTYEKRRNVLIKTLSEYGWQVKPPLATMFVWAQLPDGIKDSRKFSLDLLTNAGVAVTPGIGFGDLGEGYVRIALVADEDKLAEAGKRIGEYLQYRRVV

SEQ ID NO: 79509 - protein, 299 aa, Rubrobacter xylanophilus DSM 9941
MENLASAGRWERHRRIFEEYLEGLRFTEEPALERLQEAMRYSLLAGGKRVRPLLCMESARLFGAPPERVLPSAAAIELIHTYSLIHDDLPAMDNDDFRRGRPTSHKKFGEAMAILAGDAFFGEALTLITVRQEGTCEQRLGVVQELASSTGVNGMVGGQVLDMDQTGAGGSADPGMLFMIHRYKTGALIRSSARVGAILAGAGEEGLEAISRYATELGLCFQIVDDVLDAVGSSERLGKRAGGDAERGKATFVSVFGLEGARREADAACERALRALGRLEGRDTSALGELALFVRHRGS

SEQ ID NO: 79510 - protein, 442 aa, Prochlorococcus marinus subsp. marinus str. CCMP1375
MTLRLLLIRHGLSSYNLEHRIQGRNDLSTLTTKGTLQASKAGESLRSLHIHAVYTSPLQRAADTAKELIKNRNGELIPILDNDLLEVDLEPWSGLTIDEVKNKFSDLYSTWKHHPKELILHRKNGNSYKPIKELMDQAERFLKKIISTHHPDKNETVLVVGHNAILRCLILKMFKEPAEGFRRIKLDNSSISVFNINTDIENKAEFQVESLNSTSHLTPQIPPKGSFARIFLVRHGETNWNKEGRFQGQIDIPLNENGQKQALAASNFLKNVKFNQAFSSSMSRPMETAKIILRNHPTIEIKQQDELVEIGHGLWEGKLEAEISSEWGDLLKRWKKSPETVQMPEGETIGDVSSRAMNCFRHIAQRLSPNDTALIVAHDAVNKTILCNLLGLTNADIWKVKQGNGGITIIDLTEEQEPDIITCLNITSHLGDVVDRTAQGAL

SEQ ID NO: 79511 - protein, 110 aa, Zea mays
  misc_feature (54)..(54): Xaa can be any naturally occurring amino acid
MKKTKKRVVDVAGAPGTLYTGETYKLQVDFSEHYPMEAPQVIFLHPAPMHPHIXYSNGHICLDILYDSWSPAMTVSSICISILSMLSSSPAKVTYFLYISLFNRWVLLSD

SEQ ID NO: 79512 - protein, 470 aa, Bacillus pseudofirmus
MNTGHITQVMGPVVDVKFKSGQLPEINNALKVVQVGADKNAVDVTVTLEVALHLGDDSVRTVAMGSTDGLVRGTEALDTGAPISVPVGEATLGRVFNVLGEAIDLGEPVAADVKRDPIHREAPKFEELSTTTEILETGIKVVDLLAPYIKGGKIGLFGGAGVGKTVLIQELINNIAQEHGGISVFAGVGERTREGNDLYHEMTDSGVIKKTAMVFGQMNEPPGARMRVALSGLTMAEHFRDRDGQDVLLFVDNIFRFTQAGSEVSALLGRMPSAVGYQPTLATEMGQLQERITSTKVGSVTSIQAIYVPADDYTDPAPATTFAHLDATTNLERKLSEMGIYPAVDPLASTSRALSPEIVGEEHYSVARQVQQTLQKYKELQDIIAILGMDELSEEDKLVVHRARRIQFFLSQNFHVAEQFTGQKGSYVPVKETIKGFKEILDGKYDDLPEDAFRLVGRIEEVIEKGKQMA

SEQ ID NO: 79513 - protein, 248 aa, Oryza sativa Indica Group
MSGNIAFGRFDDSFSAASLKAYVAEFISTLVFVFAGVGSAIAYTKLTGGAPLDPAGLVAVAVCHGFGLFVAVAIGANISGGHVNPAVTFGLALGGQITILTGVFYWVAQLLGAIVGAVLVQFCTGVATPTHGLSGVGAFEGVVMEIIVTFGLVYTVYATAADPKKGSLGTIAPIAIGFIVGANILVAGPFSGGSMNPARSFGPAVASGDYTNIWIYWVGPLVGGGLAGLVYRYVYMCGDHAPVASSEF

SEQ ID NO: 79514 - protein, 496 aa, Physcomitrella patens subsp. patens
MLETKVIAHHVSHSPCAAIPGGLPVLGNLLQLTEKKPHRTFTAWSKEHGPIFTIKVGSVPQAVVNNSEIAKEVLVTKFASISKRQMPMALRVLTRDKTMVAMSDYGEEHRMLKKLVMTNLLGPTTQNKNRSLRDDALIGMIEGVLAELKASPTSPKVVNVRDYVQRSLFPFALQQVFGYIPDQVEVLELGTCVSTWDMFDALVVAPLSAVINVDWRDFFPALRWIPNRSVEDLVRTVDFKRNSIMKALIRAQRMRLANLKEPPRCYADIALTEATHLTEKQLEMSLWEPIIESADTTLVTSEWAMYEIAKNPDCQDRLYREIVSVAGTERMVTEDDLPNMPYLGAIIKETLRKYTPVPLIPSRFVEEDITLGGYDIPKGYQILVNLFAIANDPAVWSNPEKWDPERMLANKKVDMGFRDFSLMPFGAGKRMCAGITQAMFIIPMNVAALVQHCEWRLSPQEISNINNKIEDVVYLTTHKLSPLSCEATPRISHRLP

SEQ ID NO: 79515 - protein, 357 aa, Cryptococcus neoformans var. neoformans JEC21
MSHRALSAPLRALRGTRLQQTATRCASTKTPAPPKPIDDSTSALDYKLHKHGRRLPHLVTQHPRSPSAEEAVTNILYNTPPPSTEPFKRHRLNCLVQNEPGVLSRVSGILAGRGFNIDSLVVCQTEIRDLSRMCIILKGQDGVIEQARRQLEDLVPVWAVLDYTKTSCVERELLLAKVSILGPEFAEAQLSGPIPDASFEHAVENQSPENPPSFVAQGEPQGDDKIQRELALARSFESAAQPAPTGALYPNRSAAGQDMSASEALIAKNLHLSAIKTLADQFGGRVVDVAENSCIVELTAKSSRVDSFLSLMRPFGVLEAARSGVMVLPRTPIPRYSEEDDLAAEKEEIDISLLPPG

SEQ ID NO: 79516 - protein, 492 aa, Physcomitrella patens subsp. patens
MEQGNGSGSRDLEKPLLAKKEKEGSEEPRTSHHRRHTLRSRRDAVLPNSGYAIFSTLMVALGPLALGFAIGYTSPTQVAIIKDLNFTIAQFSTFGSILNVGCMIGAILSGRIADYFGRKRALLLAALPLLAGWSLIVLGKTATPLIIGRILNGFGGGIISFSVPMYIGEIAPKHLRGTLGTMNQLAITIGITLSYVFGMLFNWRVLGLLGCIPEVSLIVGLLFIPESPRWLAKAGKKEELSLCLQKLRGKDFNTTQEIADIQAAMEALNALPSVKLSDLKERKLSRPLVAGIGLMVLQQFSGINAFMLYSSGIFATAGVSNPDIASVALGTLQVFMTLAAAGLMDKAGRRILLMISAGGMALSCFLVGFSFYLRVSLSYSLNFSALMPLSVSCLNIIVYIATFSLGIGAIPWIIMSEIFPAHVKGIAGSVATLVNWFCAYAITMIFNYMLLWSAIGSFWLFAAECIGTVIFVAMFVPETRGRTLEQIEASFK

SEQ ID NO: 79517 - protein, 194 aa, Helicobacter pylori 26695
MKIFFIDNFDSFSYNLVYELECLGYEVAVYQNDIDPSYLMDLMNEESKTPLLFISPGPGNPNSSGNLLKIIAMAKKKFPILGICLGLQALAQSYGAKIIRSKEIVHGKATAIALKKHAVFKGLGESMVVGRYHSLMASGLPKNLEVIAEHDNIPMAIVNEEDKILAYQFHPESIMTLQGRALLEQSVGFLEGLL

SEQ ID NO: 79518 - protein, 201 aa, Craterostigma plantagineum
MEAMSFAARSTVLSISKSFPKNNSPTYLTLRPKFSRVRFTTVASQSQGRQQVSENAEDAKKKFSETTDSLKHKTSEATDSASHKANGAARETNDKAKETYNAASGKAGELKDKTQEGAENVREKAMDAGNDAMEKTRNAGERVADGVSNVGQNVKENVMGAGEKVKEFAEDVKDTVMGKSEEVKNQAEHETKKRSTSTNYF

SEQ ID NO: 79519 - protein, 476 aa, Prochlorococcus marinus subsp. marinus str. CCMP1375
MIEAYAHNYLKNLLKEDDLIWPHNLTLSRLVSRSLRRRDKSIFQLEISNHEDYWLGVLIPLCLQSFGAVLVVTSSQKNRLFQVEIPRLKEEGLTLPIWEGADPPLDGKVWVLDFVGFVNAFRKNHLSSRQLIIPEGEFFSRRIREAMAIHVSSSHWDCLRRAYPSTSSALINLYERLSRRLFSQAIRPDALVRIDLSDVLRLKDLLGVLPQPPAPWADVLDATNQRWASWAELDYKLLDWTWHLQPLEPLHILHKLFIDNPFVLLSGAFQHELGCLDTLANVKVKLGSPIYQDPIKLFVPYRQPLPNAECFTEHLLEQSRRLILGRQGLTVILLDDLRLLRQLTSELASEFGTRVVYESTAPDSNGVICCTSSWWLASHIHLPSPEQLILALLPISSLETPLTASRVEAFKQQGRDWFRDLLLPECLGLLPRLVLPVRKNQGRIAVLDGRLRSRAWGMKVFDALEPWTPLERLLPD

SEQ ID NO: 79520 - protein, 639 aa, Vibrio campbellii AND4
MITFSDIQLLRGGKPLLDQASATIHPGDKVGLVGKNGCGKSTLFALLKDQLSIDAGSFSQPQHWELAWVAQETPALDRSALEYVIDGDREFRELENQLAIAEEKDNGTLVAEIHGKIETIGGYSIRARAAELLDGLGFSQDQMSWNLTQFSGGWRMRLNLAQALLCRSDLLLLDEPTNHLDLDAVMWLERWLQSYPGTLILISHDRDFLDPIVGRIIHIENQQLNEYTGNYSSFENQRAQKMLLQQAMFEKQKKQMSHMQSYIDRFRYKASKARQAQSRIKALERMEKVLPAQFDNPFSFQFRDPAALPNPIMMMDQVSAGYGDKLILEKIRLNLVPGSRIGLLGRNGAGKSTLIKLLSGELTTQGGDLTYSQGVKIGYFAQHQLETLHPEETPLQHMMQIAPDQTEQQLRDYLGSFGFRGDKALEKVAPFSGGEKARLVLALIVWQKPNLLLLDEPTNHLDLDMRQALTMALQTFEGAMVIVSHDRYLLRATTDDLYLVHDRQVAPFDGDLNDYYKWLTEQQKAERKEAQAAQPVKDNTNSAAAKKEQKRRDAEFRKQTAPIRKTLTQLENKMDKLGEALAKAEQQLADNTLYEAENKAKLNQVLALQASSKADLEAIEMEWMSAQETLEQMELEFNQ

SEQ ID NO: 79521 - protein, 633 aa, Physcomitrella patens subsp. patens
MAQACASHTPHIPHVSRMLRISSRFLQQFQRGRNRRKRTGNKNNRRVTATTSSTAPSASSASCAVSATAAGSGSSGSSSSSSPATCSFGCACRQFAGQDCFKGAALVMMVEFLREGWVDLTCVRTRKRAAGVLSEGGSGSFRVASPHARATPLFGGCFVVPEPVLYRPSCLGSKIGDMTSGTRLPTWKERENNKRRERRRRAIAAKIFAGLRLYGNYKLPKHCDNNEVLKALCVEAGWTVEEDGTTYRKGSKPPAQPMEVCTSPSEASPTSSYPGAAEGTSLIPWLKGLSSNGGSGTATPSSSAGLPPLHVMHGGSSSAPVTPPLSSPTHRGPPVKPDWDHIKDADHHSHGFPPSGPPTWNHHPFLAAAAAAAQAAASNQSHLRPGYCDTPDGARTPIEEAESEISPGTALEFATVCGSNSSKWANGVRVRTSSGGRLLGGMAGLGPFPSANNDSPLETFSHAWRNPMQKSISMPVSPVSSRMKGSFGDRLGRCPSELELSGAVQGLGSLWELDGVVPEVGAKRKLPADDLELKLIAGGLVPIATEVVQVKLWVFQAVHLKDVGLVSVVYFVGLHLLEPLHEGALYSSTTLILQFNAVKSALFVSESGSASSTPKNRAEVFPVTSATELSRQL

SEQ ID NO: 79522 - protein, 497 aa, Saccharomyces cerevisiae
MGHHHHHHMSADFGLIGLAVMGQNLILNAADHGFTVCAYNRTQSKVDHFLANEAKGKSIIGATSIEDFISKLKRPRKVMLLVKAGAPVDALINQIVPLLEKGDIIIDGGNSHFPDSNRRYEELKKKGILFVGSGVSGGEEGARYGPSLMPGGSEEAWPHIKNIFQSISAKSDGEPCCEWVGPAGAGHYVKMVHNGIEYGDMQLICEAYDIMKRLGGFTDKEISDVFAKWNNGVLDSFLVEITRDILKFDDVDGKPLVEKIMDTAGQKGTGKWTAINALDLGMPVTLIGEAVFARCLSALKNERIRASKVLPGPEVPKDAVKDREQFVDDLEQALYASKIISYAQGFMLIREAAATYGWKLNNPAIALMWRGGCIIRSVFLGQITKAYREEPDLENLLFNKFFADAVTKAQSGWRKSIALATTYGIPTPAFSTALSFYDGYRSERLPANLLQAQRDYFGAHTFRVLPECASDNLPVDKDIHINWTGHGGNVSSSTYQA

SEQ ID NO: 79523 - protein, 598 aa, Vibrio campbellii AND4
MAITSEFLQSSVVFLSAAVIAVPIAQRLGLGSVLGYLIAGVLIGPWGLGLISDVDAILHFAELGVVLLLFLIGLELNPKKLWQMRGPILGLGGAQVIVTTAVIGSIVSLFGLSMQVSLVIGMGLALSSTAIALKVIEEQGQAGTETGQSGFAVLLFQDIAVIPMLAMLPLLAGGQSGGDWLDALWVLASVVALLVGGHFLLRPLFRFVVMSGVRELFTVAALLVVLGISVAMQKLGLSMALGTFLAGVLLAESEYRHELEIAIEPFKGLLLGLFFIAVGMAVNLGLLALQPFAIIGAVIALVVVKGVVLYVLARTARVRAKSRSRMAAILSQGGEFAFVIFTAASQEGILTKEQVAFLLVVVSLSMVTTPLLLMGQKKWFAHTLNQEEESVATNVVDRQPRVIIAGFGRFGQIVGRLMYANKIKVTVLESDASQIHLLRKYGYKVFYGDATQIDLLRAAGADKAEALVICTDSPDEVMAIADICCVHFPKLKILARARSRVEAYQLMNHGVHNYSRETFLGALDLGRQALVELGMHPYQAKRAEAHFRKLDNAMLKDLLPRHNEDKELAQRSKEARKELEEIFGREMESDQQSPNHWK

SEQ ID NO: 79524 - protein, 237 aa, Bacillus cereus E33L
MKKYALVTGGSGGIGSAISKQLIQDGYTVYVHYNNSEEKVNELQKESGEVIPVQANLASTDGAEQLWKQIEHPLDVIVYAAGKSIFGLVTDVTNDELNDMVELQVKSIYKLLSMALPSMIQRRSGNIVLVSSIWGQIGASCEVLYSMVKGAQNSYVKALAKEVSLSGIRANAVAPGAIETEMLNVFSEEDKNEIAEEIPLGRLGLPEEVAKTVSFLVSPGASYITGQIIGVNGGWHC

SEQ ID NO: 79525 - protein, 444 aa, Glycine max
MATIVSINARQIFDSRGNPTVEVDLTCSDGTFARAAVPSGASTGIYEALELRDGGSDYLGKGVSKAVDNVNTVIGPALIGKDPTEQTAIDNLMVQQLDGTVNEWGWCKQKLGANAILAVFLAVCKAGASVLKIPLYKHIANIAGNKKLVLPVPAFNVINGGSHAGNKLAMQEFMVLPVGASSFKEAMKMGVEVYHNLKSVIKKKYGQDAINVGDEGGFAPNIQENKEGLELLKTAIAKAGYTGKVVIGMDVAASEFYKEDKTYDLNFKEDNNDGSQRISGDALKDLYKSFVSEYPIVSIEDPFDQDDWEHYAKLTAEVGANVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 79526 - protein, 473 aa, Psychrobacter arcticus 273-4
MAKRLENSFQFLDVPRLEPIKKDIATRSTEFVEIYQPFESESVAQQSHRCLECGNPYCEWKCPVHNYIPNWLKLAAEGQIFQAAELCHQTNTLPEVCGRVCPQDRLCEGSCTLNDGFGAVTIGNVEKYINDTAFALGWRPDMSEVIWTDKKVAIIGAGPAGLGCADILVRNGVKPVIFDKRPEIGGLLTFGIPEFKMEKDVMRNRRVIFEGMGMEFRLETEIGTDVSIDELLGEYDAVFMGMGTYTYMRGGFAGEELEGVYDALDYLIANVNRCNDWEKDPAEYIDLKGKKVVVLGGGDTAMDCNRTSIRQGAHQVVCAYRRDEENMPGSRREVVNAREEGVEFLFNRQPTEIIGLNGKVNAVKVVTTQLGAPDENGRQYPEPIANSEEIIPCDAVIMAFGFSPSPADWFESQQISMDKSGRVLAAEKQTFKFQTNNPKIFAGGDMVRGSDLVVTAIWEGREAAEGILDYLEV

SEQ ID NO: 79527 - protein, 230 aa, Oryza sativa Japonica Group
MEIQVEVEEEVQPKATLAILLAEYEVKAKKTWMEVTYASAVEQEICTAFLFVSQVHGVEYAFGAHDYPSSGVFEVEPRQCPGFRFRKSIFLGTTCLDPIQVRQFMELQSVNYNGDTYHLITKNCNHFCKDMCYKLTGNKIPKWVNRLARIGAICNCLLPESLKISPVGHDPNSRPEDCEKRRLRNPLSCFSSISSQRQLPPSSPFPTSPVKEPLAYSSSRKSSAPSLRNR

SEQ ID NO: 79528 - protein, 192 aa, Bacillus cereus E33L
MNLPNKITISRICLIPIFMVIMLAPFDWGSYTIGDVDLPIQHLVGAIIFIVASATDWIDGHYARKYNLVTNLGKFLDPLADKLLVSAALITLVEMQYVPAWIVIVIISREFAVTGLRLVLAGTGEVVAANQLGKIKTWTQIIAIAAYLLHDVPLNLIHIPVADIFIWIALIFTVISGWDYFWKNRAAFVNSK

SEQ ID NO: 79529 - protein, 135 aa, Triticum aestivum
  misc_feature (38)..(38): Xaa can be any naturally occurring amino acid
SSSPVTALLAYLSPRRADCLLFAGHADGSIAAHRLTEXSPHGDDWLTLAAASSRLLVRGLDGAPVLHLEAHHAGRSRYVLSCDAGRRIRVFTENGTLYGTAIASSTPLAFVKQRLLFLTEAGAASLDLRSMTVRE

SEQ ID NO: 79530 - protein, 135 aa, Oryza sativa Japonica Group
MAGRGKAIGSGAAKKAMSRSSKAGLQFPVGRIARFLKAGKYAERVGAGAPVYLAAVLEYLAAEVLELAGNAARDNKKTRIVPRHIQLAVRNDEELSRLLGTVTIASGGVMPNIHNLLLPKKAGGSAKAAAGDDDN

SEQ ID NO: 79531 - protein, 433 aa, Leptospira interrogans serovar Lai str. 56601
MIWYPFTLQFEPDSPLKIERAKGEFLYDELGNSYIDGISSWWVSIHGHNHPKIVQAVKNQLEKLDHVLLAGFTHDPAEKLAAELLKITDGLFQKVLYSDNGSTAVEIMIKLAYQYFQNIGEVDRKIFIKWNSSYHGDTIGTMSVGGNSVFNRVFQGLMFPTKEFQTPNCNFCPMGKKPESCKVECIDPIEKFFQKSPKAVAGIVIEPLILGSGGMIFYKEEVLQRLETISKKYGSLLLLDEVFTGFGRTGSVFAYQRAKIRPDFIALAKGLSAGVSAVAVTLTTDRIHSAFVTADPEKGFYHGHTMTGNPIACSAALASLKIFFEENRLEQILRLESKLNVGLKKIAKEFPKAVKNCRVLGAVGVLELEVGKASGYHYPGNKILKKKFLEKGVLLRPLGNVIYLTPPYNIENSSLEKIFSAIRETLSEISFGN

SEQ ID NO: 79532 - protein, 729 aa, Escherichia coli K12
MLYKGDTLYLDWLEDGIAELVFDAPGSVNKLDTATVASLGEAIGVLEQQSDLKGLLLRSNKAAFIVGADITEFLSLFLVPEEQLSQWLHFANSVFNRLEDLPVPTIAAVNGYALGGGCECVLATDYRLATPDLRIGLPETKLGIMPGFGGSVRMPRMLGADSALEIIAAGKDVGADQALKIGLVDGVVKAEKLVEGAKAVLRQAINGDLDWKAKRQPKLEPLKLSKIEATMSFTIAKGMVAQTAGKHYPAPITAVKTIEAAARFGREEALNLENKSFVPLAHTNEARALVGIFLNDQYVKGKAKKLTKDVETPKQAAVLGAGIMGGGIAYQSAWKGVPVVMKDINDKSLTLGMTEAAKLLNKQLERGKIDGLKLAGVISTIHPTLDYAGFDRVDIVVEAVVENPKVKKAVLAETEQKVRQDTVLASNTSTIPISELANALERPENFCGMHFFNPVHRMPLVEIIRGEKSSDETIAKVVAWASKMGKTPIVVNDCPGFFVNRVLFPYFAGFSQLLRDGADFRKIDKVMEKQFGWPMGPAYLLDVVGIDTAHHAQAVMAAGFPQRMQKDYRDAIDALFDANRFGQKNGLGFWRYKEDSKGKPKKEEDAAVEDLLAEVSQPKRDFSEEEIIARMMIPMVNEVVRCLEEGIIATPAEADMALVYGLGFPPFHGGAFRWLDTLGSAKYLDMAQQYQHLGPLYEVPEGLRNKARHNEPYYPPVEPARPVGDLKTA

SEQ ID NO: 79533 - protein, 570 aa, Brassica rapa subsp. pekinensis
MVASPDCRISLSAPSCLRGSSGYTKHIKLGSFCNGELMGKKLNLAQLRSSSTNSSQKRIQMSLNSVAGESKVQEIESEKRDPKTVASIILGGGAGTRLFPLTKRRAKPAVPIGGAYRLIDVPMSNCINSGINKVYILTQYNSASLNRHLTRAYNSNGVFGDGFVEALAATQTPGETGKRWFQGTADAVRQFHWLFEDARSKEIEDVLILSGDHLYRMDYMDFVQDQSTKRRDISISCIPIDDRECKRVQQIHSKIMVSYKSLSVLHGRRASDFGLMKIDDKGRVISFSEKPKGDDLKAMAVDTTVLGLSKEEAEKKPYIASMGVYVFKKEILLNLLRWRFPTANDFGSEIIPFSAKEFYVNAYLFNDYWEDIGTIRSFFDANLALTEHPPAFSFYDAAKPIYTSRRNLPPSKIDGSKLIDSIISHGSFLTNCLIEHSIVGIRSRVGSNVQLKDTVMLGADFYETEAEVAALLAEEKVPIGIGENTKISSKTKRSLSNGLPSKQKVLDSFFPSHFPYRECIIDKNARVGKNVVIANSEGVQEADRSSDGFYIRSGITVILKNSVIADGVVI

SEQ ID NO: 79534 - protein, 470 aa, Staphylococcus aureus subsp. aureus Mu50
MGIGRVTQVMGPVIDVRFEHNEVPKINNALVIDVPKEEGTIQLTLEVALQLGDDVVRTIAMDSTDGVQRGMDVKDTGKEISVPVGDETLGRVFNVLGETIDLKEEISDSVRRDPIHRQAPAFDELSTEVQILETGIKVVDLLAPYIKGGKIGLFGGAGVGKTVLIQELINNIAQEHGGISVFAGVGERTREGNDLYFEMSDSGVIKKTAMVFGQMNEPPGARMRVALSGLTMAEYFRDEQGQDVLLFIDNIFRFTQAGSEVSALLGRMPSAVGYQPTLATEMGQLQERITSTTKGSVTSIQAVFVPADDYTDPAPATAFAHLDATTNLERKLTEMGIYPAVDPLASTSRALEPSIVGQEHYEVARDVQSTLQKYRELQDIIAILGMDELSDEDKQTVERARRIQFFLSQNFHVAEQFTGQKGSYVPVKTTVANFKDILDGKYDHIPEDAFRLVGSMDDVIAKAKDMGVEV

SEQ ID NO: 79535 - protein, 229 aa, Triticum aestivum
HYRTSLYKKAGWYRSGIPGISSTHASDEEHDDEAEDGAEDEPELEVEAADPDVKKVAAAPKETERQLSKKELKKKELAELDAVLAELGISENTSDAAQDGNNNAEKKGASQAGDGERKEDAPAPSESKNAKKKKNKKDKSAKEAKEAEVSEEATSAEPEEDTAVDVKERLKKMASMKKKKSGKETDTAAKIAAAEAAARTAGRPAPPKKEKSHYNQQPVRQKGAGPPKL

SEQ ID NO: 79536 - protein, 522 aa, Neisseria meningitidis MC58
MKHRTFFSLCAKFGCLLALGACSPKIVDAGAATVPHTLSTLKTADNRPASVYLKKDKPTLIKFWASWCPLCLSELGQTEKWAQDAKFSSANLITVASPGFLHEKKDGDFQKWYAGLNYPKLPVVTDNGGTIAQSLNISVYPSWALIGKDSDVQRIVKGSINEAQALALIRDPNADLGSLKHSFYKPDTQKKDSKIMNTRTIYLAGGCFWGLEAYFQRIDGVVDAVSGYANGNTKNPSYEDVSYRHTGHAETVKVTYDADKLSLDDILQYFFRVVDPTSLNKQGNDTGTQYRSGVYYTDPAEKAVIAAALKREQQKYQLPLVVENEPLKNFYDAEEYHQDYLIKNPNGYCHIDIRKADEPLPGKTKTAPQGKGFDAATYKKPSDAELKRTLTEEQYQVTQNSATEYAFSHEYDHLFKPGIYVDVVSGEPLFSSADKYDSGCGWPSFTRPIDAKSVTEHDDFSYNMRRTEVRSHAADSHLGHVFPDGPRDKGGLRYCINGASLKFIPLEQMDAAGYGALKGKVK

SEQ ID NO: 79537 - protein, 1095 aa, Pseudomonas aeruginosa PAO1
MTAPFNALLIANRGEIAIRIARACADLGIRSVAVFAEDDAASLHVRKADVALPLAGRGVAAYLDMDRLVALALEQGCEAIHPGYGFLAENGEFARRCQRAGIHFVGPQAEVLDLFGDKAAARALAERLEVPLVAGINRAVSVEEAEAFLEGLGDGAAVMLKALAGGGGRGMRAVEEVAQLADAYRRCRAEAQAAFGRDELYVEQRVARARHIEVQVLGDGSGAVSHLWERDCSLQRRQQKLLEIAPSPDLPEATREALIDCALRMAGAVRYRGIGTFEFLVDDERPGRFYFMEANPRIQVEHTVTEEVTGVDLLHAQLRLAAGMELAALGLERPPAIGGCAVQLRINLETLAADGSARPAVGTIGAYEPPSGPGLRVDGYGYAGYRVSPSYDSLLAKLVVRGADYPAALRRAYRALCEFRLEGVASNLDLLRNLLLHPAVQANRVDTRFVESHLETLLAPIPASHPRLRAECPLAEDAAPARVEAPLGSLPLSAPSSGVLVALEVADGERVRAGQRVAILEAMKMEFEVKAPGGGIVRRLAASLGEPLEEGATLLFLEPTEDDDEQAPTEQALDLAHIRADLAEVLERQAALGDERRPQALARRRKTGQRTARENVLDLLDEGSFSEYGGFALAAQRRRRSAEELLELSPADGLVAGTGTVGAASFGVQAARCLVLAYDYTVFAGTQGVMNHKKTDRLLGLAEQWRLPLVLFAEGGGGRPGDTDFVGVAGLDCHTFVGMARLSGLVPLVGVVSGRCFAGNAALLGCCDVIIATRDATIGMAGPAMIEGGGLGRFAAEEVGPTGVQGPNGVIDVLVEDEAEAVAVARRYLGYFQGPLPDWSCADQRELRHLVPENRLRAYDIRQAIEVLADRGSVLELRRQFAPGLVTALLRIEGRAFGLIANNPGHLGGAIDAAAGDKAARFMQLCDAFDIPIVSLCDTPGFMVGPEAEKQATVRHVSRMFVSAASLTVPFFTVVLRKGYGLGAQAMAAGSFHSPLFTVAWPSGEFGAMGLEGAVRLGFAKELAAEEDPQRREALFRGMVDKAYRNGKALNMASYLEIDAVIDPAETRAWLLRGLAVAGEPAPRAGRKRPFVDTW

SEQ ID NO: 79538 - protein, 180 aa, Wolbachia endosymbiont strain TRS of Brugia malayi
MFKKNLPNSLTISRALAIPAIILSFYIENRYANLITISIFIFACITDFFDGYLARAWKVQSKFGRLFDPIADKLIVVSTIMMLVYKHKINDYTIVPSVIVVCREILVSGLREFLIAKNVSLPVSKAGKIKTFLQMVAVVALIMNDYETVQYMGAVCLWIAAVMTVWSGYNYVLAGIKQID

SEQ ID NO: 79539 - protein, 111 aa, Glycine max
MDPQVWHKVAAISGVAALGLGTYGAHVFKPQNPAYKDVWHTASLYHLVHTAALVAAPITKHPNVFGGLLTAGILAFSGTCYTVAFLEDRKYSTMAPFGGFAFIAAWGSLFF

SEQ ID NO: 79540 - protein, 449 aa, Wolbachia endosymbiont strain TRS of Brugia malayi
MNSKYKDVMMNDDLDSTTKQEALKYHIRGGNPGKISILPTKSLSTQYDLSLAYSPGVAAPCLEIAKNPDVVYDYTAKSNCVAVISNGTAVLGLGNIGPLASKPVMEGKAMLFKRFADIDAVDIEVDTENIEDFINAVRYLGPSWGGINLEDIRSPDCFIIEKRLNELMDIPVFHDDQHGTAVVVAAGIENALDIAGKKLEDVKIIMNGAGAAGIACLEILKSMGAKNIVLCDKQGVIYKGRNEDMNEWKEKYATDTKERSLLDAIKDTDVFIGLSAKDALNEEMLKNMGQNPIIFALANPDPEVRPELAKSVRPDAIIATGRSDYNNQVNNVMGFPYIFRGALDVHAMTINNEMKIAAADAIAKLAREPAPDEISAVYGGRKMSYGREYIIPTPFDPRLVSIVSPAVAKAAVCSGVAKKEIQDWSKYANQLKSRLANALNTLNLLSSQY

SEQ ID NO: 79541 - protein, 107 aa, Vitis vinifera
MARGSSQSQASTTATSRPGPVGMAPRGTAAATAGMRRRRVGGGSGGSSSGYGGGGSGSNMLRFYTDDAPGLKITPTVVLVMSLCFIGFVTALHVFGKIYRYKAGGGP

SEQ ID NO: 79542 - protein, 595 aa, Glycine max
MEQEMEKRKRGKSEEKGEEKWVHDASVDYKGRVPLRASTGVWKASLFVLAIEFSERICHFGIATNLIMYLTKVMHEDLKTATKNVNYWVGATTLMPLIGGFVADAYTGRFRMVLFSSLLYLKGLSLLTMSQFIPSLKPCNNEICHWPRKVHEVVLFLALYCVALGTGGFKPCLQSFGADQFDDDHLEERKKKMSFFNWWNFTLCTAMLLGATVIVYVQDFVSWGVSYLILSMFMALTIIAFYEGKRFYRYRSTEGNPFMLILQVLIAAIRKSNLSCPSNPDSLYEFPKSEKSQGRLLSHTCRLRFLDKAAIVEGKYTEHRDQNPWRLATVTRVEETKLILNVIPIWLTSLIIGICIAQGSTLFVNQAASMNLKIINSFKIPPASMTSVSAISPIIAIPIYDKIIVPIMRKVKGNERGISVLWRVGIGLAFLVIAMVVAALVETKRLRMVEHDEVITVGGTRHETMSVLWLIPQYLILGIGADSLSLIGLQEYFYDQVPDSVRSLGVGLYLSVVGVGFFLSSFLIITVDHVTGKNGKSWIAKDINSSRLDKFYWMLAVINAFNLCFFLFLAKGYTYKTVQRKTREICSDGVETMES

SEQ ID NO: 79543 - protein, 445 aa, Populus trichocarpa
MVTIKAVKARQIFDSRGNPTVEADILLSDGSYARAAVPSGASTGVYEALELRDGGSDYLGKGVLKAVGNVNSIIGPALIGKDPTEQVQIDNFMVQELDGTVNEWGWCKQKLGANAILAVSLAVCKAGAMVKKIPLYQHIANLAGNKTLVLPVPAFNVINGGSHAGNKLAMQEFMILPVGASSFKEAMKMGVEVYHHLKSVIKKKYGQDATNVGDEGGFAPNIQENKEGLELLKTAIAKAGYTGKVVIGMDVAASEFYNDKDKTYDLNFKEENNDGSQKISGDSLKNVYKSFVADYPIVSIEDPFDQDDWEHYAKMTGEVGEQVQIVGDDLLVTNPKRVEKAIKEKSCNALLLKVNQIGSVTESIEAVKMSKHAGWGVMASHRSGETEDTFIADLSVGLSTGQIKTGAPCRSERLAKYNQLLRIEEELGSAAVYAGAKFRAPVEPY

SEQ ID NO: 79544 - protein, 170 aa, Triticum aestivum
  misc_feature (7)..(7): Xaa can be any naturally occurring amino acid
  misc_feature (17)..(17): Xaa can be any naturally occurring amino acid
  misc_feature (65)..(65): Xaa can be any naturally occurring amino acid
  misc_feature (131)..(131): Xaa can be any naturally occurring amino acid
RYKCYAXCLVLVVLFIXGTIFLVMVEKMPVISAFYCVCSTVTTLGYGDKSFNSEAGRLFAVFWIXTSSICLAQFFLYVAELNTENKQRALVKWVLTRRITNNDLEAADLDEDGVVGAAEFIVYKLKEMGKXDEKDISGIMDEFEQLDYDESGTLTTSDIVLAQTTSQIQR

SEQ ID NO: 79545 - protein, 296 aa, Prochlorococcus marinus subsp. marinus str. CCMP1375
MDFALREEVVSTKGPLSGEKIIEATAVTGGCIHDAWKIKLSTGEKFFAKTCPVENIGMLKYEEIGLASLNEKIDPNFLIIPKPIITQKLETAAILLMSWIDINRGNERKLGEGLALMHKHSAEHSQKSFGWQEDGFIGRSTQVGGWRKSWGECFVTLRLAPQLAMAEEWGLCIQKDKLFSKLIEYLDKHDPQPSIVHGDLWKGNTGIHRDGKGIIFDPAIWWADREVDIAMTKLFGGFSIDFYNGYNETYPLAKSHEERSDIYNLYHLLNHANLFGGNYQQSSISTLDKITILLSK

SEQ ID NO: 79546 - protein, 502 aa, Nocardia farcinica IFM 10152
MVEITRSVAKGFGMSLQLPTTVSAVSDNARHLRTRLSWQAQRAGLQVVKRYPTRIRPLAEPPPGSGLKPVLGDFGPPGIGYTLHTLADPMGFSRERFERLGPVSWLGVLGRPVVSVAGPEAFEEVLLDRDKVYSAQRGWEWLIGPFFHGGVMLRDFDDHMFHRRILQQAFTRPRLHGYQDLTSPLLRRGIESWRPAAEFHIHTAIKQLLLQQATEVFAGAELGRESVALAHAFEDAVHGGTAMVRANVPGGVWARGLRGRRRLEDYFRRELPAKRAGEGNDLFSVLSRATTEEGHTFTDEEVVQHMIFVMLAAHDTSTIASSMLVYELGRHPEWQDKLRAEAIGLGKESVGYDDLDELPLLDMAFKEALRMYAPVAQQARETIADTALCGHYLPRGTLVMCGPYMMMRTARYWRDPDEFDPERFAPERREDKSHRFAWAPFGGGAHKCIGLYFGGMTVKAVLYQMLTRFRWSVRPGYEPLLVAGTGPTPADGLPIRLERLAR

SEQ ID NO: 79547 - protein, 480 aa, Physcomitrella patens subsp. patens
MVKICCIGAGYVGGPTMAMIALKCPDIEVVVVDISKPRIAAWNSDELPIYEPGLDDVVKSCRGKNLFFSTEVEKHVAEADIVFVSVNTPTKTRGLGAGKAADLTYWESAARMIADVSKSDKIVVEKSTVPVKTAEAIEKILTHNNKGINFQILSNPEFLAEGTAIEDLDKPDRVLIGGRMTPEGQKAVAALKAVYAHWVPEDRIITTNLWSAELSKLAANAFLAQRISSINAMSALCESTGADVSEVAYAVGKDSRIGPKFLNASVGFGGSCFQKDILNLVYICECNGLPEVAHYWKQVVSINDYQKTRFVKRVVSSMFNTVSGKKIAVLGFAFKKDTGDTRETPAIDVCHGLLGDKAQISIYDPQVTEDQMKRDLAMNKFDWDHPQHLQPQSPTAFKQVSVVWDAYEACKDAHGICIITEWDEFKKLDYQKIYDNMQKPAFLFDGRNVLNVEEMRKIGFVVYSIGKPLDPWVKDLQVSI

SEQ ID NO: 79548 - protein, 131 aa, Oryza sativa Japonica Group
MAPPLQVATTASSSTREGKAPALNERILSSMSKRSVAAHPWHDLEIGPEAPTIFNCVIEIPRGSKVKYELDKKTGLVKVDRVLYSSVVYPHNYGFIPRTLCDDSDPLDVLVIMQVCISLHVAKSEYNKSFI

SEQ ID NO: 79549 - protein, 343 aa, Kineococcus radiotolerans SRS30216
MSWSNGRAVIVSRRGGPEHLRVLETRFPDPAPGSVRMAVQAAGVAYGDVLLREGLVPKTSYPVTPGYDAVGVVDAVGEGVTSPALGQRVLARTEGRGGYATHVQVSADFTVPVPADLEAGALVALPLNYLSAWQMLTRVALTPAEGTVLVHGAAGGVGSALVELARLRGLRVIGTASAARLPALTEQGASAVDRGGDWVRGVRALAPGGVDTVFDGVGGFTSRRSFALLAPGGHLVVYGITSGLAGGRRSPAALARTAAGTLRQSALGLFSKGLGIDGYMSATYVPAHPRRFREDLTELVALLQRGAISPTIAARLPLERAQEAHRQLAGGVSGKIVLEVAPA

SEQ ID NO: 79550 - protein, 379 aa, Prochlorococcus marinus subsp. marinus str. CCMP1375
MNLFNANHLELSSDELERYSRHLLLPEIGENGQRRLKNSSVICIGCGGLGSPLLLYLAAAGIGHIGIVDSDLVEKSNLQRQVIHETNSIGNTKIESAKKSILALNPNINVEVFNTLLTTENALEILQPFDVICDCTDNFESRYLINDASEILGKPNIYGAIAKFEGHSTVFNLREGSPTFRDLIPEPPDPELMPSCSEAGVMGILPGLVGIIQASETIKIITEIGDTLDGRLLVIDALTMKFKELSLRRDKLRKPIIELIDYQEFCSSNKAIKNSIPSISVFDLKELLEYDEPKVLLIDVRTTREHNIQSINQSISIPLERIKSEEYINKIKDLSCGKKLFIHCSTGKRSIQAAMILKDYGIEATNILGGIEAWSQANF

SEQ ID NO: 79551 - protein, 501 aa, Pisum sativum
MAMANLARRKGYSLLSSETLRYSFSLRSRAFASGSDENDVVIIGGGPGGYVAAIKAAQLGFKTTCIEKRGALGGTCLNVGCIPSKALLHSSHMYHEAKHSFANHGVKVSNVEIDLAAMMGQKDKAVSNLTRGIEGLFKKNKVTYVKGYGKFVSPSEISVDTIEGENTVVKGKHIIIATGSDVKSLPGVTIDEKKIVSSTGALALSEIPKKLVVIGAGYIGLEMGSVWGRIGSEVTVVEFASEIVPTMDAEIRKQFQRSLEKQGMKFKLKTKVVGVDTSGDGVKLTVEPSAGGEQTIIEADVVLVSAGRTPFTSGLNLDKIGVETDKLGRILVNERFSTNVSGVYAIGDVIPGPMLAHKAEEDGVACVEYLAGKVGHVDYDKVPGVVYTNPEVASVGKTEEQVKETGVEYRVGKFPFMANSRAKAIDNAEGLVKIIAEKETDKILGVHIMAPNAGELIHEAAIALQYDASSEDIARVCHAHPTMSEAIKEAAMATYDKPIHI

SEQ ID NO: 79552 - protein, 107 aa, Glycine max
  misc_feature (92)..(92): Xaa can be any naturally occurring amino acid
MASSMISSPAVITVDRACAGMVAPFTGLKSMAGFPTRKTSNDITSIAINRGKVHCMHVLPPIGNKMFETLSYLPYLDDAQLAKEVEYLLMKXWIPCLEFELEHRFAY

SEQ ID NO: 79553 - protein, 524 aa, Erysiphe necator
MYIADILSDLLTQQTTRYGWIFMVTSIAFSIILLAVGLNVLSQLLFRRPYEPPVVFHWFPIIGSTISYGIDPYKFYFDCRAKYGDIFTFILLGKKVTVYLGLQGNNFILNGKLKDVNAEEIYTNLTTPVFGRDVVYDCPNSKLMEQKKFMKTALTIEAFHSYVTIIQNEVEAYINNCVSFQGESGTVNISKVMAEITIYTASHALQGEEVRENFDSSFAALYHDLDMGFTPINFTFYWAPLPWNRARDHAQRTVARTYMNIIQARREEKRSGENKHDIMWELMRSTYKDGTPVPDREIAHMMIALLMAGQHSSSSTSSWIMLWLAARPDIMEELYEEQLRIFGSEKPFPPLQYEDLSKLQLHQNVLKEVLRLHAPIHSIMRKVKNPMIVPGTKYVIPTSHVLISSPGCTSQDATFFPDPLKWDPHRWDIGSGKVLGNDAVDEKYDYGYGLTSTGASSPYLPFGAGRHRCIGEQFATLQLVTIMATMVRFFRFRNIDGKQGVVKTDYSSLFSMPLAPALIGWEKR

SEQ ID NO: 79554 - protein, 394 aa, Legionella pneumophila str. Paris
MHLKRTLSLTLLAFYGLGTILGAGIYALVGEVAKEAAQFTPLSFLIASIIALFTAISYAELSSRLPHSAGSALYVRRAFHQKWLSGLIGWIVVLTGIISAATLSHGFVKYFQLFFPLPPSLIITILTVILAGVAIWGIRESATLILFMTLMEVGGLLMIIYYGRYSLASIDIKSFSFPHSFDGVLIGAFIAFYAFIGFEDMVNTAEETINPEKTLPKAIFLALISATILYIAVAWVIVLTIPSNTLVKTDMPLIEIIKLQGQSPLLFSIIALISITNGILVQIIMASRLIYGMANQQNAPQIFSSVYSKTQTPVHSTLLVFLMILLFAYALPITTLAKLTSSIILCIFIIIHASLIKIKLTEKKPTNAISFPIVFPMISILLTLAFLIIQFFLK

SEQ ID NO: 79555 - protein, 511 aa, Thermus brockianus
MADREALWERLKEPWDLLVLGGGATGSGVLWEATLRGLKAALVEARDFASGTSSRSTKLLHGGVRYLELALRRLDRRQLRLVMDALRERKVVMDLAPHLAYPLPLLTPLFRPLELPYYGTGLLLYDLLSGQRRLGPTRYLPPRGVAELFPDLPPTLGGILYWDGQFQDHRLVLALLLSALRRGALALNHAEAHAFLLKGGRVVGAVVRDHLTGREVEVHAKAVVNATGPFTDATRRLLDPHLPPLLTPSSGAHLVLDYPLRTGLLLPRTRDGRVLFLLPYRGKALLGTTDRPAEASFCPLPKEEEVAYLLEEVRPYLGDLSPHIRAVWSGLRPLVGRGETRLLVRDHLIAEERGLYTLTGGKWTTFRLMAQDLVDRLDRDLGLGLPPSPSHATPLLGAGPKPPLDLPEGVAEHLYRTYGREAQAVAALGDRPLLPGRPYLEGEVVYAVREELAQKPLDVLARRMGLALLDQEAAREALPRVVALMAPLLGWDEGRARAELEEARAALPGLC

SEQ ID NO: 79556 - protein, 523 aa, Escherichia coli CFT073
MTLEYEVVAMSVSKKPMVLVILDGYGYREEQQDNAIFSAKTPVMDALWANRPHTLIDASGLEVGLPDRQMGNSEVGHVNLGAGRIVYQDLTRLDVEIKDRAFFANPVLTGAVDKAKNAGKAVHIMGLLSAGGVHSHEDHIMAMVELAAERGAEKIYLHAFLDGRDTPPRSAESSLKKFEEKFAALGKGRVASIIGRYYAMDRDNRWDRVEKAYDLLTLAQGEFQADTTVAGLQAAYARDENDEFVKATVIRAEGQPDAAMEDGDALIFMNFRADRAREITRAFVNADFDGFARKKVVNVDFVMLTEYAADIKTAVAYPPASLVNTFGEWMAKNDKTQLRISETEKYAHVTFFFNGGVEESFKGEDRILINSPKVATYDLQPEMSSAELTEKLVAAIKSGKYDTIICNYPNGDMVGHTGVMEAAVKAVEALDHCVEEVAKAVESVGGQLLITADHGNAEQMRDPATGQAHTAHTNLPVPLIYVGDKNVKAVEGGKLSDIAPTMLSLMGMEIPQEMTGKPLFIVE

SEQ ID NO: 79557 - protein, 358 aa, Leptospira interrogans serovar Lai str. 56601
MKNVAVLSGDGIGPEVMEIAISVLKKALGAKVSEFQFKEGFVGGIAIDKTGHPLPPETLKLCEESSAILFGSVGGPKWETLPPEKQPERGALLPLRKHFDLFANLRPAIIYPELKNASPVRSDIIGNGLDILILRELTGGIYFGQPKGREGSGQEEFAYDTMKYSRREIERIAKVAFQAARKRNNKVTSIDKANVLTTSVFWKEVVIELHKKEFSDVQLNHLYVDNAAMQLIVNPKQFDVVLCENMFGDILSDEASIITGSIGMLPSASLSESGFGLYEPSGGSAPDIAGKGVANPIAQVLSAALMLRYSFSMEEEANKIETAVRKTIASGKRTRDIAEVGSTIVGTKEIGQLIESFL

SEQ ID NO: 79558 - protein, 425 aa, Vibrio campbellii AND4
MSEDNRQEVSPEEERRQQALDYHAYPTPGKISVELTKPAETANDLALAYSPGVAEPVREIAQNADNVYKYTAKGNMVAVISNGTAILGLGNLGPLASKPVMEGKALLFKRFAGLDSIDIEVKHRTIDEFVDTVANIADTFGGINLEDIKAPDCFEIEKRLIERCDVPVFHDDQHGTAIVTAAGMLNAIELQGKKLEESTIVCLGAGAAAVACMELLIKCGAMREKIYMLDRKGVIHTRRDDLNEYKQLFANNTDKRTLEDVIEGADLFLGVSGPNLLPAEALKLMAEKPVVFACSNPDPEIKPELARAVRDDLIMGTGRSDYPNQVNNVLCFPFIFRGALDVRASEINDEMKLAAVDAIRGLAKEPVPKAVLKAAGVDKLEFGSDYIIPKPMDPRLLPRVAKAVAKAAVDSGVARIEMPENYMAE

SEQ ID NO: 79559 - protein, 406 aa, Leptospira interrogans serovar Lai str. 56601
MNDADIHKELFQHTKELADHYLLNTYARYDVAFRYGVNELLFDFDNKQYIDFHCGVAVTNLGHADPDIIEVVRSQADKLFHTSNLFYSEEASKLAELLILNSFPGKVFLTNSGTEAIEGAFKLARKYAYSKSIVDPIILSLEKSFHGRSVSGMSLTGQDKIRKGYGELLKGIEFIEPNNDEALVAAFERYQGRIVALIEEPILGESGIIPLSRNFLTLSRELTEENEALLIFDEIQTGMGRTGTLFAFETMGFSPDAMTLAKGLGSGFPIGALIVGEKYQDLFTQGSHGSTFGGNHLAAAVAYETIRIIQTREILNNVNICSDIAFTRLREMQEKYPVISEVRGKGLHIGLELKVPSKPIAEACLSAGLVVNATADNVVRIMPPLTISTDFLNQGLDILESVLKQN

SEQ ID NO: 79560 - protein, 253 aa, Nocardioides sp. JS614
MSELLDFTGKVVLITGGATGIGRATALAFAQQGARVVVGDVDDRAAETVRLIEESGGTALFVRTDVTSAADVQQLVRTTVDTYGGLHVAFNNAGILPPTGPLAEQSEDDFDRTIAVDLKGVFLALKYEIEHMAAAGGGSIINTASVAGVIADPGMAPYVAAKHGVVGLTRAAAIDYAAAGVRVNALAPGLVDTPMTKVWQEDAEIWDAVAASNGFHRAAAPEEIAGTVLFLASDLASFTTGTVVTADAGQTAH

SEQ ID NO: 79561 - protein, 228 aa, Neisseria meningitidis MC58
MTVLQERYCEVSDRIGKLVLQAGREPHSVSLIAVGKTFPSDGIREVYAAGQRDFGENYIQEWYGKTEELADLTDIVWHVIGDVQSNKTKFVAERAHWVHTVCRLKTAVRLSGQRPSSMPPLQVCIEVNIAGEAVKHGVAPEEAVALAVEVAKLPNIVVRGLMCVAKANSSETELKVQFQTMRKLLADLNAAGVKADVLSMGMSDDMPAAIECGATHVRIGSAIFGKRG

SEQ ID NO: 79562 - protein, 334 aa, Carboxydothermus hydrogenoformans Z-2901
MLNFIEKVKSKAREFKRTIVLPESKDDRVIKASSEIINQQLAKIILLGNEKEIAERAKNLNVDLNGVTIIDPLKDNNRDRYANLLYELRKNKGMTLEKAYELINDPLYYATLMVKAEDADGLVAGSLSPTPNVLRPALQIIKTKPEFSVVSGAFIMVIPNPQFGEHGIMLFADCAVNPDPNSQQLAEIAIASAMTAQKLLGITPYVGLLSFSTKGSAEHELVEKVREAARIANRLRPDLKIEGELQVDAAIVPAVGAQKAPGSEVAGRANVLIFPDLQSGNIGYKLAQRMSGGEAIGPILQGMAKPVNDLSRGCSVDEIVNLVAITAVQSYYGI

SEQ ID NO: 79563 - protein, 77 aa, Colwellia psychrerythraea 34H
MSNIEERVKKITVEQLGVSEAEVKIDSSFVDDLGADSLDTVELVMALEEEFDTEIPDEEAEKITTVQAAIDYVTANQ

SEQ ID NO: 79564 - protein, 263 aa, Neisseria meningitidis MC58
MNVYFLGGGNMAAAVAGGLVKQGGYRIYIANRGAEKRERLEKELGVETSATLPELHSDDVLILAVKPQDMEAACKNIRTNGALVLSVAAGLSVGTLSRYLGGTRRIVRVMPNTPGKIGLGVSGMYAEAEVSETDRRIADRIMKSVGLTVWLDDEEKMHGITGISGSGPAYVFYLLDALQNAAIRQGFDMAEARALSLATFKGAVALAEQTGEDFEKLQKNVTSKGGTTHEAVEAFRRHRVAEAISEGVCACVRRSQEMERQYQ

SEQ ID NO: 79565 - protein, 468 aa, Escherichia coli
MKKVNHWINGKNVAGNDYFLTTNPATGEVLADVASGGEAEINQAVATAKEAFPKWANLPMKERARLMRRLGDLIDQNVPEIAAMETADTGLPIHQTKNVLIPRASHNFEFFAEVCQQMNGKTYPVDDKMLNYTLVQPVGVCALVSPWNVPFMTATWKVAPCLALGITAVLKMSELSPLTADRLGELALEAGIPAGVLNVVQGYGATAGDALVRHHDVRAVSFTGGTATGRNIMKNAGLKKYSMELGGKSPVLIFEDADIERALDAALFTIFSINGERCTAGSRIFIQQSIYPEFVKFAERANRVRVGDPTDPNTQVGALISQQHWEKVSGYIRLGIEEGATLLAGGPDKPSDLPAHLKGGNFLRPTVLADVDNRMRVAQEEIFGPVACLLPFKDEAEALRLANDVEYGLASYIWTQDVSKVLRLARGIEAGMVFVNTQFVRDLRHAFGGVKPRTGREGGGYSSKCSRK

SEQ ID NO: 79566 - protein, 373 aa, Neisseria meningitidis MC58
MSNQDFYATLGVARTATDDEIKKAYRKLAMKYHPDRNPDNKEAEEKFKEVQKAYETLSDKEKRAMYDQYGHAAFEGGGQGGFGGFGGFGGAQGFDFGDIFSQMFGGGSGRAQPDYQGEDVQVGIEITLEEAAKGVKKRINIPTYEACDVCNGSGAKPGTSPETCPTCKGSGTVHIQQAIFRMQQTCPTCHGAGKHIKEPCVKCRGAGRNKAVKTVEVNIPAGIDDGQRIRLSGEGGPGMHGAPAGDLYVTVRIRAHKIFQRDGLDLHCELPISFATAALGGELEVPTLDGKVKLTVPKETQTGRRMRVKGKGVKSLRSSATGDLYCHIVVETPVNLTDRQKELLEEFERISTGLENQTPRKKSFLDKLRDLFD

SEQ ID NO: 79567 - protein, 399 aa, Wolbachia endosymbiont strain TRS of Brugia malayi
MMNIPNIENCDLHGKAVLLRVDFNIPIKNGKVHDATRVLRSLPTIRHLVNAGAKVIIISHFGRPRAKDNNLSLKNVVKTLSQLLNKEVKFVDDCIGKKVQKVVNAIAIRDVILLENLRFYKEEEQNDANFAKQLASLADVYVNDAFSCSHRAHASISRITEFLPSYAGFCLQDELRYLEKAVSFEAKPITAIVGGAKISTKIKMLIRLAEKVDYLVLGGAIANNFLLFNKVNIGKSFFQNGVDSLLHDVVKIADKNNCKIVIPEDVLIAVNSDYSTCILRKTESVLDNDVILDIGPQTLSTISSIVASSKALLWNGPIGVFEHSAFANGTIEVMKVVSDSTHKGKLTSVIGGGDSLSAINAAGLTDKDFTYVSTGGGAFLSWLSGDKMPGIAALQSMLN

SEQ ID NO: 79568 - protein, 347 aa, Prochlorococcus marinus subsp. marinus str. CCMP1375
MFGLIGHSTSFKDARQKAMDLGYDHIAEGDLDVWCSAPPQLVEHVKVVSAIGKTIEGAYIDSCFVPEMLSRFKTARRKVLNAMELAQKKGINITALGGFTSIIFENFNLLENKQVRNTTLDWERFTTGNTHTAWVICRQLEINAPLLGIDLQKARVAVVGATGDIGSAVCRWLSQRTGVSELLLVARQQQPLKDLQKDLGGGRVLRLEEALPEADAVIWVASLPKNLQIDKSKLRKPCLMIDGGYPKNLDEKFSGSGIHVLKGGIVEFFEDIGWNMMEIAEMDVPQRQMFACFAEAMLLEFENCHTNFSWGRNNITLEKMDFIGEASLRHGFSVLRLQPNNLQAAFA

SEQ ID NO: 79569 - protein, 672 aa, Neisseria meningitidis MC58
MNKSLSSSVEEYRELTLRGMILGALITVIFTASNVYLGLKVGLTFASSIPAAVISMAVLKFFKGSNILENNMVQTQASAAGTLSTIIFVLPGLLMAGYWSGFPFWQTTLLCIAGGILGVIFTIPLRYAMVVKSDLPYPEGVAAAEILKVGGHEEGDNRQGGSGIKELAAGGALAGLMSFCAGGLRVIADSASYWFKSGTAIFQLPMGFSLALLGAGYLVGLTGGIAILLGISIAWGIAVPYFSSHIPQPSDMEMAAFAMKLWKEKVRFIGAGTIGIAAVWTLLMLLKPMVEGMKMSFKSFGGGAPAAERAEQDLSPKAMIFWVLAMMFVLGVSFYHFIGDSHITGGMAWLLVVVCTLLASVIGFLVAAACGYMAGLVGSSSSPISGVGIVSVVVISLVLLLVGESGGLLADEANRKFLLALTLFCGSAVICVASISNDNLQDLKTGYLLKATPWRQQVALIIGCIVGALVISPVLELLYEAYGFTGAMPREGMDAAQALAAPQATLMTTIASGIFAHNLEWVYIFTGIVIGAVLIVVDLVLKKSSGGKLALPVLAVGMGIYLPPSVNMPIVAGAVLAAVLKHIIGKKAENREGRLKNAERIGTLFSAGLIVGESLIGVIMAFIIAFSVTNGGSDAPLALNLQNWDAAASWLGLAFFVTGMFFFAQRVLKAGK

SEQ ID NO: 79570 - protein, 136 aa, Brassica napus
  misc_feature (7)..(7): Xaa can be any naturally occurring amino acid
  misc_feature (15)..(15): Xaa can be any naturally occurring amino acid
  misc_feature (25)..(25): Xaa can be any naturally occurring amino acid
  misc_feature (128)..(128): Xaa can be any naturally occurring amino acid
AFELAPXNMLFAPKXGNGYGEDEDXHLALMMELLGKIPRKIATGGARSKDYFDRHGDLKRIRRLKYWPLDRLLTDKYKLPEAEAREFAEFLCPILAFEPEKRPTAQQCLQHPWLNLRAQNNEDQVEGXMSNLQIKG

SEQ ID NO: 79571 - protein, 334 aa, Salmonella enterica subsp. arizonae serovar 62:z4,z23:--
MSTFYQKPFLKLLDFTTDELTALLQLAAKLKADKKNGKEKQKLVGKNIALIFEKDSTRTRCSFEVAAYDQGARVTYLGSSGSQIGHKESIKDTARVLGRMFDGIQYRGYGQEIVETLAEYSGVPVWNGLTDEYHPTQLLADLLTMQEHLPGKAFNEMTLVYAGDARNNMGNSMLEAAALTGLDLRLVAPKACWPQAALVTECSAMAKRNGGAITLTEDITSGVKGADFIYTDVWVSMGEPKEKWAERIALLRDYQVNSQMMALTGNPQVKFLHCLPAFHDDETTLGKKMAEEYGLHGGMEVTDEVFESAASIVFDEAENRMHTIKAVMVATLSK

SEQ ID NO: 79572 - protein, 366 aa, Oryza sativa Japonica Group
MADNAAAAADSAARTRYARGQLEALRAAPSEEAQARLWAEVSAALAAAGFSGEYDGLMDAEDPSIRKPGRKGKKAAGGGWKRHDAAAATQFLETDEVGAWRNGDSGVRYEHYVDEPRSVLQVIEEPFVQGGNAEYEDADSDDDYDGILKPAFAVDGDPDFESGEPLDGFEYLRRVRWEANQIPRVKVAKIDLNTARNEQTPYMPEIPDIAKCSPDLCASKPWEDTFITYFSETRLAFSELDSSDGPSVSGGTKNLLKPSNRSEPQTDPTLTMIRNMDAVSRAATLRNYIDMIQSLDKLSRNDCLWLFSLCVAVDTPLDAETCASLRSLLRKCANVLAAKLEMDDEVAMLNILITISGRFFGQYDNH

SEQ ID NO: 79573 - protein, 381 aa, Kineococcus radiotolerans SRS30216
MPTSKPSGDQTMLAAVLSPDSAEFVLERVPVPAPRAGEALIRVAACGVCHSDLHVLKGEIAFPRPAVLGHEISGTIVQLGDGVENLRVGDAVVGGFIMPCTRCDECQRGRDDLCPQFFAQNRLKGALFDGETRLRRTDGSPLAMYSMAGLAEYSVCPVSALAVLPSEVSMTSAAVLGCAGMTAYGAVHRAGSVQPGATVAVVAVGGLGMSMVQLAAAAGASTVVAVDVNDEKLAMARRLGATHTVNSAKEDAHAAVRAATGGRGVDVAIEALGRPATLRLAVDVLADGGRAVAVGLAAGNAEVGIEITPFVRRSRSLMGSFGARTRTDLPAVVDLAARGSFDPDALVTDVFSLEDVNEAYSRLDGGDILGRAVVSMGSSLS

SEQ ID NO: 79574 - protein, 100 aa, Triticum aestivum
  misc_feature (2)..(2): Xaa can be any naturally occurring amino acid
MXAAEDGGGGGGGKVSFKVILTSDPKLPFKVFSVPEAAPFTAVLKFAAEEFKVPPQTSAIITNDGVGINPQQSAGNVFLKHGSELRLIPRDRVGATVPSF

SEQ ID NO: 79575 - protein, 390 aa, Physcomitrella patens subsp. patens
MATWTNSTAFIYLLLVVAFMTLVLVSHDPANLHSRSHRRTLPGKRIKVRTVHHDKKHHDPVAFDPIVAEFERRKEDRAWEKQYFEDQYKKWGEQAQNNEGVFHHEGLLDPHEVDPDFEDPEEYLNDEDQFNITHRLAVLFPLLDVNPRDDFVSLIELQEWHLVQGRKAMQHRSDREMEANDKNHDGLISFEEYLPHLTEEERGQNNTEFGESGWYKEQFEVCDRDKDGLLNSTEFNDFLHPDDSNNPRVLQWCRMEQIRTHDTNKDGKINWDEFHHGMFDHLRDEHDTEHLHPAEQLEEKKQVQSKHFFSEIDRNKDGYLTEDEIAPLMEKLRPGELYYAKQQSEYLLQEADENRDGRLTLDEMLNHPYIFYSTAYDEDEFDYSTHDEFR

SEQ ID NO: 79576 - protein, 380 aa, Vitis vinifera
MSSTAGQVIRCKAAVAWEAGKPLVIEEVEVAPPQVMEVRLKILFTSLCHTDVYFWEAKGQTPLFPRIFGHEAGGIVESVGEGVTDLQPGDHVLPVFTGECKECRHCKSEESNMCDLLRINTDRGVMLSDNKSRFSINGKPVYHFVGTSTFSEYTVVHVGCVAKINPAAPLDKVCVLSCGISTGLGATLNVAKPSKGSSIAIFGLGAVGLAAAEGARIAGAARIIGIDLNPKRFNDAKKFGVTEFLNPKDHDKPIQEVIAEMTGGGVDRSVECTGNVNAMISAFECVHDGWGVAVLVGVPNKDDSFKTHPVNLLNERTLKGTFFGNYKPRSDLPSVVEKYMNKELEVEKFITHEVPFAEINKAFEYMLSGDGLRCIIRMDA

SEQ ID NO: 79577 - protein, 223 aa, Populus trichocarpa
MTKQQARFEPYDFNGGTCVAIAGADYCVVAADTRMSTGYNILTRDYSKIYKLADKCLMASSGFQADVRALQKVLGAKHLIYQHQHNKQMSCPAMARLLSNTLYYKRFFPYYTFNVLVGFDEEGKGCVYTYDAVGSYEKVGYSAQGSGAKLIMPVLDNQLKSPSPLLLPAQDAVTPLSEAEAIDVVKDVFASATERDIYTGDKLEIVILNADGMRREYAELRKD

SEQ ID NO: 79578 - protein, 380 aa, Vitis vinifera
  misc_feature (192)..(192): Xaa can be any naturally occurring amino acid
  misc_feature (263)..(263): Xaa can be any naturally occurring amino acid
  misc_feature (346)..(346): Xaa can be any naturally occurring amino acid
MSGTAGQVIRCKAAVAWEAGKPLVIEEVEVAPPQAMEVRLKILFTSLCHTDVYFWEAKGQTPLFPRIFGHEAGGIVESVGEGVTDLQPGDHVLPVFTGECKDCRHCKSEESNMCDLLRINTDRGVMLNDNKSRFSINGKPIYHFVGTSTFSEYTVVHVGCVAKINPAAPLDKVCVLSCGISTGLGATLNVAXPWKGSSVAIFGLGAVGLAAAEGARIAGAARIIGIDLNPKRFNEAKKFGVTEFVNPKDHDKPVQEVIAEMTXGGVDRSVECTGNVNAMISAFECVHDGWGVAVLVGVPNKDDSFKTHPVNLLNERTLKGTFFGNYKPRSDLPSVVEKYMNKELEXEKFITHEVPFAEINKAFEYMLQGDGLRCIIRMDP

SEQ ID NO: 79579 - protein, 123 aa, Psychrobacter arcticus 273-4
MALSKDDVLNAIAEMSVMDIVELISAMEEKFGVTAAVAAAPAAAGPAAAAAEEKDEFDVVLASFGEKKVGVIKAVREATGLGLKEAKDLVESAPASIKEGVNKAEAEELKKKLEEAGATVELK

SEQ ID NO: 79580 - protein, 570 aa, Ustilago maydis 521
MGLAGMKEGRPETDMVPTFLGLRGIRLNWAIGFAASAGFLLFGYDQGVLGSLYTLPSWLAQFPEINTGPDSSPTSNASVLQGLVTGVYELGCFVGAISMLYFGNLLGRRVNIWIGSIIMAVGAIGCTASYSLAQLFVFRVILGIGNGMHTATIPVWQSECSPPHKRGMLIMVEGAMITGGIAMAYWIDFGCFFLEPSSASWRVPLALQLVLILPTFVTAFLPESPRWLMLRGREEEARCVVAALDNVPVDDPMVGKKLREIAASLEAAKTTRIRDIFTNGPERNLHRTILGFVSQMFQQISGINLITYYIGKTLQENLGFSDINSRILAAANGTEYFIASWAAVFFIEKMGRRPLMLGGAAGQCVCMIVLAILDVPRIKNSGNGPPVASVVFYFLFNTSFAWGWLGMTWLYPAEITPLAIRAQANGISTSANWLFNFMVVMVTPVMFNNIGYQTYVVFAVLNFVILVVTFFIFPETAGRSLEEMSAIFAVSSKINPYDVVRKEKITPRRYDKQGHLINDDVDIVEDYDKGDLEKNLGDGKRGGDTNVVTEDATATPTSDGNSSREHSPRS

SEQ ID NO: 79581 - protein, 416 aa, Salmonella enterica subsp. enterica serovar Paratyphi B str.
MESKVVVPVEGKKITLQNGKLNVPENPIIPFIEGDGIGVDVTPAMLKVVDAAVEKAYKGERKISWMEIYTGEKSTQVYGQDVWLPAETLDLIRDYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTKRLVRAAIEYAITNDRDSVTLVHKGNIMKFTEGAFKDWGYQLARDEFGGELIDGGPWLKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMEGAKLLKCSEFGDAIIENM

SEQ ID NO: 79582 - protein, 408 aa, Xanthomonas campestris pv. campestris str. ATCC 33913
MSTAADSPLSLAHYYLPVYRPRQVVLERGQGSRVWDDQGREYLDLSSGIAVSGLGHNDPDLMAALTEQAGKLWHTSNVFFSAPPLKLAEELVTASRFAQKVFLCNSGTEANEAAIKLVRKWASSQGRPADKRVIVTFRGSFHGRTLASVTATAQPKYQEGYEPLPGGFRYVDFNDVPALESAMASGDVAAVMLEPIQGEGGVMPAAPGFLARVRALCDQHDALLVLDEIQCGMGRTGSLFAHWQEQVTPDIVTLAKALGGGFPIGAMLAGPKVAETMQFGAHGTTFGGNPLAAAVARVALRKLASPQIAENVARQSAALRAGLEALNAEFGVFAQIRGRGLMLGAVLAPAHAGQAGAILDLAAAHGLLLLQAGPDVLRFVPALNLTDAELADGLARLRLAIAAYVAQH

SEQ ID NO: 79583 - protein, 447 aa, Kluyveromyces lactis
MGCVASTGNYENEDDPFIQNKRANDLIEQNLQQERNKNKNEVKLLLLGAGESGKSTVLKQMKLLHQGGFTHRERMQYGQVIWADAIESMRTLILQAGKLGIELDSDLKNAHSGQLVNTELHQCKEKIFRANTLDQIDARMAGGSEFLNEYVLKYNGIGSKKKRQTTLGFKESNGADPEEEDETDAFLSEKLAGTSYTGSSETSELKRIDQSTNEEIAYAIKKLWTQDKGIRQCFNRSSEFQLEGSASYYFDNIEKFARVDYVCDDMDILKVRIKTTGITENSFKIGPSTFKVYDAGGQRSERRKWIHCFEGITAVVFVIAISEYDQMLFEDERVNRMHESIVLLDTLLNSRWFANTPFILFLNKVDIFQEKVKRSPIRTWFPNYPGKLGDSETGLKYFESLFLSLNRSNKPIYVHRTCATDTQSMRFVLGAVTDLVIQQNLKKSGIL

SEQ ID NO: 79584 - protein, 366 aa, Rhizopus oryzae
VPVSGKSGSSNTAVSASDNAALPPLISSRCAPPSNKGSKSDLQAEPYNMQKNTEWYKSHGGNLTSIGKRDDNLVGGMTLDLPSGAPPISLSSSTNSASDGGKVVAATTAQIQEFTKYAGIAATAYCRSVVPGNKWDCVQCQKWVPDGKIITTFTSLLSDTNGYVLRSDKQKTIYLVFRGTNSFRSAITDIVFNFSDYKPVKGAKVHAGFLSSYEQVVNDYFPVVQEQLTAHPTYKVIVTGHSLGGAQALLAGMDLYQREPGLSPKNLSIFTVGGPRVGNPTFAYYVESTGIPFQRTVHKRDIVPHVPPQSFGFLHPGVESWMKSGTSNVQICTSEIETKDCSNSIVPFTSILDHLSYFDINEGSCL

SEQ ID NO: 79585 - protein, 426 aa, Triticum aestivum
LWPRAISELTSLNHIEEAAVLSTCNRMEIYVVALSWNRGIREVVDWMSKKSGIPASELREHLFMLRDSDATRHLFEVSAGLDSLVLGEGQILAQVKQVVRNGQNSGGLGKNIDRMFKDAITAGKRVRCETNISAGAVSVSSAAVELAMMKLPKSECLSARMLLIGAGKMGKLVVKHLIAKGCKKVVVVNRSVERVDAIREEMKDIEIVYRPLTEMYEAAAEADVVFTSTASESLLFTKEHAEALPPISLAVGGVRLFVDISVPRNVGACVSEVEHARVYNVDDLKEVVEANKEDRVRKAMEAQTIITQELKRFEAWRDSLETVPTIKKLRSYADRIRASELEKCLQKIGEDNLNKKMRRSIEELSTGIVNKLLHGPLQHLRCDGSDSRTLDETLENMHALNRMFNLDTEKAVLEQKIKAKVEKTQS

SEQ ID NO: 79586 - protein, 923 aa, Avena sativa
MASKGAGGGGGGHEEPQRPKQQLPRDSRGSLEVFNPSSSSAAVEPPSAFRPAARSASPFIEEATGGIEDVGKATQRAAEWGLVLQTNEQTGRPQGVSARSSGGGGSARSSSDDKAVAGAIPRVSEELRAALSAFQQTFVVSDASRPGHPIMYASAGFFNMTGYTSKEVVGRNCRFLQGSGTDPAEIAKIRQALANGSNYCGRVLNYKKDGTAFWNLLTIAPIKDEEGRVLKFIGMQVEVSKYTEGNKDTVVRPNGLPESLIKYDARQKDQARSSVSELLLAIKNPRSLSESTNSTFKRKSQESVGALTGDRPGKRSSESGSRRNSKSGARTSLQKISEVPERGSKSRKSGLYSLMSLLGMGPGNIEKDMLKPRDEDPLLDSDDERPESFDDELRRKEMRRGIDLATTLERIEKNFVITDPRLPDNPIIFASDSFLQLTEYSREEILGRNCRFLQGPETDRATVRKIRDAIDNQTEVTVQLINYTKSGKKFWNLFHLQPMRDQKGDVQYFIGVQLDGTEHVRDAAEREGVMLIKKTAENIDEAAKELPDANLRPEDLWANHSKVVLPKPHMKDSASWRAIQKVLEGGENIDLKHFRPVKPLGSGDTGSVHLVELLNTGEYFAMKAMDKNVMLNRNKVHRANAEREILDMLDHPFLPTLYASFQTKTHICLITDYYPGGELFLLLDRQPLKVLREDAVRFYAAEVVIALEYLHCQGIIYRDLKPENILLHRDGHISLTDFDLSCLTSCRPQVFLPEEANKKSRRKSRSSPIFFAEPMRASNSFVGTEEYIAPEIITGAGHTSAVDWWALGILLYEMLYGYTPFRGKTRQRTFANILHKDIRFPASISVSLPARQLIYRLLHRDPSNRLGSYEGSNEIKEHPFFRGINWALVRGTAPPKLDAPLFPDDTDKGMGDAAAADTHTDMF

SEQ ID NO: 79587 - protein, 927 aa, Avena sativa
MASKGAGAGGGGGGGDGYDEPQRPKQQLPRDSRGSLEVFNPSSSAVEPPSAFRPAARSASPFIEEVAGGIEDVGKATQRAAEWGLVLQTNEQTGRPQGVSARSSGGGGSARSSSDDKAVAGAIPRVSEELRAALSAFQQTFVVSDASRPGHPIMYASAGFFNMTGYTSKEVVGRNCRFLQGSGTDPAEIAKIRQALADGSNYCGRVLNYKKDGTAFWNLLTIAPIKDEEGRVLKFIGMQVEVSKYTEGNKDTAVRPNGLPESLIKYDARQKDQARSSVSELLLAIKNPRSLSESTNSTFKRKSQESVGPLTGDRPGKRSSESGSRRNSKSGARTSLQKISEVPERGNKSRKSGLYSLMSLLGMGPGNIEKDMLKPRDEDPLLDSDDERPESFDDELRRKEMRRGIDLATTLERIEKNFVITDPRLPDNPIIFASDSFLQLTEYSREEILGRNCRFLQGPETDRATVRKIRDAIDNQTEVTVQLINYTKSGKKFWNLFHLQPMRDQKGDVQYFIGVQLDGTEHVRDAAEREGVMLIKKTAENIDEAAKELPDANLRPEDLWANHSKVVLPKPHMKDSASWRAIQKVLEGGENIDLKHFRPVKPLGSGDTGSVHLVELLNTGEYFAMKAMDKNVMLNRNKVHRANAEREILDMLDHPFLPTLYASFQTKTHICLITDYYPGGELFLLLDRQPLKVLREDAVRFYAAEVVIALEYLHCQGIIYRDLKPENILLHRDGHISLTDFDLSCLTSCRPQVFLPEEANKKSRRKSRSSPVFFAEPMRASNSFVGTEEYIAPEIITGAGHTSAVDWWALGILLYEMLYGYTPFRGKTRQRTFANILHKDIRFPASISVSLPARQLIYRLLHRDPSNRLGSYEGSNEIKEHPFFRGINWALVRGTAPPKLDAPLFPDGTDKGLGDATAAADNHTDMF

SEQ ID NO: 79588 - protein, 400 aa, Thermosynechococcus elongatus BP-1
MSKKSVAQLSAADLEGKRVLVRVDFNVPVDEKGVITDETRIRAALPTIQDLISKGAKVILVSHFGRPKGVDEKLRLTPVAQRLSELLHKPVAKLDDCIGDAVIAHTQAMANGDVCLLENVRFHPGEEKNDPEFAKQLAACAEVYVNDAFGTAHRAHASTAGVTQYLSPCVAGFLMEKELEYLQNAIEHPRRPLAAIVGGSKVSSKIGVIEALLEKVDKLLIGGGMIFTFYKARGLNVGKSLVEEDKLELAKHLETKAQEKGVELLLPTDVVVADNFANDANSQVVSIEAIPDDWMGLDIGPASVKRFQEALQDCKTVIWNGPMGVFEFDQFAKGTEAIARYLAELTSQGVCTIIGGGDSVAAVEKVGVADRMSHISTGGGASLELLEGKQLPGIAALDDA

SEQ ID NO: 79589 - protein, 951 aa, Oryza sativa
MPRRSASRYAAYWAADALAGDDALDFSLTKALVGVSPDSLTGAPEAVRERVALRCLQEVVSLASDGDYEATPTAGGVLSVDASRSCEDSLLQLIREIGSSGSLEKVMLLPFSQDVQKFICIKRPTLPETSFELLREVYPEITPVVLPSPVEQNGNDQHDNVSHDLENTEKTGFNTDGAQLQQDDLANLVNESNTGNLQKDAMATPDFHQPCTSENRCFDQPQEDSINAVGVNIRSPKDSPTNVDRHIQVAAEPSLATSADLLGSNTGTISEQDMIDDTTMVQSQSQGVKNPNTLHYNNGDEPLVASIQSPKDSIHEGLTIQATVSPAFDRSNDALPASTSEISQLPEFITARDTVMNSEPRINKSHPNSPKHDTVDEANQDVDYGSVGIQKAAAFLSEDRNGATQGEKSEIKDPPENTAEHTKMFEQENSVEAQLEVGCSDKVNQDIQDDGNIMTKNMVCDGLNVQTAPEPHSCRMALHNKNLVANHLSEQNIGRNTTAVEKDCCSIPTSPQVANDTRVKQPSNKRTMGNTVVETSHVHSSDDSLSGFAATGLLSMADKIPFCTQDQDANGPVEGLSEQDLCIKCGKDGQLLKCSSCLLAAHDTCFGSLATLDDSGQLYCPVCFYTKATEAYQKAKKTYSEARKNLSAFLGRKQLAEQHQQAAVGQRAANNEDHLNGCNDASKRKDNHQSEGNNLSHRDEDPTRKRKKQKTNATSDACAQEVVTEKVPVVQNSDVAPMNKHSVLQNNRKQAQVAEHEQPEENEEASGESGNDNSLHKTTHSSQTKCSPAVNQNVDADKENGLASSQQSEDSDEIEATSSNDSTKKSSPPWRKLRHRKAIYQDKDTAMPSNSKKVLGNRDQHMASPSRKRNYACPPKRYSNPIVPAGRRTKLCWTEKEEITLREAMAKFTPRDNGPIPWVQILEHGRDVFHRTRLPSDLRVKWRNMKKKSGS

SEQ ID NO: 79590 - protein, 334 aa, Salmonella enterica subsp. arizonae serovar 62:z4,z23:--
MSISLKKRNFIKLLDFTSAEIQHLIDLAIALKAAKKSGHEQKTLIGKNIALIFEKTSTRTRCAFEVAAFDQGAQVTYLGPSGSQIGHKESMKDTARVLGRMYDGIEYRGFGQHIVEELGEYAGVPVWNGLTDEFHPTQILADLMTMLEHAPGKTLPELSFAYLGDARNNMGNSLMVGAAKMGMDIRLIAPKSFWPDAALIAQCREIANDTGARITLTESVKDGVHGVDFLYTDVWVSMGEPKEAWAERVSLMTPYQVNQQVVNATGNPDVKFMHCLPAFHNEHTKVGREIEMAYGLKGLEVTEEVFESAGSIVFDEAENRMHTIKAVMVATLGD

SEQ ID NO: 79591 - protein, 483 aa, Erwinia carotovora subsp. atroseptica SCRI1043
MQQTPLFKNHYFHQLPGFYTALQPTPLHGARLLYHSEGLASELGLSSDWFTPEQDDVWSGTRLLPGMEPLAQVYSGHQFGSWAGQLGDGRGILLGEQQLADGRSMDWHLKGAGLTPYSRMGDGRAVLRSAIREFLASEAMHHLGIPTTRALTIVTSQHPVQREQEEKGAMLLRVAESHVRFGHFEHFYYRREPEKVRQLVEYVIARHWPQWENDERRYELWFGDVVERTARLITHWQAVGFSHGVMNTDNMSILGLTIDYGPYGFLDAYQPDFICNHSDHRGRYAFDNQPAVGLWNLHRLGQALSGLMDTDTLERALARYEPALMQHYGTLMRAKLGLFTASPDDNDVLVGLLRLMQKEGSDYTRTFRLLADSEKQASRSPLRDEFIDRAAFDSWFATYRQRLMQEDQDDEERRRLMNATNPKYILRNYLAQMAIERAESDDTSALARLHQALCRPFDEQPDSHDLAALPPDWGKHLEISCSS

SEQ ID NO: 79592 - protein, 594 aa, Thermosynechococcus elongatus BP-1
MSNQPLQRRTKIVATIGPAVSHPDKLRAIIQAGATTLRLNFSHGTHDDHQRSIRLIRQISYELGQPVGILQDLQGPKIRLGRFEHGSISLKRGDRFTLTSRPILGNQHISSITYPPLAQEVPAGATILLDDGRVEMLVEEVDKEAGELHCQVIVGGTLSNAKGVNFPGVYLSIKALTEKDREDLMFGLNQGVDWVALSFVRNPQDVLEIKELIANAGKQVPVIAKIEKHEAIEQMDAILSLCDGVMVARGDLGVELPAEDVPILQKRLIAAANRLGIPVITATQMLDSMVKSPRPTRAEISDVANAILDGTDAVMLSNETAMGEYPVEAVKMMATIAARIDNQPQLRQPPGAESTAVRSIPSAISQAVGQVAAQLHAKAIITQTKTGATARNVSKFRPQIPILAATPHIEVARRLQLVWGVEPLLTLDHPSMRESFQAAINAAQERGFLEEGDLVVMTAGTLQGVSGSTDMIKVELVTSVMGRGCGIGHGSVSGPARVVRQGMPVRTFNRGEILVAERTSAELVEVIRKAAGIITEEDSLTSHAAVLGLRLGIPVIVGVKNATRLIREGTILTMDVERGVVYSGARNGGERSPE

SEQ ID NO: 79593 - protein, 283 aa, Astragalus membranaceus
MGKDVEVAEHGEFSAKDYTDPPPAPLIDMAELASWSFYRAIIAEFIATLLFLYITVLTVIGYKSQSATDQCGGVGILGIAWAFGGMIFVLVYCTAGISGGHINPAVTFGLFLARKVSLIRAVMYMVAQCLGAICGVGFVKAFQKSYYVKFGGGANELADGYNKGTGLAAEIIGTFVLVYTVFSATDPKRSARDSHVPVLAPLPIGFAVFMVHLATIPITGTGINPARSFGAAVIYNKDKAWDDQWIFWVGPFVGAAIAAFYHQFVLRAAAIKALGSFRSNAHN

SEQ ID NO: 79594 - protein, 240 aa, Vibrio harveyi
GNLIVNGKTVRVTAERNPEDLKWDAIGVDVVAEATGLFLTDETARKHITAGAKKVVLTGPSKDATPMFVMGVNHATYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELAGVLGYTEDQVVSQDFIGEVQTSVFDAKAGIALT

SEQ ID NO: 79595 - protein, 377 aa, Oryza sativa Japonica Group
MVQRTSSDSAASAEAMVMDLSPKRPAKSYGGEGGSYFDWSPSELPMLRAASIGAAKLSLAAGGLALPFYSDSAKVAYVLQGKGTCAVLLPETPSEKILPIKEGDALALPFGVVTWWHNLHAATTELVVLFLGDTSKGHTAGRFTNMQLTGSTGIFTGFSTEFVARAWDLPQDAAASLVSTQPGAGIVKLKDGFRMPEGCDKDREGMVLNCLEAPLDVDIKNGGRVVVLNTQNLPLVKEVGLGADLVRIDGHSMCSPGFSCDSAYQVTYIVRGSGRVQVVGIDGTRVLETRAEGGCLFIVPRFFVVSKIADDTGMEWFSIITTPNPIFSHLAGRTSVWKAISPAVLQASFNTTPEMENLFRSKRLDSEIFFAPNSNSI

SEQ ID NO: 79596 - protein, 107 aa, Populus trichocarpa
MSSHNYNPASANDPRQPSASKSFLAPMVSPQDVPVDYSGFVAVILGVAGVMFRYKLCSWLALIFCAQSLSNMRNMENDLKQISMASMFAIMGLVTNYLGPARPASQS

SEQ ID NO: 79597 - protein, 557 aa, Neptuniibacter caesariensis
MLKLNALGKSNLRGDVLGGLTAAVVSLPLALTFGVASGAGAEAGLYGAILIGLFASLFGGTSTLISEPTGPMTVVMTAVISTLIAANPEKGLAMAFTVVMMAGCFQIVFGFLKLGKYITLMPYSVVSGFMSGIGVILILMQLAPALGQSSPGGGVVGTLVNLPELVMNIQLGEFLLFVVTLQLLFFTPEKVKKYVPPQLVALVFVSILSVIVFDFAQIQRIGEIDASLPSFVMPHFTHAELSIMLVEAMVLGMLGCIDSMLTSVIADNLTRSEHDSNKELVGQGLGNIMSGLFGGLPGAGATMGTVVNIQSGGRTALSGVIRVIALAIAVFGAASLIENIPLAVLAAIAVKVGMDILDWSFIKRAHRVSRHSTLIMYTVLLLTVFVDLIVAVGIGVFVANIIIIQKLSMVEAQKVRAMSDVDDELPLDDEQRELLNKADGRVLLFYLSGAMIFGVSKAIARERQDIAHHDAVIFDLSDVSFLDDTMALSIENVVLEALDMGKHVSIVTSQEEAQEKLLKLCMDSRLTREHFADSRTVALQRATKHIDESQVLMYSGA

SEQ ID NO: 79598 - protein, 372 aa, Glycine max
MADGPQHPSVVQKLAGQSYLVSRLSPNFNSGNYSSTGSYFNGGLHSSGLAVVSPGSPVTVHAPAEKGVSGFLVDFLMGGVSAAVSKTAAAPIERVKLLIQNQDEMIKSGRLSEPYKGIGDCFARTMKDEGVIALWRGNTANVIRYFPTQALNFAFKDYFKRLFNFKKDKDGYWKWFAGNLASGGAAGASSLLFVYSLDYARTRLANDAKAAKKGGERQFNGLVDVYRKTIKSDGVAGLYRGFNISCVGIIVYRGLYFGMYDSLKPVVLVGGLQDSFFASFLLGWGITIGAGLASYPIDTVRRRMMMTSGEAVKYKSSLHAFQTIVANEGAKSLFKGAGANILRAVAGAGVLAGYDKLQLVLFGKKYGSGGGG

SEQ ID NO: 79599 - protein, 474 aa, Cryptococcus neoformans var. neoformans JEC21
MTISLPDISHRQSLILTALAAALGTTSIILSFQALRREARTERLKRQVGQDVEEWERSHEGSGMSSPDEKIERIVRKEKNWEKEFDEGLIREQLTRNYNFLGEESMGLVRKSYVVVVGCGGVGSWCALMLLRSGVGRILLIDFDLATLSSLNRHACATLEDVGTPKVIAMQKYLKKIAPWARIEVEIGLWRKGEGEKWLEGADWVVDAIDNIDTKADLLAHCHEQGIKVFSSMGSGAKKDPTRVQIADISSTYEDPLARSVRRRLRMAGISSGIPVVYSTETPSEVKLLPLDEEEFKRGAVKELQAFDDFRVRIMPVLGPLPAIFGLNIATYILLDLAGKPLTDYMEIKNRKRVYQSLERGLSDRETKVKGEKLQGKLPISLEDIGFVFEELYHGRSSLPPFEVLQKANVIRWQKNQDLSADNLVVMGNKDAEKHTKECLIGDRDVREVWGDEVVEFIKRKSDEARKTIAWRRA

SEQ ID NO: 79600 - protein, 291 aa, marine gamma proteobacterium HTCC2080
MLTVLSAIPKHIVITGPTAGIGRATALSLALQGAQLTLLCRNLNKGLAVSEVIESAGGLKPHLVQVDMASLQSVRIAAASVLDLGLPIDVLLNNAGLINSYRRETPDGFEETLAVNHFAPFLLTGLLLPAILNAAPGARIVNVASGAHSFVKGMGFDDIQLQQSYKMFEAYGRSKLANILFTRTLSQRLAEKGVTVNCLHPGAVATDIGKQHGELIAKIIPILLKPFFRGPQKGAETSIYLCTDDKVADQTGGYWYNCKLTKVKPWAKDDAQAQRLWNYTQDTLGYQYPQL

SEQ ID NO: 79601 - protein, 457 aa, Rhodococcus sp. RHA1
MADAHSDVLILGGGSGGYACAFRAAQLGLSVTLIEADKIGGTCLHRGCVPTKALLHSAEVADTARTGAAFGVRTTFDGIDIEAVHQYKNGTIDRLHRGLQGLVAHHKISGVSGHGKYAGDRTIEVDGTRYTGTSVVLATGSYARTVPSIELGERIVTSDDALNLGFVPKKAIVLGGGVIGVEFASVWASFGAEVTVVEALPRLVAAEDPWCSKQLERAFRKRGIAARAGVTVAAAKETADGILVELDGGETLEAEILLVAVGRAPRTGDSGFAEHGITLDRRFVVTDERLRTDVDGVYAVGDVVAGLQLAHRGFQQGVFVAEEIAGLDPVPVAEHLVPRVTYSHPEVASVGLTEDAARERYGDVTSVVYDLAGNGKSQILKTSGGIKVIRAGDAGPVVGVHMVGDRVGELIGEAQLTVAWEALPTDVAPFVHAHPTQNEALSEAMLALSGKPLHAHG

SEQ ID NO: 79602 - protein, 555 aa, Physcomitrella patens subsp. patens
MRPQVQVPQRKSGLVYAKAEAVLGLEENKDGAVSVNGASPANPGVEGAQSQSMEIDLVTEAELKENGFRSTRRTKLICTIGPATCAPEQLEALAIGGMNVARLNMCHGTREWHTEVICNVRRLNSEKGYSVAIMMDTEGSEIHMGDFNGAPSVKAEDGEEWIFTVRKFGTLPEFTTIVNYDGFAEDVKVGDELVVDGGMVRFEVIEKVGPDVKCKCTDPGLLLPRANLTFWREGRLVRERNAMLPTISSKDWIDIDFGIAEGVDFIAISFVKTSEVIKHLKSYIQARSPNGSIGVFAKIESSDSLKNLEDIIRVSDGAMVARGDLGAQIPLEQVPSVQQAVVNLCRELNKPVIVASQLLESMIEFPTPTRAEVADVSEAVRQRADALMLSGESAMGLFPEKALSVLRTVSLRMESWCRENKQHASDRLPELSPALDDRISENICNSASQMANRLGVDAIFVYTRRGYMASLLSRCRPDCPIFAFTDTKMVRQRLNLQWGLIPFRLDFSGDMESNLRRTFALLKARGMMKKGDLVVAVSDISEADMLQSIQVRRIP

SEQ ID NO: 79603 - protein, 325 aa, Paeonia suffruticosa
MFRPGGPGQDPRPMFRPGGPRGPPGLNMTPPGDDVAHEFFPFFRVYKDGRVERFMPTEKVPPTDDPNTGVRSKDVQISPEVAVRIFLPKIDDPTQKVPVLFYTHGGGFSIGSAFAQGYHNYVSSLVAEANVIAVSVDYRLAPEHPIPACYEDSWEAFKWVASHANGNGPEPWLNDHADFRRVFMTGDSAGANITHTLAARIGSTELPGVKVIGIALVHPYFGGTDDDKMWLFLCPTNGGLEDPRLKPATEDLAKLGCEKMLIFVADEDHLKERGISYYDELKKSGWKGTVEIEENKGQHHVFHLMNPTCDDAKAMKKRLVSFIKE

SEQ ID NO: 79604 - protein, 410 aa, Rhodococcus sp. RHA1
MSNQVFLLPDLGEGLTEADIAEWKVRVGDTVTIDQVVVEVETAKAAVEVPIPFEGTVISLHGDEGSTLQVGTPLITVSGTPAAHEQYREEEQAGSGNVLIGYGTSEDTRRRRRRVGVTREATRPEPNRTGVAPRVISPVVRNLARQNGLDLSRLSGSGPGGVINRADVEKALATTPAPADAQRIPIKGLRKAVADKLSTSRREIPDATTWVDVDASELLVARRAINATLDADAGVSLMALLARLALAALKQYPELNSTVDTERGEIVRYGHVHLGIAAQTPRGLVVPVIERADSLTTVELARQLRDTTALAREGTLPPARLTGGTFTLNNYGVFGVDGSTPIINHPEAAILGVGRIIDKPWVIDGQLAVRKVTQVSLSFDHRVCDGGVAGGFLRLFADYIENPITALGRL

SEQ ID NO: 79605 - protein, 496 aa, Pseudomonas putida
MNSSLSAIDGLRLPHQMLIGGQWVNAQSGKTLNVYNPATGDILTEVPDGDVEDVNAAVESAAATLRSDTWRRMPPSARERILLRLADLLEVHGDELARLETLNNGKLLIYSKMMEVGASAQWLRYMAGWATKLTGSTLDLSLPLPPEVRSRASTQRVPVGVVAAIIPWNFPLLMAVWKIAPALACGNTVVLKPAEETPLTALRLAELAMEAGLPAGALNVVTGRGETAGDALVRHPKVAKVAFTGSTEVGRIIGGACGRSLKAVSLELGGKSPVIVLADCDPQEAAEGAAAAIFFNHGQVCTAGSRLYVHESIYEDVIQRLAVIGESIVVGSGLEQGVHMGPMVSKKHHENVLRHIRNGIEDGADLICGGTEAPCAQGFFVKPTIFANREKKDIRLLSQEVFGPVLVATPFSDIAEVVNEANRSVYGLGASIWTNDLSAALRINDELEAGAVWVNTHNMVDPNLPFGGFKDSGVGREHGAAAIEHYTTTRSLVIAY

SEQ ID NO: 79606 - protein, 599 aa, Vibrio sp. Ex25
MQVGNEALVLSAVGVIGLGCQWLAWRLRLPAILFLLLAGLIVGPFMQWLNPDEILGNLLFPLVSLAVAVILFEGSLTLNFKEIRGVSGSVWSIVSIGAIISWAATSIATHYFLGFTWELAMLFGSLTVVTGPTVIVPLLRTVRPNSTLANILRWEGILIDPLGALFVVMVYEFIVSHSAINSVEVFGTLIAVGVILGAASGAAVATIMRRAWLPEYLQPFAVLMIVLGVFSVSNHIESEAGLLTVTVMGMWLANAKGINIQQILHFKEHLTILLITGLFIFLAARISLDDFAALGSGALLLFVFMQLVSRPLSIFLSTIRSNLRLKDKLFLSWVAPRGIVAASISSLFAIKLTEYGIDEAILLVPMTFMVIIGTVVLQSATARPVALMLGVAEPAPRGFLLIGANRVAREIGQALARYDRRILMTDSNWEYISQVRMLGLDYYYGNPISSHADDNLNLIGVGQVVALTPDQHFNIMACMQFVDEFGEDRVHCLQKVKTNGNGSEKHSVAQEYHGKLLMGGNVSYTQLASLLSRGAEIKHTKLSDNFTYQDYLAHHKGNSVVPLFHVEEKGKIQFCDDPEQFAPTTTSTVVSLILSESAK

SEQ ID NO: 79607 - protein, 1955 aa, Ustilago maydis 521
MSFHLDSFVNSPASADQAPAWQLHSSTDSYLEWDANPKSLIEQQPSSTTTSPPPSMSRLRSTSSTVATLAPGAQTPAEPPSTDSASVLSHNGHTTSPERSVSPSYFTKLYFHPPDRTTSATSPTITFTSAIEPSLVAHAQPSPLLPTDAQSASHLPSPARESHTGRRPSISAVGSSSTTSPLTTPLSPTLSSRSSAAGGGFFASLRPSSPGNLPISTSKPQDGDNLGKPRRPSSVFDHVGNVWERFGRKVHHTRTATSEHHSSSSSHTRRSASQASPPIGLTPESADPFDTARNSPSGSFISQASPSQSTTTDSECRTPATPGGEPPAQLSTPQPLPSAPAYTSVSALDSSVNAPQQEEAEELPYLAPESPRPQPQSFNTIGSPRIPSGQRSATSHRRTSSLLERVLIQVTDDNERFSVVDISGVDSADAIKERMFAKLHLFDADHSSFQLFRTEIGQSEATGPVVSDDALLVLCLQMGDDRGTLKFLVQQIAPPPNSTVRALPPPTSTIVSQRAINNIRRTSGTGSAPGQHLRTESQSSKSSLSDALVYPEMIGADAAHEGSNRNSGSSLTRSKAQTRRALPSAPPVDDLRSPTHSCISSTTQSAVQDRRSIASSGDGSANESWARHGASASDGAPSAIPTQRSSSVNANASAAQSSSSGSAGRHPSNLEDDRQRYDAEPGVNRSLHAPATGSSHWQERSDEGARESLRVQTTAQLPGLTLHNAKSMDDLHRPSQSASQPSTLTTQAEVRKQAGMDRDGRYPTPAIMRPSTAAPAGAGARESASSHRQYSSDALGSSRSPQEPTLGLDPRMLQRNRSAQAAIPSGQQLVNHGPTRMSSTPQIRSPPMQHVYLGQGQIDPRFNTQPPHSAHPMQAHPSNMVARPPYSAAPSFASQPAYQSQSFGQAALRPMGHGFVNEFGARAPAASVNFNTYHGHDPRMNASAMQGSLTPRPYSYYEQPSMHQQQPMYRPYAQPSLVTASPYRTREDPFTTRYFPASSSRQVSEFQMQAGRLEPGMTVQQTLRTQEAIWGHTSAGSPGQAYQSAHAHPPGPSYGPRDPRQPGQSNQYTGMQAYPNASAAPQMQQRPSYQGSAMPNLHHVPPPRPQSYPSAQPQPQPPRNAHDRHPAPPAGHSGPQMMPQSSGSSAGRAPMQPQQNQQLSQPSQPSQREQPGHAQAMPGSESHRRDPPVRTNASERSSGSSFSSQGSFQHGRPHNDDCNSRNSIEESFSAPTSARSSQSEAASAKPVNVEHRSSYADQERDLADDELEHVRPLPKLPHSSATTRTDAFKSSSCDASGATVGGSVRRSEDEDTLRAGEWAQLWRALDPKSDGTVSGTAISGSSGGDGDTVRAEPSTPGASRPQTKDGATLPISLEPPRIPSPSLAPEENGTVSSFGTFDDDETESGTWAQPLDSDVNAPRLPLRLDADSEALSDDHATLLPGQDTLLQASTRGTRGFSAASNSPKRPELRLTIDPAAGPTVMTWTASQASTNSPRASTSHLSSALNSGGITRSNSFARRDDDWAFRPPPEQLYENLDDFFPKHDLDKPLLDTTAGPESGLVSSPRAEASVPSVASVGAQQGLSQRSRHKKSIRLVAEDRKRILERADTRRAAQGAELSSGLVRRRSTKLWGTKVVEMTPGQELATPASATSAESPWSDTASTTGQPVFKWVKGDLIGKGTYGRVYLALNATTGEMIAVKQVELPRTASDREDSRQKGVVAALKSEIETLKDLDHPHIVSYLGFEETRQFLSIFLEYVPGGSVGSCLRKHGKFEESTIKSFLHQILEGLAYLHSKGILHRDLKADNILVDFEGTCKISDFGTVRRSDDIYGNVENMSLQGSIFWMAPEVVSLSKKGYSAKIDIWSLGCVVLEMFAGRRPWSDDEAVQAMFKIGAQRKAPPIPADVKLTKQAAHFLKNCFEIDPAKRPTAQRLLDHVFTVPVPGWQFSHSALCRSLHR

SEQ ID NO: 79608 - protein, 330 aa, Paeonia suffruticosa
GSFTLNSFTGPIPDTLGKLTRLRFLRLNNNSLSGAIPMSLTNITALQVLDLSNNRLSGPVPDNGSFSLFTPISFANNLNLCGPVTGKPCPGSPPFSPPPPFVPPSTVSSPGANSPTGAIAGGVAAGAALLFAAPAIGFAWWRRRKPQEHFFDVPAEEDPEVHLGQLKRFSLRELQVATDTFSNKNILGRGGFGKVYKGRLADGSLVAVKRLKEERTPGGELQFQTEVEMISMAVHRNLLRLRGFCMTPTERLLVYPYMANGSVASCLRERPPSELPLDWPTRKRIALGSARGLSYLHDHCDPKIIHRDVKAANILLDEEFEAVVGDFGLA

SEQ ID NO: 79609 - protein, 147 aa, Fritillaria agrestis
TMLSSVATAARAAPAQASMVAPFVGLKSTSSFPVTQKPATGLSTLPSNGGRVQCMKVWPIVGLKKFETLSYLPTLSVETLLKQIEYLIRNGWVPCLEFSLEGFVSRDNNKSPGYYDGRYWTMWKLPMFGCTDAAQVVKEAAECKKEY

SEQ ID NO: 79610 - protein, 183 aa, Paeonia suffruticosa
MNHCAIQQQNVYAAREEMRSPVSIPMSDRRDSVVCPKPRRMGLLDSTISDPIRPLRWHLSHHQSEYSDSRAGTDLLDIILSKGGYSVEQSGNQLASSPPFFSGSPPSRVANPVVLDARFGDEKITPSAPLQPLLSPGPSSSPSSSARKGGCLRANYGSKPVVRIEGFDCLDRDRRNCSIPALA

SEQ ID NO: 79611 - protein, 147 aa, Fritillaria agrestis
TMLSSVATAARAAPAQASMVAPFVGLKSASAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 79612 - protein, 147 aa, Fritillaria agrestis
TMLSSVATAARAAPAQASMVAPFVGLKSTSSFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 79613 - protein, 331 aa, Nocardioides sp. JS614
MTVRVGINGFGRIGRNFFRAVVASGADIEIVAVNDLTDNKTLATLLKYDSILGRLEGDVTSTETEITAAGHTFRVFEERDPSALPWGELGADIVIESTGLFTDATKAKAHIDGGAKKVIISAPAKNEDVTIVMGVNEGDYDPAAHTIISNASCTTNCLAPMAKVLNDEFGIVKGLMTTVHAYTGDQNLLDGPHRDLRRARAAATNIVPTSTGAAKAIGLVLPELKGKLDGYALRVPVPTGSATDLTFEAGRETTVEEVNAVVKAAADGKILRYNEDPIVSSDITTDPASCIFDAPLTKVIGNQVKVVGWYDNEWGYSNRLVDLVDYVAASL

SEQ ID NO: 79614 - protein, 399 aa, Nocardioides sp. JS614
MAAYDGLGEVAGRRVLVRSDLNVPLDGTTITDDGRIRASVPTIKALADAGARVIVTAHLGRPKGAPEERYSLRPVVARLGELLGQDVAFATDTVGESARATVEALQDGQVAVLENVRFNAGETSKDEAERGAFADRLAALADAFVSDGFGVVHRKQASVYDVAQRLPHAMGALVAKETEVLRRLTVDPERPYVVVLGGSKVSDKLGVIDNLLGKADRLLIGGGMVFTFLKAQGHEVGKSLLEEDQLDTCRSYLERAERTGVQILLPTDVVVDTEFPSGDRAPEPRVVPASEIPADALGLDIGPESAAAFAAALADARTVFWNGPMGVFETDAFAGGTRTVAEALTRIDGLSVVGGGDSAAAVRKLGFDQAAFGHISTGGGASLEYLEGKELPGIKVLED

SEQ ID NO: 79615 - protein, 264 aa, Nocardioides sp. JS614
MATSRTPLMAGNWKMNLNHQEAVVLVQKLAWTLADKKHDYARAEVVVVPPFTDLRSVQTLVDGDRLLVKYGAQDVSTHDGGAFTGEISAGMLAKLGCSYVVVGHSERREYHTEDDQEVNAKAHQALGAGMVPIVCVGEGLDVRQAGGQVAHCLAQVDGSLAGFTAEQIAGLVIAYEPIWAIGTGEVATPDDAQEVCAAIRERIREVHGDEAADGVRVLYGGSVKAANVAGIMAKDDVDGCLVGGASLQADEFGGICRFYDMPVI

SEQ ID NO: 79616 - protein, 633 aa, Alkaliphilus metalliredigens QYMF
MIEVSLNGVGKYYGANQVLKNIEFQILKGERVGMVGRNGTGKTTIFKIISGVEKCDGGVFSIRKGAQIGWLEQTPEYLLEFKVIDVLNMAFHKELSIQQSIRELEEKMCFAKGKDLELIMGKYAELQEAFESQGGYNIEEKRSKICEGLGIGEKFKNMQFNDLSGGEKTSVLLGKILLEEPDILLLDEPTNHLDIESIEWLEAFLVAYKGTVIIISHDRYFLDRVVNKIVEIEVGRASTYLGNYSLYMEEKERLYLEELKRYENQQKKIKSMEESIKKLKDWANRGDSEKLFRRAFSMEKRLDKMEKVDRPTTDHDKMKLALSSQERSGQDVVWVEGLYKALEEKILFNDLSFYLRIGEKVAIIGKNGSGKSTFIKTLLGEVSSDTGDVKIGANVKIGYLQQEVYFNSEEHTVLEAFRESYVCTEGEARGILARFLFYSDDVFKKVSNLSGGERSRLRLCQLMYEDVNTLIMDEPTNHLDIMGREMLEEALLGFKGTIMFISHDRYFINRLATRVVELCNKDLVSYLGNYDYYTEKKRTEKPLVESRVLRDTTHTKSTKSPKGDLNNTSTKLNSKKLKEIEEEINKIEALVSAKEEEINANATDFNRLKDLYLEKTTLETSLNKLLDEWIGLK

SEQ ID NO: 79617 - protein, 319 aa, Salmonella enterica subsp. enterica serovar Paratyphi A str.
MKAMNKVWVIGDASVDLVPEKQNSYLKCPGGASANVGVCVARLGGECGFIGCLGDDDAGRFLRQVFQDNGVDVSSLRLDADLTSAVLIVNLTADGERSFTYLVHPGADTYVSPQDLPPFRQYEWFYFSSIGLTDSPAREACLEGARRMREAGGYVLFDVNLRSKMWRNTDEIPELIARSAALASICKVSADELCQLSGASHWQDARYYLRDLGCDTTIISLGADGALLITAEGEFHFPAPRVDVVDTTGAGDAFVGGLLFTLSRANCWNHALLAEAISNANACGAMAVTAKGAMTALPFPEQLNTFLSSHSLAQAMTVK

SEQ ID NO: 79618 - protein, 110 aa, Glycine max
  misc_feature (18)..(19): Xaa can be any naturally occurring amino acid
WIRERDTDRDEKVNFKEXXHGLFDLVRNYDEESHNDTDNSMDAPARGLFAQLDKDGDGYLSDVELQPIIGKLHPSEHYYAKQQADYIISQVHFYCRQRCRFFIARSADHA

SEQ ID NO: 79619 - protein, 507 aa, Zea mays
MGRNLPAEQVEAPRSSKMDKKRKKDKKRKLAAEAEEEAAVTATVETVKSSKKKRVENEPGAGAVEAENGAEKTVAVTGKGSEDPKYAPLRSFSAAELPSQVLECCSAFARPSPIQAHAWPFLLDGRDFIGIAATGSGKTIAFGVPALMHIRKKVGGKAGKKAVPRCLVLSPTRELAQQIADVLSEAGAPCGIKSVCLYGGTKKEPQISALKSGVDIVIGTPGRMKDLIEMGVCCLNEVSFVVLDEADRMLDLGFEPEVRAILSQTSSVRQMVMFSATWPLAVHKLAQEFMDPNPIKVVIGSEDLAANHDVMQIVEVLDDRTRDSRLLALLDKYHQAQSNRVLVFVLYKKEAARVETMLQRRGWKAVSVHGDKAQHDRTKALSLFKEGKCPLMIATDVASRGLDIPDVEVVINYSYPLTTEDYVHRIGRTGRAGKKGVAHTFFTQANKALAGELVNVLREADQVVPPALMKFGTHVKKKVWMPSNVSKSTERNTFENAVGEYILKKSL

SEQ ID NO: 79620 - protein, 114 aa, Triticum aestivum
  misc_feature (74)..(74): Xaa can be any naturally occurring amino acid
PTRPPTRPRTRGRRATTPAARPKHYRPGGKKKEGNAVKYITRTKAVKYLQISLAVFKKLCILRGVFPRRPKRKXGGDHQTYYHIEDLGFPGHGPLVEKVKGIKGHKKEGKKAMA

SEQ ID NO: 79621 - protein, 400 aa, Arabidopsis thaliana
MRFRSFFFSSSIFSLSHSRSPSLSSSRFSSLSAAMSPALEKSRQGNGGCNDDSKSKVTVVGSGNWGSVAAKLIASNALKLPSFHDEVRMWVFEEVLPNGEKLNDVINKTNENVKYLPGIKLGRNVVADPDLENAVKDANMLVFVTPHQFMDGICKKLDGKITGDVEAISLVKGMEVKKEGPCMISSLISKQLGINCCVLMGANIANEIAVEKFSEATVGYRGSREIADTWVQLFSTPYFMVTPVHDVEGVELCGTLKNVVAIAAGFVDGLEMGNNTKAAIMRIGLREMKALSKLLFPSVKDSTFFESCGVADVITTCLGGRNRRVAEAFAKSRGKRSFDELEAEMLQGQKLQGVSTAREVYEVLKHCGWLEMFPLFSTVHQICTGRLQPEAIVQYRENKL

SEQ ID NO: 79622 - protein, 498 aa, Oryza sativa Japonica Group
MRTNPTTSRPGVSTIEEKSTGRIDQIIGPVLDVTFPRGKLPYIYNALVVKSRDTDGKQINVTCEVQQLLGNNRVRAVAMSATDGLMRGMEVIDTGAPLSVPVGGATLGRIFNVLGEPVDNLGPVDTSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNLEESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLASKGIYPAVDPLDSTSTMLQPRIVGNEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEASTKAINLEEENKLKK

SEQ ID NO: 79623 - protein, 76 aa, Zea mays
  misc_feature (12)..(12): Xaa can be any naturally occurring amino acid
  misc_feature (40)..(40): Xaa can be any naturally occurring amino acid
  misc_feature (44)..(44): Xaa can be any naturally occurring amino acid
KRESHGHVKGAXSKSKFVCVARRIYDSSGRLGVVDIKFEXSMHXVETSAVGLAYGAAPSGISAVRPHVNRGISQVR

SEQ ID NO: 79624 - protein, 197 aa, Nocardia farcinica IFM 10152
MSTYTIPNVIAQHPRGGERITDIYSHLLAERIVYLGTPIDSGVANALIAQLLHLESESPDQEINFYINCEGGDLPSMLAVYDTMQHIGAPVHTTCVGQAIAVGAVLLAGGAPGQRAMLPHARVVLHQPAARGQGPIPDLILQADELVRMRSEIEAILSRHTGRSPEQLREDTDRDRVFTATAALEYGLIDTVLSPRG

SEQ ID NO: 79625 - protein, 537 aa, Physcomitrella patens subsp. patens
MDLKPRQIETQLSLDERSINDIISSGLSSPRPPRQLETAKSSECLEALLSPSIRSSAGTPREYHAFEPHPMIADAWERLRLSMVFYRSRPVGTIAALDPEEDSLNYNQVFVRDFVPSALAFLMNGEPEIVKNFLLRTLQLQSVEKRIDCFTLGEGVMPASFKVLHDPVRKTDTMIADFGESAIGRVAPVDSGFWWIILLRAYTKSTGDYTLADMPDCQRGMRLILYLCLADGFDTFPTLLCADGCCMVDRRMGIYGYPIEIQSLFFMALRSAKSLIKADGDGKEFLEKIDKRLHALSYHMREYFWLDHQQLNNIYRFKTEEYSHTAVNKFNVIPDSIPDWIFDFLPLKGGFFIGNVSPARMDFRWFAIGNFMAILGSLATADQASAIMDLLEARWPELVGDMPLKVSYPAMEGHEWRIITGCDPKNTRWSYHNAGSWPVILWMLTAACIKAGRPQIARRAIEQVETRLSADGWPEYYDGKLGRYVGKQARKFQTWSIAGYLVAKMMLEDPSHLGMIGLEEDKKIQKPSLTRSASWTA

SEQ ID NO: 79626 - protein, 483 aa, Bacillus amyloliquefaciens
VNGTLMQYFEWYTPNDGQHWKRLQNDAEHLSDIGITAVWIPPAYKGLSQSDNGYGPYDLYDLGEFQQKGTVRTKYGTKSELQDAIGSLHSRNVQVYGDVVLNHKAGADATEDVTAVEVNPANRNQETSEEYQIKAWTDFRFPGRGNTYSDFKWHWYHFDGADWDESRKISRIFKFRGEGKAWDWEVSSENGNYDYLMYADVDYDHPDVVAETKKWGIWYANELSLDGFRIDAAKHIKFSFLRDWVQAVRQATGKEMFTVAEYWQNNAGKLENYLNKTSFNQSVFDVPLHFNLQAASSQGGGYDMRKLLNGTVVSKHPLKSVTFVDNHDTQPGQSLESTVQTWFKPLAYAFILTRESGYPQVFYGDMYGTKGDSQREIPALKHKIEPILKARKQYAYGAQHDYFDHHDIVGWTREGDSSVANSGLAALITDGPGGAKRMYVGRQNAGETWHDITGNRSEPVVINSEGWGEFHVNGGSVSIYVQR

SEQ ID NO: 79627 - protein, 456 aa, Xylella fastidiosa 9a5c
MVIHSSVLELIGNTPIVKAQRLDTGLCDLFLKLESANPGGSIKDRVGLSMIEAAECRGHIKPGATLVDGAASSTSMGLAFVARQKGYRLILVVPDNMAWEKISNLKAMGAEVILTRSDVSKGHPEHYQDLAEKLAAETPGAYFINQFGNADNPAAHEFGTGPEILKQMGDHVDAVVLGCDSAGTITGLSRAFDSVASDVELILADPVGSILTQYINEGTCSDKSGTWLVEGIGSDCLPPISDFRRIKKTYAISDAESFHTARELLSKEGILGGSSTGTLLAAALKYCREQIERKRVLVFVCDTGNKYLLNMYNDDWMLDNGFLKRPHYGDLRDLILHPYSQRHTVVVDPNDLLTVAYQRMKRYGVSQLPVIEDGQLVGILDESDVLLHVYGDETRFCDPVSTAMVSKLHRLDVKSPIEGLLPVFERGQVAIVMEDAQFLGLITRIDLLNYLRRRMQ

SEQ ID NO: 79628 - protein, 339 aa, Psychrobacter arcticus 273-4
MYDVMAIGNALVDHEYLLSDAALEETDLTKGHMTLAGIEEQQQLLAYFKLAEIEPSKQAGGGSAANAMVAFSSLGGKPFYACRVGDDKQGEFYLKDLHEAGVTTSPQSIHAGGVTGSCVVAVTEDGERTMQTFLGTSSDITADNVDFNALTQAEWLYLEGYLAMSAGIQPAMDQLRQQAGVNGAKIAVSFADPAVVKFAKDGLLNMLGNKVAMIFCNSEEARLFTDETQYKSAARALLQHCQTAVVTDGANGAVIAHQPNDESDIEIYDIPTPAVDNVIDTNGAGDNYAGAFLYALSQQYSLPECGHLASAVAAQVIQQFGPRLASKDYQDIAKRVLSA

SEQ ID NO: 79629 - protein, 519 aa, Ustilago maydis 521
MPLPCGQAKAFWRLVLASFPRVPPLSHDPGEILVHDENSPVLCFLFPIVPVSALAWFLAAPSAPVFDHAWDASLVSDASFFNAPMPKSSSDPADSVVACCSLRATWFEGVVAQKSRVIWSMVKAKWSGLRRVDCDTEAHQRSARLSYLGCITDTVRIGGERTSGNHTLQTSYLESTCESRTTQPAPRPDRSIANTLSAMSTSIPATSSRTAPTPKSTVASASNPKKYPFYLGGTAASIAAFFTHPLDLTKTRMQTASSRQGMFSLMLKTFREQGPRGLYVGLTASLLRQMTYSVTRFGVYDKLKERTLKQNEGRALGPVQMALCASAAGAAGGLAGNPADILLVRMTSDVNKKPADRYGYPNAISGLVRMTRDEGLRSLFRGLGPNTVRAVLMNASQLATYDVFKNVLLGTGFFSEGTPLHFSASFMAGTVATTVCSPADVIKSRVMNAAGSGDGVLKTLRKDLAKEGLGFLFRGWTPAWMRLSPNTIIVFVVLEKLRLLVDYTREAKQSAVEPVQTTA

SEQ ID NO: 79630 - protein, 433 aa, Vibrio vulnificus YJ016
MSKIVKVLGREIIDSRGNPTVEAEVHLEGGFVGMAAAPSGASTGSREALELRDGDKARFLGKGVLKAIEAVNGAIADALVGKDAKDQAAIDAIMIELDGTENKSKFGANAILAVSLANAKAAAASKGMPLYEHIAELNGTAGQFSMPLPMMNIINGGEHADNNVDIQEFMIQPVGAKTLKEAVRMGAEVFHNLAKVLKSKGYNTAVGDEGGFAPNLKSNAEALEVIAEAVAAAGYVLGKDVTLAMDCAASEFFDKEAGIYNMKGEGKTFTSEEFNHYLAGLVEQFPIVSIEDGLDESDWAGFAHQTQLLGDKIQLVGDDLFVTNTKILAEGIEKGIANSILIKFNQIGSLTETLAAIKMAKDAGYTAVISHRSGETEDATIADLAVGTAAGQIKTGSMSRSDRVAKYNQLIRIEEALGERAPFNGLKEVKGQA

SEQ ID NO: 79631 - protein, 147 aa, Fritillaria agrestis
TMLSSVATAARTAPAQASMVAPFVGLKSTSAFPVTQKPATGLSTLPSNGGRVQCMKVWPIVGLKKFETLSYLPTLSVESLLKQIEYLIRNGWVPCLEFSLEGFVSRDNNKSPGYYDGRYWTMLKLPMFGCTDAAQVVKEAAECKKEY

SEQ ID NO: 79632 - protein, 332 aa, Gibberella zeae PH-1
MTIVTTIRSSIPRRSILVTGGAGFIGSHLVEALLADGYWKVVVIDNFDEFYSPEIKRANLAGLLQHPNLTVYEADIRDIPALTAIFADNDFSVVVHLAARAGVLPSLQVPDLYFDVNVTGTMNLLQCCKDFGVKQFVFGSSSSVYGLGAKAPFSESQKTTQPISPYAASKSAGELLCHTWSHLYQIRCVCLRFFTVYGPRQRPDLAIHKFTRLIHQGKPIPLFGDGSSIRDYTYIDDIIDGIFGAIDYEGSMFEAINLGESQTITLIDLISAIEGTLGRKALIDWRGEQPGDMPLTYADISKAGSIIGYKPKTQVQQGIVKFVAWYLNHNEV

SEQ ID NO: 79633 - protein, 147 aa, Fritillaria agrestis
TMLSSVATAARTAPAQASMVAPFVGLKSTSAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 79634 - protein, 467 aa, Oryza sativa Japonica Group
VFAGKPFIHYIRDLRREYGPIVKLQMGVRTLVVISSAELVHEALVEKGREFATRPAESPIRSIFSSGKFTVNSAVYGPEWRSLRRNMVSGMLSAARLREFRPARLRAMERFVARVRAEAAASRDGASVWVLRNVRFAMFCVLLDMTFGLLDLDEELVVRVDAVMKRVVLAVAARIDDYLPFLRPFLWRQHRQAVALRREQIDTVLPLINRRRAIVRGMRAGSPPDPAVAAPYSYLDSLLDLRVEGRDAVPTDEELVTLCAEMINGGTDTTATAIEWAMARVMDNPSIQARLHGEIMQRVGDARPVDDRDTEGMPYLKAFVKELLRKHPPTYFALSHAAVEPGSKLAGYDVPVDANLDIFLPTISEDPKLWERPTEFDPDRFLAGGETADITGSAGVRMIPFSAGRRICPGVGMGTAHIALMVARMVQAFEWRAHPSQPPLDFEDKVEFTVVMKRPLLAMVTPRKLSF

SEQ ID NO: 79635 - protein, 517 aa, Bacillus thuringiensis serovar konkukian str. 97-27
MSLLTVEKLGHTFGDRTLFKDVSMRLLAGEHVGLVGANGVGKSTFMNIITGQLIHDEGRVEWTPGTNYGYLDQHTILTPGRTIREVLADAFLPLFEKEKALNEVTEKMGTATPEELEELLEQMAEIQDALEAGGFYLLDIKIEEAARGLGIDAIGLDRDVAALSGGQRTKVLLAKLLLEQPEVLLLDEPTNYLDVEHIHWLTNYLKEYPHAFLLISHDTEFMNKCVDVIFHLEFTKMTRYTATYEKFLELAEINKNQHINAYEKQREFIKKQEDFIAKNKARYSTTGRAKSRQKQLDRMERIDRPETAIKPEFSFKESRASSRFVFEGENVEIGYTHPLLPKLTMTIERGEKIAIVGCNGVGKSTLLKTILGKIKPLSGKTSLGDFLNPSYFEQEVKADNITPIDDVWNTFPSLDQHQVRAMLAKCGLKNEHISRPLNQLSGGEQAKVRLCKLMGEESNWLLFDEPTNHLDVTAKEELKKAMKAYKGTILLVCHEPEFYEDWVTKTWDVEKWSQENS

SEQ ID NO: 79636 - protein, 516 aa, Nocardioides sp. JS614
MTTPPGWHNPLRDPRDRRLPRIAGPSGMVLFGVTGDLSRKKIMPAIYDLANRGLLPPGFSLTGFARRDWADQDFAQIVHDSVKTHARTEFREEVWRQLAEGFRFVPGNFDDDMAFERLRRTIEELDEVRGTGGNHAFYLAIPPGFFADVVGQLQEHGLTEGRGDSWRRVVVEKPFGHDLESAQRLNSVLAEVFPSGSIFRIDHYLGKETVQNILALRFANEMFEPIWNSNYVDHVQITMAEDIGIGGRAGYYDGIGAARDVIQNHLLQLMALVAMEEPTSFDAESLRIEKQKVLSSVVLPRRLDLTTARGQYAAGWAGGEQVIGFLEEEGIKRTSTTETYAAVTLHVDTRRWAGVPFYLRTGKRLGRRVTEVAVVFRRAPHLPFAASSTEELTQNALVIRVQPDEGVTMRFGSKVPGTQMEIRDVNMDFVYGGAFTESSPEAYERLILDVLLGDPPLFPRHEEVELSWRILDPILEHWARQDEQHKSRPEQYESGGWGPESANAMLARDGRVWRRP

SEQ ID NO: 79637 - protein, 321 aa, Bacillus thuringiensis serovar konkukian str. 97-27
MVVNEKVELATFAGGCFWCMVSPFEEMEGIIKVVSGYTGGHKENPTYKEVCSETTGHYEAVQITFDANKMPYEELLNIYWRQIDPTDVGGQFHDRGQSYETVIFYHNEEQHKKAEASKEELAKSGRFSKPIATKILPAATFYPAEEYHQGYHKKNTFRYELYRKGSGRDAFIKQHWPKDNAHLKEKLNEMQFYVTQENGTEPPFRNEYWNHKEEGLYVDIVSGEPLFTSLDKFDSGCGWPSFTKPVMSASVKEKMDVSHNMTRTEVRSKEGDSHLGHVFPDGPGPNGLRYCINSAALRFIPKEELEKEGYGDFLILFGNKK

SEQ ID NO: 79638 - protein, 467 aa, Vibrio sp. Ex25
MSKHQEYLAKRQLKRGTAGWILLAGLGVSYVISGDFAGWNFGIAQAGWGGFLIAAIAMAVMYFTLVLSLAEMSAAIPAAGGGYSFARQAMGPTGGFFTGLSVLIEYALAPAAIVIFIGSAVNELVGIDGPVVYALFYAVFIAIHMAGVGEALKVMMVISGLAVLAILITAAVLIGHFDVNNLFDIAPATAQATEILPFGWYGVWAALPFAMWLFLAVEGVPLAAEEAKNPAKDVPKGIIGAMLFLLLTATLVVVLLAGAVGSKVIGDSAVPLVDALKLTGNSTIAMAVNLLGLAGLIASFFSIIYGYSRLVFALSRAGYLPQTLSLTSDKKVPSRALLVPGVFGFLVSLTGEGDLILAMAVVGATVSYALMSLSHILLRIKQPELARPYKTPGGVITSSISLVLSLIAMTGVYAFDPSAFFMTMGLFLIGGVYYGLYSRNKLVAATAEEEFAMLSVAELELESDVAR

SEQ ID NO: 79639 - protein, 182 aa, Triticum aestivum
  misc_feature (7)..(7): Xaa can be any naturally occurring amino acid
MGDYTIXISTSLMEQLAPDDQNQIKRRTRKPKPRRFVEQPEEPQDNGRELPTEPKSSPAPVLPFPPPMYLPVTPAPPPPPPVIQEVEAIRAVVVESEKVLEKLQKKEATMREELTKRAKELHDKEFKLPYQNPSPCTDERAGCAECYRSNVQDPLKCAEAVKRFEACVRMAIRGGTTMGAAQ

SEQ ID NO: 79640 - protein, 382 aa, Shigella boydii
MSLKEKTQSLFANAFGYPATHTIQAPGRVNLIGEHTDYNDGFVLPCAIDYQTVISCAPRDDRKVRVMAADYENQLDEFSLNAPIVAHENYQWANYVRGVVKHLQLRNNSFGGVDMVISGNVPQGAGLSSSASLEVAVGTVLQQLYHLPLDGAQIALNGQEAENQFVGCNCGIMDQLISALGKKDHALLIDCRSLGTKAVSMPKGVAVVIINSNFKRTLVGSEYNTRREQCETGARFFQQPALRDVTIEEFNAVAHELDPIVAKRVRHILTENARTVEAASALEQGDLKRMGELMAESHASMRDDFEITVPQIDTLVEIVKAVIGDKGGVRMTGGGFGGCIVALIPEELVPAVQQAVAEQYEAKIGIKETFYVCKPSQGAGQC

SEQ ID NO: 79641 - protein, 147 aa, Fritillaria agrestis
TMLSSVATAARAAPAQASMVAPFVGLKSTFAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 79642 - protein, 188 aa, Zea mays
MAERGGERGAERGGDRGGFGRGFGGRGGGRGGPRGRGRRAGRPTEEEKWTPVTKLGRLVRDGKIKQLEQIYLHSLPVKEYQIIDLLVGPSLKDEVMKIMPVQKQTRAGQRTRFKAFVVVGDGNGHVGLGVKCSKEVATAIRGGIILAKLSVVPVRRGYWGNKIGKPHTVPCKVTGKCGSVTVRMVPAS

SEQ ID NO: 79643 - protein, 382 aa, Shigella boydii
MSLKEKTQSLFANAFGYPATHTIQAPGRVNLIGEHTDYNDGFVLPCAIDYQTVISCAPRDDRKVRVMAADYENQLDEFSLDAPIVAHENYQWANYVRGVVKHLQLRNNSFGGVDMVISGNVPQGAGLSSSASLEVAVGTVLQQLYHLPLDGAQIALNGQEAENQFVGCNCGIMDQLISALGKKDHALLIDCRSLGTKAVSMPKGVAIVIINSNFKRTLVGSEYNTRREQCETGARFFQQPALRDVTIEEFNAVAHELDPIVAKRVRHILTENARTVEAASALEQGDLKRMGELMAESHASMRDDFEITVPQIDTLVEIVKAVIGDKGGVRMTGGGFGGCIVALIPEELVPAVQQAVAEQYEAKTGIKETFYVCKPSQGAGQC

SEQ ID NO: 79644 - protein, 401 aa, Fritillaria agrestis
MDYVYGPGRNHLFVPGPVNIPEPVIRAMNRNNEDYRAPAIPALTKTLLEDVKKLFKTTTGTPFIIPTTGTGAWESALTNTLSPGDTIVSFLIGQFSLLWIDQQQRLKFKVDVIESEWGQGANLDELASKLAADRTHTIKAVCIVHNETATGVTNNLAAVRKLLDDYNHPALLLVDGVSSICALDFRMDEWGIDVALTGSQKALSMPTGMGFICASPKALEASKTAQSARVFFDWNDYLKFYKIGTYWPYTPSIQMLYGLRAALDLIFEEGLDNVIARHSRLGKATRLAVEAWGLKNCTQKEEWHSDTVTAVVVPPYIDSSEIVRRAWKRYNLSLGLGLNKVAGKVFRIGHLGNLNELQLLGCLSGVEMVLKDVGYPVKLGSGVAAAATYLQNSTPMIPSRI

SEQ ID NO: 79645 - protein, 208 aa, Vitis vinifera
MAVAELERCQTHELFRVAFHDDCIETLVTHVPHMVDSWIGDIEHIHRHRLHKLIVGLDIEWRPNNARYTNPVAILQLCVGRRCLIFQLLYAPEIPTSLIDFLGDTDYTFVGVGIQADSQKLLNDHNLRVGNVVDLAVLAARVLNTRELRNAGIKRLAREVLGREVEKPKHVARSRWDTDWLSDAQVHYACVDAFVSFEVGRSLNASAY

SEQ ID NO: 79646 - protein, 133 aa, Alkaliphilus metalliredigens QYMF
MSVDSVFVHKMWNDHELSKMIDKDIPYPMLSDQDGRIGKMYGIYDEDSGVETRGRFIIDPDGNVQGYEVLTPPVGRNVEESIRQVKAFQLVRETKGGEVAPSGWKPGKTTLKPGPDLVGNVWKVWKVSEAFED

SEQ ID NO: 79647 - protein, 382 aa, Shigella boydii
MSLKEKTQSLFANAFGYPATHTIQAPGRVNLIGEHTDYNDGFVLPCAIDYQTVISCAPRDDRKVRVMAADYENQIDEFSLDAPIVAHENYQWANYVRGVVKHLQLRNNNFGGVDMVISGNVPQGAGLSSSASLEVAVGTVLQQLYHLPLDGAQIALNGQEAENQFVGCNCGIMDQLISALGKKDHALLIDCRSLGTKAVSMPKGVAVVIINSNFKRTLVGSEYNTRREQCETGARFFQRPALRDVTIEEFNAVAHELDPIVAKRVRHVLTENARTVEAASALEKGDLKRMGELMAESHASMRDDFEITVPQIDTLVEIVKAVIGDKGGVRMTGGGFGGCIVALIPEELVPAVQQAVTEQYEAKTGIKETFYVCKPSQGAGQC

SEQ ID NO: 79648 - protein, 407 aa, Erwinia carotovora subsp. atroseptica SCRI1043
MSYPIERVRADFPLLASEVNGQPLAYLDSAASAQKPHSVIDREAEFYRHEYAAVHRGIHTLSAQATSAMEAVREKVASFINAASAEEIVFVRGTTEAINLVANSYGRTFIQPGDNLIITEMEHHANIVPWQMLAEAHGVEVRVLPLAEDGSLDVAQLPVLLDERTRLLAVTQISNVLGTLNPVKAMIAQAKAAGAVVLIDGAQSIMHQPVDVQDLDCDFFVFSGHKIYGPSGIGVLYGKRDLLQAMPPWEGGGAMIRQVSLRTGITYADSPWRFEAGSPNTGGIMGLGAALDYVTALGREDIQRYESSLMQYALEALTQVPDLTLYGPAERHGVIAFNLGQHHAYDVGSFLDRYGIAIRTGHHCAMPLMEHYGVPSMCRASLAVYTTREEIDRLVAGLQRIHRLLGS

SEQ ID NO: 79649 - protein, 568 aa, Brucella abortus
MARDATKLEATVAKLKKHWAESAPRDMRAAFSTDPGRFGRYSLCLDDLLFDWSKCRVNDETMALLKELAVAADVEGRRAAMFAGEHINNTEDRAVLHVALRDTSSKEVLVDGHNVLPDVKHVLDRMAAFADGIRSGALKGATGRKITDIVNIGIGGSDLGPVMATLALAPYHDEPRAHFVSNIDGAHIADTLSPLDPASTLIIVASKTFTTIETMTNAQTARKWVADTLGEAAVGAHFAAVSTALDKVAAFGIPEDRVFGFWDWVGGRYSVWSAIGLPVMIAVGPDNFRKFLAGAHAMDVHFRDAPLEKNLPVMLGLIGYWHRAICGYGSRAIIPYDQRLSRLPAYLQQLDMESNGKSVTLDGKPVSGPTGPVVWGEPGTNGQHAFFQLLHQGTDTIPLEFIVAAKGQRADTGINQHEMLMANCLAQSEALMKGRTLDEARAQLQAKNPACVASGAHSPAPASFPANRPSLTLIHDMLDPYALGRLIALYEHRVFVEAQIFGINPFDQWGVELGKELATELLPVVSAKEGASVRDASTQGLVAHLHARRKACRIICKVRNTRKAGPEA

SEQ ID NO: 79650 - protein, 139 aa, Wolbachia endosymbiont strain TRS of Brugia malayi
MAIERTLSILKPDTVKNNIIGNINSYIEKSGLRIIAQKMMLLTKKQAELFYAIHKDRPFFGGLVEFMTSGPVIVQVLVGENAISKYRQIMGATDPKQADKGTIRGDFADDVNENRVHGSDSLENAHKEIAFFFAECELV

SEQ ID NO: 79651 - protein, 332 aa, Salmonella enterica subsp. arizonae serovar 62:z4,z23:--
MKTLGEFIVEKQHEFSQATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDSSTSRPYTSRYIGSLVADFHRNLLKGGIYLYPSTASHPQGKLRLLYECNPMAFLAEQAGGKASDGKERILDIIPESLHQRRSFFVGNRHMVEDVERFIREYPDA

SEQ ID NO: 79652 - protein, 470 aa, Erwinia carotovora subsp. atroseptica SCRI1043
MKKTKIVCTIGPKTESEEMLGNLLSAGMNVMRLNFSHGDYVEHGQRIKNLRAVMEKTGQQAAILLDTKGPEIRTMKLENGADVTLTAGQTFTFTTDQSIVGNKDRVAVTYAGFTEDLSVGNTVLVDDGLIGMQVTAVSGNDVVCKVLNNGDLGENKGVNLPGVSIQLPALAEKDKRDLIFGCEQGVDFVAASFIRKRSDVEEIRAHLKAHGGEHIQIISKIENQEGLNNFDEILEASDGIMVARGDLGVEIPVEEVIFAQKMMIEKCNLARKVVITATQMLDSMIKNPRPTRAEAGDVANAIIDGTDAVMLSGESAKGKYPLESVTIMATICQRTDSVMKSRLDTIKTPGILRITEAVCRGAVETAEKLDAPLIVVATSGGKSAKSIRKYFPNARILALTTNEVTARQLLLSKGIDTLLVKEIASTDDFYRIGKEAALKTGHAQAGDVVVMVSGALVSSGTTNTASVHRL

SEQ ID NO: 79653 - protein, 328 aa, Acetobacter tropicalis
MARFLVTGGAGYVGSHVVLALLDDGHDVVVFDSLRTGHRAAVPEQASFVHGDLADLDCLNKVLAEGPWDGVLHFAALSLVGESMQDPMLYMSANAGIGFGLIDACVRHGIKRFVFSSTVGLFGSAGDAPISEDTPVDPGSPYGESKYMVERALYWADRIHGLKSACLRYFNAAGADPAGRAGEDHRPETHLIPLVIDAALQRRPALTLFGQDYPTPDGTCIRDYVHVTDLARAHLAVLPLLNEKSVTFNVGTGRGNSNREIIESVGRVTGLDVPWKAGDRRPGDPPCLVASPARLMEATGWAPEFTDIDRIVETAYAWRKVHPQGYGA

SEQ ID NO: 79654 - protein, 252 aa, Brassica napus
MSSSHCPTPLPSVTKLQVDSVTFPPSVISPASSNPLFLGGAGVRGLDIHGKFVIFTVIGVYLDAVAVPSLSVKWKGKTTEELTESVPFFREIVTGSFEKFIKVTMKLPLTGQQYSEKVTENCVAIWKSLGIYTDSEAKAVERFLEVFKDETFPPGASILFALSPNGSLTIAFSKDDSIPKTGKAVIENKLLAEAVLESIIGKKGVSPGARLSLAERLSQLMKENKVEKDATKTDNQDEANDVSLGDKLAKEN

SEQ ID NO: 79655 - protein, 254 aa, Salmonella enterica subsp. enterica serovar Paratyphi A str.
MNSQFAGLTREACVALLASYPLSVGILAGQWIALHRYLQQLEALNQPLLHLDLMDGQFCPQFTVGPWAVEQLPQTFIKDVHLMVADQWTAAQACVKAGAHCITLQAEGDIHLHHTLSWLGQQTVPVIGGEMPVIRGISLCPATPLDVIIPILSDVEVIQLLAVNPGYGSKMRSSDLHERVAQLLCLLGDKREGKIIVIDGSLTQDQLPSLIAQGIDRVVSGSALFRDDRLAENTRSWRAMFKVAGDTTFLPSTA

SEQ ID NO: 79656 - protein, 480 aa, Nocardia farcinica IFM 10152
MPTSTARAHIGVTGLAVMGSNIARNFARHGYTVALHNRSVAKTDALLAEHGGDGDFVRTETIEEFVAALERPRRVLIMVKAGEATDAVIEELAAAMEPGDIIIDGGNALYTDTIRREAALRERGLNFVGAGISGGEEGALNGPAIMPGGPAESYESLGPLLESIAAKVDGTPCCTHIGPDGSGHFVKMVHNGIEYADMQLIGEAYHLFRDALGFDAGQIAAVFTQWNSGDLESYLVEITAEVLNQVDAKTGRPLVDVIVDAAEQKGTGRWTVKSALDLGVPVTGIAEAVFARALSGSRAQRKAATGLAAGTLADRPTDVEQFTEDIRRALYASKVVAYAQGFDQIAAGSAEYGWNLRPGDLATIWRGGCIIRARFLNRIKEAYDKDPQLPSLILDPYFREAIEAGIDSWRRVVSTATLLGIPVPAFGSSLSYYDALRSPRLPAALTQAQRDYFGAHTYERIDADGKYHTLWSGDRSEVTA

SEQ ID NO: 79657 - protein, 255 aa, Salmonella enterica subsp. enterica serovar Paratyphi A str.
MRHPLVMGNWKLNGSRHMVNELVANLRKELAGVAGCDVAIAPPEMYIDLAKRAAAGSHIMLGAQNVDLNLSGAFTGETSAEMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKADAKIAEQVIIQYGGSVNASNAAELFAQPDIDGALVGGASLKADAFAVIVKAAEAAKQA

SEQ ID NO: 79658 - protein, 298 aa, Cryptococcus neoformans var. neoformans JEC21
MSATQLPEIMDAILFKHPYKVAVEQVPTPKLQTEGDVIIKVHLAGLCGSDLHLYRAKEDAGKDYTMGHEVVGTIVQKGKEVNSFNVGDIVAVPFTISCGKCYYCSTSHTARCTSSALFGTPSLPGCQATYVRVPLAASCLLLKPPQLPEELMLLMADILPTGYSAAWNAWRLLDRGGERGGKGEKKDICVVVGCGPVGLCAITSAQTLFSKVFAVDPTPARRELAIKHGATALVPGELQSAVMAATEGRGADAVLEVVGNQGAFDTALSIVRPYGAVSSVGVHAGELKIDGGLLYDKK

SEQ ID NO: 79659 - protein, 286 aa, Streptococcus pneumoniae TIGR4
MITLKSAREIEAMDKAGDFLASIHIGLRDLIKPGVDMWEVEEYVRRRCKEENFLPLQIGVDGAMMDYPYATCCSLNDEVAHAFPRHYILKDGDLLKVDMVLGGPIAKSDLNVSKLNFNNVEQMKKYTQSYSGGLADSCWAYAVGTPSEEVKNLMDVTKEAMYKGIEQAVVGNRIGDIGAAIQEYAESRGYGVVRDLVGHGVGPTMHEEPMVPNYGIAGRGLRLREGMVLTIEPMINTGDWEIDTDMKTGWAHKTIDGGLSCQYEHQFVITKDGPVILTSQGEEGTY

SEQ ID NO: 79660 - protein, 304 aa, Camellia sinensis
MEKYEKLEKVGEGTYGKVYKAKDKETGQLVALKKTRLEMDEEGVPPTALREVSLLQMLSHSLYVVRLLCVEHVDNKHGKPLLYLVFEYLDTDLKKFIDSHRKGPDPRALPLSLIQSFLYQLCTGVAHCHSHGVLHRDLKPQNLLVDKEKGILKIADLGLGRAFTVPLKSYTHEIVTLWYRAPEVLLGSTHYSTAVDMWSVGCIFAEMARRQALFPGDSEFQQLLHIFRLLGTPTDKQWPGVSSLRDWHVYPQWEAQNLARAVPSLGPDGVDLLSKMLKYDPAERISAKAALDHPFFDGLDKSQF

SEQ ID NO: 79661 - protein, 440 aa, Camellia sinensis
MGSRAVVVPDQQPRGRGGKQKNGQAEGRNRRVLRDIGNLVPVPTVEEKPQNQISRPVTRSLCVQPAAAAEKKNKKPLAEVVNGGGEVKAAAAAHKKHYDPPKPETVIVISSDEELESEEKKKPVAVIARKSRVGSSRTMTSILTARSKALCGPTTKPKVPIADIDAADVDNELAVVEYVEDIYKFYKLTEGESRVHDYMDSQPEINSKMRSILIDWLTEVHRKFELMPETLYLTINIVDRYLSMNAVPRRELQLVGISSMLIACKYEEIWAPEVSDFIVISDNAYVREQILIMEKAILGKLEWYLTVPTPYVFLVRFIKASVPSNDHREEMENMVFFLAELGLMHYPTIILYCPSMIAASAVYAARCTLNSNPLWTETLKHHTGYSEDQLGDCAKMLARFHSDGGGVEKSKLKAVYKKFSSSDRSSVALFPPARSLLLVL

SEQ ID NO: 79662 - protein, 243 aa, Vibrio harveyi
VEGGNLIVNGKTVRVTAERNPEDLKWDAIGVDVVAEATGLFLTDETARKHITAGAKKVVLTGPSKDATPMFVMGVNHATYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELAGVLGYTEDQVVSQDFIGEVQTSVFDAKAGIALT

SEQ ID NO: 79663 - protein, 294 aa, Camellia sinensis
MEQYEKVEKIGEGTYGVVYKARDRVTNETIALKKIRLEQEDEGVPSTAIREISLLKEMKHGNVVRLQDVVHSEKRLYLVFEYLDLDLKKHMDSCPEFSKDPRLIKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRILGTPNEDTWPGVTSLADFKSAFPKWPSKDLATVVPNLDSAGIDLLSKMLCLDPSRRITARSALEHEYFKDIGFVP

SEQ ID NO: 79664 - protein, 303 aa, Escherichia coli
  misc_feature (41)..(41): Xaa can be any naturally occurring amino acid
MSTLEQTIGNTPLVKLQRMGPDNGSEVWLKLEGNNPAGSVXDRAALSMIVEAEKRGEIKPGDVLIEATSGNTGIALAMIAALKGYRMKLLMPDNMSQERRAAMRAYGAELILVTKEQGMEGARDLALEMANRGEGKLLDQFNNPDNPYAHYTTTGPEIWQQTGGRITHFVSSMGTTGTITGVSRFMREQSKPVTIVGLQPEEGSSIPGIRRWPTEYLPGIFNASLVDEVLDIHQRDAENTMRELAVREGIFCGVSSGGAVAGALRVAAANPDAVVVAIICDRGDRYLSTGVFGEEHFSQGAGI

SEQ ID NO: 79665 - protein, 458 aa, Oryza sativa Japonica Group
MAMAAASAMRPLAPLFLFFFFSLAASASDNILANSSLADGQKLVSAGGVFELGFFTPPGSTTAARFLGIWYRDIDPPTVVWVANRDAPVSGTAGSLAVVVNGGGGGGGGRLVLGDGSGRVVWSSAPSNVTASDPVAARLLDSGNFVLAGGGGSGDVIWQSFDYPSDTLLPGMKFGWDLTTGLDRYLTTWRSAGDPSPGDYTFKIDPRGAPEGFIWYNGTSPVYRNGPWDGLQFSGEPEMEPNNTSFRFEFVANRTDVYYTFVVDGGGGGGVLSRFVLNQSSAQRYVWLPQAGGWSLYWSLPRDQCDQYAHCGAYGVCDVGAASMCGCPAGFAPASPRNWELRDSSAGCARRTRLNCTGDGFLPLRGVKLPDTTNATVDAAIAVDQCRARCLANCSCVAYAASDVRGGGSGCIMWSSPLVDIRKFSYGGEDLFMRLAASDLRMILLSSLVRMPYTFLRF

SEQ ID NO: 79666 - protein, 675 aa, Xanthomonas campestris pv. campestris str. ATCC 33913
MLEHYGLMLALGCAVLAIVYGMLSARWVVAQPSGNARMQEIAAAIQEGARAYLNRQYLTISIAGVVLFVLVGLFLSWYTAIGFAIGAVLSGLAGYIGMNVSVRANVRTAQAARHGISKAMDVAFRGGAITGMLVVGLGLLGVAGYFAILQAMGLPLEQNLHALVGLAFGSSLISIFARLGGGIFTKGADVGADLVGKVEAGIPEDDPRNPAVIADNVGDNVGDCAGMAADLFETYAVTVIATMLLGSLTLAETGPHAVLYPLVLGGVSIVASIIGAAFVKVKPGGSIMGALYKGVIVSGVLAAIAYLPITQALMRENAHGAMSLYACALIGLVLTGLIVWITEYYTGTQYGPVQHVAAASTTGHGTNIIAGLGISMKSTALPVIAVCAAIWGAFHFGGLYGIAIAATAMLSMAGMIVALDAYGPITDNAGGIAEMAELPPEVRNVTDPLDAVGNTTKAVTKGYAIGSAALAALVLFADYTHNLQAANPNEVFAFDLSDHTVIIGLLIGGLIPYLFGAMAMEAVGRAAGAVVEEVRRQFRDIPGIMTGTAKPQYDRAVDMLTRSAIREMIVPSLLPVVVPVIVGLLLGPRALGGLLIGTIVTGLFVAISMTTGGGAWDNAKKYIEDGHFGGKGSEAHKAAITGDTVGDPYKDTAGPAINPLIKIINIVALLLVPLL

SEQ ID NO: 79667 - protein, 247 aa, Triticum aestivum
SELLLVYDYMPNGSLDRVLHGQRKQTIDWVQRFNIIKGIASGLCYLHEDWEKVVIHRDIKASNVLLDNEMNGRLGDFGLARLHNHGTDAHTTHLAGTWGYIAPELARLGRATKATDVFAFGVFMLEVACGRRPIQVNDSAGEPVLLTDWVVDAWESGSILRTVDPKLEDYVSEEAELVLKLGLLCSHPVQSARPCMRLVMQYLVKDVLLPDFQPSFLSLTSRDEEFGQHILSCPSVATTITGLSGGR

SEQ ID NO: 79668 - protein, 330 aa, marine gamma proteobacterium HTCC2080
MSSVMPPEWAPHSATWMGFPAAAYPEADVSNDDVWQAWATVANVIVDHEPVNMLCRPEQLPIARRLLSSAVTLHEFPIEDAWLRDTGPTFVAADNGLKAVDWRFNGWGDNTTFAWGEDAKIATHIAELLDIERISSQLTNEGGGLHVSGDGLVLLTDTVQLDPDRNPKWTRRQVEEEVHRLLGTGSAIWLPHGLWRDYAAHGTRGHVDIVACFNELGSVLLHRQQDRSHPDCERYELHRQALEQADLKYTDIVAPKTLEDRHGWVDYSYINHYVLNGAVVVPTFSDPNDGLACEQLAEAWPERDIRIVDARVIFAMGGGIHCITQQQPRI

SEQ ID NO: 79669 - protein, 338 aa, Bacillus thuringiensis serovar konkukian str. 97-27
MAILITGGAGYIGSHTCVELLNNNYKIIVVDNLSNSSIESLNRVKEITGKQFEFYKENVLNREKMNEIFLENNIEAVIHFAGFKAVGESTTTPLAYYYNNIISAIVLCDVMQKHNVKNFIFSSSATVYGIPKTSPITEEFPLSVTNPYGQTKLMIEQIMRDVAKADDEWSIALLRYFNPFGAHQSGRIGEDPNGIPNNLMPYVTQVAVGKLKELNIFGNDYPTKDGTGVRDYIHVVDLAKGHVKALEKVLKTKGIEAYNLGTGKGYSVLEMVKAFEKVSGKKIPYKVIGRRPGDVAICFADVSKAKRELGWEAEYGLEEMCVDSWRWQVNNKNGYQMI

SEQ ID NO: 79670 - protein, 272 aa, marine gamma proteobacterium HTCC2080
MFTYINPDVRKKLIARNKLVRIDEEGRQINSEGASPAGQRSLNLLGPVPLPLARGTKQPMADWYATVRSTELSEVEGLATTLREQGGQHLFSQLASSMAVNSVLAIGDAETTESPLVRVHSNCLTGDVFGSRRCECGPQLEAAIDRLAEEPGGGYLIYMAGHEGRGIGLWAKAATYLLQDEGEDTYQANRSLGLPDDSRDFSDAATLLKYFGRGRPLRLLTNNPKKIDDLLANGLTNIERVKHVTGVDDHNLRYLKAKQAWGHSIDEDDLKS

SEQ ID NO: 79671 - protein, 178 aa, Xanthomonas campestris pv. campestris str. ATCC 33913
MGLELVTSGKNLPEEINVVIEIPKDSEPVKYEVDKASGAIFVDRILSTPMRYPCNYGYVPNTLCGDGDPADVLVVLPLPLVPGSVVRCRPVGVLRMSDEAGSDEKILAVPIEKIFSGYAHIEDIDQVSSHWMERIGHFFEHYKDLEKGKWVKLDGWGGAAEAKRILVESVERYNSDAP

SEQ ID NO: 79672 - protein, 182 aa, Bacillus thuringiensis serovar konkukian str. 97-27
MWVTIVDMWISYVDNMFVRWGIRVNISIISIGKLKEKYLKQGIAEYLKRLSAYAKVEVIELPDEKAPENLSEAEMLIVKEKEGIRILDKISDDTHVIALAIEGKQKSSEEFAVSLDRLATYGKSKVAFVIGGSLGLSSEVMKRSNESLSFSKMTLPHQLMRLVLLEQVYRSFRINRGEPYHK

SEQ ID NO: 79673 - protein, 805 aa, Capsicum annuum
MTDQAESSDSKNAKKDFSTAILERKKAANRLVVDEAVNDDNSVVALHPATMEKLQLFRGDTILIKGKKRKDTVVIALADETCDEPKIRMNKVVRSNLRVRLGDVVSVHQCPDVKYGKRVHILPIDDTIEGLTGDLFDAFLKPYFLEAYRPLRKGDNFLVRGGMRSVEFKVIETDPGEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLGIHTKNMKLAEEVDLERISKDTHGYVGADLAALCTEAALQCIREKMDVLDLEDDTIDAEVLNSMAVTNEHFQTALGTSNPSALRETVVEVPNVSWEDIGGLENVKRELQETVQYPVEPPEKFEKFGMSPSKGVLFYGPPGCGKTLLAKAIANECQANFISVKGPELLTMWFGESEANVREIFDKARQSAPCVLFFDELDSIATQRGSSSGDAGGAADRVLNQLLTEMDGMNAKKTVFIIGATNRPDIIDPALLRPGRLDQLIYIPLPDEDSRHQIFKACLRKSPLSKDIDLRALAKHTQGFSGADVTEICQRACKYAIRENIEKDIEREKRRQENPDSMDEDVDEVPEIKPAHFEESMKYARRSVSDADIRKYQAFAQTLQQSRGFGTEFRFADTSGGATAAADPFATSNAAADDDDLYS

SEQ ID NO: 79674 - protein, 176 aa, Salmonella enterica subsp. arizonae serovar 62:z4,z23:--
MSLLNVPAGKELPEDIYVVIEIPANADPIKYEVDKESGALFVDRFMSTAMFYPCNYGYINHTLSLDGDPVDVLVPTPYPLQPGSVIRCRPVGVLKMTDEAGEDAKLVAVPHTKLSKDYDHIKDVNDLPELLKAQIAHFFEHYKDLEKGKWVKVDGWDNAEAAKAEIVASFERAAKK

SEQ ID NO: 79675 - protein, 444 aa, Bacillus sp. SG-1
MNNGLKRELGKWHGYALMIGGMIGSGIFVVTGEAGAQAGPSVPFGYVVLLPVLLCSALAYLIFMSTPLGNSPGGAYVHISRTFNNYFAGFLFMWFQYIALLGVMAIMAISFGDYISGVIGAGNTAILATALLLVFYLLNIIGVKWFGVVQLVMSAILFVAILVLVVPGVFFIETENFSPMLPNGWSGFVAILPSLFFAYFGFEQLAQAGGEMKDPQKAMPRTMLIGSFATVVIYFLISIVAFGVVPYDQLAQSQSAMFDVASVYLPAGGKWIVMTGIIMAFATTLNSLVMVVSRMLFAFAEDCVIPEGIAKVNKRFNTPHIAITINTIIVLALIWTRTLDYLLNVALQGMFLMYIGHAIAMIALPFVRPALFQTALIKPKLPLVIFCGIFSLSVLLFFSYTLIFSVIKLLLIWTAVGIVIFLLGRRQGKSKQFDYKTQLENAWK

SEQ ID NO: 79676 - protein, 507 aa, Burkholderia vietnamiensis G4
MHEDFNYLTSILNAPVYDVAVKTPLESLSRLSERLGSRVLLKREDMQPSFSFKVRGAYTLMARLSAEALARGVVTASAGNHAQGVALAAHTLGCRARVFMPHTTPDIKVQAVARYGAEVVLYGDNFDDACDAALADARERDSTFVPPFDHPHVIAGQGTVGMEILQQTTQLDAIFVPIGGGGLAAGICAYVKRVKPQIRIFGVEPSDADSMYQALEGGAPVRLAHVGRFCDGVAVRQVGAYSFALCRQYLDGVVRVDNDEVCAAIKDVFVDTRSILEPSGALALAGLKAWQRREQKGGTLVAIASGANMNFDQLRYIAERSTLGENREARFAVSIAERPGSFRALIEQLGDCVVTAFDYRRATGGDAQVFVGVRTPGAEGARKIVQDLAAAGYRATDLGGSTLWRTHGHQLVGAEAFRIDDEKLFQVMFPERRGALLEFLRKLDDAWDISLFHYRNEGFDYGRVLIGIRCGEADSARLYGALEATNFEFSEQADASPYLASLQGERR

SEQ ID NO: 79677 - protein, 349 aa, Bacteroides fragilis NCTC 9343
MNNHVVIMAGGIGSRFWPMSTPECPKQFIDILGCGKTLIQLTVERFGNVCPQENMWVVTSEKYIDTIREQLPGIPESNILAEPCPRNTAPCIAYACWKIKKKYPEANIVVTPSDQVVIDTTEFRRVIEKALLFTDKSSAIITLGIKPARPETGYGYIAAGEPITRDKEIFHVEAFKEKPDKETAEKYLAAGNYFWNAGIFVWNVRTITAVMRVYAPGIAQIFDRIYPDFYTEREEESVKKLFPTAESISIDYAVMEKAEEIYVLPAQMGWSDLGTWGALHTLLPKDKEGNATVGPDIRMYESRNCMVHASQEKRVVIQGLNDYIIAEKDNILLICQLSEEQRIKDFSKE

SEQ ID NO: 79678 - protein, 524 aa, Burkholderia vietnamiensis G4
MTHLENWQIRKAAISASGGIVVSQHYKASSIGAAVLEDGGNAVDAAIAASFAIGVLEPWQSGLGGVGHMVVAPAGRTAFSIDFAARAPLALEADDYRLTGEPARGMFGWPAVVDDRNLEGPFSIGVPGQVAGMTLAHRECGSLPWRRLVEPAVRCAREGLEIDWYLTLKIASVAAGLARYPGSSACYLRDGHAPASDWAGAALPIVLEEQAATLEAIAERGGDDFYRGALARRIAADFAAVGSRLSFDDLAAYRAEITPIEALRYRDASILTSSALTAGPALTRALSLFARQADADGTARPDARFFSRIADALTQTYAERIGGAAAGDDARRGTCTTHISVVDRHGNAVALTQTLLSMFGSKVTLPQTGIVMNNAVMWFDPRPGKANSIMPGAVPLSNMCPTVVKRATGDVLALGASGGRRIMPAVMQLVAYLVDCGMSIEDAIHFPRLDASGDPWVTIDDRFDASVAQAIGAAHEVRRAANLVAPNLFGCPNVVLRDGQTRQLTGGAFVSSPWSAAVAERDAH

SEQ ID NO: 79679 - protein, 755 aa, Staphylococcus saprophyticus
  misc_feature (245)..(245): Xaa can be any naturally occurring amino acid
  misc_feature (357)..(357): Xaa can be any naturally occurring amino acid
  misc_feature (361)..(361): Xaa can be any naturally occurring amino acid
  misc_feature (387)..(388): Xaa can be any naturally occurring amino acid
  misc_feature (391)..(391): Xaa can be any naturally occurring amino acid
  misc_feature (431)..(431): Xaa can be any naturally occurring amino acid
  misc_feature (464)..(464): Xaa can be any naturally occurring amino acid
  misc_feature (540)..(540): Xaa can be any naturally occurring amino acid
  misc_feature (709)..(709): Xaa can be any naturally occurring amino acid
MKNRENRYSIRKFSVGASSILVATLLFMGGGGGAAQATETHQKVGTSESTLAQSTGDNQKQADEQKTQQNKVQSNEQTTSTSQSVTNENEKQQNLLNENTPSTSVNDDTNKSYTNEETTNRLTDQNTKNQSTEATEASTTETHSDDSQSALTREDPPSLEKQETTKSTLQKDTETSNKKDNTTETTANVNPTAEKATNQELSVTPTTTDESKTLSTKDNTSKITDNHSSEKIRSEPTEETLQSTXSKAEDNSNVNHDSTKNDNNDVETLSTEKNNGIINTNAAKQTIPTKQSIDSTTSKENTLNIKKGTISINDTANETVGNKGAKDQKDSPAELEMLANNTVATTNNTSQQQGTTXTKDXTNKPAKQGQYKNQDPIILVHGFNGFXXGIXPSILSHYWGGDKLNIRQDLEQNGYNAYEASISAFGSNYDXAVELYSYIKGGTVDYGAAHAERYGHERYGKTYXGVYKDWQPGQKVHLVGHSMGGQTVRQLEELLRNGSQEEIEYQKAHGGDISPLLQGGQDNMVSSITTLGTPHNGTHXSDKLGNEAIVRQIAFDLGKKLGNKYSRVDFGLSQWGLKQQPGESYLSYLSRAKTSKLWQTKDNGFYDLTRDGATDLNRKTSLNPNIVYKTYTGEATHSTLSGKYKADYNLFLPFTATANVIGKAPEKEWRENDGLVSVISSQHPFNQAYTEATDVNQKGVWQVTPTKHXWDHVDFVGQDSKDTKRTREELQQFWYDLADDLVQSERSLKLKKLSL

SEQ ID NO: 79680 - protein, 567 aa, Lentisphaera araneosa HTCC2155
MTDPLTSSSKENITSFDDFIRLADYSLMDKLNADPDAKPNGENHHAREVFSGHYVPVTPTPLPNPEYISHSSTLFEELGLSNDMAHNKEFCQMFSGDLSVAREPMRPYGWATGYALSIYGREYTHQCPFRTGNGYGDGRAISIIELVSKGKRWEMQLKGSGTTPYCRGGDGRAVLRSSVREFLAQEYMHALGIPTSRSLSLYVSKSETVSRPWYSEDSGSINPDIHVDNPVAISTRVAPSFLRVGQVELFARRARSHAHPEVLEELRMIVTHLIDREYKQEIDQSDPFADQVLELAKLFSLRLSSLVAHWLRIGFCQGNFNSDNCPAGGYTLDYGPFGFCEVFDPEFQPWTGGGNHFEFFNQHAAAEKNFHMFYTALCTLLGDDPQALEKLEQVRADFSELIKNEIKKMWEAKLGLKTFNAELFSQLMALMMNTKVDYTIFFRELSHIPEDVSALEKSFYIPASKDLLEQWQTWLKTWRELVSENGDLSEISEQMKGVNPKYAWREWLVVPAYEQAAKGDYSLVKELQEVLLKPYEEQSKEIEEKYYRLKPKEFFNTGGVSHYSCSS

SEQ ID NO: 79681 - protein, 269 aa, Haemophilus influenzae R2866
MLTLNEHLLNQVLLIAYQAGKHLQQFYQKQVHVELKEDNTPVTEADLFVSQFLTEKLTALFPNVPVLSEENCHISFEERKNWKEYWLIDPLDGTQQFINRSDQFSVLITLVRKNKPVLSVIHAPILSTTYYAMDNFGAFKKQLDQVKKLTKNTTNFDRPLRIAVGATTSQEKVRSILPKDFPCEFVVVGSSSLKSGLVAEGAVDCYVRLGQTGEWDTAGAEVLLGETHGAIFDSHFEPLTYNQRETLINPHFVMVGDQSFDWRSIFQFN

SEQ ID NO: 79682 - protein, 164 aa, Geobacillus stearothermophilus
AFENKIVEAFIEIPTGSQNKYEFDKERGIFKLDRVLYSPMFYPAEYGYLQNTLALDGDPLDILVITTNPTFPGCVIDTRVIGYLNMVDSGEEDAKLIGVPVEDPRFDEVRSIEDLPQHKLKEIAHFFERYKDLQGKRTEIGTWEGPEAAAKLIDECIARYNEQK

SEQ ID NO: 79683 - protein, 319 aa, Streptococcus pneumoniae TIGR4
MSDRKNMKLFALNSNQEIAQKIAQAVGVPLGKLSSRQFSDGEIQVNIEESVRGYDVYIIQSTSFPVNNHLMELLIMVDACVRASAHSINVVLPYFGYARQDRIACPREPLTAKLVANMLVKAGVDRILTLDLHAVQVQGFFDIPVDNLFTVPLFAKHYCDKGLLGSDVVVVSPKNSGVKRARSLAEYLDAPIAIIDYPQDDATRNEGYIIGDVEGKKAILIDDILNTGRTFSEASKIVEREGATEIYAVSSHGLFVEGAAELLDNTNIKEILVTDSVATKEKTPKNVCYITASELIGDAIVRIHERKPVSPLFAYNKKK

SEQ ID NO: 79684 - protein, 199 aa, Haemophilus parasuis
EEGDIIIDGGNSNYPDTNRRVKALVEKGIRFIGSGVSGGEEGARHGPSIMPGGNEEAWQYVKPIFQAISAKTDKGEPCCDWVGKEGAGHFVKMVHNGIEYGDMQLICEAYQFLKDGLGLSYDEMQAIFAEWKKTELDSYLIDITTDILGYKDTDGTPLVEKILDTAGQKGTGKWTGINALDFGIPLTLITESVFARCVS

SEQ ID NO: 79685 - protein, 263 aa, Neptuniibacter caesariensis
MSIKIKTPEEIEKMRLAGKLAAEVLEMIEPYVKPGVTTNELNQICHDYIVDKQNAIPAPLNYHGFPKSICTSVNQVVCHGIPNDKKLKDGDIINIDITVIKDGYHGDTSKMFFVGKELPHARRLVDITLECMYRGIRLVKPGARLGDIGHSIQTYAEQNHYTVVREYCGHGIGAEFHEEPQVLHYGKADTGEILEEGMTFTIEPMINAGKRQVKLSKKDGWTVETSDRRLSAQWEHTILVTADGYEILTYRSDDSIERIGKAE

SEQ ID NO: 79686 - protein, 248 aa, Triticum aestivum
  misc_feature (82)..(82): Xaa can be any naturally occurring amino acid
EKKRLLQRGFPGYRRPTRPHHYLTTKDVVGGVSRGRNGLLPLRSGEVFDPKTGLWSELPEMPFVKAQVLPTAFLADVLNPIXYNGKLYVSFSLYSWPFFFDIGCDLYDSELNSWSTMPDGLGDGWPARQAGTKLGVVVNDELYTLEPSSSLDSGQIKRYDAEEDVWRTIVPHVPVHDFTDAESPYLLAGLHGKLHVITKEANNNLQVMQAVLENNTGNDAPEENVLWNIVASKNFGAAELISCQVLNV

SEQ ID NO: 79687 - protein, 567 aa, Lentisphaera araneosa HTCC2155
MTDPLTSSSKENITSFDDFIRLADYSLMDKLNADPDAKPNGENHHAREVFSGHYVPVTPTPLPNPEYISHSSTLFEELGLSNDMAHNKEFCQMFSGDLSVARAPMRPYGWATGYALSIYGREYTHQCPFRTGNGYGDGRATSIIELVSKGKRWKMQLKGSGTTPYCRGGDGRAVLRSSVREFLAQEYMHALGIPTSRSLSLYVSKSETVSRPWYSEDSGSVNPDIHVDNPVAISTRVAPSFLRVGQVELFARRARSHAHPEVLEELRMIVTHLIDREYKQEIDQSDPLADQVLELAKLFSLRLSSLVANWLRVGFCQGNFNSDNCPVGGYTLDYGPFGFCEVFDPEFQPWTGGGNHFEFFNQHAAAEKNFHMFYTALCTLLGDDPQALEKLEQVRADFSELIKNEIKKMWEAKLGLKTFNAELFSQLMALMMNTKVDYTIFFRELCHIPEDVSTLEKSFYIPASKDLLEQWQTWLKTWRKLVSENGELSEISEQMKGVNPKYAWREWLVVPAYEQAAKGDYSLVKELQEVLLKPYEEQSKEIEDKYYRLKPKEFFNTGGVSHYSCSS

SEQ ID NO: 79688 - protein, 355 aa, Sporothrix schenckii
MGACMSSNSEEVEQKKRSQKIDKDLEEDSKRLRRECKILLLGSGESGKSTIVKQMKIIHLKGYSEDELFSYRPTVFKNLLECAKAVINAMRQFEIELESDEIRAYCDFLLDYSIGSGPQPSIDPKVGEAVLALWEDPVRGQLMERQTEFYLMDSAGYFFDEVRRIVHPDYIPNEMDVLRARTKTTGIYETRFQMGPLSIHMFDVGGQRSERKKWIHCFEDVTSIIFCVALSEYDQVLLEESSQNRMMESLLLFDSVVNSRWFMRTSIILFLNKVDIFKQKLGRSPLGNYFPDYSGGDDANKAAKYLLWRFNQVNRAHLNLYPHLTQATDTSNIRLVFAAVKETILNNALKDSGIL

SEQ ID NO: 79689 - protein, 324 aa, Streptococcus pneumoniae TIGR4
MEVFESLKANLVGKNARIVLPEGEEPRILQATKRLVKETEVIPVLLGNPEKIKIYLEIEGIMDGYEVIDPQHYPQFEEMVSALVERRKGKMTEEDVRKVLVEDVNYFGVMLVYLGLVDGMVSGAIHSTASTVRPALQIIKTRPNVTRTSGAFLMVRGTERYLFGDCAININPDAEALAEIAINSAITAKMFGIEPKIAMLSYSTKGSGFGESVDKVVEATKIAHDLRPDLEIDGELQFDAAFVPETAALKAPGSTVAGQANVFIFPGIEAGNIGYKMAERLGGFAAVGPVLQGLNKPVNDLSRGCNADDVYKLTLITAAQAVHQ

SEQ ID NO: 79690 - protein, 490 aa, Pseudomonas aeruginosa UCBPP-PA14
MARFEEQKLYIGGRYVEASSGATFETINPANGEVLAKVQRASREDVERAVQSAVEGQKVWAAMTAMQRSRILRRAVDILRERNDELAALETLDTGKPLAETRSVDIVTGADVLEYYAGLVPAIEGEQIPLRETSFVYTRREPLGVVAGIGAWNYPVQIALWKSAPALAAGNAMIFKPSEVTPLTTLKLAEIYTEAGVPDGVFNVLTGSGREVGQWLTEHPLIEKISFTGGTSTGKKVMASASSSSLKEVTMELGGKSPLIIFPDADLDRAADIAVMANFFSSGQVCTNGTRVFIHRSQQARFEAKVLERVQRIRLGDPQDENTNFGPLVSFPHMESVLGYIESGKAQKARLLCGGERVTDGAFGNGAYVAPTVFTDCSDDMTIVREEIFGPVMSILVYDDEDEAIRRANDTEYGLAAGVVTQDLARAHRAIHRLEAGICWINTWGESPAEMPVGGYKQSGVGRENGLTTLAHYTRIKSVQVELGDYASVF

SEQ ID NO: 79691 - protein, 79 aa, Glycine max
  misc_feature (21)..(21): Xaa can be any naturally occurring amino acid
NFSTTRPIGFAVFLVHLATIXITGTGINPARSLGAAIIYNRDHAWNDHWIFWVGPFIGAALAAIYHHVIIRAIPMTSRS

SEQ ID NO: 79692 - protein, 574 aa, Oryza sativa Japonica Group
MEIARVVAPPLRLAWCPASRRWGRRKGRPPCPSSLPGPRHDHAVKRPGGEAAGGRSVNGAAPAPAPAPAEAPAKAPQRRQRRGPHDVEDEAWGLLRESVVRYCGSPVGTIAACDPNDASPLNYDQVFIRDFVPSGIAFLLKGDYEIVRNFILHTLQLQSWEKTMDCHSPGQGLMPASFKVRVVPLDGDDDVTEEVLDPDFGEAAIGRVAPVDSGLWWIILLRAYGKCSGDLSVQERIDVQTGIKMILKLCLADGFDMFPTLLVTDGSCMIDRRMGIHGHPLEIQALFYSALLCAREMLTPEDGSADLIRALNSRLIALSFHIREYYWLDKRKLNEIYRYKTEEYSYDAVNKFNIYPDQIPPWLVEWIPPKGGYFIGNLQPAHMDFRFFSLGNLWSIVSSLATSHQSDAILDLVEAKWSDLVADMPMKICYPALEDQEWKFITGSDPKNTAWSYHNGGSWPTLLWQLTVACIKVDRSEIAAKAVEVAERRIANDKWPEYYDTKRARFIGKQSRLFQTWTIAGFLVAKQLLENPDKSRILWNNEDEEILNAMNRMTDASNLKRRRGRKGLKKTYIV

SEQ ID NO: 79693 - protein, 448 aa, Pseudoalteromonas tunicata D2
MSSSFIVAKFGGTSLADFDAMFRCAQIIHDDNNVRVVAVSASAGVTNHLVALSHKDISDAVRQSHIDGVLAIQNNILAKLTLDADLATLFSQTLADFEQCAALTSTSEQHNDELLSFGERLSSCLFTQVLRDLGIKAERFDVRSVLKTDAHFGKATPNVAQTRAAALEHLVPLLNETVVVTQGFIGSDQHGRTTTLGRGGSDYSAALLAEAIDACSVHIWTDVVGIFSTDPRLCQKAKPIPKLSFDEAAEMATFGAKVLHPATILPASRAGISVFVGSSRAPEQGGTWIEKEKSQHPGIRAVTQRKNQILLTLKSPEMLLASGFLARVFTILSEYNISVDLVTTSEISVALTLDNAPNASRPELDQACLQRLSEFCHVTVENNLTLVALVGSEIQLRQHEMNLMQVLADFNIRMICHGASKHNLCFLVEQSESDAVVQSIHRRLLEVC

SEQ ID NO: 79694 - protein, 495 aa, marine gamma proteobacterium HTCC2080
MSTSQHFEHSFHALGSEYVTPTAATPVSAPKWLAWNNRLAEQLGWPEAWGHNEQTLITLAGNGQFEGSQPGSAAYAGHQFGNYNPQLGDGRAILLGEWRRPDGQLFDIQLKGAGPTPYSRGGDGRSPVGPVVREYLMSEAMHSLGVPTTRALAAVATGDPVYRQQLEPGAILTRVAKSHIRIGTVQFFAMTRQGKGLKELVSYVTQRHYGAALQKAQALNPQATHAQVLLNEVTRALANLVAHWQSLGFIHGVLNTDNMLLCGETVDYGPCAFMDTFAAGQVFSSIDTGGRYAFGNQPGIVHWNLSVLAQCLLPLIDEDQEKAVAVAQKSVDQFPTLFTDIYSARLAAKFGLDAMRDSDHALIESFFSQLEEDKLDFTLAFRWLTEVANGNMDATILESLFTPSSGLLNWQTQWSNRRLQATSASCEHMKTANPVVIPRNHWVAQAIGMAEAGDNELMETLQSRWQDPFNWHAGDEQFAAAPKREEQVHRTFCGT

SEQ ID NO: 79695 - protein, 492 aa, Mycobacterium bovis AF2122/97
MATIHPPAYLLDQAKRRFTPSFNNFPGMSLVEHMLLNTKFPEKKLAEPPPGSGLKPVVGDAGLPILGHMIEMLRGGPDYLMFLYKTKGPVVFGDSAVLPGVAALGPDAAQVIYSNRNKDYSQQGWVPVIGPFFHRGLMLLDFEEHMFHRRIMQEAFVRSRLAGYLEQMDRVVSRVVADDWVVNDARFLVYPAMKALTLDIASMVFMGHEPGTDHELVTKVNKAFTITTRAGNAVIRTSVPPFTWWRGLRARELLENYFTARVKERREASGNDLLTVLCQTEDDDGNRFSDADIVNHMIFLMMAAHDTSTSTATTMAYQLAAHPEWQQRCRDESDRHGDGPLDIESLEQLESLDLVMNESIRLVTPVQWAMRQTVRDTELLGYYLPKGTNVIAYPGMNHRLPEIWTDPLTFDPERFTEPRNEHKRHRYAFTPFGGGVHKCIGMVFGQLEIKTILHRLLRRYRLELSRPDYQPRWDYSAMPIPMDGMPIVLRPR

SEQ ID NO: 79696 - protein, 719 aa, Psychrobacter arcticus 273-4
MVYQGNRITVTMLEDGIANMQYNAENESVNKFDTETNKQFAEVVNALEKADDVKGLIVTSSKGVFIAGADITEFVASFKQSEEEIKDWVININDAFNRFEDLPFPKVAAINGAALGGGCEMTLVCEYRVMSDKAIIGLPETQLGIFPGFGGTVRSTRVIGIDNALELIATGAPKKALDALKLGLVDATVAADDLQDAAIDLVKKCISGELDWKAKREEKLVAVKLNQLEQAMAFNSAKGMIFAKANPKQYPAPALAIAAIEKHVNLPRDKAIEVEAAGFAKAAKTPQAESLVGLFLSDQLVKKLAKQHSKKAHEINEAAVLGAGIMGGGIAYQAASKGLPIIMKDIKSEQLDLGMGEASKLLGKMVDRGKMTPAKMGETLSRIRPTLNYGDFAETDIVIEAVVENPNVKRAVLKEVEGLVKDDCILASNTSTISITFLAEALERPENFVGMHFFNPVHRMPLVEVIRGEKSSEEAIATTVALASKMGKVPVVVNDCPGFLVNRVLFPYFGAFDLLLKQGADFAHVDKVMEKFGWPMGPAYLIDVVGLDTGVHGAEVMAEGFPDRMKPDYKGAIELLYENKRLGQKNGVGFYKYEMDKRGKPKKVADEATYELLKTTTDSEKQTFDDQAIIDRTMLAFCNETVRCLEDNIVSTPSEADMAMIMGVGFPPFRGGPCRYIDQMGLDNYLALCEKYAHLGKAYEAPQKIRDMAAAGETFYATA

SEQ ID NO: 79697 - protein, 428 aa, Nocardioides sp. JS614
MTTTQLAGLLPELEVIRADFPILDRTLAGGLPLVYLDSANTSQKPQVVIDTMVDHLERHNANVARAMHQLGAESSEAFEAARDKVAAFINAPSRDEVIFTKNASEALNLVANTLSWARGDRVNGVGALGAGDEVVITEMEHHSNIVPWQLLTERTGATLRWFGLTDDGRLDLSNIDSLITERTKVVALTWVSNMLGTINPVAEIARRAHEVGALVVVDASQAAPQLPVDVVASGADLLAFTGHKVVGPTGIGVLWGRREVLDQLPPFLGGGEMIETVRMERSTYAPIPHKFEAGTPPIVEAVGLGAAVDYLSMIGLDAIHRHEQAITAYALDGLATVPGLRVLGPLSAKDRGGAIAFEIDGVHPHDVAQVLDSRGVAVRAGHHCAKPAHARFGVQSSTRMSSYLYTTPAEIDALVEALEYTRSYFKLG

SEQ ID NO: 79698 - protein, 569 aa, Xanthomonas campestris pv. campestris str. ATCC 33913
MRCVPALLVSALVLLAPPSGAADRITGQPFATRSEVIAPHAMAATSQPLATQIALDVMKDGGSAVDAAIAANAALGLMEPTGNGVGGDLFAIVWDPKTNKLYGYNGSGRSPKSLTLAELQRRGLKDIPPTGPLPVSVPGAVDGWFALHGRFGRKPMAQDLAPAIRYAREGHPVAETIAYYWDRSVPRLSQYPGFKEQFTLDGHAPRKGELWKNPNLANTLQQIADGGRDAFYKGEIARTIGAYFKANGGFLSYEDLASHQGEWVEPVSTNYRGYDVWELPPNSQGIAALQMLNILEGYDFSKIGFGSTEHVHLFTEAKKLAFADRARFYADPAFQPAPLAKLISKDYAAQRRALISMDKALKEVQPGTPKQLEEGDTIYMTVADADGMMVSLIQSNYRGMGSGMAPPGLGFILQDRGEMFVLKKDHPNGYAPGKRPFQTIIPAFVTKDGKPWLSFGVMGGAMQPQGHVQIVMNLVDFHMNLQEAGDAPRIQHEGSTEPTGQATAMSDGGEVNLETGFSYDTIRGLMRKGHRVIFADGPYGGYQAIARDPASGVYYGASESRKDGQAAGY

SEQ ID NO: 79699 - protein, 441 aa, Burkholderia thailandensis E264
MSDKATRIDLLDWRTPPMRAFHLTWIAFFVCFFAWFACAPLMPLIAREFRLSADQVANVNIAAVAATIAVRLVVGPLCDRFGPRRVYAGLLALGAIPVFAVTFSHDYPTFLLCRLGIGAIGASFVITQYHTSVMFAPNVVGTANAAAAGWGNAGAGAAQAAMPLLAAAALLLGLPDACAWRAALAVPGVAMLVMAIVYWRGTQDCPQGDFVALRARGVTVDSGKKGGFASFAAACANYRVWMLFVTYGACFGVEVFMHNIAALYYVNHFQLSLKDAGLAAGIFGLLALFARALGGWLSDRVAARRGLDVRATLLFALIVGEGLGLLWFAHAGSVPVAVVAMVAFGLFTHMACGATYALVPFIDRRALGGVAGIIGAGGNVGAVAAGFLMKGVGDIEQTLTLLGLFVTVSAFCALAVRFSAEHKAREAALRERALAANGFTH

SEQ ID NO: 79700 - protein, 588 aa, Erythrobacter sp. NAP1
MRSKLSRYLPILEWGREYNRSILADDLMAAVIVTIMLIPQSLAYALLAGLPPVVGLYASILPLMLYAIFGTSRTLAVGPVAVISLMTASAAGSVAAQGTAEYLEAAITLAMLSGAMLAILGLLRAGFLANLLSHPVISGFITASGILIATSQIKHILGVDAGGDTWPAMLGSLAVAVGDTNVWTLVIGIPATLFLFWVRKGGSSALQAIGLRKRPADLVSKASPILAVALSIIAVIALDLGEKDVRLVGAIPQGLPPFALPGANISLIEQLWVPALLISVIGFVESVSVAQTLAAKRRQRISPDQELIGLGSANIASALSGGYPVTGGFARSAVNFDAGAQTPAAGALTAVGIAFATLFLTPLLFNLPIATLAATIIVAVLSLVDLKTPGQLWRYSKTDFTAHAVTIAITLIAGVEMGVIAGVGVGLVLFLWRASRPHAAIVGRVPETEHFRNIARHKVFTVPHVLSIRIDEALTYLNARWLEEYVLEEVADRPSVRHVILMCSAVNEVDASGLESLEAINHRLGDGGIGLHLSEVKGPVMDRLKRTHFIEELNGKVFLTQDKAFAEVSLDTGEPPAPVDHYMARGLI

SEQ ID NO: 79701 - protein, 382 aa, Shigella boydii
MSLKEKTQSLFANAFGYPATHTIQAPGRVNLIGEHTDYNDGFVLPCAIDYQTVISCAPRDDRKVRVMAADYENQLDEFSLNAPIVAHENYQWANYVRGVVKHLQLRNNSFGGVDMVISGNVPQGAGLSSSASLEVAVGTVLQQLYHLPLDGAQIALNGQEAENQFVGCNCGIMDQLISALGKKDHALLIDCRSLGTKAVSMPKGVAVVIINSNFKRTLVGSEYNTRREQCETGARFFQQPALRDVTIEEFNAVAHELDPIVAKRVRHILTENARTVEAASALEQGDLKRMGELMAESHASMRDDFEITVPQIDTLAEIVKAVIGDKGGVRMTGGGFGGCIVALIPEELVPAVQQAVAEQYEAKAGIKETFYVCKPSQGAGQC

SEQ ID NO: 79702 - protein, 876 aa, Zea mays
TTKKRVFHFGKGKSEGNKTMKELLGGKGANLAEMASIGLSVPPGFTVSTEACQQYQDAGCALPAGLWAEIVDGLQWVEEYMGATLGDPQRPLLLSVRSGAAVSMPGMMDTVLNLGLNDEVAAGLAAKSGERFAYDSFRRFLDMFGNVVMDIPRSLFEEKLEHMKESKGLKNDTDLTASDLKELVGQYKEVYLSAKGEPFPSDPKKQLELAVLAVFNSWESPRAKKYRSINQITGLRGTAVNVQCMVFGNMGNTSGTGVLFTRNPNTGEKKLYGEFLVNAQGEDVVAGIRTPEDLDAMKNLMPQAYDELVENCNILESHYKEMQDIEFTVQENRLWMLQCRTGKRTGKSAVKIAVDMVNEGLVEPRSAIKMVEPGHLDQLLHPQFENPSAYKDQVIATGLPASPGAAVGQVVFTAEDAEAWHSQGKAAILVRAETSPEDVGGMHAAVGILTERGGMTSHAAVVARGWGKCCVSGCSGIRVNDAEKLVTIGGHVLREGEWLSLNGSTGEVILGKQPLSPPALSGDLGTFMAWVDDVRKLKVLANADTPDDALTARNNGAQGIGLCRTEHMFFASDERIKAVRQMIMAPTLELRQQALDRLLPYQRSDFEGIFRAMDGLPVTIRLLDPPLHEFLPEGNIEDIVSELCAETGANQEDALARIEKLSEVNPMLGFRGCRLGISYPELTEMQARAIFEAAIAMTNQGVQVFPEIMVPLVGTPQELGHQVTLIRQVAEKVFANVGKTIGYKVGTMIEIPRAALVADEIAEQAEFFSFGTNDLTQMTFGYSRDDVGKFIPVYLAQGILQHDPFEVLDQRGVGELVKFATERGRKARPNLKVGICGEHGGEPSSVAFFAKAGLDYVSCSPFRVPIARLAAAQVLV

SEQ ID NO: 79703 - protein, 372 aa, Xanthomonas campestris pv. campestris str. ATCC 33913
MPDSGRPTTQEPDVGEVAVSVADVLAAQARLRKYLSPTPLHYAERFGVWLKLENLQRTGSYKVRGALNALLAGLERGDERPVICASAGNHAQGVAWSAYRLGVQAITVMPHGAPQTKIAGVAHWGATVRQHGNSYDEAFAFARELADQNGYRFLSAFDDPDVIAGQGTVGIELAAHAPDVVIVPIGGGGLASGVALALKSQGVRIVGAQVEGVDSMARAVRGDLREITPVATLADGVKVKIPGFLTRRLCSSLLDDVVIVREAELRETLVRLALEEHVIAEGAGALALAAGRRVSGKRKCAVVSGGNIDATVLATLLSEVRPRPPRKPRRRNTERLRNERSTKASPPSIAIPRPSAVASTPVTAIAVEESSW

SEQ ID NO: 79704 - protein, 376 aa, Hordeum vulgare subsp. vulgare
MDKISAPFFSGTSPAAASVAGVDEDDRLCFQAQELMFAYNISMVLRAAIQLGLLDALSAAGGKALTPNELVENVETSSNKAEAAAAVDRILRYLSCFNVVTCSSEAAGPDGTLVRRYTTGPLCRWLTKDRGDGTLSPFAVFVVDPDHLFPWHHIAEAVTAGGPSAFERTQKWPYYEYMGKNQRLGTLFDNAMAQHSVILVTKMLERFKGFDGVQRLVDVGGGTGSTLGMITSKYKHMTGINYDLPHVIAQGLPLPGVEHVAGDMYESIPTGDAVLLQWITLMLNDDEFVKILSNCHNALPKDGKVIVVDGILPENPDSSLTARDAFTLDIIMFVLFKGAKQRTEKEFARLAKQAGFTGGIKKTYIFFNFYALEFTK

SEQ ID NO: 79705 - protein, 357 aa, Xanthomonas campestris pv. campestris str. ATCC 33913
MSKQILILPGDGIGPEIMAEAVKVLTRIDTQHTLGVTLVYDELGGAAYDKYGSPLADETLERARAADAVLLGAVGGPQWDTIDPALRPERGLLKIRSQLGLFANLRPALLYPQLADASTLKPEVVSGLDLLILRELTGGIYFGQPRGTRTLDNGERQAYDTLPYSESEIRRIAKAGFEMARLRGKKLCSVDKANVLASSQLWRAVVEEVAKDYPDIALSHMYVDNAAMQLVRAPKQFDVIVTDNMFGDILSDQASMLTGSIGMLPSASLDANSKGMYEPCHGSAPDIAGQGIANPLATILSVAMMLRYTFAQAAAADAIEAAVGKVLDQGLRTADIWSEGTTKVGTAAMGDAVVAAL

SEQ ID NO: 79706 - protein, 182 aa, Brassica napus
MRFWTKLFIPFRTPFPPTSSMAPIAVGDVVPDGSISFFDENDQLQTVSVHSLAAGKKVILFGVPGAFTPTCSMKHVPGFIEKAEELKSKGVDEIICFSVNDPFVMKAWGKTYPENKHVKFVADGSGEYTKLLGLELDLKDKGLGVRSRRFALLIDNLKVTVANVESGGEFTVSSADDILKAL

SEQ ID NO: 79707 - protein, 362 aa, Thermosynechococcus elongatus BP-1
MPKAHWAIALPEGNSGGKAFYHKSIQFTSNNDGMNIKQGFVGTVGQTPLIRLNYFSDLTGCEILGKAEFLNPGGSVKDRAALYIIEDAERKGLLKPGGTVVEGTAGNTGIGLAHICNAKGYRCLIVIPNTQSQEKIDLLRTLGAEVRPVPAVPYKDPNNYVKLSGRIAAEMENALWANQFDNLANRQAHYETTGPEIWEQTDGRIDAWVAATGTGGTYAGVALFLKEKNPAIRTVIADPMGSAIYSYVKTGTLSSTGSSITEGIGNSRITANLAGAPIDDAIQIEDQECLDVIYQLLHYDGLFMGGSVGINVGAAVRLAKELGPGHTIVTVLCDGGSRYQSRLFNPEWLASKGLRVPEIKKR

SEQ ID NO: 79708 - protein, 210 aa, Brassica napus
GLCSSEISITIGGMSSTENLITSIQGLSASSGDLSALHRILKGAEETLRADSDLQLSTLEQLDASKHSLGYLYLLDVLTCGPMSKEKALDVVLLISRFITSCDAEQIRIASDKFVSLCKRFKDRVLELEDPLRGVAPLLTAVRKVQVSTKRLTALHPDCLQLCLLAKCYKAGFSILSDDILEVDQPRDFYLYCYYGGMICIGQKKFQKAL

SEQ ID NO: 79709 - protein, 222 aa, Bacteroides fragilis NCTC 9343
MNVTDNLKQVLAELPSGVRLVAVSKFHPNEAIEEAYRAGQRIFGESKVQEMTGKYESLPKDIEWHFIGHLQTNKIKYMAPYVSMIHGIDSYKLLAEVNKQAIKAEKVIRCLLQIHIAQEETKFGFSFDECKEMLNAAEWKALANIQICGLMGMATNTDSKEQIEREFRSLNCFFHEVKKQYFANEPTFCELSMGMSHDYHLAIKEGSTLVRVGSKIFGERVY

SEQ ID NO: 79710 - protein, 579 aa, Oryza sativa
MEGADEERPLIHHLPPQEQCSQYTCDGTVDIDRRPALKHSTGNWRACFFILGAEFTQCLCFSAVVKNLVRYLTSVLQESNVNAARSVSTWIGTCFFTPLIGAFLADTFWGRYRTIVICLSVYSIGMLILTTSASLPFLLHDSYNNGDDIRRVVAYLGLYLIALGAGGIKPCMSALGADQFDGADPVERVTKGSFFNYYYFSNNMGTLLSTTVLVWVQDNIGWGIGFATPMLLMGFGLSMFVAGRRVYRYRKLGRSPLTRVSQVVVAAARNHRLKLPDDSSLLHELPSLTEGGYRIQHTTRFRFLDKAAIPSDSDDNSPVQPDPWRLCTVSQVEELKMLLRVFPVWASLLVFFVVTAQMSSTLIEQSAAMDGRVGPFTVPPASLATFNVVAVLIWVPVYDAVLVPLARRATGNDRGLSHLQRIGVGLALSAVAMAYSAQVERRRRRPAAEEEAMSIMWQAPCYLVLGMAEVFTSIGMLEFFYERSPGSMKSLGTSLAHLAVATANYLNSGVLGVVVAATTRGGGAGWIPDNLDEGHLDYFFWMMALVRSDWASAAGQTGGDLMPQESIAGDGSGVNLEIR

SEQ ID NO: 79711 - protein, 246 aa, Salmonella enterica subsp. arizonae serovar 62:z4,z23:--
MLEQVCQLARNAGDAIMQVYDGAKPMEYFRKQDDSPVTAADIAAHTVILEGLRTLTPDIPVLSEEDPPAWEVRQHWQRYWLVDPLDGTKEFIKRNGEFTVNIALIEQGKPVLGVVYAPVLKVMYCAADGKAWKEECGVRKQIQVRDARPPLVVISRSHTDDELTEYLQQLGEHQTTSIGSSLKFCLVAEGQAQLYPRFGPTNVWDTAAGHAIAVAAGAHVHDWQGKTLDYTPRESFLNPGFRVTIY

SEQ ID NO: 79712 - protein, 532 aa, Nocardioides sp. JS614
MITTHHLEVRAGARLLMEDVSFRVAAGDKVGLVGRNGAGKTTLTKILAGEALPANGTVQTTGEVGYLPQDPRIGDPEVLARDRILSARGLDDVVRRLRQAEADMGSEDAGVRERAMRRYERADAQLHAGGGYAAESEAAQIAHSLGIEDRLLAQPLRTLSGGQRRRVELARILFSGAETLLLDEPTNHLDADSVVWLRDFLKAHKGGLIVISHDTGLLEATVNRVLHLDANRAEIDVYNMGWKAYLSQRETDEKRRKRERTNAENKAKTLTDQANKMRAKATKAQAAQSMLKRAEKLLAGVESERHADKVARIKFPAPAPCGKTPLTATELSKSYGSLEVFTDVDLAIDKGSRVVILGLNGAGKTTLLRILAGVDQPDTGSVVPGHGLKVGYYAQEHETLDVDRTVLENLQSAAPQLTDTEARSVLGSFLFSGEDAHKPARVLSGGEKTRLALAALVVSSANVLLLDEPTNNLDPASREEVLAAIRTYEGAIVLVTHDEGAVFALEPDRVLILPDGVEDLWNPEYADLVSLA

SEQ ID NO: 79713 - protein, 426 aa, Spinacia oleracea
MAIEHEDDLKDEKNPRPLDEDDIALLKTYGLGPYSASIKKVEKEIKDMSKKVNDLIGIKESDTGLAAPSQWDLVSDKQMMQEEQPLQVARCTKIINPNTEDAKYVINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRPDTLDPALLRPGRLDRKVEFGLPDLEGRTQIFKIHTRTMNCERDIRFELLARLCPNSTGADIRSVCTEAGMYAIRARRKTVTEKDFLDAVNKVIKGYQKFSATPKYMVYN

SEQ ID NO: 79714 - protein, 305 aa, Wolbachia endosymbiont strain TRS of Brugia malayi
MLDKTTKNLLITEINKILPEDSQNRLISAVRYVLLAPAKHIRPFLVVASSQVFNVEIERVISIAMAVECIHTYSLIHDDLPCMDNSDTRRGQLSCHKRFDKATAVLAGDALLTLAFEILSSLNEGSNKRCEIIKALSQAIGAKGMVGGQILDIKTALHVIQHHDYLDPESSVINEHTRQLCNKNRTLGSCAKITPDSKIKEIHLMKTAKLFAASCEIGAIIGSATDKQRRALYNYGVNLGLIFQAKDDIRDYKQDEVNNLMSMLSKSEIENYIDNLFKQALDNLGELSGDTNYLYNLLNQVKRDD

SEQ ID NO: 79715 - protein, 489 aa, Campylobacter lari RM2100
MKSMFLINCVDEKFLTQSLEKVQGKIAFYFPVFCEKNKEKIALICSKTNFKLDFFSSFEKNNYQSKFTQNSNDFFKKIIQDYEKLKKENDFVIVVGVDDFGLMGDLSLNIALAKELNAPLYAKSQDENHTMLNFLLSQKLSDFVLLKESEDFTQDLLQEYTYKTQARFSYELFEKAKADKKIVVLPESFDERVLKASEFLMQNEIVDLILLGDSNEICAKANSLNINIDGVRIINPKNSQYNEEFEELLYEARKSKGMSKEEAKKLVQDKTYFATLLVHTQKAHAMVSGASTTTAETIRPALQIIKTKPDVSLVSGMFFMSLEDKVLVFADCAVMPNPSPEQLAEIAYVSANSAKAFGLEPKVALLSYSSGDSGSGASVDAIKEASKIAKEKYPQLELEGPIQFDAAYDMLTAKSKMPNSKVAGRANVYVFPDLNAANICYKAVQRTANSLAIGPILQGLKKPINDLSRGCLVEDIVNTVILSAIQAQE

SEQ ID NO: 79716 - protein, 226 aa, Ralstonia solanacearum GMI1000
MGCNLEDNIGRIRKAIQHAAIDNGRRADAVTLVAASKTVESHRIQKAIDLGLTVFGENRVQEAVSKWPELRSRNPGIELHLIGPLQSNKVRQAVDLFDVIESVDRSRLARAIAEEAERQGHAPAIYIQVNVGKEPQKGGVLPAEASALIGECRDVYQLNVQGLMCIPPAGLDPSGHFAGLRSIAADHGLHVLSMGMSADYPQAIAQGATHVRVGSALFGARAPLQP

SEQ ID NO: 79717 - protein, 469 aa, Salmonella enterica subsp. arizonae serovar 62:z4,z23:--
MVDQVKVAADEQATAEQSLRRNLTNRHIQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPGLSDWVASLAVVILLLSLNLATVKMFGEMEFWFAMVKIVAIVALIVVGLVMIAMHFKSPTGVEASFAHLWNDGGWFPKGISGFFAGFQIAVFAFVGIELVGTTAAETKDPEKSLPRAINSIPIRIIMFYVFALIVIMSVTPWSSVVPNKSPFVELFMLVGLPAAASVINFVVLTSAASSANSGVFSTSRMLFGLAQEGVAPKAFAKLSKRAVPAKGLTFSCICLLGGVVMLMVNPSVIGAFTMITTVSAILFMFVWTIILCSYLAYRKKRPHLHEKSIYKMPLGKLMCWVCMAFFVFVLVLLTLEDDTRQALMVTPLWFIALGLGWLLIGKKRMAGMR

SEQ ID NO: 79718 - protein, 371 aa, Nocardia farcinica IFM 10152
MKTKAAVVRQAGKPIEIEELELDKPREGEVLIRYLYGGLCHSDVHIAHGDLEARLPMVLGHEGAGIIEEVGPGVTRVKPGDHVVCSFIPNCGTCRYCSSGQQSICDMGATILDGYLPGERFPITGPLGRYGAMCMLGTFSQYGVIHQNSCVKVDDDLPLDKAVLVGCGVPTGWGAAVNTAEVKAGQTVVVMGIGGIGINAVQGAALAGAKNVIAIDPLPNKREKAMELGATHAFASADEAMQTITDLTRGQMADSAILTPGLMTSEIVQGGFDAVGKGGVVVLTGLNKLEETTVQLSGSVMTLFRKQLRGSLFGDCNPTVDIPRILGLYQSGDLKLDELITKTYTLEQVNEGYDDLLNGKNVRGVLVHDHS

SEQ ID NO: 79719 - protein, 514 aa, Oryza sativa Japonica Group
MAVQILPTLSKLADVEVEFLDQYMGSTSRPVDDEVLDAATGVHYSALRLEELNMNGSVSGEDQPTTSGVENGHQEPFVIGVAGGASSGKSTVCKMIIDQLRDQRVVVVTQESFYYGLSDEELVHVHDYNFDHPDAFDTELLLSCMENLKHGKAVDIPNYNFKTYKSVASARKVNPSDVIILEGILVFHDSRVRDLMNMKIFVDTDADVRLTRRIRRDTIEKGRDIKTVLDQYSKFVKPAFEDFILPTKKYADIIIPRGGDNDVAIDLIVQHIRTKLGQHDLCKVHPNLYVIQTTYQIRGMHTIIRDAATTTHDFIFYADRLIRLVVEHGLGHLPFKEKQVITPTGSVYTGVEFSKRLCGISVIRSGESMENALRACCKGIKIGKILIHREGDNGKQLIYHNVPKDIANRHVLLLDPILGTGNSAVQAISLLLKKGVQETNIIFLNLISAPQGVHVVSKRFPRVKIVTSEIDFGLNDDFRVIPGMGEFGDRYFGTDDYQSSTPFFCDEKNRVRLL

SEQ ID NO: 79720 - protein, 469 aa, Salmonella typhimurium
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRREEDDRVRMTPHPVEFELYYSV

SEQ ID NO: 79721 - protein, 173 aa, Arabidopsis thaliana
MSTMKPSRSDEISDPEQQIKNANQIRADFDSLAPKRPTKPTRSEPGFPGSFSASDKITDHPEADKFQSLQSQTHGKVLGEGDSSAVQDEFLETEYYSNLTAIDKQHHTTGSGFINVVKEDNGEESEAVTAAAIGDGGEKAVYRSNPATNEWIPATEEDFDSESSSKPNRSESS

SEQ ID NO: 79722 - protein, 371 aa, Sulfolobus solfataricus P2
MIILYLILMKGAILYKYNEPLIIEDNIQIDEPKVGETKIRIEATGLCHSDVNVFEGKTPVPPPVIAGHEIAGVIEEVGNNVTDFKPGDRVISAFIHPCGKCKNCITGKENLCEVFAKNRLNGTLLDGTTRLHFKDGTPIRAFLGGGFAEYAMVPYTALTKVPEDLDLRKVAVLGCAGLTAYGAVNSAKIEPGETVAVIGVGGVGLSVIQMLKIAGAGRIIAVGTRKWKLEKALELGASDVVNSKETDVVRAVKNITGGGPDVVIEVAGTTETVKMSLDMVRIGGKVVLVGLPPTTAEIPIRIASIVRGGIKIIGDYGGRPRVDMPRLIELVKLGKYDPTALVTGKFRLEEINEAVKLLEQGEAIRSLIIPN

SEQ ID NO: 79723 - protein, 335 aa, Psychrobacter arcticus 273-4
MSVSSTPSIVPVSFIPFDSTEKFHHDVRTQLAKDIEVLFSYAELPSPLLDACRYVMTGTGKLVRPLLVASAFASTYSHNDTIADKDNALATLLENDSDYDMSRRAALAVELLHTYSLVHDDLPCMDDDELRRGQPTAHIVFAEATALLAGDVLQTLAFEVLTAEMPTFAPFDSDIASQLFAIFAPRARRMVSGQMLDLNAEATTGISQSDLEAIHRDKTGALIEAAMLMGGICAGATATQRMALQECAQHIGLAFQVQDDILDVTTSTDMLGKPAGSDEKLDKSTYVKLMGVDKATSYAQSLFDDGRAALNRELSGNKDTDALMALIEWLWARKK

SEQ ID NO: 79724 - protein, 140 aa, Zea mays
  misc_feature (28)..(28): Xaa can be any naturally occurring amino acid
  misc_feature (112)..(112): Xaa can be any naturally occurring amino acid
MGSLRPVATHLSELLGAEHLMANDWIGXEVENLADNKPEGGVLLLANVRYYTETEKNKPDYANKVVYAADLYGKDACGTAQIDNASTERDTKCFKPAAAAFIMNKELDYLAXADANPTIPLADIVDSLQGLTNIGVVESL

SEQ ID NO: 79725 - protein, 225 aa, Psychrobacter arcticus 273-4
MTDYDRITANPHFDMLMSAHNHVQSTTQSALVPMVVEQSARGERSFDIFSRLLRERVIFLTGQVEDHMANLIVAQLLFLEAENPDKDIHLYINSPGGSVSAGLAIFDTMNFIKPEVSTICMGGAYSMGSFLLAAGQKGKRYALANARVMIHQPSGGAQGQATDIEINAREILKTRARLNEILAERTGQSVEKIEKDVERDYWLDAKEAKEYGLIDEVLERRPASL

SEQ ID NO: 79726 - protein, 342 aa, Bacillus thuringiensis serovar konkukian str. 97-27
MTKIFILASTLSLSFFSGLNIGNAATENFSPITNAIVQNNDYFAEGNSKDNNKPPGNGGSQDDSGSDGNGSDGSGSGDNGSGGNGSGGNGSGDNGSGDDGSGGNGSGDNGSGGNGSGGNGSGGNGSGGSGSGDNGSGGNGSGGNGSGGNGSGGNGSGGNGSGGSGSGDNGSGGNGSGGNGSGGNGSGGNGSGGNGSGSSGSGDNGSGGNGSGGSGSGDNGSGGSGSGDNGSGGSGSGDNGSGGSGSGDNGSGGSGSGDNGSGGSGSGDNGSGGSGSQGGNRVKGDSSSQGGNGSQGGNVKDNAKKQGDKLPNTATHYPASILMGLSTFLIGMLLFIRRKNAK

SEQ ID NO: 79727 - protein, 94 aa, Zea mays
MPLSSWTMRKGFGLGEADVVSRVFVPAFAIDEDPVTGSAHAVITPYWTEKLGRESFVAEQASARGGRLTCRLVGDRVVLGGGCVTVIEGTFLLP

SEQ ID NO: 79728 - protein, 148 aa, Glycine max
  misc_feature (110)..(110): Xaa can be any naturally occurring amino acid
  misc_feature (116)..(116): Xaa can be any naturally occurring amino acid
  misc_feature (124)..(124): Xaa can be any naturally occurring amino acid
MAHSMISFRAVTTVNRARADMVAPFTGLKSMAGFPTRKTNNDITSIASNGGRVQCMQVWPPVGKKKFETLSYLPDLDDAQLAKEVEYLLRKGWIPCLEFELEHGFVYREXHNRSPXYYDGRYWXTMWKLPMFGCTDASQGVERSFQEG

SEQ ID NO: 79729 - protein, 434 aa, Caulobacter vibrioides
AIYPVILCGGSGTRLWPASRSDHPKQFLKLVSDRSSFQETVLRVKDIPGVAEVVVVTGEAMVGFVSEQTAEIGAWATILVEPEARDSAPAVAAAAAYVEAQDPAGVVLMLAADHHIAQPEIFQQAALTATKAAEQGYIVTFGVQPTVPATGFGYIRPGAPLLDGSVREVAAFVEKPDQATAERYLLEGYLWNSGNFAFQAATLLGEFETFEPSVAAAAKACVAGLQLEAGIGRLDREAFAQAKKISLDYAIMERTQKAAVAPAAFAWSDLGAWDAIWEASTRDGDGNAQTGDVDLHGSSNVLVRSTGPYVGVIGVNDIVVVAEPDAVLVCHRKDSQAVKTLVDGLKAKGRSIASRKSASPNGTETLVSTDGFDVELRRVPAGETLMLPVSTLQVLEGVIEMDGDVYAAGAIIALDDSVQARAIGAATLLVTKPR

SEQ ID NO: 79730 - protein, 382 aa, Shigella boydii
MSLKEKTQSLFANAFGYPATHTIQAPGRVNLIGEHTDYNDGFVLPCAIDYQTVISCAPRDDRKVRVMAADYENQLDEFSLDAPIVAHENYQWANYVRGVVKHLQLRNNSFGGVDMVISGNVPQGAGLSSSASLEVAIGTVLQQLYHLPLDGAQIALNGQEAENQFVGCNCGIMDQLISALGKKDHALLIDCRSLGTKAVSMPKGVAVVIINSNFKRTLVGSEYNTRREQCETGARFFQQPALRDVTIEEFNAVAHELDPIVAKRVRHILTENARTVEAASALEQGDLKRMGELMAESHASMRDDFEITVPQIDTLVEIVKAVIGDKGGVRMTGGGFGGCIVALIPEELVPAVQQAVAEQYEAKTGIKETFYVCKPSQGAGQC

SEQ ID NO: 79731 - protein, 525 aa, Cicer arietinum
MAVSATGQIMLSSTVQLREPTIMGSTRNLRFVKFCNGEIMGRKIELKAGGAISNCCTKNVIRQNISMSLTADVAAESKLRNVDLEKRDPSTVVAIILGGGAGTRLFPLTKRRAKPAVPIGGAYRLIDVPMSNCINSGINKVYILTQFNSASLNRHIARAYNSGTGVTFGDGYVEVLAATQTPGEQGKKWFQGTADAVRQFHWLFEDARSKDIEDVLILSGDHLYRMDYMDFVQNHRESGADITLSCLPMDDSRASDFGLMKIDNKGRVLSFSEKPKGEDLKAMQVDTTVLGLSKDEALEKPYIASMGVYVFKKEILLNLLRWRFPTANDFGSEIIPASAREFYMKAYLFNDYWEDIGTIRSFFEANLALTEHPSKFSFYDAAKPMYTSRRNLPPSKIDNSKIVDSIVSHGSFLNNSFIEHSVVGIRSRINSNVHLKDTVMLGADFYETEAEVAALLAEGRVPIGIGENTKIKDCIIDKNARIGKNVIIANSEGIQEADRSAEGFYIRSGVTVVLKNSTIEDGLVI

SEQ ID NO: 79732 - protein, 252 aa, Aspergillus nidulans FGSC A4
MSPPAIIAPSILSADFATLGSECSTKISEGADWLHVDIMDGHFVPNITFGAPVVTKIRSHVHRPSQPQGKGTFDCHMMIAEPQKWVKDFKDAGCDLYCFHYEAAVSSVAAKEPADKETTRKTSPKELIRFIHEEGMQAGIAIKPDTPVDVLWDILAADDEKERPDMVLVMTVHPGFGGQKFMASELPKVKALREKYPDLNIEVDGGLGLGTIDQAAEAGANVIVAGSAVFGAENPGDVIQKLRDAVNKHRKA

SEQ ID NO: 79733 - protein, 521 aa, Cicer arietinum
MDLAIGSNYASLRSSVFLGETLKGNLSTKFLTSPKFSQIHINNLRSFNPRNGASYSVLTSGINDFEESMTFHEGPYFDTPKADPKSVASIILGGGAGTRLFPLTSKRAKPAVPIGGCYRLIDIPMSNCINSGIRKIFILTQFNSFSLNRHLSRSYNFGNVSTFGEGFVEVLAATQTSGEAGKKWFQGTADAVRQFIWVFEDAKTKNVEHILILSGDHLYRMNYMDFVQKHIDTNADITVSCIPMDDSRASDYGLLKIDGKGRIIQFAEKPKGSELKAMRVDTTLLGLSPEEAKKQPYIASMGVYVFRTETLLKLLRSNCSTCNDFGSEIIPSAVNDDHNVQAYLFNDYWEDIGTIKSFFDANLALTDQPPKFQFYDPNTPFYTFPRFLPPTKVEKCKIVDAIISHGCFLRECSVQHSIVGIRSRLESGVELQDTMMMGADYYQTESEIASLLAEGKVPVGVGENTKIRNCIIDKNARIGRNVIITNADGVEEADRTKEGFYIRSGITAILKNATIKDGTVI

SEQ ID NO: 79734 - protein, 241 aa, Haemophilus influenzae R2866
MSSMEGKKVPQVTFRTRQGDKWVDVTTSELFDNKTVIVFSLPGAFTPTCSSSHLPRYNELAPVFKKYGVDDILVVSVNDTFVMNAWKEDEKSENITFIPDGNGEFTEGMGMLVGKEDLGFGKRSWRYSMLVKNGVVEKMFIEPNEPGDPFKVSDADTMLKYLAPQHQVQESISIFTKPGCPFCAKAKQLLHDKGLSFEEIILGHDATIVSVRAVSGRATVPQVFIGGKHIGGSDDLEKYFA

SEQ ID NO: 79735 - protein, 264 aa, Yarrowia lipolytica CLIB122
MTKFRGCIDIHSGQVKQIVGGTLTDSDADLKTNFVATQPPGYFAQLYKDNNVVGTHVIKLGPGCDEAAEEALAGWPDHLQIGGGINHDNAEKWIKLGASHVIVTSFLFPDAKLDMKRLTDLEAILEPYGGKKRIVVDLSCRRKDGKWVVAMNRWQTLTDTEVNKETLEQLAKHCDEFLIHAADVEGLCNGIDEELVTKLGEWLEEGHLPPVTYAGGAKNIDDLALVQKLSHGKVDLTYGSALDVFGGDKVKFSDCVEWNEKMHK

SEQ ID NO: 79736 - protein, 516 aa, Cicer arietinum
MASMAAIGVLKVPPSSSSSSSSSSSKAIIARNLSFTSSQVCGDKIGTFSRRGRGSYVGNPIIVSPKAVSDSKNAQTCLDPDASRSVLGIILGGGAGTRLYPLTKKRAKPAVPLGANYRLIDIPVSNCLNSNVSKIYVLTQFNSASLNRHLSRAYASNMGGYKNEGFVEGLAAQQSPENPNWFQGTADAVRQYLWLFEEHNVLEYLVLAGDHLYRMDYERFIQAHRESDADITVAALPMDELRATAFGLMKIDEEGRIIEFAEKPKGEQLKAMKVDTTILGLDEERAKEMPYIASMGIYVVSKHVMLDLLREKFPGANDFGSEVIPGATNIGMRVQAYLYDGYWEDIGTIEAFYNANLGITKKPVPDFSFYDRSSPIYTQPRYLPPSKMLDADITDSVIGEGCVIKNCKIHHSVVGLRSCISEGAIIEDTLLMGADYYETDADRRFLAAKGSVPIGIGKNSHIRRAIIDKNARIGDNVKIINSDNVQEAARETEGYFIKSGIVTVIKDALIPSGTVI

SEQ ID NO: 79737 - protein, 167 aa, Erwinia amylovora
RHFADTPEEKNLPILLALIGIWYNNFFGAETEAILPYDQYMHRFAAYFQQGNMESNGKYIDRAGNAVSYQTGPIIWGEPGTNGQHAFYQLIHQGTKLVPCDFIAPAVSHNKLSDHHSKLLSNFFAQTEALAFGKSREAVEQEFADAGKDAKSVEHIVPYKVFEGNRP

SEQ ID NO: 79738 - protein, 247 aa, Yarrowia lipolytica CLIB122
MSRTFFVGGNFKMNGSLESIKAIVERLNASELDPKTEVVISPPFPYLLLAKESLKKPTVSVAGQNSFDKGDGAFTGEVSVAQLKDVGAKWVILGHSERRTINKESSEWIADKTKYALDNGLDVILCIGETIDEKKAGKTLDVVRSQLDPVIAKIKDWSNVVIAYEPVWAIGTGLAATAEDAQQIHHEIRAYLKDKIGAQADKVRIIYGGSVNGKNSGTFKDKSDVDGFLVGGASLKPEFVDIINSRL

SEQ ID NO: 79739 - protein, 382 aa, Shigella dysenteriae
MSLKEKTQSLFANAFGYPATHTIQAPGRVNLIGEHTDYNDGFVLPCAIDYQTVISCAPRDDRKVRVMAADYENQLDEFSLNAPIVAHENYQWANYVRGVVKHLQLRNNSFGGVDMVISGNVPQGAGLSSSASLEVAVGTVLQQLYHLPLDGAQIALNGQEAENQFVGCNCGIMDQLISALGKKDHALLIDCRSLGSKAVSMPKGVAVVIINSNFKRTLVGSEYNTRREQCETGARFFQQPALRDVTIEEFNAVAHELDLIVAKRVRHILTENARTVEAASALEQGDLKRMGELMAESHASMRDDFEITVPQIDTLVEIVKAVIGDKGGVRMTGGGFGGCIVALIPEELVPAVQQAVAEQYEAKTGIKETFYVCKPSQGAGQC

SEQ ID NO: 79740 - protein, 366 aa, Zea mays
MVIYLSTPKTDKVSEDGENDKLKFGLSSMQGWRATMEDAHSALLDLDNDTASFGVFDGHGGKVVAKFCAKYLHREVLHTEAYAAGDLGAAVHRAYLRMDEMMRGQRGWRELQALGDKINQFTGITEGLIWSPKASDSNDRHDDWAFEEGPHSDFTGPNCGSTACVALVRNRQLVVANAGDSRCVISRNGQAYNLSRDHKPELEAERERIQSAGGYIKMGHVNGSLNLSRAIGDMELKQNKFLSPDKQILTANPDINIVELCDDDEFIVLACDGIWDCMSSQQLVDFIREHINTEESLSAVCERVLDRCLAPSTMGGEGCDNMTMILVQFKKPFAQVKDASDAEQLTGDAGCSETHGAEENGSDKQI

SEQ ID NO: 79741 - protein, 167 aa, Pectobacterium carotovorum
QHFATTPAEKNLPVLLALIGIWYNNFFVAETEGILPYDQYMHRFAAYFQQGNMESNGKYVGRNGNPVDYQTGPIIWGEPGANGQHAFYQLIHQGTKLVPCDFIAPAMTHNALSDHHSKLLSNFFAQTEALAFGKSREVVEAEFAAAGKSAKEVEHVAPFKVFEGNRP

SEQ ID NO: 79742 - protein, 274 aa, Glycine max
MEIFPIPAESYTLGFIGAGKMAESIARGAVRSGVLPPSRIRTAVHFNLARRGAFESFGVTVLPSNDDVVRESDVVVLSVKPQLVKDVVSKLTPLLTKNKLLVSVAAGTKLKDLQEWAGNDRFIRVMPNTPAAVGQAASVMSLGGSATEEDGNIIAQLFGSIGKIWKAEEKYFDAITGLSGSGPAYVYLAIEALADGGVAAGLPRDLSLSLASQTVLGAASMVSQTGKHPGQLKDDVTSPGGTTITGIHELENGGFRGTLMNAVVAAAKRSRELS

SEQ ID NO: 79743 - protein, 265 aa, Bradyrhizobium sp. ORS278
MRAQELAVCWRARTMPQALADRRIALVVDDGGWRNTTAFDLGVQAMGGLCVHAPIRLNATEAVEDLAAYLDNWFDAVVCRTPELELLYALSHWAQAPVVNARTRQNHPCETLGDLAFLWHRRGAIDGLKIAVVAPAANILGSWIEAAQILPIDVVQVYPARWHAQGESPRFHVTTDLDALQAADVIITDCWPIEEEASVLQDYQITAALLDGLRPDLEFLPCPPVTRGHEVSDDAMRHRACRAVQSKAFVLHAQNAALEWVFGRP

SEQ ID NO: 79744 - protein, 514 aa, Verbena x hybrida
MTFSELINILFWDLTAAILLYVALILVCSLYSKPSTVSRNLPPGPKGFPVVGALPLLGTMPHIALAKMAKTYGPVMYLKVGTWGMAVASTPDAARAFLKTLDTTFSDRPPNAGATLLAYNAQDMVFAHYGPRWRLLRKLSNLHMLGAKALEDWADVRSSEVGHMLQAMLTSSLRHEAVALPEMLIYSMANMIGQVILSRRVFETKGKEVNEFKDMVVELMTSAGYFNIGDFIPALAWMDLQGIEKGMKSLHKKFDDLIGRMLDKHLESAHKRNAKPDFLDVILANRHNSEGESLTTTNIKALLLNLFTAGTDTSSSTIEWALAEMIKNPTILKTAHNEMDRVIGRDRRLLESDLPKLPYLQAICKEAYRKHPSTPLNLPRISSQPCIVNGYYIPENTRLSVNIWAIGRDPDVWENPLDFNPDRFLSGKNAKIDPRGNNFELIPFGAGRRICAGARMAMVLVEYILGTLVHSFDWELPVGVDEMDMEEAFGLALQKAVPLAAMVSPRLPPHCYAP

SEQ ID NO: 79745 - protein, 172 aa, Campylobacter lari RM2100
MDISKIKIGEVPNKLNAVIEIPYGSNIKYELDKESGAIMVDRVMYSAMFYPANYGFIPNTLADDGDPIDVLVLNEYPIQAGAVIPCRLIGVLLMEDESGMDEKLLAVPVSKIDPRYDDIKTLNDLPKASLDKIKNFFETYKMLEPNKWVKVKEFAGIEKASEILENSIKNYK

SEQ ID NO: 79746 - protein, 507 aa, Nocardia farcinica IFM 10152
MTVTDTLSEASASTLTPVLPQVRDWLARPKQLFIGGRWVDAASGRSFETVDPATGQVLTTVAHGGAEDVDRAVRAARTAFEGEWSLWTPAQRQRLLFRIGEAIFEHAEELAQLESLDNGKSAAVAQAVDITWVAELFQYYAGWATKIEGRTIPVSMPWAPGTQWHAYTLREPVGVCGAITPWNFPLLMVAFKLPVALACGNTIVVKPAEQTPLTTLRLAEIMVEAGLPDGVLNVVTGYGDAGAALAGHLDVDKIAFTGSTEVGKLIVDAAKGNLKRVTLELGGKSPQVVFADADLDLAVPGVASGFLFNHGQTCTSGTRILVERGIFDEFTQRVADIAAASKLGPGLDPTTEVGPLVSQEQLERVTGYIDQGLRDGARALCGGRRHGDSGFYVEPTVLVDVQSSFSVYREEIFGPVVVATPFDAEDGVAAAANDTPYGLAASVWTRDISKAHRTARQIKAGTVWVNAHNAFDAALPFGGYKQSGWGRELGASAIDAYTEQKTINAQL

SEQ ID NO: 79747 - protein, 633 aa, Streptococcus pneumoniae TIGR4
MIILQANKIERSFAGEVLFDNINLQVDERDRIALVGKNGAGKSTLLKILVGEEEPTSGEINKKKDISLSYLAQDSRFESENTIYDEMLHVFNDLRRTERQLRQMELEMGEKSGEDLDKLMSDYDRLSENFRQAGGFTYEADIRAILNGFKFDESMWQMKIAELSGGQNTRLALAKMLLEKPNLLVLDEPTNHLDIETIAWLENYLVNYSGALIIVSHDRYFLDKVATITLDLTKHSLDRYVGNYSRFVELKEQKLVTEAKNYEKQQKEIAALEDFVNRNLVRASTTKRAQSRRKQLEKMERLDKPEAGKKSANMTFQSEKTSGNVVLTVENAAVGYDGEVLSQPINLDLRKMNAVAIVGPNGIGKSTFIKSIVDQIPFIKGEKRFGANVEVGYYDQTQSKLTPSNTVLDELWNDFKLTPEVEIRNRLGAFLFSGDDVKKSVGMLSGGEKARLLLAKLSMENNNFLILDEPTNHLDIDSKEVLENALIDFDGTLLFVSHDRYFINRVATHVLELSENGSTLYLGDYDYYVEKKATAEMSQTEEASTSNQAKEASPVNDYQAQKESQKEVRKLMRQIESLEAEIEELESQSQAISEQMLETNDADKLMELQAELDKISHRQEEAMLEWEELSEQV

SEQ ID NO: 79748 - protein, 1399 aa, Arabidopsis thaliana
MATDSFIKLNPISFNRARFDLRDFAGISPKSISSLCCISPRLISCNHFSPRTLISGENGNILFSKKKIPAFVRCQTSLGIGRNQKWWEKELKPNMKSVTSPQDLVVSLRNAGDKLVVVDFFSPSCGGCKALHPKIRKFKEALEKHGREQCSIGETKGLEEKELVAMAANKDLSFDYKPTSRNNNGDGETTLVKKVGRDEKGQTVLLCALGYWVQGLRCFSWLALNFHMAHCLNLKPSTLQLVQYTASLPMVAKPLYGVLSDVLYIGGARRVPYISVGVLLQGLAWGSLAIFPGAREVLPSLMAFILLSNLGASITEVSQDALVAEYGLRYQINGLQSYALMASAVGGILGNLLGGYCLLKTPPRILFLAFTALLSLQLIVSLSSKEESVNLPRIGEVTPEISSVLGIVKKQFLDLKGIVQVDEISQPLIWIVSSIALVPLLSGSVFCYQTQVLNLDPSVIGMSKVIGQLMLLCLTVVYDRYWKKLPMRALIHIVQLLYAFSLLFDYILVKQINLAFGISNTAFVLCFSSVAEILAQFKILPFSVLLANMCPGGCEGSITSFLASTLCLSSVVSGFTGVGMANMIGITSKNYSNLPAGILIQSLAALVPLWFIHYVPMLEPGFEREGKRAMSKKSRRNRRVGRVIEIYGFQKDCLNRFISKLEYSVAEIKDSDDLVSNSDFSIASLLEILCSSLALPPPITYHNKNSSVDKLRQPRSNANTLRPDPIRDPNSFRIRSPGVVSVFGSLGRMSTLLPFPDLNLMPDSQSSTAGTTAGDTVVTGKLEVKSEPIEEWQTPPSSTSDQSANTDLIAEFIRISELFRSAFKPLQVKGLDGVSVYGLDSGAIVAVPEKENRELIEPPPGFKDNRVSTVVVSPKFERPRELARIAILGHEQRKELRQVMKRTRMTYESLRIHLMAESMKNHVLGQGRRRRSDMAAAYIMRDRGLWLNYDKHIVGPVTGVEVGDIFFYRMELCVLGLHGQTQAGIDCLTAERSATGEPIATSIVVSGGYEDDEDTGDVLVYTGHGGQDHQHKQCDNQRLVGGNLGMERSMHYGIEVRVIRGIKYENSISSKVYVYDGLYKIVDWWFAVGKSGFGVFKFRLVRIEGQPMMGSAVMRFAQTLRNKPSMVRPTGYVSFDLSNKKENVPVFLYNDVDGDQEPRHYEYIAKAVFPPGIFGQGGISRTGCECKLSCTDDCLCARKNGGEFAYDDNGHLLKGKHVVFECGEFCTCGPSCKSRVTQKGLRNRLEVFRSKETGWGVRTLDLIEAGAFICEYAGVVVTRLQAEILSMNGDVMVYPGRFTDQWRNWGDLSQVYPDFVRPNYPSLPPLDFSMDVSRMRNVACYISHSKEPNVMVQFVLHDHNHLMFPRVMLFALENISPLAELSLDYGLADEVNGKLAICN

SEQ ID NO: 79749 - protein, 199 aa, Haemophilus parasuis
EEGDIIIDGGNSNYPDTNRRVKALAEKGIRFIGSGVSGGEEGARHGPSIMPGGDEEAWQYVKPIFQAISAKTDKGEPCCDWVGKEGAGHFVKMVHNGIEYGDMQLICEAYQFLKDGLGLSYDEMQAIFAEWKKTELDSYLIDITTDILGYKDTDGTPLVEKILDTAGQKGTGKWTGINALDFGIPLTLITESVFARCVS

SEQ ID NO: 79750 - protein, 474 aa, Streptococcus pneumoniae TIGR4
MTRYQNLVNGKWKSSEQEITIYSPINQEELGTVPAMTQTEADEAMQAARAALPAWRALSAVERAAYLHKTAAILERDKEEIGTILAKEVAKGIKAAIGEVVRTADLIRYAAEEGLRITGQAMEGGGFEATSKNKLAVVRREPVGIVLAIAPFNYPVNLSASKIAPALIAGNVVMFKPPTQGSISGLLLAKAFEEAGIPAGVFNTITGRGSEIGDYIIEHKEVNFINFTGSTPIGERIGRLAGMRPIMLELGGKDAALVLEDADLEHAAKQIVAGAFSYSGQRCTAIKRVIVLESVADKLATLLQEEVSKLTVGDPFDNADITPVIDNASADFIWGLIEDAQEKEAQALTPIKREGNLLWPVLFDQVTKDMKVAWEEPFGPVLPIIRVASVEEAIAFANESEFGLQSSVFTNDFKKAFEIAEKLEVGTVHINNKTQRGPDNFPFLGVKGSGAGVQGIKYSIEAMTNVKSIVFDVK

SEQ ID NO: 79751 - protein, 291 aa, Lentisphaera araneosa HTCC2155
MKQFSAFLILCLILSSCSSTNTKKLTFGAVADCQYCDQKSRGVRKYSSSHKKLAQCVEHFNKEDLDFVIHLGDLIDKDFKSFDVVLPIYNSLKADHYHALGNHDFDVADELKKDVPTKMGMDSKYHYFDKANWRFIILDGNDVSFHAYPKESPEYKYAAEYYKTKKITSPKWNGAVGEEQMKWLETLLQESQEGNQQVILFSHFPVYPKDPHNLWNAKELVALLEDYPCVKAYINGHNHKGNYAEKQGIHYLTLKGMVDTPENTYAIIKLNQESILVQGFGREKQRSLFIK

SEQ ID NO: 79752 - protein, 154 aa, Triticum aestivum
VNAVIDGDDIIYRDYVDISVAVGTSKGLVVPVIRDADNMNFADIEKGINALAKKATEGALSIDEMAGGTFTISNGGVYGSLISTPIINPPQSAILGMHSIVQRPVVVDGNILARPMMYLALTYDHRLIDGREAVYFLRRIKDVVEDPRRLLLDI

SEQ ID NO: 79753 - protein, 380 aa, Streptococcus pneumoniae TIGR4
MKNEMLALILAGGQGTRLGKLTQSIAKPAVQFGGRYRIIDFALSNCANSGIHNVGVVTQYQPLALNNHIGNGSSWGLDGINSGVSILQPYSASEGNRWFEGTSHAIYQNIDYIDSVNPEYVLILSGDHIYKMDYDDMLQSHKDNNASLTVAVLDVPLKEASRFGIMNTDANNRIVEFEEKPAQPKSTKASMGIYIFDWQRLRNMLVAAEKSKVGMSDFGKNVIPNYLESGESVYAYEFSGYWKDVGTIESLWEANMEYISPENALDSRNRQWKIYSRNLISPPNFLGANAHVEDSLVVDGCFVDGTVKHSILSTGAQVREGAEVLDSVIMSGAIIGQGAKIKRAIIGEGAIISDGVEIDGTDEVQVVGYNEVVGVATDED

SEQ ID NO: 79754 - protein, 440 aa, Rhodococcus sp. RHA1
MECPTSARPKGRLPRMAGDEISEGNDAHPTATPQLRRRLGVFDSVMIGLGSMIGAGIFAALGPAAAAAGGALLVGLAVAAVIAYCNAHSSARLAALYPQSGGTYVYGRERLGPFFGYLAGWGFMVGKTASCAAMALTVGAYAWPGREHLVAVIAVAVITAVNYLGVQKSALVTRVIVFTVLAVLTVIVVVCLTGSDTGFDGLEITSGHGATGVLQAAGLLFFAFAGYARIATLGEEVKDPARTISRAIPIALAITLVVYLCVAIAVLTALGADALAAATDPLAQAVAAAGFGGLEPVVRVAAVIAALGSLLALILGVSRTTFAMARDGHLPRLLTAVHPRFAVPYRAELAVGAVVALLAATADLRGVIGFSSFAVLVYYLIANASACTLSAKPWSRLIAVVGAVGCLVLAAFLPLASVISGVIVLGLGAVIYGIRTSLRT

SEQ ID NO: 79755 - protein, 345 aa, Sulfolobus solfataricus P2
MISSMVKEVCMKCRKERESIYEIKCNKCGGPFEILIDFEFDKNSERGFPYSEKIFPYIKHFISLGEGRTPLIKKGNIWFKLDFLNPSGSYKDRGAVTLVSYLAEKGVKQISEDSSGNAGSAIAAYSAAAGIEAYIFVPETAKGGKLKQIESYGAHVVRVRGSREDVAKAAENSGYYYASHVLQPQFRDGIRTLAYEIVKDLDWKIPNYVFIPVSAGTLLLGVYKGFKHLLDSGVISEMPKIVAVQTEQVMPLCAKFKKISYTPPDKVTSIADALVSTRPFLLDYMVKASSECIVVSDNEIVEAWKELAKMGLLVEYSSATVFAAYKKYSVNDAVLVLTGSGLKVL

SEQ ID NO: 79756 - protein, 167 aa, Pantoea agglomerans
QHFASAPAEQNLPVLLALIGIWYNNFFGAETEAILPYDQYMHRFAAYFQQGNMESNGKYVDRAGHPVDYQTGPIIWGEPGTSGQHAFYQLIHQGTKLVPCDFIAPAITHNALADHHPKLLSNFFAQTEALAFGKSRDVVEKEFTDAGKSAESVAHIVPFKVFEGNRP

SEQ ID NO: 79757 - protein, 382 aa, Shigella dysenteriae
MSLKEKTQSLFANAFGYPATHTIQAPGRVNLIGEHTDYNDGFVLPCAIDYQTVISCAPRDDRKVRVMAADYENQLDEFSLDAPIVAHENYQWANYVRGVVKHLQLRNNSFGGVDMVISGNVPQGAGLSSSASLEVAVGTVLQQLYHLPLDGAQIALNGQEAENQFVGCNCGIMDQLISALGKKDHALLIDCRSLGTKAVSMPKGVAVVIINSNFKRTLVGSEYNTRREQCETGARFFQQPALRDVTIEEFNAVAHELDPIVAKRVRHILTENARTVEAASALEQGDLKRMGELMAESHASMRDDFEITVPQIDTLVEIVKAVIGDKGGVRMTGGGFGGCIVALIPEELVPAVQQAVAEQYEAKTGIKETFYVCKPSRGAGQC

SEQ ID NO: 79758 - protein, 495 aa, Phyllostachys edulis
TNPTTSRPGVSTIEEKSTGRIDKIIGPVLDITFPPGKLPYIYNALVVKSRDTAGKQINVTCEVQQLLGNNRVRAVAMSATDGLMRGMEVIDTGAPLSVPVGGATLGRIFNVLGEPIDNLGPVDTSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNIEESKVALVYGQMNEPPGVRMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLASKGIYPAVDPLDSTSTMLQPRIVGNEHYETAQRVKQTLQRYKELQDIIAILGLDELSEEDRLTVARARKIERFLSQPFFVAEVFTGSAGKYVGLAETIRGFQLILSGELDGLPEQAFYLVGNIDEASTKAINLEEENKLK

SEQ ID NO: 79759 - protein, 167 aa, Photobacterium sp. WH69
KHFAEAPLEQKLPVILALIGIWYNNFHGAETEAILPYDQYMHRFAAYFQQGNMESNGKYVDRGGNPVDYQTGPIIWGEPGTNGQHAFYQLIHQGTKLIPCDFIAPAISHNPLGDHHPKLMANFFAQTEALAFGKSREKVEAEFFAAGKSQEEVNELAEFKVFEGNRP

SEQ ID NO: 79760 - protein, 251 aa, Bacillus thuringiensis serovar konkukian str. 97-27
MKTTENFTDKADIYAKYRPSYPNEYIEYLLSANELNENQIVADIGSGTGIFSRQLLDSGLHVIGVEPNDDMRKMAEQSLKRYPRFQSIKATAENTTLKENSVDLVTVAQAFHWFDKEAFKIECQRILKQKANVALVWNSRDVTSPLIKKNAEICQKTCPTFKGFSGGIDETPEVFNSFFKDGEYEFKEYQNDLLFDYESFLGRNLSASYAPKENDEQYKNFIFLLSELFEKYSKNGKIVLPNLTRSYLGNV

SEQ ID NO: 79761 - protein, 167 aa, Serratia marcescens
KHFAETPAEKNLPVLLALIGIWYNNFFGAETEAILPYDQYMHRFAAYFQQGKMESNGKYVDRNGNPVDYQTGPVIWGEPGTNGQHAFYQLIHQGTKLVPCDFIAPAISHNPLGDHHAKLLSNFFAQTEALAFGKSLEVVEAEFAAQGKTPEQVKHVAPFKVFEGNRP

SEQ ID NO: 79762 - protein, 199 aa, Campylobacter lari RM2100
MILNAKFLISASKIDEAPQPIYTEIAFLGRSNVGKSSLINTLCKNKNLAKSSSTPGKTQLINFFEVDCKKDEDKFKLIFIDLPGFGYAKVSKKTKAIWNKNLDEFLKERSSIKLFIHLIDSRHENLDIDLNLDLYLDSFIRADQKKITVFTKADKLNQSQKAKLLNANKNAILVSNLKKSGIDKLEQKIILESLGFNEE

SEQ ID NO: 79763 - protein, 379 aa, Streptococcus pneumoniae TIGR4
MKIDKYSAILGNTVGFHNMSTLTDHRPVASLPFGGKYRLIDFPLSSLANAGVRSVFGIFQQDNISSVFDHIRSGREWGLSTLLSHYYLGIYNTRVESSTVGKEYYQQLLTYLKRSGSNQTVALNCDVLINIDLNQVFHLHSTTKEPITVVYKKLAKKDISEVNAILDVDETDHVLSHKLFDSKSTAETFNMSTDIFVVDTPWLIEHLEEEAKKEHPEKLRYVLRDLAVKEGAFAYEYTGYLANIHSVKSYYQANIDMLESQKFYSLFSPNQKIYTKVKNEEPTYYANTSKVSTSQFASGSIIEGQVANSVLSRNIHVHKDSLVKDSLLFPRVVIGEGAQVEYAILDKGVEVEHGVVIRGTAEHPVVVKKGAKVTEDIHS

SEQ ID NO: 79764 - protein, 127 aa, Zea mays
MESAVNPKAYPLADAQLTIGIIDIIQQAANYKQLKKGANEATKTLNRGISEFVVMAADTEPLEILLHLPLLAEDKNVPYVFVPSKQAFGRACGVTRPVIACSVTSNEGSQLKQQIQGLKDSIEKLLI

SEQ ID NO: 79765 - protein, 428 aa, Cryptococcus neoformans var. neoformans JEC21
MSSRDSPSSDTEIPQVIAGRYNVKVDKQMAETNQGGVYPAVDTKTGQEVAVKLEHILFALLEDRRDLRDEHEAYRDISKHVPNAHTIPSIKWYGEEGNYCALVMDMLGPTLQDLFSSHSGPFSLKTVLMIADQLISHVEFLHGQLYIHRGIKPDNFCIGLQDQRKIFMIDLGFAKRYRDPKTKRHMPYEKYERCANPSWCSLRVSEGTMASRRDDLESLGYMFVFFLKGSLPWHGTCSIEMEDIKSEPLEDLCKDLPDEFLKYLQYCRALKFDSDPDYRYLRLLFHQLFLEKGYENDWEFDWCKKPNNEGAAEEKDDKEPLEANDKKNGNNAEKRNNISKDLEESNNVTNADTDQSEITSVNNTDLKQVSEAKEDQKAQTEIKVPSKSVNFDDHHANIDEPEGGNDLQEGENRLRRSARLKKMAREEP

SEQ ID NO: 79766 - protein, 434 aa, Streptococcus pneumoniae TIGR4
MSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAVARAAADYLEIPLYSYLGGFNTKVLPTPMMNIINGGSHSDAPIAFQEFMILPVGAPTFKEALRYGAEIFHALKKILKSRGLETAVGDEGGFAPRFEGTEDGVETILAAIEAAGYVPGKDVFIGFDCASSEFYDKERKVYDYTKFEGEGAAVRTSAEQIDYLEELVNKYPIITIEDGMDENDWDGWKALTERLGKKVQLVGDDFFVTNTDYLARGIQEGAANSILIKVNQIGTLTETFEAIEMAKEAGYTAVVSHRSGETEDSTIADIAVATNAGQIKTGSLSRTDRIAKYNQLLRIEDQLGEVAEYRGLKSFYNLKK

SEQ ID NO: 79767 - protein, 517 aa, Myxococcus xanthus DK 1622
MDLHAEKILILDFGSQYTQLIARRVRELGVYCEIHRPDLPAEDIRKYAPRGIILSGGPASVEAPDSPRCDPFVFEAGVPVLGICYGLQLTAKLLGGKIDRSAHREFGNAEVEVLARRGPFAEFTPGDRVQVWMSHGDRVEALPPGFEAIGRSGNSPFAATAHATKPWFGVQFHPEVVHTPQGKAMLRAFVFNECKVSGSWTMKGFIDEAVGTIRRQVGEHGRVICALSGGVDSSVAALLLHRAIGPRLQCIFVDNGVLRQNERAQVEALFVDRFHVPLKTVDARQRFLDKLAGVTDPEKKRKIIGREFIAVFEEAARDVQDAEFLAQGTLYPDVIESVSYKGPSVTIKSHHNVGGLPETMKLKLVEPLRELFKDEVRALGRELGLPDEMVSRQPFPGPGLAIRVLGEVTEQRLELVRRADAIVQEEIRSAGLYKEVWQAFAVLLPVQSVGVMGDERTYESTCVLRAVTSVDGMTADWARLPFPVLERISTRITNEVRGINRVAYDISSKPPATIEWE

SEQ ID NO: 79768 - protein, 277 aa, Sulfolobus solfataricus P2
MKIMEDLTIGILGAGKIGSAIVRAIRLKYPSIHVIATARKDETLRNVKDLEVETTKDNNYAVNKSDVIILSVKPQHFPTVLRQVGIESWRDKVVISIMAGVKLSTLSTLLNNAEVYRAMPNINAIVYKSTTTIAENNGKSRELVENIFKTLGNVYWLPEEYLDIWTALVGSGPAFISEIIDALSLGAVACGMQREIAYNAVLDMISGTIIMLKEGKIDHPMLLRDQVTTPVGTTIRGLMVMEAKSVKSALIETIEASYKRAVEIGNEIDKSIRNNSK

SEQ ID NO: 79769 - protein, 481 aa, Nocardia farcinica IFM 10152
MRNQLFIDGEWRPGRAGTFATVDPATGKVITDVAQASTADVDDAVAAAAAARAYTAPSWAAMLPATRARLLNRLADLVEAHADELALLETTDQGQPLGVAAGISVPNAVEHLRYYAGWATKITGITAPLSIPDVDYRTRREPLGVCALITPWNFPLTILTWKLAPALAAGNTVVVKPAEQTPLSTLRLAELAAEAGFPPGVINVVPGGPDTGRALVAHPGIAKISFTGSTEVGREIGAAAGRALTRVSLELGGKTPSIVTADADIDAAVRGNIAGGTLNSGQVCAAYSRIYVDRRREAEFVDKLVAAARAIKVGPGRAADTQMGPLVSAEHLDRVHTLVRTGVAEGAELVTGGARAEGDLADGYFYEPTVFTGVRQDMRIAREEIFGPVLSVLSYDDPEEIAGQANDSDFGLAAVVWSRDLATANRLAAAVRAGTVYLNLPPMLDAAAAWGGMKASGIGREMGWEAIAAYTEVKSIWTALT

SEQ ID NO: 79770 - protein, 199 aa, Haemophilus parasuis
EAGDIIIDGGNSNYPDTNRRVKALAEKGIRFIGSGVSGGEEGARHGPSIMPGGNSEAWQYVKPIFQAISAKTDKGEPCCDWVGKEGAGHFVKMVHNGIEYGDMQLICEAYQFLKDGLGLSYDEMQAIFAEWKKTELDSYLIDITTDILGYKDTDGTPLVEKILDTAGQKGTGKWTGINALDFGIPLTLITESVFARCVS

SEQ ID NO: 79771 - protein, 108 aa, Agropyron cristatum
KKMVMPTDPMLWHKVAAVSGVAALGLGTYGAHMFRPQNPRYKEIWQTASLYHLVHTAALLGAPMTKRPNIFGGLLTTGIVLFSGTCYTVAYLEDRKFSSPAPIGGFAF

SEQ ID NO: 79772 - protein, 458 aa, Rhodococcus sp. RHA1
MSDQPDVLILGGGSGGYACAFRAAQLGKTVTLIEEDKVGGTCLHRGCIPTKALVHAAEVADTVTHASALGLGATLDGIDLGGVHAYKNATVERLYKGLQGLVRSHKIEVVHGTGRYGGGRTVHVGDRTITGASLVLATGSQVRGLPGLEIGGRILTSDEALTFPELPKRVVVLGGGVIGVEFASIWASLGADVTIVEALPRLVAAEDEWSSKQLTRALRKRGITIMTATRFAKAVQDESTVSVTVESGDTIEADLLLVAVGRGPRTPDIGLTENGVVLDSRGFVTVDDSLRTSQPDVYAVGDIVAGPQLAHRGFQQGIFVAETIAGLTPTPIEDSGIPRVTYSKPEVASVGLTEDQARERHGDVATVVYDLAGNGKSQILGTSGGVKLVRAGATEGPVVGIHMVGERVGELIGEAQLIVNWGAYPDDVATLVHAHPTQAEALGEAHLALAGTPLHSHS

SEQ ID NO: 79773 - protein, 424 aa, Rhodococcus sp. RHA1
MPTVKTFLLPDLGEGLTDAELLSWLVRVGDTVTLNQIIAEVETAKASVELPSPYAGTVVALHAEEGTTVDVGSPFIDVAVAGEDPADAPEPTTPAAPAERTPVLVGYGVAEDSSSRRRQRRPAGTRVDVTPAPRTSRPLASPPVRFAAKQHGVDLTEVDATGVHGEVTRDDLERHRTAASVTTSAATVPPDADEERIPIKGVRKHTAAAMVRSAFTAPHVTEFVTVDVTPTIDLLAELRETKHFTDVRLTPLTLVAKALLVALRTNPTLNSSWDEDAGEIVVKRSVNLGIAAATPRGLMVPNIKNAHTLGLRDLAIALSDLTTTAKEGKTGPADLADGTITITNVGVFGIDAGTPILNPGEAAILCFGAIRRRPWEYRGEIALRSVTTLSLSFDHRLVDGEQGSRFLAAIGQILSDPLTLIALS

SEQ ID NO: 79774 - protein, 311 aa, Sulfolobus solfataricus P2
MRHFIIDCDTAEDDVLSLYLLLKNNIDVVAVTIVEGNISYEQEVKNALWALEQVNREIPVYPGANKPLLKNYITVEKVHGKGGIGDVTVEPKRLKAQEKHAALAIIDLANEYAGELEFLAISPLTNLALAYLLDNSIVKKIKKVWVMGGAVFGIGNITPVAEFNIWVDPDAAKIVFNAGFDITMIPWDVIINYPVTDEEWNVIKNMKTRMSELYVSMYLHYRQYSSTVQKINGHPHPDAITTAIAIDGSIATRREKRFVVIDNTDNITRGMTLVDRFDADTSWSDKPNAEIVYEINKKSFMEKIYDLLNWF

SEQ ID NO: 79775 - protein, 363 aa, Pseudoalteromonas tunicata D2
MGFKCGIVGLPNVGKSTLFNALTNAGIEAANFPFCTIEPNTGVVAVPDPRLKQLAEIVNPQRILPTSMEFVDIAGLVKGASKGEGLGNQFLANIRETDAIGHVVRCFEDENIIHVAGTIDPADDIDTINTELVLADMEAADKAVFRIAKKAKGGDKDSKFELVVLEKVKAHLDQGLTLRSLELTKEEHAAIKTINFLTIKPTMYIANVSEDGFENNPYLDKVLEIAAAENAIVVPVCAAIESELSELDEADKIEFMTDLGLEEPGLDRVIRGGYQLLQLQTYFTAGVKEVRAWTIPVGATAPQAAGKIHTDFERGFIRAQTIGFNDYITCKGESGAKEAGKMRSEGKDYIVKDGDVMNFLFNV

SEQ ID NO: 79776 - protein, 151 aa, Oryza sativa
MDYSNLRRQAASMKKSLFDQGYLDEQFCQVEDLQDEASPNFVEEVVTLFFKDSGRLMSNIEQALEKYPRDFNRWDTYMQQLKGSCSSIGASRMKNECMSFRDSCGQGNVEGCMRSFQKVKREHAVLRQKLESYFQLLRQAGPAGAATRPVM

SEQ ID NO: 79777 - protein, 307 aa, Gibberella zeae PH-1
MTGLRNATLTILGTGNITKPIVKNLLPAIKNGKTDLPFTKIIACVRSEASEKKLNEQFSEYSTALTVSRGDNVTAVQQGHVIILGVDPADIESVLTQDGIRDALSGKLLISVAAGWTREKIEATIYGSETTKDNWSGRSWVIRTLPNIACMVSEGLIAIEKSPSKPEVPKEHRDLAKAIFTTIGETVEVPPRLMNATTAVGGSTPAFWAIICDAFIDASVAVGVPRADAQKMIYQSMKGSAAMLQSGLQPGDLRDQGTSPEGCTIGGIMVLEEAGVRGHLGRALREAVTTARLMETTAHVNDTRPTS

SEQ ID NO: 79778 - protein, 250 aa, Zea mays
MVKLAFGSVGDSFSVTSIKAYVAEFIATLLFVFAGVGSAIAFGQLTNGGALDPAGLVAIAVAHALALFVGVSVAANTSGGHLNPAVTFGLAVGGHITVLTGLFYWVAQLLGASVACLLLRFVTHGKAIPTHGVSGGTTELEGVVFEIVITFALVYTVYATAADPKKGSLGTIAPIAIGFIVGANILAAGPFSGGSMNPARSFGPAVAAADFAGNWVYWVGPLIGGGLAGLVYGDVFIGGSYQQVADQDYA

SEQ ID NO: 79779 - protein, 170 aa, Thermosynechococcus elongatus BP-1
MDLKSLIRDVPDFPKPGILFRDLTTLLQNQAGLRYVIDQLVEKHANAGIDYVAGIESRGFIFGAPLAYRLGAGFIPLRKPGKLCAPVYAVEYELEYGRDRLEMHQDAIEPGRRVLIVDDLIATGGTAAAAAGLIQKAQAELYGFAFIVELTDLAGRQKLPDVPITTLVTY

SEQ ID NO: 79780 - protein, 938 aa, Gibberella zeae PH-1
MSTHQHSAFASAQYISPDPIFEVTKRFNADQDPQKVNLGQGTYRDESAKPWVLPSVREAEKLIANSGHEYLPIEGLQSFRDAAKDRIATCQSISGTGSLLLAGLVLKKANSGIENIIITDPTWSNHDLLFHEIGFNVIKAPYYKDRSFDFKGYLDTIKAADKRSAVVLHACAHNPTGCDPTRDQWKQIAEVIKENGIFPIIDSAYLGFNSGNYDEDAWAVKYIIEELGLEAAICLSFAKNMGLYGERVGLTAIVTKSEETKKAVFSLLQQSQRQTVSNPPVHGARIAAAVLSNPDTLKQWHQDLVTMSSRIKSMRSKLFDELVRLETPGDWSHIVNQTGMFGYTGISKPQIECLEEKYHIYMADTSRISLAGLNEHNVDVTQRAERHATPVVALTSRCTIPRRRHPTTANSLDNPASDLKIGVEQKNGAIPDARRNQAPYNVRVTSSDTTPLPQTPRVINGGNRSIGWGTDGVMVAFGQHHSQVPGSPELDSHTQGRWAKTSGNAAAALEATRTNTPVVNGAETPLSELPPLILYRSLFINAVSSRPWLLIPSLHLLQKLSHAGNPYLFNVSRNPLLRTILKHTFYKQFCAGETGAEAQATMKELQDMGFKGTILTFAKETVFDSKTGKEQGHGIETSTTNECQWCDNIEAWRDGTLKTVELLREGDQLATKLTGAGPGVCEALHNDAQLPKQFVDACYEISQKVKDRGAYILIDAESQHYQWGIFRLGMELQQKFNTDGNVVLYNTYQAYLKSTQESLEKHLQIASDKGFTLGVKVVRGAYMSSDPRSLIHDTKQDTDDNYNQIAQGVLRQDFRGFGGSNAKPFPSAQLLLASHNKESLVKAHEMHQERTKANLPTVPVKFAQLHGMSDEVSFGLLKLKDDNGVAPEVYKCTTWGTLGECMAYLTRRAIENRDAASRTLDEYTALKNEAWRRLAFWR

SEQ ID NO: 79781 - protein, 382 aa, Shigella dysenteriae
MSLKEKTQSLFSNAFGYPATHTIQAPGRVNLIGEHTDYNDGFVLPCAIDYQTVISCAPRDDRKVRVMAADYENQLDEFSLNAPIVAHENYQWANYVRGVVKHLQLRNNSFGGVDMVISGNVPQGAGLSSSASLEVAVGTVLQQLYHLPLDGAQIALNGQEAENQFVGCNCGIMDQLISALGKKDHALLIDCRSLGTKAVSMPKGVAVVIINSNFKRTLVGSEYNTRREQCETGARFFQQPALRDVTIEEFNAVAHELDPIVAKRVRHILTENARTVEAASALEQGDLKRMGELMAESHASMRDDFEITVPQIDTLVEIVKAVIGDKGGVRMTGGGFGGCIVALIPEELVPAVQQAVAEQYEAKTGIKETFYVCKPSQGAGQC

SEQ ID NO: 79782 - protein, 439 aa, Xanthomonas campestris pv. campestris str. ATCC 33913
MSSTAPPLSFARILALNAGFFGVQYSFGLQQSNMSPIYNYLGADHASLPYLWLAGPITGLVLQPFVGALSDRSVTRWGRRMPYMVLGALVCSLCLLAMPFSTALWMAVCLLWVLDAANNVAMEPYRALVSDVLAPPQRPLGYLTQSAFTGLAQTLAYLTPPLLVWFGMSQDAANAHHIPYVTIAAFVIGAGFSAASILLTARSVREPVVPAAEIARMRKAGTGLGATLREIGSALRDMPPTMRQLAPVMLFQWYAIFSYWQYIVLSLSTTLFGTTEANSHGFREAGLVNGQIGGFYNFIAFLAAFAMVPVVRRVGPKYTHAACLLAAGVGMWVLPGIENRWLLLLPMIGIGLAWASMMGNPYLMLADSIPPERTGVYMGLFNLFIVLPMLIQIVTLPLYYEPLLHGDPRNVIRLAGALMLAAAVAMLCVRIRKPKAVAA

SEQ ID NO: 79783 - protein, 445 aa, Triticum aestivum
MSMTDTSTAPRAEFGTRPKPSPSPLQSSDHLAQIAADSIRFLDGMATKRSVGTLGEADLKGKKVFVRADLNVPLDDAQKITDDTRIRASIPTIKYLLEKGAKVILASHLGRPKGVTPKFSLKPLVARLSELLGLEVVMAPDCIGEEVEKLAAALPDGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGLAVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADKMSHISTGGGASLELLEGKPLPGVLALDEA

SEQ ID NO: 79784 - protein, 332 aa, Burkholderia vietnamiensis G4
MTRTETAIRIGIDRYGDAGALRRVDAPVAPPGPGEVRIRQTAVGVNFVDIYFRTGAHPLPALPAALGVEAVGVVDAVGPGVDAVVAGQRVAYAGLPTGSYASLRTLPAERVVPVPDGVSDETVAGGLLKGITVYMLLHRVRQVAAGDSVLVHAAAGGVGLLATQWAHALGARVIGTVGSAAKAALVRAHGAQAVVDYRDEDFVAAARAFGGGAGVDYAIDGIGGDVLTRTLGAIRPFGMVASIGQVAAIGARQTIDLDELGPARSIALARPSVLGFIARDVAGYRDAAHATLERFARGMHVEVGARLPLEQAADAHRLLESRQTTGGVVLLP

SEQ ID NO: 79785 - protein, 245 aa, Brassica napus
  misc_feature (236)..(236): Xaa can be any naturally occurring amino acid
MGSVTTQPLFSFGVIADVQYADIPDGRSFLGTPRYYRNSILVLQKAVQAWNQHGNLKFVINMGDIVDGFCPKDQSLSATKKLVDEFEKFQGPVYHMIGNHCLYNLPRRELLPLLNIPSRDDDYNAYYDFSPTPEYRVVVLDGYDISAVGWPEDHPKTLAALKILDEKNPNSEKNSPEGLVGVERRFVKYNGGVGEKQLEWLDGVLKDATESNQRVIVCGHVPMSPGCASSAALWWXFDEVMSVIH

SEQ ID NO: 79786 - protein, 435 aa, Zea mays
MPIQKILARTIFDSRGNPTVEVDLTTDKGLFRAAVPSGASTGIYEALELRDGDKANYHGKSVFKAVSNVNDVIAPALLAQNFNLTQQRDIDNFMLNLDGTENKSKLGANAILGVSLAVCKAGAAEAGLPLYAYIAKLAGNDKIILPVPAFNVINGGEHAGNKLPMQEFMILPTGAATFREAMKIGSEVYHHLKAVIKKRFGLDATAVGDEGGFAPNILDAKDALELIKTAVEVSGHASKIEIGMDVAASEMYKRDQKKYDLDFKNPQSDPTKWITSAELGALYQKFATEYPIVSIEDPFDQDDWEAWTALTGAVNFQIVGDDLTVTNPKRIQSAVEKKACNCLLLKVNQIGSVSESIDAHLLAKKNGWGTMVSHRSGETEDTTIADLVVGLSAGQIKTGAPCRSERLAKYNQILRIEEELGDKAIYAGKNFRHPA

SEQ ID NO: 79787 - protein, 484 aa, Magnaporthe grisea 70-15
MAPIQKETDYLVIGGGSGGLASARMASSKFGTKAMIVEGGRIGGTCVNVGCVPKKVTFNAAAIAETIHQAKSYGFSVQETKPFDWRSFKQKRDAYITRLNGIYDRNLANDKVEYLHGWAKLLSRNEVEVTLDDGTKAVVKAKKILIAVGGTPTKPSSSIPGAEFGTDSDGFFDIEDLPKKVALVGAGYIAVEFAGMFNALGVETHLFIRGDTFLRNFDPMVQEVVTKEYERLGVKLHKQSSQSKIERDESTGKLTVHYKDKDGEAAISDVDHLIWAIGRTPMTKDIGLDKAGVKVNEKGYIEVDEFQNTSVENVYALGDVTGQVELTPVAIAAGRRLSHRLFGGEQFSTYKLDYSNIPSVVFAHPEVGSIGLTEPEAVEKYGKENLKIYKTSFTAMYYAMMEPDEKGPTAYKLICAGPEEKIVGLHIVGLGSGEMLQGFGVAVKMGATKKDFDSCVAIHPTSAEELVTLNKEAGSSSYSHWDCL

SEQ ID NO: 79788 - protein, 1528 aa, Aspergillus nidulans FGSC A4
MAPVTSAGEAVARIAYQASEVVLSVQPSLQSDSWFTKTLKSLKAAGARSVVPEGVPDVVSVRYNEDPFLSAFHPLQSGKVVSAVTSSSTLLTSIPHLYRLANSPVVIHVALEPYPFPDYSAISSIRQCGFTFLHSETLQEAQDIALTAHALARKSGKGVIHFFDPANSANDDAIEQEDAQTLKSILDLSRSAVSHSEGHGVDTLYAETGRVATVSDETVESSTAAQVEETATPTQPSQTPSSRSVANSSVGSSERDSSVDSRATSSAATTVDGSVRPVSATDIFSWASQIWKALSEITGRNYRAIEYTGPSDAKSAIFVFGSTGVFVDVLSKEDVPAELTNIGLITARLYRPWVGAEIANSIPRSIEKIAVLEQVRKTTRWGPSFMDLLSSLTPAAVGGRSPQIVGYRLGYVEPSTAVQALRGIIQNLSSPSPIQSLEIGSSNVPTLQTPLEQPRIENAYLKILNQLFGERLYLANQLSSNNAGISSTIAASPEYGFGSLIARKEHRQRFIREVEAASKSNSFATDVVSKWLADWALNATDATKANRLAPDVIARLSNDGSALSKQLLQTKKLFYSESQWLIGSDAWAYDLGNSGVHHVLASGADVNMLVIDSQPYSERSAADPTRRKKDIGLYAMNFGNAYVASVAVYSSYTQVLQAMAEAEQFKGPSIVVAYLPYNQENDSALTVLQETKKAVDLGYWPLYRWNPANEDKGEPKFALDSERVKRELEEFLRRDNQLTQLMNRQPKFSSVLSESYGTEVRAIQKRKAKDSYEKLLEGLFGAPLTILFASDGGNAATLAKRLGNRGRARGLKTLVMAMEDYPFEDLPTEENVVFITSTAGQGEFPQNGRALWEYVKNTGDLDLSTINYSVFGLGDSHYWPRKEDKIYYNKPAKDLDARIAFLGGRKLTDIGLGDDQDPDAFQTGYSEWEPRIWQALGVDKVEGLPEEPAPLTNEDIKIQSNYLRGTIAEGLLDESTGAISASDQQLTKFHGTYMQDDRDVRDERKAQGLEPAYSFMIRCRLPGGVATPSQWLQMDAISSAYGNETMKLTTRQTFQFHGVVKRNLRGAMRAINKALMTTIAACGDVNRNVMCSSLPELSYYHREVHAVSKKISDHLLPATTAYHEIWLQDENDKKVQVAGDAVVDQEPLYGPTYLPRKFKITIAIPPHNDTDVYAHDIGLIAIKGADGHLEGFNILAGGGMGTTHNNKKTYPQTGRMFGYVPADQAHIVCEKIMLVQRDYGDRKNRKHARLKYTIDDMGVEAYKEKVEALLPDGLRFAEPRPFKFASNVDTFGWQKDENGLNHFTFFIENGRIEDTADFRMRTGLRELASLDKGEFRLTGNQHLILSNIKDEDLPAIKELMAKYKLDNTSFSGLRLSSSACVAFPTCGLAMAESERYLPVLITKLESTLEEVGLARDSIVMRMTGCPNGCARPWLAEVAFVGKAYGAYNMYLGGGYHGQRLNKLYRSSIKEDEILDIMKPLLKRYALERNTDGEEPERFGDWLIRAGVIKETTDGRNFHEGVAEEEDEE

SEQ ID NO: 79789 - protein, 382 aa, Shigella flexneri
MRLKEKTQSLFANAFGYPATHTIQAPGRVNLIGEHTDYNDGFVLPCAIDYQTVISCAPRDDRKVRVMAADYENQLDEFSLNAPIVAHENYQWANYVRGVVKHLQLRNNSFGGVDMVISGNVPQGAGLSSSASLEVAVGTVLQQLYHLPLDGAQIALNGQEAENQFVGCNCGIMDQLISALGKKDHALLIDCRSLGTKAVSMPKGVAVVIINSNFKRTLVGSEYNTRREQCETGARFFQQPALRDVTIEEFNAVAHELDPIVAKRVRHILTENARTVEAASALEQGDLKRMGELMAESHASMRDDFEITVPQIDTLVEIVKAVIGDKGGVRMTGGGFGGCIVALIPEELVPAVQQAVAEQYEAKTGIKETFYVCKPSQGAGQC

SEQ ID NO: 79790 - protein, 361 aa, Nocardia farcinica IFM 10152
MPQQVRGVIARSTGAPVEITDIVIPDPGPGEVVVAVAACGVCHTDLTYREGGINDEFPFLLGHEAAGTVESVGPGVDSVQPGDFVVLNWRAVCGRCRACRRGRPQYCFDTFNAEQKMTLLDGTELTPALGIGAFAEKTLVHAGQCTKVDPAADPAVAGLLGCGVMAGLGAAVNTGGVSRGDSVAVIGCGGVGDAAIAGARLAGAATIIAVDRDPRKLVWATELGATHTVDASQVDAVAAIQDLTGGFGADVVIDAVGRPETWKQAFYARDLAGTVVLVGVPTPDMRLEMPLIDFFSRGGALKSSWYGDCLPERDFPYLVDLYLQGRLPLEKFVTERIGLEDVEKAFHTMHAGEVLRSVVIL

SEQ ID NO: 79791 - protein, 400 aa, Campylobacter lari RM2100
MLIVQKYGGTSVGTLERIDEVAKRVAKSKKTCDKLVVVVSAMSGVTNELIDFAHHFSKNPSGREMDMLLSSGERVTSSLLAIALNEMGLKATAFSGRNAGIITDDVYTKARIERIDTANINKALDEGYIVVVAGFQGIDKMGNVTTLGRGGSDLSAVALAGALNADLCEIYTDVDGVYTTDPRIEPKAKKLDKISYEEMLELASLGAKVLQNRSVELAKKLNVKLVTRSSFNENEGTIITKEENMEQALVSGIALDKNQARVTLRNIDDKPGIAAEIFGTLANENINVDMIIQNVGVDGATNLGFTVPENELDLATNAMKKVLGANAIIETDSAVVKVSVVGVGMKSHSGVASAAFKALANENINIQMISTSEIKISVIVHEKYGELAVRVLHEVYKLDI

SEQ ID NO: 79792 - protein, 412 aa, Lentisphaera araneosa HTCC2155
MNYKKLQIRIFTLSWLSYAFYYVSRKNFSVVKSTLHEDLGFSMVQLGTIETLYAGSYMLGQFISGALGDKLGPRKLLTFGMFGSAITSIIMGLSVAYSIFAFSLVFNGLFQSTGWANNLKAMTPWFNQESRGKVTGFWCTCYTAGPIIATATATYLLVNYSWQTAFIIPGILVMAVGALVFFFLIDSPEKAGFESSEVTPSREINEKSKTPFMQMITHPTVIVYGIAYAFIKFVRYSFTFWLPWYLYERLGFSKGDSGYVSVAFEMGGFFGVIGIGVLSDKYFSKNRAKIVVICIMAMAGALYLYQLFGGADMLLNVLLLALIGFMLFGGDSVLSASATQDIGGKEATASAVGIVNGIGSLGGVCGGVIPALITQRFGWSALFYFLIFSTIFAGVLLSVCTQKKGTRIDRQN

SEQ ID NO: 79793 - protein, 504 aa, Lentisphaera araneosa HTCC2155
MPQPVFINEYDLKKYINTNKGRKMIYSAPTQDSSIVSLKSQYENFIGGEHLPPVEGKYFDNVSPVNGEVFCQVARSSDKDVEKALDAAHNAFPSWEQSSVTERANILLKIADRIEDNLEKLALVETWDNGKPIRETLAADVPLAADHFRYFAGCIRAQEGGISEIDHDTVAYHFHEPIGVVAQIIPWNFPLLMAAWKLAPALAAGNCVVLKPAEQTPLSISVLIELIEDLIPPGVLNLVHGFGTEAGKSLASNSRIAKVAFTGSTPVGKQIMSYASENIIPITLELGGKSPNIFFEDIMDHGDDFIDKAIEGMLLGFFNQGEVCTCPSRILIQESIYDEFIQRVILRARKIVQGNPLDTETMLGAQASQQQLDKILFYANVAEEEGAQCLIGGERNMDDELAKGFYIKPTLYKGDNSMRIFKDEIFGPVLSVTTFKSEEEALGIANDTEYGLGAGIWTMDMNRAYRFGRQFKRDEYGPIVIICTQHMRLSVVIKSQVLVEKLIE

SEQ ID NO: 79794 - protein, 497 aa, Arabidopsis thaliana
MAMLGFYVTFIFFLVCLFTYFFLQKKPQGQPILKNWPFLRMLPGMLHQIPRIYDWTVEVLEATNLTFYFKGPWLSGTDMLFTADPRNIHHILSSNFGNYPKGPEFKKIFDVLGEGILTVDFELWEEMRKSNHALFHNQDFIELSVSSNKSKLKEGLVPFLDNAAQKNIIIELQDVFQRFMFDTSSILMTGYDPMSLSIEMLEVEFGEAADIGEEAIYYRHFKPVILWRLQNWIGIGLERKMRTALATVNRMFAKIISSRRKEEISRAKTEPYSKDALTYYMNVDTSKYKLLKPNKDKFIRDVIFSLVLAGRDTTSSVLTWFFWLLSKHPQVMAKLRHEINTKFDNEDLEKLVYLHAALSESMRLYPPLPFNHKSPAKPDVLPSGHKVDANSKIVICIYALGRMRSVWGEDALDFKPERWISDNGGLRHEPSYKFMAFNSGPRTCLGKNLALLQMKMVALEIIRNYDFKVIEGHKVEPIPSILLRMKHGLKVTVTKKI

SEQ ID NO: 79795 - protein, 488 aa, Nocardia farcinica IFM 10152
MNQTADVLTRGLTARHIRFIALGSAIGTGLFYGSAEAIHRAGPAVLLAYLIGGAAIYIVLRSLGEMAVSNPVSGSFGEYASKHLGPLAGFMTGWTYTFEMVIVCLADVTAFGVYMGFWFPDVPRWIWVLSIILFIGAVNLLHVKVFGEVEFWFSLVKIVAILAMIVGGVAILIFGFGMHDTDAGLTHLWAEGGFFATGIGGFLTCFAIVMFAFGGTEIIGITAGEAERPERTIPRAINTVPVRIMLFYVLTLAVIMAINPWQSIGSEGSPFVQIFQALGIGPAATVLNIVVITAALSAINSDIFGAGRMMYGMAQRGQAPAVMRQVSRNGVPWMTVVIMTVTLLVGVLLNYLIPDKVFLIIASIATFATIFVWLMILLAHYRSRRRMSAEETAALRFPVPFWPYGQLITIAFLVFVVAMIAFDADSRVALVVGAVWLALLWLAYRRWVRPTPAATDAAPVAGPGTDPADPADPALTTPTPRIEMEKNL

SEQ ID NO: 79796 - protein, 498 aa, Campsis radicans
  misc_feature (1)..(19): Xaa can be any naturally occurring amino acid
XXXXXXXXXXXXXXXXXXXLGRIVQIIGPVLNVAFPPGKMPNIYNALVVKGRDTVGQKMNVTCEVQQLLGNNRVRAVAMSATDGLTRGMEVIDTGAPLSVPVGGATLGRIFNVLGEPVDNLGPVDTRTTFPIHRSAPAFIQLDTKLSIFETGIKVVDLLAPYRRGGKIGLFGGAGVGKTVLIMELINNIAKAHGGVSVFGGVGERTREGNDLYKEMKESGVINEENIAESKVALVYGQMNEPPGARMRVGLTALTMAEYFRDVNKQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESNLKK

SEQ ID NO: 79797 - protein, 166 aa, Glycine max
  misc_feature (65)..(65): Xaa can be any naturally occurring amino acid
  misc_feature (96)..(96): Xaa can be any naturally occurring amino acid
PRVRAVAGGTTYLLFHAVGYIWQTSNCFLTASYSLTLRHVMDGAKQATKPGNLNELSMVLLNNVXFSLPSGIILVLGLNEVEYLLETSLLRMPEFXLVINASGVLGLGISFTLMVLLNNVLSLPLGIILVLGLNEVEYLLEKSLLRMPEFWLVITASGVLGLGISF

SEQ ID NO: 79798 - protein, 291 aa, Xylella fastidiosa 9a5c
MSEALFTRWRQRTDSYLERTLSIPTQAPQRLHAAMRYTVLSRGKRIRPLLVYAAGHLFHVDEPLLDVPAAAVELIHAYSLVHDDLPAMDDDLLRRGRPTVHIAFDEATAILTGDALQTLAFECLADAPSDTSLRIAWLQTLTHAAGVAGMCGGQAIDIDATGQSQTLKALEAMHALKSGTLMRAAVRMGALAGDPSAEDLHSLDTFAATLGLAFQVRDDILDIESSSEQLGKTAGKDAIQQKSTFPALLSVEGAKCYLQELAERLYTQLHPYGERAAPLTALARLAVERAH

SEQ ID NO: 79799 - protein, 312 aa, Pseudoalteromonas tunicata D2
MKLFAGNATPELALKVAKRLYIELGNADVGRFSDGEISVQINENVRGSDVFIIQSTCAPTNDNLMELIVMVDALRRASAGRITAVIPYFGYSRQDRRVRSARVPITAKVVADFLSSVGVDRVLTVDLHAEQIQGFFDVPVDNVFGSPVLLEDMKARNFEDVVVVSPDIGGVVRARAIAKLLNDTDLAIIDKRRPRANVSQVMHIIGDVEGRDCIIVDDMIDTGGTLCKAAEALKEHGAKRVFAYATHPILSGNAAENIRNSVIDQVIVTDSVPLSAELLAIDKIKVLTLADMLAETIRRISNEESISAMFEH

SEQ ID NO: 79800 - protein, 514 aa, Oryza sativa Japonica Group
MPLDTNACAQPMRRAGEGAGTERLMERLNIGGMTQEKALRKRCFGDGVTGTARCVFTSDADRDTPHLRTQSSRKNYADASHVSAVILGGGTGVQLFPLTSTRATPAVPVGGCYRLIDIPMSNCFNSGINKIFVMTQFNSASLNRHIHHTYLGGGINFTDGSVQVLAATQMPDEPAGWFQGTADAIRKFMWILEDHYNQNNIEHVVILCGDQLYRMNYMELVQKHVDDNADITISCAPIDGSRASDYGLVKFDDSGRVIQFLEKPEGADLESMKVDTSFLSYAIDDKQKYPYIASMGIYVLKKDVLLDILKSKYAHLQDFGSEILPRAVLEHNVKACVFTEYWEDIGTIKSFFDANLALTEQPPKFEFYDPKTPFFTSPRYLPPARLEKCKIKDAIISDGCSFSECTIEHSVIGISSRVSIGCELKDTMMMGADQYETEEETSKLLFEGKVPIGIGENTKIRNCIIDMNARIGRNVIIANTQGVQESDHPEEGYYIRSGIVVILKNATIKDGTVI

SEQ ID NO: 79801 - protein, 418 aa, Pseudoalteromonas tunicata D2
MTIVALGINHKTAPVELREKVAFSAEQLTVALQQLQQANLVMESVIVSTCNRTEIYCSLEGTDTQTLLSWLAQFHQLPVEQLQDHTYCYVNDRAISHLMRVSCGLDSLVLGEPQILGQIKQAYNDAKHYKSVGVMLERLFQKTFAVAKHVRTETEIGASAVSVAYAAVSLAKHIYGKLDKTNVLLIGAGETIELVARHLHQNGCARMTVANRTVARAENLAKEFSAHVVSLAEVPEQLIKADIVISSTASTLPIIGKGVVEQALKARRYKPMLFIDIAVPRDIESQVGELNDAYLYTVDDLQAIVSENMASREKAADEAEDIIVQRVDEFLLWLKSLDSVDVIKLYREDSEQIKQELLNRAQQQLLAGKSPDKVLLEFANKFSNRMMHAPTKAIKEAAEAGELAELAQLRKILGIEPQ

SEQ ID NO: 79802 - protein, 601 aa, Triticum aestivum
SLHTTSRRRPLAGRGIEIVYRRVAQTAAKRGAKSSAAASSSSASSAADKAANGIAALNLSDRTCTGVLASHPLSRDIHIESLSLTFHGHDLIVDSELELNYGRRYGLLGLNGCGKSTLLTAIGCRELPIPEHMDIHHLTREIEASDMSALQAVICCDEERVKLEKEAEILAAQDDGGGEALDLVYERLEAMDASTAEKRAAEILFGLGFDKQMQAKPTRDFSGGWRMRIALARALFMNPTILLLDEPTNHLDLEACVWLEEKLKNFERILVVISHSQDFLNGVCTNIIHMQNKTLKLYTGNYDQYVQTRSELEENQMKQYKWEQEQIANMKEYIARFGHGSAKLARQAQSKEKTLAKMERGGLAEKVVNDRILVFRFTDVGKLPPPVLQFADVTFGYTPDNLIYKNLDFGVDLDSRVALVGPNGAGKSTLLKLMTGDLSPLDGMVRRHNHLRIAQFHQHLTEKLDLDMPALQYMMREYPGNEEEKMRAAIGKFGLSGKAQVMPMKNLSDGQKARVIFAWLAFRQPQMLLLDEPTNHLDIETIDSLAEALKEWDGGLVLVSHDFRLINQVAQEIWVCENQAVTRWEGDIMDFKQHLKKRAGL

SEQ ID NO: 79803 - protein, 555 aa, Lobelia erinus
MDATYIASMILFHELSAAILLFMVTHLFIRFLIKASGHHDHQPQLPPGPRGWPIIGALPLLGSMPHVALASMARKYGPVMYLKLGSSGMVVASNPEAARAFLKTLDTNFRNRPLEGGPTHLAYNAQDMVFANYGPKWQLLRKLCNLHMLGAKALDDWAHVRIMEVGHMLQAMYDQCSSSSSSSSSTSTGPAGPVAVVLPEMLTYAMANMLGQVIFSKRAFVASKSDATTSTSSTLKSAGEFQHMVMELMRVAGLFNIGDFIPSIAWMDLQGIQRDMKTVHKKFDELLTRMIREHTESAHERKGNPDFLDILMALATATNQEKNTATGEEQQLSITNIKALILDLVTAGTDTSSSIIEWALAEMMNKPSILKRAQEEMDQVVGRNRRLEESDIPRLPYLGAICKETFRKHPSTPLNLPRVSSEACQVDGYYVPKNTRLMVNIWAIGRDPNVWENPLDFNPDRFLTSSGDVIDPRGNHFELIPFGAGRRICAGTRMGIGMVEYILGTLVHSFDWKVAAAEAAINVDMEESFGIALQKKVPLSAILSPRLPPSAYSPS

SEQ ID NO: 79804 - protein, 494 aa, Thermotoga maritima MSB8
MGSDKIHHHHHHMKEALTFDDVLLVPQYSEVLPKDVKIDTRLTRQIRINIPLVSAAMDTVTEAALAKALAREGGIGIIHKNLTPDEQARQVSIVKKTENGIIYDPITVTPDMTVKEAIDLMAEYKIGGLPVVDEEGRLVGLLTNRDVRFEKNLSKKIKDLMTPREKLIVAPPDISLEKAKEILHQHRIEKLPLVSKDNKLVGLITIKDIMSVIEHPNAARDEKGRLLVGAAVGTSPETMERVEKLVKAGVDVIVIDTAHGHSRRVIETLEMIKADYPDLPVVAGNVATPEGTEALIKAGADAVKVGVGPGSICTTRVVAGVGVPQLTAVMECSEVARKYDVPIIADGGIRYSGDIVKALAAGAESVMVGSIFAGTEEAPGETILYQGRKYKAYRGMGSLGAMRSGSADRYGQEGENKFVPEGIEGMVPYKGTVKDVVHQLVGGLRSGMGYIGARTIKELQEKAVFVKITPAGVKESHPHDIIITKESPNYWVQA

SEQ ID NO: 79805 - protein, 423 aa, Xanthomonas campestris pv. campestris str. ATCC 33913
MSTAPQKPLAIRERLSEVRYEIRGELARRARELEAQGRKLIKLNIGNPGAFGFRAPEHLQRAIADDMGRTDPYTHQQGLPEAREAIAAAYARRQHPDAHPDRIFIGNGVSELIDLSLRALLNPGDEVLVPSPDYPLWSAATILNDGRPVYYRCAPENGFQPDPVEIETLVSSRTRAIVLINPNNPSGASYSRELLERIVAIAVKHNLLLMVDEIYDQVLYDGAAFVPVAPLAGEHPCITFSGLSKVHRACGWRVGWALLSGEQSRINDLRNAMDLLGALRLCANVPGQYAIDAAVNGPDTISALCAPGGRLYETRRAVIEACAASSHLSLVAPAGALYAFPAVVGPAARAFDDHTFALDLMNDEGVLVVPGSSFNVPYRHHFRVTLMPEAAVMRDVFARIDRALTRRAEAVTKVVPLKSRSVA

SEQ ID NO: 79806 - protein, 527 aa, Thermotoga maritima MSB8
  misc_feature (1)..(1): Xaa can be any naturally occurring amino acid
  misc_feature (13)..(13): Xaa can be any naturally occurring amino acid
  misc_feature (110)..(110): Xaa can be any naturally occurring amino acid
  misc_feature (117)..(117): Xaa can be any naturally occurring amino acid
  misc_feature (132)..(132): Xaa can be any naturally occurring amino acid
  misc_feature (197)..(197): Xaa can be any naturally occurring amino acid
  misc_feature (204)..(204): Xaa can be any naturally occurring amino acid
  misc_feature (229)..(229): Xaa can be any naturally occurring amino acid
  misc_feature (249)..(249): Xaa can be any naturally occurring amino acid
  misc_feature (422)..(422): Xaa can be any naturally occurring amino acid
  misc_feature (431)..(431): Xaa can be any naturally occurring amino acid
  misc_feature (443)..(443): Xaa can be any naturally occurring amino acid
  misc_feature (492)..(492): Xaa can be any naturally occurring amino acid
  misc_feature (504)..(504): Xaa can be any naturally occurring amino acid
XGSDKIHHHHHHXSLRDKIEELKKIEKEIEQGGGPEKVEKQHRAGKLTAWERLELLLDPGTFVEIDKFVEHRNTYFGLDKVKLPRDGVITGVGEINGRKVAVFSQDFTVXGGSLGEXHAKKIVKLLDLALKXGIPVIGINDSGGARIQEGVDALAGYGEIFLRNTLASGVVPQITVIAGPCAGGAVYSPALTDFIVXVDQTARXFITGPNVIKAVTGEEISQEDLGGAXVHNQKSGNAHFLADNDEKAXSLVRTLLSYLPSNNAEEPPVEDPDTSLETPEDILDILPDNPNKGYDVRDVIKRVVDHGEFFEVQPYFAKNIVIGFARIQGKTVGIVANQPSVLAGVLDIDSSDKAARFIRFLDAFNIPILTFVDTPGYLPGVAQEHGGIIRHGAKLLYAYSEATVPKITVILRKAYGGAYIAXGSKHLGADXVLAWPSAEIAVXGPEGAANIIFKREIEASSNPEETRRKLIEEYKQQFANPYIAASRGYVDXVIDPRETRKYIXRALEVCETKVEYRPKKKHGNIPL

SEQ ID NO: 79807 - protein, 554 aa, Lobelia erinus
MDATNIASMILFHELSAAILLFMVTHLFIRFLIKASGHHDHQLQLPPGPRGWPIIGALPLLGSMPHVALASMARKYGPVMYLKLGSSGMVVASNPEAARAFLKTLDTNFRNRPLEGGPTHLAYNAQDMVFANYGPKWQLLRKLCNLHMLGAKALDDWAHVRIMEVGHMLQAMYDQCSSSSSSSSTSTGPAGPVAVVLPEMLTYALANMLGQVIFSKRAFVASKSDATTSTSSTLKSAGEFQHMVMELMRVAGLFNIGDFIPSIAWMDLQGIQRDMKTVHKKFDELLTRMIREHTESAQERKGNPDFLDILMALATATNQEKNTATGEEQQLSVTNIKALILDLVTAGTDTSLSIIEWALAEMMNKPSILKRAQEEMDQVVGRNRRLEESDIPRLPYLGAICKETFRKHPSTPLSLPRVSSEACQVDGYYVPKNTRLMVNIWAIGRDPNVWENPLDFNPDRFLTSSGDVIDPRGNHFELIPFGAGRRICAGTRMGIGMVEYILGTLVHSFDWKVAAAEAAINVDMEESFGIALQKKVPLSAILSPRLPPSAYSPS

SEQ ID NO: 79808 - protein, 369 aa, Prochlorococcus marinus str. MIT 9313
MVSLSQNLPQAISTTPVMQDWPGLIEAYRSWLPVSETTPVVTLKEGATPLIPVSSIAEQIGRGVKVYVKYDGLNPTGSFKDRGMTMAISKAKEANCEGVICASTGNTSAAAAAYAKRAGMRAFVLIPDGYVAQGKLAQALVYGAEVLAIRGNFDRALDIVQEMALKYPVTLVNSVNPYRLQGQKTAAFEIVDALGEAPEWLCIPMGNAGNITAYWMGFQEYKQAGKCQLLPQMMGFQASGSAPLVFNKTVNNPNTIATAIRIGNPVNKEKAIAAKSSSNGAFLDVSDEKILEAYKLLGREEGIFCEPASAASVAGLLKRASEVPSGATVVCVLTGNGLKDPDCAINNNDAIFHADLNPDLTTVAHVMGF

SEQ ID NO: 79809 - protein, 200 aa, Aspergillus nidulans FGSC A4
MGLSYPFGFATVSLLVIGGYMLFHGEGEQFNVGQFLESVSPYVWANIGIAMCIGLSVVGAAWGIFLTGSSIVGGGVKAPRIRTKNLISIIFCEVVAIYGVIMAIVFSSKLNLATGDEIHSPSSYYTGYALFWGGITVGACNLICGISVGINGSGAALADAADPSLFVKILVVEIFSSVLGLFGLIVGLLVQGKATEFGAA

SEQ ID NO: 79810 - protein, 544 aa, Bradyrhizobium sp. BTAi1
MSSGDLLLHSPTRFSHALREELERLGPIKYLLAPNVAHWMFLRDWQAALPNAQVYAAPGLARRAQVRRSGLRIDRELTDVTPDAWSQDLQIVLISAPLFSEVELFHRPSRTLILTDLVQNLAPEGLGAVRRTVARLLGITAPDGKAPAYLRLVLRLGGRAVRLAAARLITLAPERVIFAHGRWFDTGGTQRLRASLGWLLDSAPEARRLMRDLRGTRVVVTGASSGIGRATALALAREGASVVLAARRENVLKDVALECETLGGRAIAVATDVTDADAVKRLAEQAVRTFGGVDVWINNAGTGVFGPYQDADMALHRKTVEVNLLGTMNGAYAVLPIFLRQRRGTLINNISLGGWAPTPFAAAYTASKFGLRGFSASLRQELTAHKDVHVCSVFPAMVDTPGFVHGANVSGRTLDPGPLLYRPEDVAETFVQLVRTPRDEVAVGWPARLGQISYALARRPTEQLMSTAFRFLLSRANSAPRSTGAVLAPIAAGTAVSGGWLGRKKLPPAGQLSRIGLAVGIGGIALMLLARRRPPSAPRARAHR

SEQ ID NO: 79811 - protein, 348 aa, Rosa hybrid cultivar
NQKWSNGEHSNELLHAQAHIWNHIFSFINSMSLKSAIQLGIPDIINKYGYPMTLSELTSALPIHPTKSHSVYRLMRILVHSGFFAKKKLSKTDEEGYTLTDASQLLLKDHPLSLTPYLTAMLDPVLTNPWNYLSTWFQNDDPTPFDTAHGMTFWDYGNHQPSIAHLFNDAMASDARLVTSVIIDDCKGVFEGLESLVDVGGGTGTMAKAIADAFPHIECTVLDLPHVVADLQGSKNLKYTGGDMFEAVPPADTVLLKWILHDWNDQECIKILKRSRVAITSKDKKGKVIIIDMMMENQKGDEESIETQLFFDMLMMALVGGKERNEKEWAKLFTDAGFSDYKITPILG

SEQ ID NO: 79812 - protein, 436 aa, Triticum aestivum
MGRQIAALCGLLVVLLELTSGVNAQTEILFQGFNWDSWNKQGGWYNMLKAQVGDIAGAGVTHVWLPPPSHSVSSQGYMPGRLYDLDASKYGTAAELRSLIAAFGAKGIKCVADVVINHRCAEDKDGRGIYCIFKGGGPEGLLDWGPGMICSDDTKFSDGTGYRDTGADFAAAPDIDHLNPRVQKELSDWLNWLKSDLGFDGWRLDFAKGYSADVARTYVQNTSPGFVVAEIWNSLSYDGDGKPAVNQDGERQELVNWAKAVGGPAMAFDFTTKGILQSAVQGELWRMRDKEGNAPGMIGLLPEKAVTFVDNHDTGSSQKKWPFPADKVMMGYAYILTHPGVPCIFYDHVFDWNLKQEINALAAVRNRNGINAGSKLRILAAESDMYVATVDEKVIVKLGPRFDAGSVIPSDFHVVAHGNNYCVWEKSGLRVPAGRR

SEQ ID NO: 79813 - protein, 382 aa, Shigella flexneri
MSLKEKTQSLFANAFGYPATHTIQAPGRVNLIGEHTDYNDGFVLPCAIDYQTVISCAPRDDRKVRVMAADYENQLDEFSLNAPIVAHENYQWANYVRGVVKHLQLRNNSFGGVDMVISGNVPQGAGLSSSASLEVAVGTVLQQLYHLPLDGAQIALNGQEAENQFVGCNCGIMDQLISALGKKDHALLIDCRSLGTKAVSMPKGVAVVIINSNFKRTLVGSEYNTRREQCETGARFFQQPALRDVTIEEFNAVAHELDPIVAKRVRHILTENARTVEAASALEQGDLKRMGELMAESHASMRDDFEITVPQIDTLVEIVKAVIGNKGGVRMTGGGFGGCIVALIPEELVPAVQQAVAEQYEAKTGIKETFYVCKPSQGAGQC

SEQ ID NO: 79814 - protein, 554 aa, Lobelia erinus
MDATNIASMILFHELSAAILLFMVTHLFIRFLIKASGHHDHQLQLPPGPRGWPIIGALPLLGSMPHVALASMARKYGPVMYLKLGSSGMVVASNPEAARAFLKTLDTNFRNRPLEGGPTHLAYNAQDMVFANYGPKWQLLRKLCNLHMLGAKALDDWAHVRIMEVGHMLQAMYDQCSSSSSSSSTSTGPAGPVAVVLPEMLTYALANMLGQVIFSKRAFVASKSDATTSTSSTLKSAGEFQHMVMELMRVAGLFNIGDFIPSIAWMDLQGIQRDMKTVHKKFDELLTRMIREHTESAQERKGNPDFLDILMALATATNQEKNTATGEEQQLSVTNIKALILDLVTAGTDTSSSIIEWALAEMMNKPSILKRAQEEMDQVVGRNRRLEESDIPRLPYLGAICKETFRKHPSTPLSLPRVSSEACQVDGYYVPKNTRLMVNIWAIGRDPNVWENPLDFNPDRFLTSSGDVIDPRGNHFELIPFGAGRRICAGTRMGIGMVEYILGTLVHSFDWKVAAAEAAINVDMEESFGIALQKKVPLSAILSPRLPPSAYSPS

SEQ ID NO: 79815 - protein, 348 aa, Rosa hybrid cultivar
NQKWSNGEHSNELLHAQAHIWNHIFSFINSMSLKSAIQLGIPDIINKHGYPMTLSELSSALPIHPTKSHSVYRLMRILVHSGFFAKKKLSKIDEEGYTLTDASQLLLKDHPLSLTPFLTAMLDPVLTKPWNYLSTWFQNDDPTPFDTTHGMTFWDYGNHQPNIAHLFNDAMASDARLVTSVIIDDCKGVFEGLESLVDVGGGTGTVAKAIADAFPHIECTVLDLPHVVGDLQGSKNLKYTGGDMFEAVPPADTVLLKWILHDWNDEECIKILKRSRVAITSKDKKGKVIIIDMMMENQKGDEESIETQLFLDMLMMALVGGKERNEKEWAKLFTDAGFSDYKITPILG

SEQ ID NO: 79816 - protein, 517 aa, Triticum aestivum
  misc_feature (206)..(206): Xaa can be any naturally occurring amino acid
  misc_feature (265)..(265): Xaa can be any naturally occurring amino acid
MELPQLASFLGVVLATVLFFKAVLRRRRRQYNLPPGPKPWPIIGNLNLIGTLPHRSIHALSKKYGPLMQLQFGSFPVVVGSSVEMAKFFLKTHDVVFTDRPKTAAGRYTTYNYSDITWSPYGAYWRQARKMCLTELFSAKRLESYEYIRREEVLALLGDLYRGGAGAGRVVVLKDYLSTVSLNVITRMVMGKKYLEKEVKDEAGAXITTPEEFKWMIDELFLLNGVLNIGDSIPWLDWMDLQGYIKRMKKLSKMFDRFLEHVVDXEHSERRGREGESFVVKDMVDVLLQFASDPGLEVKLNREGVKAFTQDLIAGGTESSAVTVEWALSELLKKPEVLAKATEELDRVVGRGRWVTEKDMLNLPYVDAIVKETMRLHPVAPMLVPRLSREDTSINGYDIPAGTRVLVMVWSIGRDPELWKAPEEFMPERFLGSRLDVKGQDYELLPFGSGRRMCPGYSLGLKVIQVSLANLLHGFTWRLPDGVELSMEEIFGLSTPRKYPLEAVVEPKLPAHLYAEA

SEQ ID NO: 79817 - protein, 301 aa, Arabidopsis thaliana
MEDIIIGVVALAAVLLFFLYQKPKTKRYKLPPGPSPLPVIGNLLQLQKLNPQRFFAGWAKKYGPILSYRIGSRTMVVISSAELAKELLKTQDVNFADRPPHRGHEFISYGRRDMALNHYTPYYREIRKMGMNHLFSPTRVATFKHVREEEARRMMDKINKAADKSEVVDISELMLTFTNSVVCRQAFGKKYNEDGEEMKRFIKILYGTQSVLGKIFFSDFFPYCGFLDDLSGLTAYMKECFERQDTYIQEVVNETLDPKRVKPETESMIDLLMGIYKEQPFASEFTVDNVKAVILVSINMF

SEQ ID NO: 79818 - protein, 232 aa, Triticum aestivum
  misc_feature (56)..(56): Xaa can be any naturally occurring amino acid
  misc_feature (129)..(129): Xaa can be any naturally occurring amino acid
  misc_feature (154)..(154): Xaa can be any naturally occurring amino acid
  misc_feature (211)..(211): Xaa can be any naturally occurring amino acid
RSFAPTVNDVFEALELLKSAIHSAGHDGIMQIGMDIAASEFYNETTKKYDLHFKDXKLSKSVPHLSSSELYNVYAKYVEQYPIVSIEDPFDQDDWDGYQHMTSQLGNKVQIVGDDLLVTNPKRIATGIXRKSCTALLLKVNQIGTLTESIEAYXQSKKNNWGVMVSHRSGETEDSFIADLVVGLSTGQIKTGAPSRSERLAKYNQLLRIEXELGDRGVYAGKNFRFPYKLIE

SEQ ID NO: 79819 - protein, 519 aa, Panus rudis
MAFSTAFTSLITLAWAVGTFAAIGPVTDLHIVNDNIAPDGFTRAAVLAGGTFPGPLITGNKGDNFRINVIDDLTEESMLKSTSIHWHGFFQKGTNWADGPAFVNQCPITTGHSFLYNFNVPDQAGTFWYHSHLSTQYCDGLRGAFVVYDPNDPHADLYDVDDDSTVITLADWYHTLARQITGVPTPDATLINGLGRSASGPQDSELAVITVEQNKRYRLRLVSISCDPNYIFSIDSHNFTIIEVDGVNSKPLTVDSAQIFAAQRYSVVLNANQPVGNYRIRARPNNGDTTFTNGRNSAILRYKGATVEEPATITPPVSQTPLIEANLKPLASMPVPGTHTPGVADVVKPLQFGFNPPAFTINGASFVPPTVPVLLQILSGAKTAQEIVPSGSIIELPLNSVVELSFPNPTGAPGGPHPFHLHGHTFFVVRSAGQTTYNYDDPIARDVVSTGTAGDNVTIRFATDNAGPWFLHCHIDWHLDAGFAVVMAEGINQTQAANPTPDAWNQLCPIYNATDPSDL

SEQ ID NO: 79820 - protein, 873 aa, Aspergillus nidulans FGSC A4
MTTDSYPKKYDIVIVGAGPVGILLSLCMSRWGYKVKHIDNRPVPTATGRADGIQPRSTEILRNLGLKRKIMAYDPAKVYDVSFWDPRPDGSGIMRTGNWPSCPRFIDTRYPFTTLVHQGKIETVFLDEIKKAGTTVERPWTIIGFKNDGLDATYPVQVQLKCLDTNVVETVRAKYLFSGEGARSFVREQLGIQIRHKDPISYVWGVMDGVVRTDFPDIQTKCTIHSDAGSIMVIPREDDMVRLYVQIASSSDPDFNPRKTATAEEVQNVAKKILKPYYIEWDRVEWYSVYPIGQGISEKYTLDERVFMGGDACHTHSPKAGQGMNTAFHDALNMAWKLHAVESGLAQRSILSTYETERKNIAETLLDFDNKYAALFSKRRPNAGEVGEAATAETGRSAEEDPFVKTFKDSCEFTSGYGVAYLPNIFNWDPSHPAKSPLFDVPGINLVTGKAFTPSTVTRLADSNFVHLEQEIPANGAFRIFIFAGRQSRSKKAIADFAANLEKERSFLSAYRRSDIGEISFFERHNPHSKLFTLCLIYAEKKNDIDMDSIPQILRDYRYHIYSDDIPDVRVPNATYAAHEKLGFDPEKGGVVVTRPDSHIACTVQLAEGSGTVDALNAYFGSFSTKPLGQEQASPYSIKCFPSFSRQSSQDLRPQDTEEAPYYYTFKVQCTSCRETHPNWVSFNRFSTQEQHEIPGSRGEANFVWKCKLCQRTHSASVLAGPNAYAAGDDKRKGQKIIDLECRGLEFTEFKPDGEWEAVGVESSTPFKGIDLSEGEWYDYDEKAGDEVAIKEIKWELGRAVGTEVIVRLKWGQTEYKGRLESIDSYMNVLLRDTEEFIDGKPTGTLGLVLIRCNNILWMGSAENVEMTDLGLR

SEQ ID NO: 79821 - protein, 366 aa, Campylobacter lari RM2100
MSLSVGIVGLPNVGKSTTFNALTRAQNAESANYPFCTIEPNKAVVPVPDHRLKELAKIVNPQKIIRSNIEFVDIAGLVAGASKGEGLGNKFLSNIRETEMILHIVRCFDDENITHVAGSVDPVRDVQIIETELILADIEQLSKKIEKLSKGVKANEKGAKESLALANELLEHLNQNNSANSFANKNEIYQALIKELRLLSAKEVIYGANVDENSLSVDNEYVKALKEFAAKSGHEVIKLCSKIEEEMIALSEEENYEFLKSLGVESSGLEVVIRTAFSKLNLISYFTAGQIEVRSWTIQRGWKAPKAASVIHNDFEKGFIKAEVISYEDYITCKGENGAKEAGKLRLEGKDYIVQDGDVMHFRFNV

SEQ ID NO: 79822 - protein, 520 aa, Trametes sp. AH28-2
MSRFQSLLAFVVASLAAVAHAAIGPTADLTISNAEVSPDGFARQAVVVNNVTPGPLVAGNKGDRFQLNVIDNLTNHTMLKSTSIHWHGFFQKGTNWADGPAFVNQCPISSGHSFLYDFQVPDQAGTFWYHSHLSTQYCDGLRGPFVVYDPNDTHASLYDVDNDDTVITLADWYHTAAKLGPTFPLGADATLINGLGRSPSTTAADLAVINVTKGKRYRFRLVSLSCDPNHTFSIDGHDLTIIEVDSINSQPLVVDSIQIFAAQRYSFVLNADQDVGNYWIRANPSFGNVGFAGGINSAILRYDGADPVEPTTTQTTPTKPLNEVDLHPLDTMAVPGSPVAGGVDKAINMAFNFNGTNFFINGASFVPPTVPVLLQIISGAQNAQDLLPSGSVYSLPANADIEISFPATAAAPGAPHPFHLHGHAFAVVRSAGSTVYNYDNPIFRDVVSTGTPAAGDNVTIRFRTDNPGPWFLHCHIDFHLEAGFAVVMAEDIPDVASANPVPQAWSDLCPIYDALDVNDQ

SEQ ID NO: 79823 - protein, 453 aa, Micromonospora echinospora
MPFLPDPGEPSPLKVVIAGAGYVGTCLAVTLAGRGAEVVAVDSDPGTVADLRAGRCRLPEPGLAGAVRDLAATGRLTASTSYDPVGAADVVIVTVGTPTDAGHEMVTDQLVAACEQIAPRLRAGQLVILKSTVSPGTTRTLVAPLLESGGLVHERDFGLAFCPERLAEGVALAQVRTLPVVVGGCGPRSAAAAERFWRSALGVDVRQVPSAESAEVVKLATNWWIDANVAIANELARYCAVLGVDVLDVIGAANTLPKGSSMVNLLLPGVGVGGSCLTKDPWMAWRDGRDRGVPLRTVETARAVNDDMPRHTAAVIADELVKLGRDRNDTTIAVLGAAFKNDTGDVRNTPVRGVVAALRDSGFRVRIFDPLADPAEIVARFGTAPAASLDEAVSGAGCLAFLAGHRQFHELDFGALAERVDEPCLVFDGRMHLPPARIRELHRFGFAYRGIGR

SEQ ID NO: 79824 - protein, 501 aa, Trametes sp. AH28-2
MNGLRLLPSFASLAVVVSLALNTLAGIGPVTDLTISNENVSPDGFTRAAVVANGKAPGPLITGQKGDRFQINVVNKLSNHTMLKSTSIHWHGFFQKGTNWADGPAFVNQCPIATGHSFLYDFQVPDQAGTFWYHSHLSTQYCDGLRGPFVVYDPNDPNASLYDVDNDDTVITLADWYHVAAKLGPAFPPRSDATLINGLGRTSDTPNADLAVITVTTGKRYRFRLISLSCDPAYTFSIDNHDMTIIEADGVNTQQLTVDSLQIFAGQRYSFVLEANQKSGNYWVRANPLFGTTGFAGGINSAILRYDDAVPAEPTSEQGTSTKPLKETDLHPLTAMPVPGSAVSGGVDKAINFAFTFNGTNFFINGATFQPPTTPVLLQILSGAQDAKDLLPSGDVYALPSDATIELSFPASTGAPGAPHPFHLHGHTFAVVRSAGSTEYNYDNPIWRDVVSTGTPQAGDNVTIRFRTDNPGPWFLHCHIDFHLEAGFAVVMAEDIPDTKL

SEQ ID NO: 79825 - protein, 329 aa, Micromonospora echinospora
MPRSLVTGGFGFVGSHVVERLVRRGDEVVVYDLADPPPDLEHPPGAIRHVRGDVRDADGLAAAATGVDEVYHLAAVVGVDRYLSRPLDVVEINVDGTRNALRAALRAGARVVVSSTSEVYGRNPRVPWREDDDRVLGSTATDRWSYSTSKAAAEHLAFAFHRQEGLPVTVLRYFNVYGPRQRPAYVLSRTVARLLRGVPPVVYDDGRQTRCFTWIDEAAEATLLAAAHPRAVGECFNIGSSVETTVAEAVRLAGTVAGVPVAAQTADTGAGLGARYQDIPRRVPDCGKAAALLDWRARVPLVTGLRRTVEWARRNPWWTAQADDGLVVR

SEQ ID NO: 79826 - protein, 624 aa, Coccidioides immitis RS
MAALPNPPHPTDPDPLSPNISARPVSYISSHITDIQSEDGDPRPRSPPTRSYRSSSRRGPPARHSLSAASNPGNGPPPSGGSRISRTHVPSLTSHAFFRPMSSQRLQMQRSGRPPTATTQGFSSEDGQSDIANPARRSLISNSTGLPGLSGLDYEIPPPSRGTEFTDPVFLDRGTSTASPTGNTTVRSGGDSVRLLHDRSRGTAPTHLNLGNNFKQGVSQDPPQRSPLSFRSGFLKTSKGEHPERPDSRDHERLSSAASSPVSNVLKSEKPAPKGNLGKNYEYFTGNTIFFWGGRFQNARDRPVNIATGIFVILPGALFFGYSAPWLWHNLSPAIPILFAYVFFLCVSSFLHASLVNPGIYPRNLHVFPPTNPAEDPLTLGPPTNDWVMVKLATSDMAAMDVPVKYCKTCNLWRPPRCYHCRTCDNCIETLDHHCVWLNNCVGRRNYRYFFSFVSSATICALFLLGASLTHILVYQSREGITFKQSIDKWRVPFAMVLYGALAFPYPAALWCYHLFLVGRGETTREYLNSQKFKKADRHRPFTQGNFLKNWIAVLGRPRPPSYVEFKKPYVEGDQRFATQKVKHRRRDLEAQNGDLEMSRVKGAPPTFEGPSGRGPLPNTQQAS

SEQ ID NO: 79827 - protein, 345 aa, Fusarium oxysporum
MLLLPLLSAITLAVASPVALDDYVNSLEERAVGVTTTDFGNFKFYIQHGAAAYCNSEAAAGSKITCSNNGCPTVQGNGATIVTSFGSKTGIGGYVATDSARKEIVVSFRGSINIRNWLTNLDFGQEDCSLVSGCGVHSGFQRAWNEISSQATAAVASARKANPSFKVISTGHSLGGAVAVLAAANLRVGGTPVDIYTYGSPRVGNVQLSAFVSNQAGGEYRVTHADDPVPRLPPLIFGYRHTTPEFWLSGGGGDTVDYTISDVKVCEGAANLGCNGGTLGLDIAAHLHYFQATDACNAGGFSWRRYRSAESVDKRATMTDAELEKKLNSYVQMDKEYVKNNQARS

SEQ ID NO: 79828 - protein, 742 aa, Coccidioides immitis RS
MARDPMLSPSSTPTSSALDSDATAIDATVPVLTPATSISEQSTPVDTEKDGEHRAKKAKASRRVTRSSLKNGELEANGGGEAMVTRPNDESLDNTNTQEDEDCTSLLNGAEDASGSVDKWSSKNAEAAGKKPNKKAGNKSPKRRSTRLSLLAKTMDLAQSAPSVLGKRTLDAISKSKDKVKTIDRKASLRPRVENEKKEASTPAPQEPSPKKRRVSGDNKSTCQVPRQEQTATRENSLIRQKRKPWLKHGLYAGQEYIDSSVPKSKRGTRDAKNNGQQSQVFPFPMYAGARLLENGRAYKLPFDIFSPLPHGQPKPNEWRKANKNVFVGDAASIWKAAKIKEHSTCTCTPETGCDENCQNRYMFYECDDTNCKLGSELCRNRPFSALRRRAKAGGKFNIGVEVIKTEDRGYGVRSNRSFDPNQIIVEYTGEILTQEECERRMRTVYKKNECYYLMYFDQNMVIDATRGSIARFINHSCEPNCRMEKWTVAGKPRMALFAGEDGIMTGEELTYDYNFDPYSQKNVQECRCGAPTCRGVLGPRPKESWKNKDKEKKSAPAAKRKVDSALDESASRLNKKPKPSRASSLKTGIKKAVSKARTALKSTQTKGKVKRVGRPAKKAVSIKPIPVKKRRSTLTRAKMPVKSASKSAEGDEKPPRNKGRKLKMPSKPRLGNSIAAARASNKTPALMRKFLEAGDTKGGAKVVSDTIKPGRKTRAARTADVRSSPDNVPVSRKRGRAKKTS

SEQ ID NO: 79829 - protein, 573 aa, Oryza sativa Japonica Group
MATFCKVRKRDDGIYVLTLASSDGHHYLTTEAITQLKQALERIRSTKARGLVTTTTSGSFCDGINAVSDDDDDEPLSSLERGMAEVVRLLLDLPMPTAAAVRGDARWLGFVLALAHDHLFVHTEAVLGLAAAADTTAKPRRRPLPDYVVALLREKIPYAQLRKLLLLKAHVFTGEELKGNWHSVHEAIPNRDHVVAVAVQNLQSVVVGDGMDYAKVRRTMYTNSCVAVAVTTTTTTMLPFDGSSSVANGVTISSEMTPSGESFNSSYNSSTTPVDISLAAIEACTDGFSESKKVGSGAYGKVYKGVYNEEELAFKKIDGLAVLNEDQFKNELKHLMSVQHRNIVRFVGYCSQIKEKFIWRGKEYVSVQYITRILCFEYLPGGSLDKHLDKESESDGFDWRTRYNIIKVISQGLNYLHELEKPIFHLDLKPANVLLDENMEPKIADFGISKHFTGTKTHITISKPTGTPRYMPPEYLNKLVISNKYDVFSFGVMVMEIIAGPTGYDNFSEANDQDSFKYIDRVYKQWEKRITAKSHDPSAEINQVKRCINIAVKCLNQNRDDRPEIKAIVGELN

SEQ ID NO: 79830 - protein, 152 aa, Glycine max
MSTYRDEDPRLHDIKTKIRVVPNFPKPGIMFQDITTLLLDPKAFKDTIDLFVERYKGKNISVVAGIEARGFIFGSPIALAIGAKFVPLRKPKKLPGKVISQEYILEYGRDCLEMHVGAVEPGERALVVDDLIATGGTLCAAMDLLGKYLYKF

SEQ ID NO: 79831 - protein, 636 aa, Zea mays
FGTRRPLPLRRIRSDPRPPPRPRRNIIRKPSRRGERSPSHTLAPQHPQSAPACLHDLSCSCATLLECGAGARGHLMAAAAEIGGFTAAALRPVAHPAPAAAPRRAVAAQSLRTTATETLTADLAASTTNGVVHAQMYSEASSEIPSQSAIANSRRKTKIVCTIGPSTNTREMIWKLAETGMNVARLRVSHGDHQSHQKVIDLVKEYNAQNTDGNVIAIMLDTKGPEVRSGDVPEPIMLSEGQEFNFTIKRGVSTEDTVSVNYDDFINDVEAGDILLVDGGMMSLAVKSKTADTVKCEVVDGGELKSRRHLNVRGKSATLPSITEKDWEDIKFGVENGVDFYAVSFVKDAKVIHELKDYLKGVNADIHVIPKIESADSIPNLQSIIAASDGAMVARGDLGAELPIEDVPLLQAEIVQTCRNMEKPVIVATNMLESMIDHPTPTRAEVSDIAIAVREGADAIMLSGETAHGKYPLKAVKVMHTVALRTESSIYNPTTSPSVIASAQGLQNEEFSPSQLSKMFGSHATMMANTLRTPIIVFTQTGSMAVLLSHYRPSSTLFAFTNEERVKQRLALYQGVIPIHMQFSDDAEETFSRAISSLLKAQYVKKGDYVTLVQSGVTSIWREESTHNIQVKRAQV

SEQ ID NO: 79832 - protein, 390 aa, Zea mays
MIKSLYILSKVPLDRLASTSVAKQSSGGLCSWLLGGKSSELPPLDVPLPGISIPSPLPDFVEPSKTKVTTLPNGVKIASETSSSPAASVGLYIDCGSICETPASSGVSHLLERMAFKSTVNRTHLRLVREVEAIGGNVSASASREQMSYTYDALKSYTPEMVEVLIDNVRNPAFLDWEVKEQIRSFVHMANDAFGRRVAKLLGDVFHVLLLVLLKTPMSVVTKTIPRNHFLSSSTGCLSSCSKTIAVLQVVAAAPTPASAIGFEGYEKRLEISFYEAPVFADPNGRGFLFVYPYKILIKTCGTTKLLLGILRILELAKELSLPLVAAKYSRGTFIFPDAQPSPHKNFDDEVTFLNHFFDGLRFGGNAYVIGDSAKHKQKWHVYYATTEHP

SEQ ID NO: 79833 - protein, 85 aa, Xylella fastidiosa 9a5c
MRSDKPMSDIEARVRKIVAEKLNVDEEKVTNTSTFVDELGADSLDTVELVMALEDEFQCEIGDEAAEKMTSVQHAIDYIKSNAKC

SEQ ID NO: 79834 - protein, 394 aa, Bacteroides fragilis YCH46
MAEKRDYYEVLEVTKESTVEEIKKAYRKKAIQYHPDKNPGDKEAEEKFKEAAEAYDVLSNPDKRARYDQFGHAGMSGAAGNGGPFGGFSGGMSMDDIFSMFGDIFGGHSGGGFGGGFGGFGGFGGGGSQQRKFRGSDLRVKVKLNLKEISTGVEKKFKLKKYIPCSHCHGTGAEGNSGSETCPTCKGSGSVIRNQQTILGTMQTRTTCPTCNGEGKIIKDKCKVCGGEGIEYGEEVVTVKIPAGVAEGMQLSMGGKGNAGKHNGIPGDLLILVEEEPHPELIRDENDLVYNLLLSFPTAAIGGAVEIPTIDGKVKVKIEAGTQPGKVLRLRGKGLPSVNGYGTGDLLVNVSVYVPETLSKEEKSTLEKLEESKNFKPSTSIKEKIFKKFRSLFD

SEQ ID NO: 79835 - protein, 342 aa, Pseudomonas aeruginosa UCBPP-PA14
MTLPQTMKAAVVHAYGAPLRIEEVKVPLPGPGQVLVKIEASGVCHTDLHAAEGDWPVKPPLPFIPGHEGVGYVAAVGSGVTRVKEGDRVGIPWLYTACGCCEHCLTGWETLCESQQNTGYSVNGGYAEYVLADPNYVGILPKNVEFAEIAPILCAGVTVYKGLKQTNARPGQWVAISGIGGLGHVAVQYARAMGLHVAAIDIDDAKLELARKLGASLTVNARQEDPVEALQRDIGGAHGVLVTAVSNSAFGQAIGMARRGGTIALVGLPPGDFPTPIFDVVLKGLHIAGSIVGTRADLQEALDFAGEGLVKATIHPGKLDDINQILDQMRAGQIEGRIVLEM

SEQ ID NO: 79836 - protein, 217 aa, Candidatus Kuenenia stuttgartiensis
MRGLYKGRKMTFYDVTVPISNAMITWPSDPAVSITGTSLISRGDFCNLSELKIGSHCGTHIDAPSHFLENGRTIDQLALENLIGEATVFEFKHKENIDVSDIKQLRFDNVKRVLFKTVNSSYWKFSTFKKDFVYLTKDAAQYLVDKGIRLVGVDYLSVEKFESQLAETHHTLLRNDVIILEGLDLSNVERGRYELIALPLKIKDGDGSPARVVLKST

SEQ ID NO: 79837 - protein, 162 aa, Brassica napus
  misc_feature (131)..(131): Xaa can be any naturally occurring amino acid
MNTSGVQQNAFEETRRNSALLCPQPRRLDVLSHHQHLARSLRRQVSHQMELSESNSRREMLDLILAKGGGGCEQQDPFFTGSPPSRVSNPLTKDSLFRDELFVVAPPPYTPRATKPPPPSSPRSGGGGCVXVVTNFGNKPPVRVVGFNCLDRDRRSSVPTLA

SEQ ID NO: 79838 - protein, 515 aa, Lobelia erinus
MSLIFYTCIIAFLLYVLLSTLRTFLLNRNPASRKPLPPGPKPWPIVGNLPHLGTMPHQTMAALARTYGPLMHLRLGSVDVVVAASGAVAEQFLKVHDANFLNRPPNSGAVHIAYNYQDLVFAPYGPRWRLLRKVSAVHLFSAKALDDFRHVRQEEVAVLTRDLASAGNAPVHLNQLLSVCTTNALSRVMFGKRVFGGGGDSKADEFKQMVVEAMVLAGVFNIGDFIPALEWFDLQGVVGKMKKLHVRFDSFLTAILEEHKTTGSRGGGKHVDLLSTLISLKDNDLAGEGEKLSDTEIKALLLNMFIAGTDTSSSTVEWALAELIRHPKILAQAQQELDEVVGRDRLVSESDLSQLTFFQAIIKETFRLHPSTPLSLPRMAAESCEINGYFIPKGSTVLVNVWAIARDPDIWAEPLEFRPQRFLPGGEKANVDVKGNDFEVIPFGAGRRVCAGLSLGLRMVQLVTATLVHSFDWELADGQKPEELNMEEGYGLTLQRAKPLKVHPRPRLSEHVYQA

SEQ ID NO: 79839 - protein, 382 aa, Shigella flexneri
MSLKEKTQSLFANAFGYLATHTIQAPGRVNLIGEHTDYNDGFVLPCAIDYQTVISCAPRDDRKVRVMAADYENQLDEFSLNAPIVAHENYQWANYVRGVVKHLQLRNNSFGGVDMVISGNVPQGAGLSSSASLEVAVGTVLQQLYHLPLDGAQIALNGQEAENQFVGCNCGIMDQLISALGKKDHALLIDCRSLGTKAVSMPKGVAVVIINSNFKRTLVGSEYNTRREQCETGARFFQQPALRDVTIEEFNAVAHELDPIVAKRVRHILTENARTVEAASALEQGDLKRMGELMAESHASMRDDFEITVPQIDTLVEIVKAVIGDKGGVRMTGGGFGGCIVALIPEELVPAVQQAVAEQYEAKTGIKETFYVCKPSQGAGQC

SEQ ID NO: 79840 - protein, 387 aa, Yarrowia lipolytica CLIB122
MIHQASTTAPVNIATLKYWGKRDPALNLPTNNSISVTLSQDDLRTLTTASCSPDFTQDELWLNGKQEDVSGKRLVACFRELRALRHKMEDSDSSLPKLADQKLKIVSENNFPTAAGLASSAAGFAALIRAVANLYELQETPEQLSIVARQGSGSACRSLYGGYVAWEMGTESDGSDSRAVQIATADHWPEMRAAILVVSADKKDTSSTTGMQVTVHTSPLFKERVTTVVPERFAQMKKSILDRDFPTFAELTMRDSNQFHATCLDSYPPIFYLNDVSRASIRVVEAINKAAGATIAAYTFDAGPNCVIYYEDKNEELVLGALKAILGRVEGWEKHQSVDAKKIDVDERWESELANGIQRVILTKVGGDPVKTAESLINEDGSLKNSK

SEQ ID NO: 79841 - protein, 179 aa, Campylobacter lari RM2100
MMKEQDKKYLLDSIRAIKDFPKKGIIFRDITTLLNNKEAFAFLMDYLVEKYQNAKLDYIVGIESRGFIFGAALSARLKLPFVPIRKPGKLPSKCLQESYSLEYGSDTIEIHIDAFNNQKANVLLIDDLIATGGTAIAAVKLIQRLNANCVEACFLLNLKDLDGEKELSKLTSVYSVLEV

SEQ ID NO: 79842 - protein, 513 aa, Erythrobacter sp. NAP1
MTDQSRIADAWERLSALPTETLAGLFDADEDRVARLSQRLEFDLGELGEVGILLDWSKTHLNDAALDAFEELAKASQFGAARDALFDGGIVNPTEGRPATHGAMRGSGRESDVEEAEALLARMGMLVEAIHQGTLGEIKHLIHIGIGGSALGPDLAVDALTRDLKLVDVHVVSNIDGLALEQAFAACDPATTLIAVASKTFTTTETMTNASSALKWLADNGVSDPSGRVVALTANPEKAVQWGVDETRILPFPESVGGRYSLWSSIGFPVALAVGMDDFSAMLAGAQAMDAHFRESEGRANGPLLAAFGDLYYTRVRGCQTRAVFAYDERLALFPDYLQQLEMESNGKSVTADGKPVNGPTAPITWGGVGTDAQHAVFQLLHQGTHLVPVDFIASIAPGDELDPAHHSSLLMNCLAQGAALMAGKTSDDPARNYPGDRPSAMFLVDDLDAATLGALIAFHEHRTFANAVLMGINPFDQFGVELGKAMAKAIDSGEGEFDASTKALMQAAGLGG

SEQ ID NO: 79843 - protein, 459 aa, Trametes sp. AH28-2
AIGPKANLVITDAAIAPDGFLRDAIVTNGVFPGPLIKGNKGDRFQLNVIDNLSNHTMLKSTSIHWHGFFQAGTNWADGPAFVNQCPIASGHSFLYDFHVPDQAGTFWYHSHLSTQYCDGLRGPFVVYDPKDPHASRYDVDNGQSSTVITLSDWYHTAARLRPRFPLGADSTLINGLGRSSSTPTADLAVINVQRGKRYRFRLVSLSCDPNHTFSIDGHNLTVIEVDGINSKPLTVDSIQIFAAQRYSFVLNANQPVGNYWVRANPNFGTTGFAGGINSAILRYQGAPNVEPTTTQTPSDIPLIETNLHPLSKMTPGKATIGGVDKALNLGFTFNGTNFFINDATFTPPTVPVLLQILSGAQTAQDLLPAGSVYPLPAHSSIEITLPASAAAPGFPHPFHLHGHAFAVVRSAGSPAYNYADPIWRDVVSTGVPGDNVTIRFRTDNPGPWFLHCHIDFHLE

SEQ ID NO: 79844 - protein, 308 aa, Rhodospirillum rubrum ATCC 11170
MVMFRGHLLCFGLGYSALRLARGLLRDGWRVSGTCRSEEKRQALSAQGITAFVFDETTPLPAEAWTGVTHVLVSIPPGPDGDPVLALHRADLLALRPEWLGYFSTTGVYGDTGGAWVDEGKPVRPTQERSKRRVAAEEDWLDLWRDEDLPVHLLRLAGIYGPGRSVFDQLRAGTAKRIIRPGHAFSRIHVDDIGLITRASMADPDPGAIYNLVDDEPAEPSEVMDHACALLGIDPPPAQSFDEVAPGLSPMALSFWADNRKVSNERLWDDLRLRLLYPTFRQGLEAILAEETGRVAEGPPVYKEASDC

SEQ ID NO: 79845 - protein, 514 aa, Trametes sp. 420
MSKFQSLVAFVALCLSHSRLVAGAIGPVADLTISNANISPDGFTRSAVVMNNQFPGPLVTGNKGANFQINVIDNLTNDTMLTATTIHWHGFFQKGTNWADGGAFVNQCPISKGNSFLYDFSAPDQAGTFWYHSHLSTQYCDGLRGPMVVYDPSDPHKSLYDVDDDSTIITLADWSHTAARLGPRFPFGGDSTLINGLGRFAGATTTADLAVITVTKGKRYRFRLVSLSCDPNFTFQIQGHSLSVIEADAVNVNPVTADSIQIFAGQRYSFVLNADQDVGNYWLWAVPNIGTVSVSGGVNSAILRYDGADPVEPDAADPSSSNLLQETSLVPLTDVAAPGTAVVGGVDYALNLDFSFDGTDFFVNGATFTSPTVPILLQIMSGAQSAADLLPSGSVFALPANSVVELSFPITATNAPGAPHPFHLHGHTFYVVRSAGSTDYNYVNPPQRDVVSTGTAGDNVTIRFRTDNPGPWFLHCHIDFHLEAGFAVVFAEDVPNVASANTPSCTSCSVSHVR

SEQ ID NO: 79846 - protein, 519 aa, Trametes sp. 420
MLQLTSFRRLSLFLFTALATRTFAAIGPVTDLNIVNANISPDGFARDAVLAEGTFPGPLITGQKNDNFRINVVDKLTNTTMLTATSIHWHGFFQHGTNWADGVPFLNQCPIVSGNSFLYNFNVPDQAGTFWYHSHLNTQYCDGLRGALVVYDPADPHASLYDVDEESTVITLADWYHVAAPLAGAVPRSDATLINGLGRWSGDPTSELAAINVTPGKRYRFRLVSMSCDPNYTFQIDGHSMTVIEADGQNTEPLPVDQIQIFAGQRYSFVLEANQTVGNYWIRASPNLVADGGSGFANGINSAILRCDGAPEEEPTTTQDTSINPLREFDLHPLTDPAAPGNPTEGDVGVPINLAIGFSGGNFTVNGTTFESPSVPVLLQILSGAQNAQDLLPSGSVYSLPSNATVELSIPAFAIGGPHPFHLHGHAFSVVRSAGQTEPNYVNPVRRDVVSIGSGTDNVTIRFRTDNPGPWFLHCHIDWHLQAGLAIVFAEDIPETAATNPVPQAWSDLCPEYEASLNA

SEQ ID NO: 79847 - protein, 428 aa, Burkholderia vietnamiensis G4
MNDNNSLDSAQTRPHRGSWLRRLGPGLVTGAADDDPSGIGTYSQAGAQFGLELLWSLLLTYPLMTAIQLVSARIGRVTGKGLASNMRAHYPPWLLYATVVLLIVANVINIAADLAAMGAAVNLLLHGPQELYVVFLGALSALLQIFVPYDRYARLLKWTALALLAYVAVALIVPVDWGEVGRALVRPRFQLTAAYLTTVVAVLGTTISPYLFFWQASQEVEELRAKPNQKSLRRAPHQAPAQLQRINFDTWVGMGVSNVIAFFITLTAAATLNRHHIAVKTSADAARALEPIAGHFAYILFALGIIGTGLLALPVLAGSAAYAAAGTFRWRNSLALKVGVAPEFYAVIALAIIGGVAITFMHFDPIRALYWSAVINGVTAVPIMIVMMLMARSRRIMGEFAVRGVLAWGGWIATAAMAIAATGVFVPG

SEQ ID NO: 79848 - protein, 394 aa, Deinococcus radiodurans R1
MKLLVVGGAGYIGSHTVRQLRAAGHEVAVFDNLSSGHAEALPGEVELIRGDLLDAASIRAALEAQKPDAIIHFAALIEVGESMRAPGRYYRNNVVGTLNLLQSIVETRKVPLVFSSTAAVYGTTDAVPIPEDAAMQPESVYGETKRMSEQMIHAFHVAHGLPYTVLRYFNVCGAAPGGDIGEAHPNKTHLIELACLTALGQREKMMIFGDDYPTPDGTCIRDYVHVQDLADAHVLAVEALHAGKTDAATYNVGLGHGFSVREVLDAVDAVVGTPLQRELAPRRAGDPPRLVADASRIVDQLGFAPKFTDLRDIVQTAWDWHRTHPQGLGSNNKDPSPLPLAGPLLRSFTSLPLVEGQTAQHKQRTEISPPFLLPLLYSSSSTTALPRVASRRAA

SEQ ID NO: 79849 - protein, 519 aa, Trametes sp. 420
MLQLTSFRRLSLLLVTALATRSFAAIGPVTDLNIVNANISPDGFARDAVLADGTFPGPLITGQKNDNFQINVVDKLTNTTMLTATSIHWHGFFQHGTNWADGVPFLNQCPIVSGNSFLYNFNVPDQAGTFWYHSHLNTQYCDGLRGALVVYDPADPHAGLYDVDDESTVITLADWYHVAAPLAGAVPRSDATLINGLGRWSGDPTSELAVINVTPGKRYRFRLVSMSCDPNYTFQIDGHSMTVIEADGQNTEPLPVDQIQIFAGQRYSFVLEANQTVGNYWIRASPNLVADGGSGFAHGINSAILRYDGAPEEEPTTTQDTSINPLREFDLHPLTDPAAPGNPTEGDVEVPINLAIGFSGGNFTVNGTTFESPSVPVLLQILSGAQNAQDLLPSGSVYSLPSNATVELSIPAFAIGGPHPFHLHGHAFSVVRSAGQTEPNYVNPVRRDVVSIGSGTDNVTIRFRTDNPGPWFLHCHIDWHLQAGLAIVFAEDIPETAATNPVPQAWSDLCPEYEASLNA

SEQ ID NO: 79850 - protein, 189 aa, Triticum aestivum
MPTLHGPLLFVNPGAYQEPKSFPKSTASPFNNLLGCNTVCSSVEGHHVQKPHIVSSFRVNFTRVSHYLQRSLNERTTRHWLHRFHVNASSDEDFRSSRNIATSLFKQYDNVIDRGGGDNIKGFVSAGVQAYALCCTEEGLTKELMDIEKSGGKIERLQSYGRTSLSFKVTSFEVNECILWLIIEFIIIL

SEQ ID NO: 79851 - protein, 563 aa, Trametes sp. 420
MGKLQSFTALVVLLFSSANRAVAAIGPVADLTISNADVSPDGFTRAAVVMNGQTPGPLITGNKGDDFQINVIDSLDNDTMLTPTTIHWHGFFQKGTNWADGAAFVNQCPISTGNSFLYDFTATDQAGTFWYHSHLSTQYCDGLRGPLVVYDPDDPHASLYDVDDDTTVLTVSDWYHTAARLGTQFPTADSTLINGLGRFAGGDADSALAVVNVTQGQRYRFRLLSLSCDPNHIFTIQGHNFTVIEVDGVNVEPVTVDSIQIYAGQRYSFVLTADQDVDNYWIQAVPNTGTVATTGGVNSAILRYSGAEEIEPDAADQSSTNLLAETDLVPLENLAAPGDASEGGVDYALSLDFDFVLRNGTAFFINGDSFTPPSVPVLLQIMSGTQSAADLLPSGSVYTLPSNATVEISFPMTSTNAPGAPHPFHLHGHTFYVVRSAGSSDYNYVNPPQRDTVSAGTAGDNVTIRFTTNNPGPWFLHCHIDYHLEAGFAIVLSEDTEEAASLNTASCKCRRGCWFNFHGSVLMLLYRSCLGRPVPRLQRCLPRRHLSIINCGTRRDAEGYTPL

SEQ ID NO: 79852 - protein, 345 aa, Micromonospora echinospora
MQRQRPPSRAGGDMDRLQSALALYEEAMGYTYAAALRAAAAVGVADHLVDGPRTPAELAAATGTDADALRRVLRLLAVRDVVRESDGRFALTDKGAALRSDSPVPARAGILMFTDTMFWTMSHRVASALGPERPAFADIFGSSLDAYFDGDAEVEALYYEGMETVSAAEHLILARAGDFPATGTVADVGGGRGGFLLTVLREHPGLQGVLLDRAEVVARHRLDAPDVAGRWKVVEGDFLREVPHADVHVLKRILHNWGDEDSVRILTNCRRVMPAHGRVLVIDAVVPEGNDAHQSKEMDFMMLAARTGQERTAAELEPLFTAAGLRLDRVVGTSSVMSIAVGVPA

SEQ ID NO: 79853 - protein, 269 aa, Brassica napus
  misc_feature (48)..(48): Xaa can be any naturally occurring amino acid
  misc_feature (60)..(60): Xaa can be any naturally occurring amino acid
MASVASSTTLISSSASVLPATKSSLLPSPSLSFLPTLSSPSPSASLRXSLVPLPSPQSAXSSRRSFAVKAQTDDLPLVGNKAPDFEAEAVFDQEFIKVKLSEYIGKKYVILFFYPLDFTFVCPTEITAFSDRYAEFEKLNTEVLGVSVDSVFSHLAWVQTDRKSGGLGDLNYPLISDVTKSISKSFGVLIHDQGIALRGLFIIDKEGVIQHSTINNLGIGRSVDETMRTLQALQYIQENPDEVCPAGWKPGEKSMKPDPKLSKEYFSAI

SEQ ID NO: 79854 - protein, 338 aa, Oryza sativa
  misc_feature (302)..(302): Xaa can be any naturally occurring amino acid
MGKIKIGINGFGRIGRLVARVALQSEDVELVAVNDPFITTEYMTYMFKYDTVHGQWKHHEVKVKDSKTLIFGTKEVAVFGCRNPEEIPWAAAGAEYVVESTGVFTDKDKAAAHLKGGAKKVVISAPSKDAPMFVVGVNEKEYKSDVNIVSNASCTTNCLAPLAKVINDRFGIVEGLMTTVHAITATQKTVDGPSMKDWRGGRAASFNIIPSSTGAAKAVGKVLPALNGKLTGMAFRVPTVDVSVVDLTVRLEKPASYDQIKAAIKEEAEGKLKGILGYVEEDLVSTDFQGDSRSSIFDAQGXAIALSDTFVKLVSWYDNEWGYSTRVIDLIRHMHSTN

SEQ ID NO: 79855 - protein, 415 aa, Sulfolobus solfataricus P2
MGIFLIKVGDLTIPTMDDIDIQSKKVLLRIDINSPVDENGKIIDDSRIKAHIGTIKELINKGNSVVLISHQGRPGDKDFTSLEEHAKLISKYLDREVIFVDDVIGPYAREMIKKLENNGILLLDNIRLISEELIEAPPQQHVKSFLVKKLAPLFDIYINDAFATAHRSQPSIVGFPLALPSAAGRVMEREVSALAKIFNAEDTPKIFTLGGGKVHDTIRIIENLVRKRIADRILTGGLVAELFSVAKGMNLNPKNMEILEKLGILSLIPRARKLLLSGAPIEIPVDYKVEINGNVIEEPASKVTGIIKDIGSTTAEIYSSFIKDAKVVVLRGPMGVIEDERFKSGSKSVLKASLEGQGYVIIGGGHMISALDEDMKIDSSKVHISTGGGALLLFLSGERLPALEALSMSVVNSGD

SEQ ID NO: 79856 - protein, 216 aa, Arabidopsis thaliana
MSEEAYEETQESSQSPRPVPKLNERILSTLSRRSVAAHPWHDLEIGPEAPLVFNVVVEITKGSKVKYELDKKTGLIKVDRILYSSVVYPHNYGFIPRTLCEDNDPLDVLVLMQEPVLPGCFLRARAIGLMPMIDQGEKDDKIIAVCADDPEYKHFTDIKQLAPHRLQEIRRFFEDYKKNENKKVAVNDFLPSESAHEAIQYSMDLYAEYILHTLRR

SEQ ID NO: 79857 - protein, 460 aa, Parvularcula bermudensis HTCC2503
MTENDTDQSPKTTPTFSELGLDTKILEALTESGYTHPTPIQADAIPEALRGRDVLGIAQTGTGKTASFVLPVIHRLARGRARARMPRSLILAPTRELAAQVSEQFEKYGKNHKLSMALLIGGVSFADQDAKLTRGVDVLIATPGRLLDHHERGKLLLTGLEVMVVDEADRMLDMGFIPDLERIFKLTPFTRQTLFFSATMPPEIQRLTDQFLSAPARIEVAKPATTAKTITQRIARLPSGEDKLKRAALRHLVETAENLKNGIIFCNRKKNVDVIAKSLQEHGFDARPIHGDLPQSFRTETLQMFRDGGLKLLVASDVAARGLDIPDVSHVFNFSVPINADDYVHRIGRTGRAGRLGHAVMLVTPDDGKAFDAVLKVTGLDKIEEHDISALLDDWNGAARPPEKGRNNRRGGPNKKEASSSRPTSNKGRDRRDDRHDDGPADPVVGFGDHTPDFLLKEMS

SEQ ID NO: 79858 - protein, 502 aa, Nicotiana tabacum
MEHSLMSTGSYFLLFSSSAFLLILLSFSVEKSHALETRETIESHFHTLQLSSLLPSSSCNPATKGKRRGASLEVVNRQGPCTLLNQKGAKAPTLTEILAHDQARVDSIQARITDQSYDLFKKKDKKSSNKKKSVKDSKANLPAQSGLPLGTGNYIVNVGLGTPKKDLSLIFDTGSDLTWTQCQPCVKSCYAQQQPIFDPSTSKTYSNISCTSAACSSLKSATGNSPGCSSSNCVYGIQYGDSSFTIGFFAKDKLTLTQNDVFDGFMFGCGQNNKGLFGKTAGLIGLGRDPLSIVQQTAQKFGKYFSYCLPTSRGSNGHLTFGNGNGVKASKAVKNGITFTPFASSQGTAYYFIDVLGISVGGKALSISPMLFQNAGTIIDSGTVITRLPSTAYGSLKSAFKQFMSKYPTAPALSLLDTCYDLSNYTSISIPKISFNFNGNANVELDPNGILITNGASQVCLAFAGNGDDDSIGIFGNIQQQTLEVVYDVAGGQLGFGYKGCS

SEQ ID NO: 79859 - protein, 287 aa, Dichelobacter nodosus VCS1703A
MFVEPTYRLQNGIEIPRLGLGTWCIEQKNAAKAVQHALDLGYRHIDTAQAYENEAGVGAGIKNSGIPRENIFVTSKVAAELKSYDDAARSIDETLSQMGLDYLDLMLIHSPQPWDEWRHPEKRYIAENKAVWQALEAAYQAGKLKAIGVSNFLISDLEFLFETCHIRPMVNQILLHIGNTPFELLEFCQRHQIVVEAYSPIAHGEAGKSAAIVAMAEKYQVSVAQLCIRYAWQLNTVVLPKAENPAHMKNNRELDFTISADDMAALKAIRFTDYGTFSHFKVFSGCF

SEQ ID NO: 79860 - protein, 199 aa, Nannochloropsis gaditana
AGGIAEMSQQPEFVRESTDRLDAAGNVTKAITKGYSIGSASLACFLLFGAFMDEFSQFSGKPFRVVDIAVPEVLIGGIIGTMMVFYFVGLTVAAVGKTAGEVVKEVRRQFRDNPEIMTFKARPDYRSCVALVTHAALKEMVWPGLLATGLPIVVGVVFRGVGAITDRSLLGAEVPGRGYLMFGTVTGDTCMAATTRTMS

SEQ ID NO: 79861 - protein, 206 aa, Brassica napus
MQLKLMGTEIPTSPEISEALLLPEPNKTAATVILDQDEHVPEWKEQITIRGLVVSALLGTLFCIITHKLNLTVGIIPSLNVAAGLLGFFFVKSWTGFLSKLGFTVKPFTKQENTVIQTCVVACYGLAFSGGFGSYLIAMDEKTYKLIGADYPGNHAEDVINPGLWWMIGFLFVVSFLGLFSLVPLRKVMGLDYKLTYPSGTATAML

SEQ ID NO: 79862 - protein, 484 aa, Erythrobacter sp. NAP1
MTQFSDLGLSQPVLQALDLKGYSTPTPIQEQAIPPVLEGRDLLGIAQTGTGKTAAFMLPSIDRLREADNRIPFKSCRMLVLAPTRELVSQIAASAKDYGALAGLKVQSIVGGTSVNKDRNKLHRGTDILIATPGRLLDLIDQKAFNLGSVEVLVLDEADQMLDLGFVHALRRISQLVPKERQTLFFSATMPKAIKELVSGYCNNPVQVSVTPESTTAERIDQYLFMVQQDEKQSLLELILSGRHKVPGEFERILIFTRTKHGADRVVKKLSRAGIPANAIHGNKSQPQRQRALDEFRRGKTMILVATDVAARGIDIPGVSHVLNYELPNVPEQYVHRIGRTARAGKDGVAIAFCAEDERAYLKDIRKTTGAELDRLNLPENFRAVVEGVGPTKPAPRGATRVSAKKIKPKPAGASAGKPAGDGSSKPKKPGGKHPSRKGRPSGRPGGGNPNGNSRRSGGPGRRGRRGKGGSPGGGGGHARSANG

SEQ ID NO: 79863 - protein, 138 aa, Triticum aestivum
MKELEPESPVSQCDFDRLKLSTAPFMERNLEFMIGCMDGLSSEQNKFQYYYRNLGRQQSQQQAWLQKRRQENMSRKAAGEEPLPEEDPSNPIFKPLPEPSRLEGYLVTNQISSYCNHINGVAGQSFNRLYLMKALQED

SEQ ID NO: 79864 - protein, 263 aa, Dichelobacter nodosus VCS1703A
MNILLKGAAALEKMRVAGQLAADVLDMITPHVQVGITTAQLDELCQQYITQRGAVSACLGYGNPPFPKATCISVNHVICHGIPSDKKLKNGDIVNIDVTVIVDGYHGDSSRMYVAGTAGVLAQRLIEVTYDCLWAGISVVKPGARLGDIGHAIQTIAEKERFSVVREFCGHGIGVGFHEDPQILHYGKPDHGIVLEEGMTFTIEPMINAGRAALKILPDGWTAVTRDRSLSAQWEHMLAVTKTGYEVFTLSAKERASGRKACG

SEQ ID NO: 79865 - protein, 451 aa, Erythrobacter sp. NAP1
MADQDYDFDLFTIGIGSGGTRASRVAAAHGARVAAAEEHRVGGTCVIRGCVPKKMLVYGAQFAEDLEDATHFGWTIEGKSFDWIKLRDHVMKDVSRIESVYTDTLDKHDVTIFHERAEITGDHEITLASGKVVTAKYILIATGAWPHVPEFEGSEHCITSNEAFHLDEIPKRVLIAGGGYIANEFAGIFNEFGCKVVVANRSDVILRQYDFALRDRLMQISMTKGIEFCFHAEFEYVKKNEDGTFAVKMTNHEEREFDLVMVATGRVPNTSGLGLENVGVELGDKGEIKVDEYSKTNVDYIYAVGDVTDRVQLTPVAIREGQAFADSVFGPGEPYSVDHSCIPSAVFSHPPICSVGLNEREAKDQYGKVAVYTSDFRPMKNVVANRNERSLVKMICDDANGKILGIHMIGPDSPEIMQAAAVAVKAGMTKADFDATTAIHPTVAEELVLLR

SEQ ID NO: 79866 - protein, 330 aa, Synechococcus sp. WH 8102
MTATETAAYRFSVAPMLDCTDRHFRVLMRQISRHALLYSEMVVAQALHHSNRRDKLLDFDAVEHPIALQVGGDDPALLADAARLASDWNYDEINLNIGCPSQKVQAGNFGACLMAEPDLVARCVEAMSNATSLPVTVKHRIGIDDLDSDDLLTAFVDRVASAGASRFSVHARKAWLDGLDPKQNRTIPPLQHDRVQALKQRRPHLTIELNGGLESPEDCIEALRTCDGAMVGRAAYSHPLRWAAMDHLVFGKPPRDLLASDVVTGLLPHAAAHLSSGGRLWDLCRHLVQLVEGVRGARHWRRELGDRAQRPGADLTVLEEAGRQLREAGL

SEQ ID NO: 79867 - protein, 438 aa, Zea mays
  misc_feature (11)..(11): Xaa can be any naturally occurring amino acid
MATHAALAASXPASSRHGVQRLDFADFSGLRPGSCSVSAAAREASFSDVLGAQLVAKATGENAVRAPAEAKLKVAINGFGRIGRNFLRCWHGREDSPIDVVVVNDSGGVRNASHLLKYDSMLGTFKADVKIVDDTTISVDGKPITVVSSRDPLKLPWGELGIDIVIEGTGVFVDGPGAGKHIQAGAKKVIITAPAKGADIPTYVVGVNEGDYDHSVADIISNASCTTNCLAPFVKILDEEFGIVKGTMTTTHSYTGDQRLLDASHRDLRRARAAALNIVPTSTGAAKAVALVLPQLKGKLNGIALRVPTPNVSVVDLVINTVKTGITADDVNAAFRKAAAGPLQGILDVCDVPLVSVDFRCSDVSCTIDASLSMVMGDDMVKVVAWYDNEWGYSQRVVDLAHLVAAKWPGAAAAGSGDPLEDFCKDNPETDECKVYEA

SEQ ID NO: 79868 - protein, 382 aa, Escherichia coli
MSLKEKTQSLFANAFGYPATHTIQAPGRVNLIGEHTDYNDGFVLPCAIDYQTVISCAPRDDRKVRVMAADYENQLDEFSLDAPIVAHENYQWANYVRGVVKHLQLRNNSFGGVDMVISGNVPQGAGLSSSASLEVAVGTVLQQLYHLPLDGAQIALNGQEAENQFVGCNCGIMDQLISALGKKDHALLIDCRSLGTKAVSMPKGVAVVIINSNFKRTLVGSEYNTRREQCETGARFFQQPALRDVTIEEFNAVAHELDPIVAKRVRHILTENARTVEAASALEQGDLKRMGELMAESHASMRDDFEITVPQIDTLVEIVKAVIGEKGGVRMTGGGFGGCIVALIPEELVPAVQQAVAEQYEAKTGIKETFYVCKPSQGAGQC

SEQ ID NO: 79869 - protein, 510 aa, Erythrobacter sp. NAP1
MSANIAEMERRREAARMGGGQKRIDAQHAKGKLTARERLDVLLDEGSFEEIDTYVEHDCVDFGMEKQKIPGDGVVTGSGTINGRLVYVFSQDFTVFGGSLSKRHAEKICKVMDTAMKVGAPVIGLNDSGGARIQEGVASLGGYAEVFQRNVLASGVIPQISLIMGPCAGGAVYSPAMTDFIFMVKDSSYMFVTGPDVVKTVTNEVVTQEELGGAITHTTKTSVADVAYENDVETLLATRDFFNYLPLSNREEVPELPTNDPWDREEPSLDTIIPDNANQPYDMHEVIRKTLDEGDFFEIQPAHAANIICGFGRVEGRTVGVVANQPMVLAGVLDIASSKKAARFVRFCDAFEIPIVTFVDVPGFLPGTAQELGGIIKHGAKLLFAYAEATVPKITVITRKAYGGAYDVMASKHLRGDLNYAWPTAEIAVMGAKGAVEIIFRQDRDDPEKIAEKTAEYEERFANPFVAASRGYIDEVIHPHATRRRVALGLRKLRTKQLENPWKKHDNIPL

SEQ ID NO: 79870 - protein, 500 aa, Bradyrhizobium sp. BTAi1
MRGGANVSSGFIEAHGLWSDEQKAAAGEALAAVKETGLRCIRVSVADPQGKLRSKTLMPGPFHAALKNGIEFTNAQYGFDSAEGIAYNPFVDGGGFGMAEMAGFANVILVPDPTTFRVLPWSPGTGWVLGDLYFRDGRPVPFDARHKLKAALAELAREKYTFITGLEIEFYVTKVIDPKLAPEDMGTLGLPPTPPVVEAAARGFSYQVEDNLDRMDDFICTLADHCVALNLPLRTMENEMGPGQLEFTFDVQTGLKTADTMSLFRSMVKQVATRMGLHATFMTRPGLPNYVASGWHLHQSLATADGRNAFVSEPGSGELLSEVGRRFVGGLLEHAAAASVFTTPTVNGYRRRKPNSLAPDRATWGYDNRAAMIRVQGMPGEPSAHIENRIGEPGANPYLYIASQALAGLDGLRRKLDPGPLETSPYTATHRPLLPTNLMEALEALKGSSYFRAQLGDVFVDWLLGMKQSEVNRFLAAEPDWQATPDDVTAWEHREYFTRY

SEQ ID NO: 79871 - protein, 471 aa, Herminiimonas arsenicoxydans
MPTTTPSTTPNSSRWQAYLRDCRTLLDIAEPMLVSGRITRVAGLVMEAVGLKLAVGSACTIPLANGARIEAEVVGFEDDRLFLMPQSDVEGIVPGTRVFPVEVVQSLPKPGAVSHPRRRPSDRTRHLPVGMELLGRVLDGAGRPLDSLGPLHATHSGPLNVRAANPLTRAPITDVLDVGVRAINSMLTVGRGQRMGLFAGSGVGKSVLLGMMARYTTADVIVVGLIGERGREVKEFIEQILGPEGLARSVVVAAPADTPPLMRLQGAAYTTAIAEHFRDEGKDVLLIMDSLTRYAMAQREIALAIGEPPATKGYPPSVFAKLPALVERAGNGKEGGGSITAFYTVLTEGDDQQDPIADAARAILDGHIVLNRSLAEAGHYPAIDIEQSISRAMHNITTPEHQKQTRKLKQLTSRYQRNRDLISVGAYSAGSDPVLDEAIALNTKIESFLQQDITERSGINESLGQLASLFE

SEQ ID NO: 79872 - protein, 411 aa, Oryza sativa Japonica Group
MNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGIAGQRFVIQGFGNVGSWAAQLISEAGGKVIAISDVTGAVKNSNGLDIAKLMKHSSENRGIKGFDGGDAIDPRSLLTEECDVLIPAALGGVINKDNANEIKAKYIIEAANHPTDPEADEILSKKGVLILPDILANSGGVTVSYFEWVQNIQGFMWDEEKVNNELKTYMTRGFRDVKEMCRSHHCDLRMGAFTLGVNRVARATVLRGWEA

SEQ ID NO: 79873 - protein, 395 aa, Cryptococcus neoformans var. neoformans B-3501A
MVYEATASAPVNIACIKYWGKRDTRLILPTNSSLSVTLDQDHLRSTTTSRADASFEAGDKLWLNGKEEVIKEGGRLAVCIKELRRWRKEMESKDKDLPKLSEWPLRIASYNNFPTAAGLASSASGLAALVASLASLYSLPQSPSQLSLVARQGSGSACRSLFGGFVAWREGTDPAGSDSLAEEVAPREHWPEMHALICVVSDAKKGTSSTSGMQKTVETSTLLQERLRIVPKRMDAISQAIKARDFSEFAKLTMADSNSFHAVCLDTAPPIFYLNDVSRAIIAVVEELNRAAGEIIAAYTFDAGPNAVIYTLEKNMPVVLGAIKRFFPTGEEFEDPFQTGVRDLPEGFNTGVVREGGWEKGAVKGLIHTRVGDGPRVLKNEESLLGENGVPKVLA

SEQ ID NO: 79874 - protein, 428 aa, Arabidopsis thaliana
MMTSRSIVPQQSTDDVVVVDGKNVAKGRNRQVLGDIGNVVRGNYPKNNEPEKINHRPRTRSQNPTLLVEDNLKKPVVKRNAVPKPKKVAGKPKVVDVIEISSDSDEELGLVAAREKKATKKKATTYTSVLTARSKAACGLEKKQKEKIVDIDSADVENDLAAVEYVEDIYSFYKSVESEWRPRDYMASQPDINEKMRLILVEWLIDVHVRFELNPETFYLTVNILDRFLSVKPVPRKELQLVGLSALLMSAKYEEIWPPQVEDLVDIADHAYSHKQILVMEKTILSTLEWYLTVPTHYVFLARFIKASIADEKMENMVHYLAELGVMHYDTMIMFSPSMVAASAIYAARSSLRQVPIWTSTLKHHTGYSETQLMDCAKLLAYQQWKQQEEGSESSTKGALRKKYSKDERFAVALIPPAKALLTGTESA

SEQ ID NO: 79875 - protein, 487 aa, Arabidopsis thaliana
MHTLPNKELEVTEPGEQKLGSSLNTLLEDSLIFFAELGCQKLNVFLNVSDESLLVISWLLLKSEGVDNVNNLLSRVINTFILTTFFSRWIGTNVNIYSSHSNPLSFYFPEDSILNLLVRERVRQKLITGEKILVHQHGRLLIVFSLRWMRINENRRLRERDAATRRFSRIAKDVTELIGNTPLVYLNNVAEGCVGRVAAKLEMMEPCSSVKDRIGFSMISDAEKKGLIKPGESVLIEPTSGNTGVGLAFTAAAKGYKLIITMPASMSTERRIILLAFGVELVLTDPAKGMKGAIAKAEEILAKTPNGYMLQQFENPANPKIHYETTGPEIWKGTGGKIDGFVSGIGTGGTITGAGKYLKEQNANVKLYGVEPVESAILSGGKPGPHKIQGIGAGFIPSVLNVDLIDEVVQVSSDESIDMARQLALKEGLLVGISSGAAAAAAIKLAQRPENAGKLFVAIFPSFGERYLSTVLFDATRKEAEAMTFEA

SEQ ID NO: 79876 - protein, 581 aa, Kluyveromyces lactis NRRL Y-1140
MSFNASRRSVVYSTQGVVASTQPLASAAGIRILELGGNSVDASIAVASVLAVVEPASTGVGGDCFMLHYDESKKKVVGLNGTGRSPKALDIDHIRSLGIEDVRIPLTSIHSVTVPGTIAGWIDAIEKYGSGRVGLDAILAPAIKLCKEGHIISEISAYLTGKCWEDLERLNGNDLLKYWAPIDAPLEPPNTGSLVQNRKLAELLQLVADNGKDGFYKGVVAESIIEEMKTRGGLMDMDDLAAHKSDFVDPIYLDFLEHKIWEIPPNSQGLVVLLALGIIRELDNQKLINLHSMQRNSVEYLHMLIECLKLAFYDSDEYVSDPNCQEADILHRLLSKDYLKSRAKLFSPSGIIDSSVIKHGVPNEDFNQSDTVYFTVSDPYGNVTSFINSLYDGFGSCIVPRTFGGFALQNRGANFNLTPGTKNSLEPSKRPYHTIIPSIITSNDESTVYGMGNMGGFMQPSGHVQHFLNLILFGLNPQESLDSPRCCLSPHPKYSHLDRGRGSSGPVNTPVSLIQLEEDIPEDVFDGLVKLGHEVEYVRGLSRSIFGRGQIIKRTKNNETNTWLYAAGSDKRGDGAAVPLI

SEQ ID NO: 79877 - protein, 471 aa, Arabidopsis thaliana
MAMEKDLSPNSPRIRKLRDTSYPTTPTSRMNTNNQRDNHYPNIPNSPRDYNYTPSSPTARIRHRRRSSENLAEVNRSNVSRVSNLLLGDKNKYRSMWIRTCSSLWMLGGVVFIIYMGHLYIWAMVVVIQIFMAKELFFLRRRAHEERRLPGFWLLNWHFFFTAMLFVYGRIIQQQLVNTVSSDRFIYKLVSGLIKYQMVICYFLYIAGLIWFILTLKNKMYKYQFGQYAWTHMILIVVFTQSSFTVANIFEGIFWFLLPAALIAMNDVAAYFFGFYFGKTPLIKLSPKKTWEGFIGASVATIISAFIFANVLGQFQWLTCPRKDFSTGWLHCDPGPLFRPEYYPFPSWITPFSPWKGISTLPVQWHAFSLGLFASIMAPFGGFFASGFKRAFKIKDFGDSIPGHGGFTDRMDCQMVMAVFAYIYIQSFIVNRDYSVEMILDQISRSLGHEEQKMLYEKLGDILQHKLQGRF

SEQ ID NO: 79878 - protein, 278 aa, Podophyllum peltatum
MGSTSTPDSSTNRLQDKVAIITGGAGGIGETTAKLFVRYGAKVVIADIADDHGQKVCNNIGSPDVISFVHCDVTKDEDVRNLVDTTIAKHGKLDIMFGNVGVLSTTPYSILEAGNEDFKRVMDINVYGAFLVAKHAARVMIPAKKGSIVFTASISSFTAGEGVSHVYTATKHAVLGLTTSLCTELGEYGIRVNCVSPYIVASPLLTDVFGVDSSRVEELAHQAANLKGTLLRAEDVADAVAYLAGDESKYVSGLNLVIDGGYTRTNPAFPTALKHGLA

SEQ ID NO: 79879 - protein, 376 aa, Parvularcula bermudensis HTCC2503
MAVTQKARDLQAAGRDVLTLSMGELDFETPAPVKEAAIAAIAAGETRYTAVDGTPALKAAITEKYRRDHDFLLSPEEIVATTGGKFLIYAALRATLEPGDEVIIPSPYWVSYPGIVRMCGAVPVILATQAGQGFLPDPQTLKATMTPKTRWILLNFPNNPSGATLPLEHAAALAEVIEAHPRALVLSDDIYELIRFDASPPGPLFAKMKGMRERTLTVNGVSKSHAMTGWRLGFGAGPAPLMAAIRRVAGQTTSNPCSISQAAAVAALGMEPSFLTDWRTALRTRRDLVVRTLNRIEGISCLSPSGAFYVFPDINGVVKRKGLADDTAFCTALLDEEALALVPGSAFGAPGFVRLSFAAADSVLEEAMGRLKRFCA

SEQ ID NO: 79880 - protein, 166 aa, Cyanidioschyzon merolae
MKHTLSVLVEDEAGVLTRIAGLFARRSFNIESLAVGPAEQAGISRITMVVPGDDRTIEQLMKQLYKLIPILQVENLTQVPCVERELILMKVQANSQTRREILDMANIFRARVVDISADDVMLEVTGDPGKMVALEQILTKFGIVEVARTGKIALKRSSKVNTEWLR

SEQ ID NO: 79881 - protein, 238 aa, Oryza sativa Japonica Group
MAGGVVIGVAPPAAAEEPEPHVERLPADLLAHVLSLLPSFHDLSMAGGVSRRWRRAVERSLAGRRRMSFAGQRTGDDSTARFVRAAVNLRDLDISRSCWGCQITDQGLIRISTADCVKNLTSISLWGLAGITDNGVIQLVSRAHSLQHLNIGGTFITDESLYAVAKSCINLKSIIVWSCRHVTEAGLVALVGGCRRLECINVGGMRVPPESFAGLLAIRPALQIRSIPQILNANVQVS

SEQ ID NO: 79882 - protein, 519 aa, Dichelobacter nodosus VCS1703A
MNRVNALCQLSQAKCWDVVVIGGGATGLGIALDAITRGFSTLLLEAKDFAQGTSSRSTKLVHGGVRYLAQGDVALVREALRERGRLAKNAPHLFKIQPFIIPGEYFWTAPYYTFGLWLYDRLSGKLSIGATRYLSKTETQKRLAGIKAEKIRAGVCYYDGQFDDARLAVTLAQSAVDHGATVLNYCPVVALHKNDAGKVDGVVAQDAFSQQSYQISARAVINATGVFANEIVAMDEPDSKPRIVPSQGIHLVFDRDLLASDDALMVPKTSDGRVLFAVPWHDKLVVGTTDTLVNSVSYDPKPLDQEIQFILETARDYFKRAPTRADVKSVFVGLRPLAAPKKEGKATKEVSRSHKVHISDSGLVHIIGGKWTTYRQMAEDTIDAAMKANLLPKKACQTVALKLHGYQESSLSDSFLSVYGSDTAALQKYSADDAALAEKIHPDYPYLLAQVAWAIDHESALTLEDILARRIRLLFLDARAAAQSAEKVARFMAKRLQWDDERLQTELNNFTAKAAQYHL

SEQ ID NO: 79883 - protein, 341 aa, Synechococcus sp. WH 8102
MTLRVAINGFGRIGRNVMRGWISRGADTGLEIVGMNSTSDPKTSAHLLTYDSILGKLDPSVKIETTDDTMLVNGKEIKFFADRNPLNCPWKDWGVDLVIESTGVFNTDEKASMHLEAGASKVILTAPGKGDGVGTFVVGVNDDQYRHEDWNILSNASCTTNCLAPIVKVLDQNFGLDWGLMTTIHSYTGDQRILDNSHRDLRRARAAALNMVPTTTGAAKAVALVYPEVKGKLTGFAMRVPTPNVSAVDLTFGPSRATSVDEVKAVIKAASENGMKGIIKYSDLPLVSTDYAGTNESTIFDADLTYAMGDKAVKILAWYDNEWGYSQRVVDLAEVVARNWK

SEQ ID NO: 79884 - protein, 392 aa, Oryza sativa Indica Group
METVAAASYTRGAATRSPACCAAMSFSQSYRPKAARPPSTFYGESLRVNTARSLPSGRQSKAASRAALSTRCEIGDSLEEFLTKATPDKNLIRLLICMGEAMRTISFKVRTASCGGTACVNSFGDEQLAVDMLADKLLFEALEYSHVCKYACSEEVPELQDMGGPVDGGFSVAFDPLDGSSIVDTNFTVGTIFGVWPGDKLTGVTGGDQVAAAMGIYGPRTTYIIALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLIEKAGGYSSDGKQSVLDKVINNLDERTQVAYGSKNEIIRFEETLYGSSRLTAGATVGAAA

SEQ ID NO: 79885 - protein, 356 aa, Micromonospora echinospora
MELTTTAARPGLRHRMQQLIYGFFTAQTLHVAVRLRIPDLLADGARDVGDLASATGADAPSLRRLLRALVFLEVLDEPAPGTFALTEQGEVLRADVTGSMRELVLLLSGPESWAAWGQLEHSVRTGEVAWEHVHGRSCFDHLMADPQRQAAFNAAMAEGSRAFVPTLLSAYDFGDLRTVVDVGGGSGALLAGVLAAHPHLRGTVFDTPDGVADAARTVAEQGVADRCGVETGDFFVSVPPGADAYVLKSVLHDWDDEQCVEVLRTVRRAVRPDSRVILVESLMPTTVTTAPSVAQVVMNDLNMMVCHGGRERTVAEFRELLRVAGFRLESVTPCPAPSVVGILEAAPAPATGPDGS

SEQ ID NO: 79886 - protein, 194 aa, Glycine max
MFVLENGVKNKGEDPRLQAISQAIRVVPHFPKQGIMFQDITTLLLDHNAFKDAVDIFVDRYRDMDISVVAGVEARGFIFGSSIALGIGAKFAPLCKPGKLPGEVISEKYVLEYGTDCLEMHVGAVQQNERVIIIDDLVATGGTMSAAIRLLERADAEVVECACVIGLSDLKVRCKLNGKPLYILVEPRQVENGF

SEQ ID NO: 79887 - protein, 454 aa, Corynebacterium glutamicum
MSQEDITGKDRLQELIGADYRLQWIIGHGGMSTVWLADDVVNDREVAIKVLRPEFSDNQEFLNRFRNEAQAAENIDSEHVVATYDYREVPDPAGHTFCFIVMEFVRGESLADLLEREGSLPEDLALDVMEQAAHGLSVIHRMNMVHRDIKPGNMLITANGIVKITDFGIAKAAAAVPLTRTGMVVGTAQYVSPEQAQGKEVTAASDIYSLGVVGYEMMAGRRPFTGDSSVSVAIAHINQAPPQMPTSISAQTRELIGIALRKDPGRRFPDGNEMALAVSAVRLGKRPPQPRTSAMMAQAEAPSPSESTAMLGRVARPATITQEAAPKRGSGIGIGLFIAALLAVIIGTGSMRAPPEFCSTTLRKKPPHLKPLRKPTPQPWRKPPLSGYRQRLQLGQHSPNLKQLHTVRRQVKRAHPRNQPRKLQQVAELCLKSLPLHLGRVLAFQLRLMHRLMI

SEQ ID NO: 79888 - protein, 339 aa, Synechococcus elongatus PCC 7942
MTIRVAINGFGRIGRNFLRCWFGRQNTDLEVVAINNTSDARTAAHLLEYDSVLGRFNADISYDENSITVNGKTMKIVCDRNPLNLPWKEWDIDLVIESTGVFVTAEGASKHIQAGAKKVLITAPGKGEGVGTYVIGVNDSEYRHEDFAVISNASCTTNCLAPVAKVLHDNFGIIKGTMTTTHSYTLDQRILDASHRDLRRARAAAVNIVPTTTGAAKAVALVIPELKGKLNGIALRVPTPNVSVVDLVVQVEKPTITEQVNEVLQKASQTTMKGIIKYSDLPLVSSDFRGTDESSIVDSSLTLVMDGDLVKVIAWYDNEWGYSQRVVDLAELAARKWAA

SEQ ID NO: 79889 - protein, 155 aa, Triticum aestivum
MASSATTRAPFQGLKSTDGLTVRRRYSDSLCSVSNGVRIRCMQVWPIEGIKKLETLSYLPPLYTEALLKHVDYLIRCKWVPCLQLSTVDFVFLEHINYGGFYDCRYWTMRKLPMLGCTDTTQVLNVVEEVKKEYPDRYVRGIGLDNLRQVQCVSF

SEQ ID NO: 79890 - protein, 253 aa, Synechococcus elongatus PCC 7942
MSFSDHFSAVAASYAKARPRYPQRWFRYLARIVPDRQRVWDCATGNGQAAIALAEYFSEVIGSDASAAQVRQARSHPRVQYQVFPAEATPLAPASLDLITVAQAAHWFDLPQFYIEAQRLLRPGGVIALWGYGLGSLNPAIDHVFNHFYRDWLDPYWPPERQWVEQAYEGLSFPFEPLPTPTFSMQCDWTLFDLLAYLRTWSGVQQFQRQRGFDPVWAIAPELQRVWGDPQRYRRITWPLFAKVGRWQPDRVR

SEQ ID NO: 79891 - protein, 293 aa, Shewanella sp. MR-7
MLVNAIKEYQLRVDDQLKQRFSTLEDTAAQLKAAMTHGALLGGKRIRPFLVYSVGQMFGVSLEKLDACAAAIECIHAYSLIHDDLPAMDDDDLRRGQPTVHIAFDEATAILAGDALQTLAFEIVTEAVPGISSEQHIAMVRALAKASGYRGMCGGQAIDLASTDKLIDLKALTQLHNMKTGALISCAVELALIAANAPKDEYQTMMEFAHAVGLAFQVQDDILDIIATTEELGKPQGSDAESNKSTFPQLLGLQGAKDTAAQLIQEALSALAKLPYNSQLIADFARYIIERRI

SEQ ID NO: 79892 - protein, 452 aa, Cryptococcus neoformans var. neoformans B-3501A
MSPIASTASPLPSSKPTLSSQEVMNLEHEYSAHNYHPLPICFEKGLGAHVWDPEGNEYLDFLSAYSAVNQGHCHPEILNTLVTQASKLTLSSRAFYSSNLGPFAKKITSMFGYDMVLPMNTGAEAVETAIKLARKWGYEKKKIPDGKAKVLSVEGNFHGRTIGIISMSTDPESRTGFGPFLENVGPRWDTGLIRYNHTEDLEKVLEKHGDEVAAFLVEPIQGEAGIFVPDDGYLAKCAEICKKYNVLLICDEIQTGLCRTGKMLCYEWDNIRPDMVILGKALSGGMYPVSCVLADKDIMLCIKPGEHGSTYGGNPLGCAVAMTALDVLVKEDLANRSLKLGEIFRSELAKLNSPFIKLIRGRGLFNGVVIDETASKKGRTAWQLCLLMKSKGLLAKPTHVNIIRFAPPLVISEEDVRKAVKIIGESLEELDTIEKIPGDEGEEHKAAIKLDD

SEQ ID NO: 79893 - protein, 314 aa, Triticum aestivum
MAEHLASIFGTEKDRVNCPFYFKIGACRHGDRCSRLHNKPSVSPTLLLCNMYQRPDMITPGVDAQGNPIDPVKIQGDFEDFYEDIFDELSKHGEVENLHVCDNLADHLIGNVYVQFREEDQAAKALQALQGRFYSGRPIIAEFSPVTDFREATCRQFEEHNCNRGGYCNFMHVKEIGRDLRKRLYGHLHRSRRSHSRSSRSPSPYRHHARDRDRSSRSRDRGDYYGGSLDRGDYGDYYHHSRRSSERNRNYDSDGSRCRRHRSRTRSPVREGSEERRAKIEQWNREREAPARQGSEERRAKIDQWNRERETAQA

SEQ ID NO: 79894 - protein, 609 aa, Coprinopsis cinerea okayama7#130
MPRLTVTPGVAFLTRNLVVPTAFNYGLATLALRVASNKISGIPRVPGWLLLALSVLVIPTRIAAALVYQQWRNQREAEKRGARLAPVLQGKRIGNMDQLSYLLNCWKNGYAADGIREIIEDLGNTFNPRIMFADTIFTVEPEHVKLILSTDFNNYVKGERFQFAIFHRSMTRPFFSRERVTDLDRFDRHTQTALSLLLAKAKTGYAVDFQDVMQRLTLDISTDILFGACVDNLKITPDDLALPYNHPRYSSASSAKDTSFTQAFLNAQFVIAERERNGWAWPLLEIFEDKAAPHMAVVNRFVEPIINEAIRKRKEKEALYGDSEKANGQKADIDADETLLDHLVRSTSGKPLLTVQSRRQKVKYVEFADPRILKDETLNILLAGRDTVSATLTFTIYLLSLHPHVLERVREEVLNRVGPSRAPTYDDVREMKFLRAVINESLRLLPPVPMDVRECVNGAIWPSPDPTQKPIYVPPGAATPYSALLTQTRKDLWGPDALEFDPDRFIDERVKKYLVPNPFIFIPFNAGPRICLGQQFAYNVTSFVLVRLFQTFSSFTLDEEAFPPDCRVPKEWAEVGKNSRKAKERFMPKLVLTMSSKGGMWLKMQPVDH

SEQ ID NO: 79895 - protein, 498 aa, Digitalis grandiflora
  misc_feature (1)..(15): Xaa can be any naturally occurring amino acid
XXXXXXXXXXXXXXXEKKNLGRIVQIIGPVLDVAFPPGKMPNIYNALVVKGRDTAGQPINVTCEVQQLLGNNRVRAVAMSATDGLTRGMEVIDTGAPLSVPVGGATLGRIFNVLGEPVDNLGPVETRTTFPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESNLKK

SEQ ID NO: 79896 - protein, 2685 aa, Coprinopsis cinerea okayama7#130
MADPATGPNLVLLGGPLYIGSLLAYLLYGAFVVQTVTYLSERPAKASWVGAAVVALVAIVETLSIGFITQTGWHSLVLALNNQESTDRLLKYPEAIVANPMLNGLGEVVRTAAWLVQLCFAYRIWILASTMIGKSAAVLVTLLTSTQFALTILIAFLFGRKGRNVVESTNDPVTQRAVAAYLSITVICDILITIAMISILRGFHQLTTFTATKRLLNTLTVHTIENGLITTLCATVNLILYFARPDDAIHIAFQFIIGRLHANVLMAYLNHRHTNEAGTFGTVDLSGGTHSFHRRRATTMGTAADFSDPPLEFTVIKSPENARPDMTEAHNTNSNASPNVQETYILHRTPWRPPVVKSAEGITFTLEDGRKVIDAVGGAAVACLGGNHPKVSSAIKDQLDKVSYVYNMQLSNEPAEKLAKKLIDTSDGAFALVGYASGGSEAMEGVLKLARQYYTEIGQLERVNFIARKSSFHGNTLGTLACAYHPTRRGLYVPLLEKEHFHHVSPAYAKRYQRPDETEEQYVERLRQELEDKFLELGPNTVIGFVAETVVGATTGVVSAPKGYFKAVKSVCEKYGALFILDEVMCGMGRMGSLHAWQSVGDGVAPDIQAVAKGLGGGYATIGAILMSPKVVNGIRRQSGLWKHGHTYQAHPLACTAALAVQEVIEEENLLENIRTQGAYFGRALREALTSPSSLVRPFVFDVRGQGGFWAVEFDFDNAEAASYDFKGESFSILTQAQAFEDGLIVMGMSGGASLDGSKGDTIIFAPAYNVTKQEVEKIVELFASSVEEVLMKHRAAKQKASAKGKGKERASTLAEQEQPTTVSDDTPVSRNTRAATSSAKGKRTKDSSAAKGKAKEIQSEDAPRSSAKRPRRNIASSSAALTINEPSTSTKGKKRATQEADNDDIAEPSTKRPKTTAHSRRSGPPATHTDMAPRKTRASTSARNKAALKSKIAAASSSRLENEDVEMLDADYQMQEDSDVEEPGLDLDEAKGEGAKDEDKRDANECHDDDGLDNEDSDDGDEDGPHNTGLGTSSGGPPQPSHSGFAGLDETAAMALFGDYRQFGSYMVSLSSRLKNMLNNIKPTADPTTRLLTLQELSELLSISTEETLAGSFPVDSFVRELVKILGGKGADEDDDGDDDEDVEQDEDAALAAALAMSGGNQYQGDENPEAQVLACRCLANLMEALPGVAHTVVYHGAVPVLCSKLIEISYIDLAEQTLSTMEKISEEFPSAIVREGGLAALLNYLDFFSIAVQRTALQAAANCCRSVSAEHFTMIREVWPIIRNCLSYSDQRLVEFACLCVIRVIDSYHRSSVDNLEALVDAPLIKAVNHLLLPAGGSPIIASNTFTLLLRALATSARASPKITVALLEADIVDTLYQILTGVLPSAVTNGSEQGDGVGGQGLGGGLADMTVMENLAHRPKDQVEEALSLISELLPPLPKDGVFDHKAYTEKSLARMVKAKAKAERAAARQATQAASTTSSTPEPNAMAVDNAPSPGPASTAGDATPQEADEAASTPPQPALSRTEILRSKSAVVDRFMQLLIPILVDVYAASVATAVRVKTLNGLLKAVSFLDGEGIKTVLKFVPIATFASSILSSRDHPSFVIAALQLVELLLSKAPAFYRPAFRREGVFHEVESLAERQLIVSKSKEKEKDKEKDREGEPSTEPPNPLSSSSLHGLKKLSSLSLDPEDAITLRARVLKFKHMSEEQNHSEEDSFDRLRTLVDRFSSPTASEDELSEALWELAQLFSSPHSPISSFELLQSGIVDGLLRLATDEGRMVGIKKRKELLLDAFTGKKSKALPNTQNPFATLVKKLQESLTRMESFEVITVSQNIDESKRSSPSLLARQLRLRLVADTDGDVPRTLNNIVVSIHAIATFQALHDYLRPRVAGLLGGSSRLSSMFAALAASGYPTPFSRGPEASTSSAGAAASSSTQEQSTSTVTRRRSQRLSAKNNTESTAETNAPSTSAAATEEAPPSTGAALPPPSAVESAHSDPMLDPDFHDDFSDDDVDAEVYDDDVDDPDNSVADKTITLNINEDGSKVEAQTPDGTRVATPSGSSKDAGSASSSKAASGSRGSYAAALKSKPTDWHLQFSMDDQVLPLDLTIYGAIHQHEMRKKTGALPLHMIWQSIYTIKFKKVPGPPPTPESRSDHSDVGQKRSPSPSLSSLPEDAAPTKILRLLRVLSQLNTLEAERSGHDADKRTLADSAFVNNKLSAKLTRQLEEPMIVASSCLPDWAVDLPQHFPFLFPFATRYNFLQSTSFGYARLILKWQSQQNRGGSDSSRRDEGIGFLGRLQRQKVRISRKHILESAVKVFELYGSSSSVLEVEYFEEVGTGLGPTLEFYSLVSKEFARKDLKIWRDNDASGPGSYVSHPHGLYPAPISREDIISDGGQKRTHILRVIGQFVAKAMLDSRIIDLSFSKVFLKIVLGEEVPITIASLKLVDPSLAKSLSQLQAIASEPTEPPTDPRKIAEIEKVNIEDLALDFTIPGYDIELRPGGRDIPVTSANVYDYIDEVLDAILGKGIQVQAKAFREGFSKVFPIDDLRAFTADELVMLFGNTEEDWCIETLSESIKADHGFNVDSRSIRYLLEIMAEFDVPTRRAYLQFITGSPKLPIGGFKGLNPPLTVVRKPHEAPLTADDYLPSVMTCVNYLKLPEYSSKEVMREKLCIAIQEGVGSFHLS

SEQ ID NO: 79897 - protein, 498 aa, Delarbrea michieana
  misc_feature (1)..(4): Xaa can be any naturally occurring amino acid
XXXXPTTSGSGVSTLEKKNLGSITQIIGPVLDVAFPPGKMPNIYNALVVKGRDTVGQQINVTCEVQQLLGNNRVRAVAMSATDGLTRGMEVIDTGAPLSVPVGGTTLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDSLPEQAFYLVGNIDEATAKAMNLETESNLKK

SEQ ID NO: 79898 - protein, 166 aa, Cyanidium caldarium
MKHTLSVLVEDEAGVLTRIAGLFARRSFNIESLAVGPAEQVGISRITMVVPGDDRTIEQLMKQLYKFIPIFKVENLTQVPCVERELMLMKVKANSDTRREILDMANIFRARIVDIAAEDLMLEVTGDPGKMVALEQVLAKFGLVEVARTGKIALKRSSKVNTEWLR

SEQ ID NO: 79899 - protein, 433 aa, Neisseria meningitidis Z2491
MPSEHQHISSLLDFDRTHLLHPYTSMTDPLPVYPVKRAEGVFIELADGTRLIDGMSSWWCAIHGYNHPVLNQVVETQIKQMAHVMFGGLTHESAVELGKLLVGILPQGLDRIFYADSGSVSVEVALKMAVQYRQARGLMAKQNIATVRRGYHGDTWNAMSVCDPETGMHHIFGSTLPQRYFVDNPKSRFDDEWDGADLQPVRALFEAHHADIAAFILEPVVQGAGGMYFYHPQYLRGLRDLCDEFDIVLIFDEIATGFGRTGKMFACEHAEVVPDIMCIGKGLSGGYMTLAAAITSQKVTETISRGEAGVFMHGPTFMANPLACAVACASVKLLLSQDWQANIRRIESILKGRLKAAWDIRGVKDVRVLGAIGVIELDKGVDMARFQADCVAQGIWVRPFGRLVYLMPPYIISDGLLTELADKTVQILKEHSK

SEQ ID NO: 79900 - protein, 301 aa, Synechococcus sp. WH 8102
MLSDLVNRSQPLARDARVLVLGGGYSGGHLTRLLRALGTTVRCSRRSLSSPEADLVFDSTAGLIPTSRDLDGITHVLSTIPPTTEGHDPVLTHLGSQLKERSLTWVGYLSTTGVYGDQQGRWVSEDDPANPGQPRSQRRHACEQAWLDSGLPVQILRLPGIYGPGRSVLDSLRTGTARRILKADQVFCRIHVDDIAGACLHLMHQAAAGPGPAIVNVSDDRPAAPQDLLQYGAALLNCKLPDEEPFELASHSMSAMARSFWSENRRVRNTLLCQQLGYALLHPDFKAGLQDCLRQESQSCS

SEQ ID NO: 79901 - protein, 275 aa, Magnetospirillum magnetotacticum MS-1
VSGVNAETADRDLGRGGSDTSAVAIAAAIGAERCDIYTDVDGVYTTDPRVVPKAQRMERVTFEEMLEMASLGAKVLQVRSVELAMVHRVPTTVRSSFDPPDAARPGTLICDEDQIVEQQIITGIAFSKDEAQITLRAVKDSPGIAAAIFGPLADANINVDMIIQTVSGDQSTTDMTFTVPAADYERSRAILDAQRDTIQFGQIEGATDVVKVSAIGVGMRSHAGVAAKAFRALAQKGINIRAITTSEIKFSVLIDAAYTELAVRTLHSLYGLDQA

SEQ ID NO: 79902 - protein, 372 aa, Rhodospirillum rubrum ATCC 11170
MIVSRAAIAWEAGKPLSVEEVEVAPPRQGEVLVRIIATGVCHTDAYTLSGSDPEGVFPAILGHEGGGIVEEIGPGVTSVAVGDHVIPLYTPECGTCKFCRSGKTNLCQAIRATQGQGLMPDGTSRFSIKGREIRHYMGTSTFSEYTVLPEIALAKVNKAAPLEKICLLGCGVTTGMGAVLNTAKVEPGATVAIFGLGGIGLSAIIGCVMAGAGRIIGVDINPDKFEIARQLGATDVINSRDYDRPIQEVLIDMTDGGVDYSFECIGNVGVMRSALECCHKGWGQSVIIGVAGAGQEISTRPFQLVTGRVWRGSAFGGVKGRSELPALVERYLAGDFELDTFITHTMGLADINHAFELMHEGKSIRSVIHYDL

SEQ ID NO: 79903 - protein, 507 aa, Thiomicrospira crunogena XCL-2
MKNDQAWSFFVSISIKNEGVFYNRVTMSNTQKTTLSVEKIGGTSMSDYQAVRDNIILYPENFYNRIFVVSAYGGITDDLLEHKKTDQPGVYGLFANDDVDDDWRIALDQLSLKLNKINANLFSDDELRLKANDFIDERIAETKQLLNHLQDLCRHGHFSLESHLLTVRELLASLGEAHSAWNLAHLLQTEGVNARFVDLTGWQADEALPLDAMIETHLGDIDFTKELPIVTGYTHCRENLMYTFDRGYSEMTFSRIAVLCQATEAVIHKEYHLSSADPRLVGEDNVVPIGKTNYDIADQLANLGMEAVHPRAAQGLRQAQIPLRIKNTFDPGHHGTIFTEDYVSEYPQVEIIAGMQHLIALEVFDQEMMGQQGSYEKVIIDATNRLKCQVITKDFNANTITIYLKASLKKVKRLAEQLKQGLPTATINTSKVALASAMGSDMRIKGLLAKAVQTLFDQGINVEAIHQNTRQVEMQFFVNETDYEKAVKALHTNLIEVHNHGKAICEH

SEQ ID NO: 79904 - protein, 329 aa, Zea mays
MAAAGDPPPPIYAEGAARTRGEISPHFQTYARDDDAKLETTRARLSNILKRHEDLKERLSRDSDKLIFERLQKEFEAARAAQTEEISINDDEWNDGLLATIREKVFNVHMEADRKAMSNQVNVPADLSFQSRTTYRIRNKVIYCLDGARIGIQYETFFAGEPCEIFHCVLESKSFLEKMIMIEHTLPFFLPKFIDHLEEILQAYIDRREQVRLIKELYGNQIGELFHSLPYNMIEFVLEDFECKVTISIRYSDLLQTLPSQARVLAWPLRSAKKISTRSSSASAAQPVPFHLSYAEEALKTLCLPEAYADIVLELPHALKRILSSRDSD

SEQ ID NO: 79905 - protein, 427 aa, Kluyveromyces lactis NRRL Y-1140
MFKKEPLSENNSRKPEEPEPVEGHKLTKLFNKVTGQPSSYVNKSDYIFGKTLGAGTFGVVRQARCISSGENVAVKILLKKALKGQSVQLQMLYDELSILQQLNHPNIVRFKDWFESKEKFYIVTQLATGGELFDRILEKGKFCEVDAVFIVKQILQGVQYLHQRNIVHRDLKPENILYLNKSDDSPLVIGDFGIAKELKDDNELIHKAAGSMGYVAPEVLTSSGHGKPCDIWSIGVITYTLLCGYSPFLAESADGFIEECTSGQYPVVFHKPYWNNVSKTAKEFILWALTVSPKRRPTATDLINDIWITSTEKSTTDLLPEIRKGFDARKEFRDAVEIVKLNNRIKKLKVLYENQDESDTDIEVNSTDSFSKNDYSADSLQSSLKSLSIKDSHTELKSSLTQNAFAQLVLTASKNKEKVKSFQDSGN

SEQ ID NO: 79906 - protein, 517 aa, Arabidopsis thaliana
MAAMNMIDFQNCFIFILLCLFSRLCYSHFFKKPKDPRLHFDLPPSPPSLPIIGHLHLLLSVLLHRSLQKLSTKYGSILYLRVFRFPVVLISSASIAYEIFRAHDLNISYRGFTPTDDSLFAGSFSFISAPYGDYWKFMKKVLVTNVFGPQAHEQSRGVRADVLERFYGNLFDKAIKKQSVEICAEALKLSNSSICKMIMGRSCSEERFRALATELDVLTKKLFFANMLRAWFKKLVVSLFKKETTVISYRFDELLESILVEHEKKLDVHHQRTDLMDALLAAYRDENAEYKITRNHIKSIIADLLFAGTENQVQTIQWAMAEIINNPNVLERLRGEIDSVVGKSRLIQETDLPKLPYLQAVVKETIRLHPPGPFFLRFTKEGCRIRGFYVPENTSVVVNVYAVMRDPDAWEDPLVFKPERFLASSRAEQEEERREKEIKYLPFGSGRRSCPGENLAYVIMGTAIGVMVQGFEWRTTEEKINMDEAVVGLSLTMAHPLKIIPVARTSNSLTSSLQKCL

SEQ ID NO: 79907 - protein, 237 aa, Desulfotalea psychrophila LSv54
MLNSTSIIGCRPKNCRRSFSRIIPPCRGDSSPMQSADFFLLRHGETEWNREKRIQGCQDSPLTATGSQTSALWGPLLQRYSFDHLFSSPQGRAQATAAIINRSLGLETIVHRALREQDWGLWEGLTRAEVEVHFPGELQRQMDRGWDFQAPAGESRRQVQLRAEQAIRHISHQHPGGTFLLICHQGLIKSLLYAILGRDFLPTEEQVLEKNSLQKISLRPGGSLQIEALNIRPPSLP

SEQ ID NO: 79908 - protein, 543 aa, Corynebacterium efficiens
MTISSPLIDVANLPDINTTAGKIADLKARRAEAHFPMGEKAVEKVHAANRLTARERLDYLLDEGSFIETDQLARHRTTAFGLGNKRPATDGIVTGWGTIDGREVCIFSQDGTVFGGALGEVYGEKMIKIMELAIDTGRPLIGLYEGAGARIQDGAVSLDFISQTFYQNIQASGVIPQISVIMGACAGGNAYGPALTDFVVMVDKTSKMFVTGPDVIKTVTGEEITQEELGGATTHMVTAGNSHYTVATDEEALDWVQDLISFLPSNNRSYAPVEEFDEEDGGIAENITADDLKLDEIIPDSATVPYDVRDVIQCLTDDGEYLEIQADRAENVVIAFGRIEGQSVGFVANQPTQFAGCLDIDSSEKAARFVRTCDAFNIPIVMLVDVPGFLPGAGQEYGGILRRGAKLLYAYGEATVPKITVTMRKAYGGAYCVMGSKGLGADINLAWPTAQIAVMGAAGAVQFIYRKELMAADAKGLDTVALAQSFEREYEDHMLNPYLAAERGLIDAVILPSETRGQIARNLRLLKHKNVSRPARKHGNMPL

SEQ ID NO: 79909 - protein, 147 aa, Zea mays
  misc_feature (44)..(44): Xaa can be any naturally occurring amino acid
  misc_feature (66)..(66): Xaa can be any naturally occurring amino acid
RKFGCPPRPKKRGGCPPLGKSLSKTRLYKKIFPYYPLKGVGGVXRGGKERVFPQRTKGSFGEPGYXSQGKGFLFIRPVRGNQIKSPHPFLPPVGGAAPPISGSQAPFFVKAGFPFAPGGTFPPGAKWEIVVLNKAGFKPGYIPPGKD

SEQ ID NO: 79910 - protein, 431 aa, Herminiimonas arsenicoxydans
MRIFNRLESEVRGYIRSFPTVFSKAQNAVLTDEGGNTYIDFLAGAGTLNYGHNNPVMKQAVIEYLAEDGIVHGLDMATSAKKAFLQTFESHVLKPRSMQYKLQFTGPTGTNAVEAAIKLARNVTGRQMVISFTNGFHGVSLGSLALTGNRKFRDAAGVSLSDVHRAPYSGYFGMNIDTIAMLDKLIADPSSGVDLPAAIIVECVQGEGGLNVAGMNWLKKLEQLCKRHEILLIVDDIQAGCGRTGTFFSFEPAGIKPDIITLSKSLSGFGLPMALLLMKPELDIWKPGQHNGTFRGNNMAFVTATAALGHYWRDNKFQAAIQKKALTIEIFLDKLVASYPDAKLTRRGRGMMQGIACADPALADRISSIAFQNGLIIETSGGEDEVVKLLMPLTIEQETLLAGLDILEHAVAEAVGEKTESHVESDKEVTA

SEQ ID NO: 79911 - protein, 260 aa, Opitutaceae bacterium TAV2
MPTNSSFRLDGKIALVTGCKRGIGRAMAIALAEAGADIIGVSATLETTASGAVSNVARDVTALGRKFTGYAADFSKREALMTFIKQVKADHPRIDILVNNAGNILRKPAAEHPDEYWDAIIEINLSAQFLLSREIGRDMIARGSGKIIFTASLLTFQGGINVPGYAASKGGVGQLTKALANEWAGKGVNVNAIAPGYIATDNTEALRNDPARAKSILDRIPAGRWGEPDDFKGPIVFLASDASRYVHGTVLLVDGGWMGR

SEQ ID NO: 79912 - protein, 538 aa, Kluyveromyces lactis NRRL Y-1140
MTARPELNTLHSAATEPTIIHSNNESLNALDYTGNDDKSVALSNAISRTNSTGNKIPKKRKPRRMFTTPGRFQQQLAIPTSYLERKPTTKAEAKGFYYFVSCMKQGKIMLFDQTLDRIDQCYDTMWTWPGFSHGVDFYQSHKDAKVLGTFLQVLRCCFDTRSIVFLPLFPVGIVFYKREEDIPAVICLLLALMYFAKLLSNTTEYASEHFGPVFGSLLNATFGNLVELIISGTTVSKDDAILTITSLIGSVISNNLLVIGSCFFFGGLDGVIMHSKAAIANHLFFLSSVTMALSLTSVIAVIDSGKSLRFKMDTSQIGAALIFLCYIIYLIVSTNQEFKALSSKKLKERSLKESDIETLPELDSDSDFEFSVGDKKDDEEKDLPPKLVCFITLAIATAGLGPTANFFVESLKELTDDKPISKVFIGLIILPLAGSLPEHISSLISAHHGQMDLAVSLAIGSSNQVLGMVLPIVQLISSRYPRTGFTLYFEPYVAGYLFSSTFVCCFTLIHGLLFSVNILHGTLLLATFGFIIYLTFAN

SEQ ID NO: 79913 - protein, 449 aa, Lactobacillus reuteri
MSQEKSTGAGLPTLSKSTIWMINFGFLGVQTAFTLQSSQMSRIFQTIGADPNNLGWFFILPPLAGLIVQPIIGYYSDRTWAPKLGGRRLPYLLLGMIVAVIVMILLPNSGSFGFGYGSLAALWFGAITVALLDLSSNVAMQPFKMMVGDMVNDDQKSYAYGIQSFLSNTGAVLAAVFPFILTAWFGVRNTAKRGVVPDSVIIAFYVGAALLVVTSLFTVFRVHEYDPATYAKYHGISEDDNKEGGNWFTLLKHAPKAFWTVTLVQFFCWFAFQYLWTYSAGAIAKNVWNTVDATSAGYQAAGNWYGVLAAVQSIAAVIWSYVLAKVPNKYHKLGYGGSLLLGALGFISVFFVHDQWTLIVSYTLVGIAWAAMNTYPLTIVTNALTGKHMGTYLGLFNGSICLPQIVASLLSFALFPLFGHSQVHMFILAGIVMALGALSVATIKETYAE

SEQ ID NO: 79914 - protein, 377 aa, Coprinopsis cinerea okayama7#130
MSSSETKGRNEEDVAEIKKAIATGAVKDPSNLSAIPPIFVVSGANFSMNFLLLCIQSSVCCACVFAVKKLGIISFRDFDMKDAKMWFPISFLLVSVIYTGSKSLVRPKTISHPATAKLGPQQYLSIPVYTIFKNLTIILIAYGEVLWFGGRVTALTFVSFIFMVISSIIAAWSDVQSALASSIPGASSGVSVGAMQSLFGALRGLNVGYFWMLVNCLTSAAYVLSMRKRIKSTGFSDWDTMFYNNLLSIPVLAVFSLIAEDWGRENLNRNFPAETRNFLLFAIAFSGAAAVGISYTTAWCVRVTSSTTYSMVGALNKLPVAASGMLFFGDPVTVGSVSAVGVGFFAGIVYAVAKNNQKKNERRQAADAIIPMASRKP

SEQ ID NO: 79915 - protein, 1212 aa, Oryza sativa
MQFMMPLDTNACAQPMRRAGEGAGTERLMERLNIGGMTQEKALRKRCFGDGVTGTARCVFTSDADRDTPHLRTQSSRKNYADASHVSAVILGGGTGVQLFPLTSTRATPAVPVGGCYRLIDIPMSNCFNSGINKIFVMTQFNSASLNRHIHHTYLGGGINFTDGSVQVLAATQMPDEPAGWFQGTADAIRKFMWILEDHYNQNNIEHVVILCGDQLYRMNYMELVQKHVDDNADITISCAPIDGSRASDYGLVKFDDSGRVIQFLEKPEGADLESMKVDTSFLSYAIDDKQKYPYIASMGIYVLKKDVLLDILKSKYAHLQDFGSEILPRAVLEHNVKACVFTEYWEDIGTIKSFFDANLALTEQPPKFEFYDPKTPFFTSPRYLPPARLEKCKIKDAIISDGCSFSECTIEHSVIGISSRVSIGCELKDTMMMGADQYETEEETSKLLFEGKVPIGIGENTKIRNCIIDMNARIGRNVIIANTQVYVLGLFWNGNSIIGILKFAPLSQQTCPVICFACLMCLRFFNSHLLATYETEELMGEVNSCKEMKSVCNWFALARQLIILLSVLVSCPGCQDFLSSLKMSHSSDEDSEISDSEIDEYADKFYARLVAGEFKVKDGQSYSCPFCSGKKKKDFNINNLIQHASGVGAASNRQAKDKATHRALAKHLKNGLTKSSGQQSQTAVVEPQPLPNRDEKFVWPWMGVLVNVPTEWKDGRQIGRSGNHLKEQLSRFCPLKIIPLWNFRGHSGNAIVEFGKDWHGFRNALAFEDYFGKEGYGRRDWKEKQNQGSNLFGWVARAEDHTSPGLIGDHLRKNGDLKTINDLENEGARKTDKLVANLANQIEVKNRHLQELEVTYNERTTSLEKMMGQREQLLQKYNEEIRKMQQLAQRHSQKIIDENQKLRSELESKMSELNTRSKELDEIAAKSDYDRRIIDQEKQKNAIKSSHLKLATLEQERADENVLKLVREHKREKEAAVKKILKLEQQVDAKQKLELDIQQLKGKLEVMKHMPGDEDSALKNKIDELSEELQEKMDELDAMESLNQTLVIKERKSNTEMQDARKELENGLLDLLDGQSHIGIKRMGELDLEAFSKACRKMSSEEDAEITAAILCSKWQAEIKNPDWHPFRFVLVDGQEKEIIEDDAKLQELKEEHGEDIYRLVRDALCEINEYNPSGRFPVGELWNFKDKRKATLKETVQFVLRQWRANRRKR

SEQ ID NO: 79916 - protein, 192 aa, Acer saccharum
VTGLLDPPELIKPPKILVIEGLHPMYDERVRDLLDFSIYLDISNEVKFAWKIQRDMAERGHSLESIKASIEARKPDFDAYIDPQKQYADTVIEVLPTELIPDDNEGKVLRVKLIMKEGVKHFSPVYLFDEGSTISWIPCGRKLTCSYPGIKFAYGPDTYFDHEVSVLEMDGQFDRLDELIYVESHLSNISTK

SEQ ID NO: 79917 - protein, 111 aa, Lactobacillus reuteri
MAFNTYNGVFAEEKKLGQKIEIDCEMDYPIETMVKTDELEETVSYADVYETIAEFVAHHNYNLIESLANNLLHELFKTYPMLNGIRLRIRKYSVPIAGIFDNVEIEVAGSK

SEQ ID NO: 79918 - protein, 186 aa, Acer saccharum
VTGLLDPPELIKPPKILVIEGLHPMYDERVRDLLDFSIYLDISNEVKFAWKIQRDMAERGHSLESIKASIEARKPDFDAYIDPQKQYADTVIEVLPTELIPDDNEGKVLRVKLIMKEGVKHFSPVYLFDEGSTISWIPCGRKLTCSYPGIKFAYGPDTYFDHEVSVLEMDGQFDRLDELIYVESHL

SEQ ID NO: 79919 - protein, 333 aa, Oryza sativa
HSSPSQQSFTTIESAESATAATSIETAESTTAARDVSPPAAVSAARDVSPPPAAARDVSPPSAAASAARDVSPPSAAAPAAARDVPPPPAVVPAAALDVPPPAVVPMAAEMEVDDVDVHEVPECIASMIDRGSVESHRLFLARRTAMEMLRDRGYSVPEAEIARTLPEFRAWWAEKPGIERLAFTTTLVSDPSKKVQLVFCPPEPVKIATIREIYLQTKEENLSRLVLILQSKILSRAREAIKEIFKFKVDIFQATDLLVNITKHVLKPKHEVLSADQKAKLLKEYNVEDSQLPRMLETDAVARYYGFDKGTVVKVTYDGELTGKRVAYRCVF

SEQ ID NO: 79920 - protein, 261 aa, Pseudoalteromonas tunicata D2
MILPIFQVDAFSEHQFKGNPAAVMPLQSWLADDVLQQIAAENNLSETAFYVEEDDGIHLRWFTPATEVDLCGHATLATAWVLVNEYQFEHDEIIFKTRSGLLKVRHLNGLFELDFPVHHAKECEVKAPLLTAFGETPLEILAADDYLLLFKDETTIKELKPNFALLAQLPLRGVIATAQGDKVDFVSRWFGPNVGVEEDPVTGSAHTVLTPYWAHKLDKTLLTATQVSKRSGDLICELKGERVLISGRASLYLKGEVHLAL

SEQ ID NO: 79921 - protein, 632 aa, Parvularcula bermudensis HTCC2503
MLHINDLTYRVEGRTLFDQATAMIAQGWIVGFTGRNGTGKSTLFRLIQDQISPDGGSLSLTPGRRIGGVAQEAAATEDTLIETVLAADTERADLLHRAEHATDPHEIARIQTRLADIDAYSAEARAAQVLSGLGFDSVDQRRPCAEFSGGWRMRVALAGALFAAPDLLLLDEPTNYLDLEGAVWLETYLKKYPYTAIVISHDRGLLNRSVSHILALEGGKLSVHPGGYDTYARRRAEQQRLAEAQAHKTEAQRAHMQAFVDRFRAKASKAKQAQSRLKALEKLKSSDVPLDESTTPFVFPAPKPAMAPPIVRLQSADLGYEEDRPVLRDLTLRIDEDDRIAILGTNGQGKSTLVKAIAGRLSPLNGNVYAHKKLKIAYFAQHQLDELRPDETPYDHVKALMPEGTEAQIRARTAGLGFGPEKADIPVRNMSGGEKARLLLGLIAFEGPHLMILDEPTNHLDIQSREALIAALDAYPGAVLLITHDAHLAEATVDRLWEVKNGAVHILDEDIDNYRARILASAKAAGEQKKTSGKTGPTAPTPADHRREAAARREALKPLRAHITGLEGEIARIDGVIAQMDDILATPGLFDTDLARATDISQKRARAEEKKAALEEAWLEASSQYEEAIAAD

SEQ ID NO: 79922 - protein, 211 aa, Glycine max
MEESKKRVRDESSYSPESQTQLVDSPESESQRVDSPESKIRRVDSSESQLDSVLDSEVRLQDDIFNILDDADNVPERDSVQGLDSVIKSFEDEINAPGSDSGSGDPTQEPDSGELQSNLGYLLEASDDELGLPPTVVDGEETGRVGPEMTELARLMGFEDDIPSYDAFGFGSGFAAESDGGAGGFVTVDGLFDYSDPAADVLWRSESLQAM

SEQ ID NO: 79923 - protein, 408 aa, Synechococcus sp. WH 8102
MCRSKQRMRWDMRRCFLDSPIGSLHAVQDKLTLMIPGPTPVPESVLKAMGRHPIGHRSGEFQAVVQRTTEQLKWLHQTQGDVLVITGSGTAAMEAGIINTLSRGDKVLCGDNGKFGERWVKVARAYGLEVEVIQAEWGQPLDTEAFRLALEADSAKAIKAVILTHSETSTGVINDLETIARHVKAHGTALTIADCVTSLGATDVPMDAWGVDVVASGSQKGYMLPPGLSFVAMGERAWQAYERSDLPKFYLDLGPYRKTATKNSNPFTPAVNLYFGLEAALEMMQNEGLEAIFARHARHRSAAQAGMKAIGLPLFAAEGHGSPAITAVAPDGIDAEQLRKAVKERYDILLAGGQDHLKGKVFRIGHLGYVCDRDVLTAVSAIEATLQSLGLHSGNMGAGVAAAATALS

SEQ ID NO: 79924 - protein, 528 aa, Synechococcus sp. WH 8102
MSQSSSDGQRQPAIVILDFGSQYSELIARRVRETEVFSVVLGYSTSAEELRAMQPKGIVLSGGPSSVYAEHAPLCDPAIWELGIPVLGVCYGMQLMVQQLGGVVEAASGKAEYGKAPLEVDDPTDLLTNVTGGSTMWMSHGDSVKALPEGFVRLAHTANTPEAAVAHLQRRLYGVQFHPEVVHSTCGMALIRNFVYHICGCEPDWTTSAFIDEAVAVVREQVGEKRVLLALSGGVDSSTLAFLLKKAIGDQLTCMFIDQGFMRKGEPEFLMDFFDRKFNIHVEYINARQRFISKLKGITDPEEKRKIIGTEFIRVFEEESKRLGPFDYLAQGTLYPDVIESAGTNVDPKTGERVAVKIKSHHNVGGLPKDLQFKLVEPLRKLFKDEVRKVGRALGLPEEIVRRHPFPGPGLAIRILGEVTDEKLNCLRDADLIVREEIREAGLYHEIWQAFAVLLPVRSVGVMGDKRTYAWPIVLRCVSSEDGMTADWSRLPYDLMETISNRIVNEVKGVNRVVLDITSKPPGTIEWE

SEQ ID NO: 79925 - protein, 525 aa, Dichelobacter nodosus VCS1703A
MNNIFSQLSHHAEQLKRQTLNQLFVEDPKRVEKWQWQVAGIRVDLSKNHIDDAGRILWFSWLKQQQTSAHIKAMLSGEKVNYSEHRPALHHALRARAEGSFIVDCTDIYAEIRKTRAQIRDLTAAIRQGTLRGFSGKAIEDVVHIGIGGSELGPRLLCESFVHRSDRVRIHFLASPDPIHIQSLQQRLNPETTLLIIASKTFTTEETLANAHLMRHWLHAAGGQKADEQMIALTAAIDKAHEFGISSAHILPFWDWVGGRFSLWSAIALPFALQNGYDAYEQLLSGAREMDQHFQSTPEEHNLPMHLALIDAWYNHYFAIDNRAIVTYAQPLNSFVPYLQQLEMESLGKRANQQGAALIKPSGMIIWGGSGTESQHAFFQLIHQGQRRIPLDFITVKSVPNGYEAAGTIVHGNCLAQAEALMCGRTLEDLKDLPLEERYQRTCAGNHPSNMVILDELTPFHLGALIALYEHKTTVLGTLYDVNAFDQWGVELGKVLAKKTEASLRGECTVDNPSTRALIDYLRQK

SEQ ID NO: 79926 - protein, 245 aa, Neisseria meningitidis Z2491
MGGQKTHFGFSTVNEDEKAGKVAEVFHSVAKNYDIMNDVMSAGLHRVWKHFTINTAHLKKGDKVLDIAGGTGDLSRGWAKRVGKEGEVWLTDINSSMLTVGRDRLLNEGMILPVSLADAEKLPFPDNYFNLVSVAFGLRNMTHKDAALKEMYRVLKPGGTLLVLEFSKIYKPLEGAYDFYSFKLLPAMGRLIAKDAESYQYLAESIRMHPDQETLKQMMLDAGFDSVDYHNMSAGIVALHKGVKF

SEQ ID NO: 79927 - protein, 315 aa, Thiomicrospira crunogena XCL-2
MKKRFSFIFIFLVALPLYSANNVAAPLIDLGAEAKKQAQKSAATQSAVPEKESATKVAEKQKEPEEKAKPEPKKPPHWGYFGEEGPQYWGELAPEFSTCKTGKNQSPINLKPQTAVGTTSLPGFDVYYRETALKLINNGHTLQVNIPLGSYIKINGHRYELLQYHFHTPSEHQRDGFNYPMEMHLVHKDGDGNLAVIAILFQEGEENETLAKLMSFLPQTLKKQEIHESVKIHPAKFFPADKKFYKYSGSLTTPPCSEGVYWMVFKQPIQASVTQLEKMHEYLGSNARPVQRQNARTLLKSWPDRNRANTVYEFY

SEQ ID NO: 79928 - protein, 231 aa, Zea mays
MACRRWWSTAVVFPPVARPPGSAGSHFLGGAGVRGVEIGGNFIKFTAIGVYLEDAAVPALAKKWGGKTADELASDAAFFRDVVTGDFEKFTRVTMILPLTGEQYAEKVTENCVAFWKAAGLYTDAEGVAVEKFREVFKPETFAPGRSILFTHSPAGVLTVAFSKDSSVPAAGGVAIENKRLCEAVLESIIGERGVSPAAKLSLAARVSELLAKETAAAADAPQAEPVSITA

SEQ ID NO: 79929 - protein, 493 aa, Aspergillus nidulans FGSC A4
MPPPVGRYGPTGLTGPYSHLAQQQAHLQQQQQAQHHPAHAQSSNTALPPPSLGVHPGFTTANANANMNPFTLAGAGVGNGMSVAGFGAAGDGGGTGLASHAAQMGFARGAQMQQQQLHQAHDGRFTLEGKGGGVKTRIRDVWKHNLAQEMAVLRHLVERYPYISMDTEFPGIVARPIGSFTNKADYHYQTLRCNVDLLKMIQLGITLFSPKGEVPPPDATDANGQPLGNGLVPAPCTWQFNFRFSLEEDMYAQESTAMLAKAGIDFATHEKNGIDPLEFGALLISSGLVLLDDVHWISFHSGYDFGYLMKIMLCQALPENEEEFHKLLNIFFPSLYDIKYLMKHATRNQAVNDSPLTPAAAQIISNLGQKSGLQDIADELGVKRVGIAHQAGSDSLVTGEIFWKMRQLVFNGKIDDSKYSGQIWGLNGQMPTVTYHNNPHQTPNLNGATIYSAAGTPSTPNNAGVQTPQNHTPGALTPGATGGVLGQYQMAKS

SEQ ID NO: 79930 - protein, 409 aa, Candidatus Kuenenia stuttgartiensis
MKPFDHTLYRKVLVMLLAGGKGERLYPLTRDRAKPAVPFGGIYRIIDFTLSNCINSGLRKICVLTQYKSYSLDRHLRVGWNIFNTELDEFIENIPPQKRTNEMWYLGTADAVYQNIYVLESERPEMVLVLAGDHIYKMDYAELINYHITNEADLTVPCIEVPLEDATRFGVVAIDNDSRIIDFDEKPSNPKPLPTNQNVALVSMGIYLFNTEVLVRRIIENAKNDTNRDFGKNIIPTMIQKDRVLSFVFNGNEHNTSNYWRDIGTLDAYWEANIDLVKKNPDFDLFDNRWPIRTYNKQYPPAKYIFENEKNGMIKDALISNGCLINDASIVKSIISPCVTIGAQSSVIGSIIMEGVRIGENVKIKNAIIDKHVTIPDGMKMGYDLQDDGKQFTVTEKGIVVAHKEMHLI

SEQ ID NO: 79931 - protein, 282 aa, Campylobacter lari RM2100
MQELINDIQKAVIEISQELRYLKDFDYTSSQNATGDNQLKLDVKSDEIITRILGQNKNIKSLISEEKQEQLLINENEKYIVAYDPLDGSSLVDVNFAIGSIFAIYENEAKAKNLKAAIYAIYGVRLELVVCFEKPMLYRLNENDEFVFVKELKLNEKGKLNACGGTQKNWSSTHGAFIKALFDEGYRLRYSGAMVSDLHQILLKGGGLFSYPATSDAPNGKLRAYFEVFPFAFIFEKANGLSTNGENDSLLDLEFEKIHASTPCFLGSKYEIEKLKQAYKGL

SEQ ID NO: 79932 - protein, 223 aa, Pisum sativum
MCCSILHHRNPRREHEFPAVVTSPVTENHIFLGGAGERGLTINGTFIKFTCIGVYLEDKADKSLATKWEGKLEELLETLDFYRDIISGPFEKLIRRSKIKELSGPEYSRKVMENCVAHLKSVGTYGDAEVEAIQNLQKLSRMLIFHLVLLKKNRQSPDGILGLSSSKDISIPEKEDAIIENKAASSAVLETMIGEHAVSPDLKRCLAARLPALLNEGTFKIGN

SEQ ID NO: 79933 - protein, 243 aa, Zea mays
MGRDGGDGELKLLGLWASPFVARAKLALQIKGLSYEYVEEDLGNKSELLLSSNPVHKTVPVLIHNGTPVCESTVIVQYIDDAFAGTGPSLLPADPYQRALARFWAAYLEDKIVTPWRRVFMVKADEEKAEAMRQAVAAMDALEGGLKECSSGGGGQSPFFGGDSVGYVDVLLGGMVSWVKASEPLSGAKIIDAARTPLLAAWMERFCELDAAKAVLQDVHAVVEYARTMQMQARVAAATASNQ

SEQ ID NO: 79934 - protein, 462 aa, Hordeum vulgare subsp. vulgare
MDSHSAVTMEAGAPTRKESGRLPARYGGNAHGHSGLARTAHGMSSSSLRKKSDATLVRKVPVASLRPVLANLQEILLGTKLAVLFVAVPLAVVAQCFHFGQVWVFALSLIGLIPLAERVSFLTEQIALYTGPTIGGLLNATCGNATELIIAMFALVQGKIEVVKCSLLGSVLSNLLLVLGTSLFCGGIKNLGANQPYDRKQADVSTGLLTLGVLCQSLPLLLRYAVSSGEHAVATDTTVLELSRACSFIMLLAYVAYLFFQLKTHRQLFEPQEIEGGDEEEEEAVLGFGSALFWLILMTIIIAVLSEYVVGTIEPTSQSWGLSVSFISIILLPIVGNAAEHAGAVIFALKNKLDITLGVALGSATQISMFVVPLSVLVAWIMGIQMDLDFKLLETGSLFISVLVTAFTLQDGTSHYLKGVLLLLCYIVIGACFFVTRQTEHHANGNGTLLDVPMGPMIVQVA

SEQ ID NO: 79935 - protein, 511 aa, Herminiimonas arsenicoxydans
MHQQLHCDILIVGGGINGAGIARDAAGRGLSVVLCEKDDLASHTSSASTKLIHGGLRYLEQYDFGLVRKALIEREILLRSAPHIIRPLRFVMPQDKGQRPAWMIRAGMFIYDHLARRELLPGSQGIDLRKHAAGTPLKDCFTKGFAYSDGWVDDARLVVLNAIAARENGATILTRTACIAVQRTGDQWNATLRNADNATIEVNARLLVNATGPWAAEFLHDTVHGRAGKKLRLIKGSHIVVKKLFDHPCAYIFQHPDGRIVFAIPYEHDYTLIGTTDIDYHGDTDTVAIDATEINYLCELVNHYFARPITPADVVWSYSGVRPLVEDDKVNESESASEVTRDYKLAFDTDAAPLLSVFGGKITTFRKLAEEALDLIAPVLGNHHGAWTAESCLPGGDIFGAKPNNRAVLEFDRFVREMQQQYAWLPAALLERYARAYGTRLMLLLADRSGLAAMGKEITPGLFVAEVEYLQRYEWATCAGDILWRRTKCGLHSTGAAEHELEAWMNRSTGR

SEQ ID NO: 79936 - protein, 495 aa, Arabidopsis thaliana
MCFNNIETGDEVETERQVFGSSEEDEFRVEDTARNTNNVQISQQQQQPLAHVVKWERYLPVRSLKVLLVENDDSTRHIVTALLKNCSYEVTAVPDVLEAWRILEDEKSCIDLVLTEVDMPVHSGTGLLSKIMSHKTLKNIPVIMMSSHDSMVLVFKCLSNGAVDFLVKPIRKNELKNLWQHVWRRCHSSSGSGSESGIHDKKSVKPESTEGSENDASISDEHRNESGSSGGLSNQDGGSDNGSGTQSSWTKRASDTKSTSPSNQFPESPNKKGTYENGCAHVNRLKEAEDQKEQIGTGSQTGMSMSKKAEEPGDLEKNAKYSVQALERKNDDTLNRSSGNSQVESKAPSSNREDLQSLEQTLKKTREDRDYKVGDRSVLRHSNLSAFSKYNNGATSAKKAPEENVESCSPHDSPIAKLLGSSSSSDNPLKQQSSGSDRWAQREAALMKFRLKRKERCFEKKVRYHSRKKLAEQRPHVKGQFIRKRDDHKSGSEDN

SEQ ID NO: 79937 - protein, 495 aa, Arabidopsis thaliana
MCFNNIETGDEVETERQVFGSSEEDEFRVEDTARNTNNVQISQQQQQPLAHVVKWERYLPVRSLKVLLVENDDSTRHIVTALLKNCSYEITAVPDVLEAWRILEDEKSCIDLVLTEVDMPVHSGTGLLSKIMSHKTLKNIPVIMMSSHDSMVLVFKCLSNGAVDFLVKPIRKNELKNLWQHVWRRCHSSSGSGSESGIHDKKSVKPESTEGSENDASISDEHRNESGSSGGLSNQDGGSDNGSGTQSSWTKRASDTKSTSPSNQFPESPNKKGTYENGCAHVNRLKEAEDQKEQIGTGSQTGMSMSKKAEEPGDLEKNAKYSVQALERKNDDTLNRSSGNSQVESKAPSSNREDLQSLEQTLKKTREDRDYKVGDRSVLRHSNLSAFSKYNNGATSAKKAPEENVESCSPHDSPIAKLLGSSSSSDNPLKQQSSGSDRWAQREAALMKFRLKRKERCFEKKVRYHSRKKLAEQRPHVKGQFIRKRDDHKSGSEDN

SEQ ID NO: 79938 - protein, 122 aa, Zea mays
IFMAAVVTYTVITDGLPFRKELLTPWMAATLIDFYINVFVISVWVAHKESSWISTTIWIVLLICFGSITTCGYIVIQLFKVSYQDPIYHVLLNSHSKRSSDGLILNDGLEVSSSVSAFSWAD

SEQ ID NO: 79939 - protein, 429 aa, Aspergillus nidulans FGSC A4
MAKDTTLPAQSVTELNACVTTSSHRPVKDTTFREWVVSNQIGISLTTLSMLLAVHHLYPSLSPYTTPFFQLSYYQPSQGVYIQGWDDIYFVISSVFAFTAIRAIAMEWVFWPLARWSGLKRKASIRLAEQGWMWLYYAVFWTVGMYIWSQSDYWMDFKAIWAHWPARGVSGLMKWYLLAQLAFWVQQIFVINIEERRKDHYQMLTHHFITSCLLTSAYVYGFYNVSNVVLNLMDIVDLLLPTAKILKYLKFEMSCNIAFGVFMVVWAISRHIMYPLLCWSIFKDVPAVMPWGCYSGATGELISTNGYPDRVMHLFSPFLNIDGPICMNRTIKWIFLSSLLALQVLSIIWFSMVIRVAIGVLRTGNAEDTRSDSEEKDEEEVDPKSAANGNAIAAEVSSAEWRRNGPSSTRSRRSDRKALLGRIGCDTRT

SEQ ID NO: 79940 - protein, 166 aa, Brassica napus
MRGMKYLTIWSLFAVLLSQQLFASVTSLKFEDEKTYYSPPSGGHGGYTPTPNCGSPPYDPTPSTPSHTPTPHTPTHHTPPCNCGTPPHDPSTPSHPSTPSHPFRPSRPFTPSNPAFGGYYSYPSPSTPVVVTPPTPIVDPDTPSSGWNPSFCWWICLMYSTKFFSF

SEQ ID NO: 79941 - protein, 181 aa, Catharanthus roseus
MGLSFTKLFSRLFAKKEMRILMVGLDAAGKTTILYQLKLGEIVTTIPTIGFNVETVEYQYISFTVWDVGGQDKIRPLWRHYFQNTQGLIFVVDSNDRDRVVEARDELHRMLNEDELRDAVLLVFANKQDLPNAMNAAEITDKHGLHSLRQRHWYIQSTCATSGEGLYEGLDWLSNNIANKA

SEQ ID NO: 79942 - protein, 210 aa, Triticum aestivum
  misc_feature (23)..(23): Xaa can be any naturally occurring amino acid
  misc_feature (130)..(130): Xaa can be any naturally occurring amino acid
  misc_feature (148)..(148): Xaa can be any naturally occurring amino acid
  misc_feature (181)..(181): Xaa can be any naturally occurring amino acid
YSAWKDDGTTVKSVGCDKVVKMXPLLTGGGFTDFSRHDAPVEELAWIPQINLLVSGSWDKTLTYWDIRQPNPPHVHQLPEPCYALSLSYPLMAVGTADRNAGIFNLDNPQAEFKKIVSPFKSQTMCICCXPDPQAFLLSPLAMHPNVXSIEGPVAFHHVNDSNPSKNHTFKFPRQGHHLYXAHPINIHPLNQTVATAGPECKSNLWVNGP

SEQ ID NO: 79943 - protein, 325 aa, Coprinopsis cinerea okayama7#130
MGEVQQSQDAIDPKSIPSNAPEHCPGTESEQAGKSDACNGCANQEICASGATKGPDPSLPFIRERMSTVKRKILILSGKGGVGKSTFTAQLGWAFAADEDTQTGIMDVDICGPSIPTILGIASEQVHSSSSGWSPVYVQDNFGVMSVGFMLPSAKDAVMWRGPKKNGLISQFLKDVDWGELDYLLVDTPPGTSDEHLSIVQYLKESGIDGAVVITTPQEVALQDVRREIDFCRKVGIRIIGLVENMAGFVCPSCKTESQIFKPSTGGGKRLAEETGIEFLGSVPLDPRIGKSADYGVSFLDEYPDSPATTAYLNIIDRIRDVLGD

SEQ ID NO: 79944 - protein, 572 aa, Sulfolobus solfataricus P2
MPTGARILVDSLKREGVKVVFGIPGLSNMQIYDAFVEDLANGELRHVLMRHEQAAAHAADGYARASGVPGVCTATSGPGTTNLTTGLITAYWDSSPVIAITGNVPRSVMGKMAFQEADAMGVFENVTKYVIGIKRIDEIPQWIKNAFYIATTGRPGPVVVDIPRDIFYEKMEEIKWPEKPLVKGYRDFPTRIDRLALKKAAEILINAERPIILVGTGVVWANATPEVLELAELLHIPIVSTFPGKTAIPHDHPLYFGPMGYYGRAEASMAALESDAMLVVGARFSDRTFTSYDEMVETRKKFIMVNIDPTDGEKAIKVDVGLYGNAKIILRELIKAIITLGQKRDKSAWIKRVKEYKEYYSQFYYTEENGKLKPWKIMKTIRQSLPRDAIVTTGVGQHQMWAEVFWEVLEPRTFLTSSGMGTMGFGLPAAMGAKLARPDKIVVDLDGDGSFLMTGTNLATAVDEHIPVISVIFDNRTLGLVRQVQDLFFGRRIVGVDYGPSPDFVKLAEAFGALGFNATTYEEIEKSIKSAIKEDIPAVIRVPVDKEELALPTLPPGGRLKQVILRDPRKSS

SEQ ID NO: 79945 - protein, 219 aa, Brassica napus
MAATTMTTTLGFVLPTSLSPRRGGFRVSVIRCSASPLTTSTGSAASGIVEKPWSTYDARLVLEDGSIWPAKSFGAPGTRVAELVFNTSLTGYQEILTDPSYAGQFVLMTNPQIGNTGVNLDDEESEQCFLAGLVIRSLSISTSNWRCTKTLADYLTERNLMGIYDLDTRAITRRLREEGSLNGVLSTEQSQTDEELLHMSRSWDIVGIDLISDVSCQSP

SEQ ID NO: 79946 - protein, 593 aa, Synechococcus sp. WH 8102
MSTAYQPLHHKYRPQRFDQLVGQEAIAATLGHALTSNRIAPAYLFSGPRGTGKTSSARILARSLNCLNSDGPTPEPCGTCELCTTIAAGTALDVIEIDAASNTGVDNIRELIERSRFAPVQARWKVYVVDECHMLSTAAFNALLKTLEEPPPQVVFVLATTDPQRVLPTILSRCQRFDFRRIPLDALEAHLSWIAEQEAIEIQPEAIHVVALRSQGGLRDAESLLDQLSLLPPPIEATAVWDLLGAVPEQELLQLVQAMSSAEPVALLEATRNLLDRGRDPGAVLQGLAGILRDLVLMAAAPDRPELTGVSPQFRDQLPPLAKALGRARLLQWQAQLRGSEQQLRQSVQPRLWLEVLLLGLLAEAPAAAPATSAPVTAAVPSQTAPAITPTPAVPAPSPTPSAAPATAPELPKVAPAAAEGAAPNLAELWQQILGSLELPSTRMLLSQQGQLVRLDANRAVVQVASNWMGMVQSRAALLEQAMAKALGGSRQLVLEASSGGAAPKVQPPPAAVVTPPVINTPSPTPEPTPPAQTRAAPAATPQLPEPVSQAPKPPEPKRPPANTSEPSGLDRQAKNLADFFNGQVLDMDNPEV

SEQ ID NO: 79947 - protein, 502 aa, Bradyrhizobium sp. BTAi1
MNATVSRIGRDHGDVDVAVIGGGINGAGIARDAAGRGLKVLLCEKDDFAEGTSSRSGKLIHGGLRYLEYYEFRLVREALIEREVLLASAPHIIWPMRFVLPHSPEQRPAWLVRTGLFLYDHLGGRKQLPPSRAVDLAHEPEGAPLREEFRRGFEYSDCWVDDARLVILNLVDAARKGATILPRTRAVSARRENGAWHLEMRAANGELQIVRARALVNAAGPWVQDVVQGVAGLNSAHHVRLVKGSHLVVPKFWSGSQAYLLQNTDRRVIFVNPYESDLALIGTTDIVHNGRAEDVAVDDGEVDYLLAVLDRYFRAAPGKGDIVHAFSGVRPLYDDNADNPSAVTRDYVFEVHGAADQPPLLSIFGGKITTFRRLAEQALERLAPWFPQLAPAWTAGACLPGGDLGGPFEQFLIDLARDYQGLPRELVAHYARLYGSSARDLLGTARSPNDLGRHFGGTFYERELFYLREREWAVTAADVLDRRTKHGLHLTRSEREAFELQF

SEQ ID NO: 79948 - protein, 545 aa, Debaryomyces hansenii CBS767
MGYEDKLLGPALKFRNFLDKFPNIHNVYIVVGISCISGMMFGIDISSMSLFIGDDKYLDYFNSPDSTLQGFITASMSLGSFFGALFSAFISEPFGRRMSLMFCAFFWCVGAAIQSSSQNVVQLIIGRFISGFGVGFGSSVAPVYGTELAPRKIRGLIGGLFQLSVTLGILVMFYVCYALHYINGVASFRLSWGLQIVPGLLLFIGCFFIPESPRWLAKQGCWEEAEYIVAMIQAKGNREDPDVMIEITEIKDQILTEENIKAFTYADLFKRKYLLRTVTATFAQIWQQLTGMNTLMYYIVYVFDMAGYQGDANLIASSIQYVLFFVMTAPSLYLMDKLGRRPILLSGAAFMMIWQFAVGGLLSTYAEPTNDVGGNDTVRLRIPADNSTAAKGVIACCYLFVVSFAYSWGVCIWMYCAEVWGDSASRQRGACFTTSANWIFNFAIAMFTPSAFKNITWKTYMIFATFCGCMFLHVFFFFPETKGKRLEEIGQMWDEGIPAWRTAAWEPSIPFLSDNDLREKLEVKHVEDSNSSNSDAEKPSAVHIA

SEQ ID NO: 79949 - protein, 379 aa, Aspergillus nidulans FGSC A4
MASTVGKTITCKAAIAWAAGEPLSIEDVEVAPPKAHEVRIQVLHTGVCHTDAYTLSGKDPEGAFPVILGHEGAGIVESVGEGVTSVKPGDHVIALYTPECRECKFCKSGKTNLCGKIRATQGKGVMPDGTSRFKARGKDLLHFMGTSTFSQYTVVADISVVAVTDKIPTDRSCLLGCGITTGYGAAVVTAKVEEGSNIAVFGAGCVGLSVMQGAVKNKAGKIIAVDVNDAKEEWSRKFGATDFVNPTKLNGQTIQEKLIEMTDGGCDYTFDCTGNVGVMRAALEACHKGWGESIVIGVAAAGQEISTRPFQLVTGRVWRGCAFGGIKGRTQLPGLVDDYLDGKLKVDEFITHREPLANINTAFEQMKAGDCIRCVVDLS

SEQ ID NO: 79950 - protein, 477 aa, Symbiobacterium thermophilum IAM 14863
MYIGGEWREAVSGRRFEVTNPATGEVIATVPDAGREDARAAIEAAHAAFGEWSSLPAHVRARYMRRLYDLIVQNVDRLARVLTEENGKPLAEAKGEVFNGAEYLNWYAEETRRIYGETIPSSSRRTRIWVLRQPVGVVGAITPWNFPSSMVTRKIAPALAAGCTVVLKPAEQTPLSALLIAELIHEAGLPAGVVNVVTTLDPAAVGQEFLENRLVRKISFTGSTEVGKHLMQGAAAQMKRVSMELGGNAPFIVFEDADLDAAVQGVVISKFRNAGQTCICANRIYVQESIAPAFTERLVEAVRGLRVGHGLEEGINVGPLIDEAAYVKVEGHVSDARGKGARVLTGGHRLTGPGFDRGFFYAPTLLDQVSDEMRIVHEETFGPVAPILTFRTEEEVIRRANDTNYGLAAYIFTRNLGRTVRVSEALEYGMVAVNDSLLAVPQAPFGGVKESGLGREGGHHGLDDYLEYKYLSVVLDG

SEQ ID NO: 79951 - protein, 475 aa, Zea mays
MEVCGAELGQGKPDKCFDDDGRPKRNGTMWTASAHIITAVIGSGVLSLGWAIAQLGWVAGPVVMLLFSLVTYYTSSLLADCYRSGDPSTGKRNYTYMDAVNANLSGIKVQICGFLQYANIVGVAIGYTIAASISMLAIRRANCFHQKGHGNPCKISSTPYMIIFGVAEIFFSQIPDFDQISWLSILAAVMSFTYSSIGLGLGVVQVIANRGVQGSLTGITIGVVTPMDKVWRSLQAFGDVAFAYSYSLILIEIQDTIRAPPPSESTVMKRATVVSVASTTLFYMLCGCMGYAAFGDGAPGNLLTGFGFYEPFWLLDVANAAIVVHLVGAYQVYCQPLFAFVEKWAAQRWPDSAYITGEVEVPLPLPASRRRCCKVNLFRATWRTAFVVATTVVSMLLPFFNDVVGFLGALGFWPLTVYFPVEMYVVQKKVPRWSSRWVCLQMLSLGCLVISIAAAAGSIAGIASDLKVYRPFKSY

SEQ ID NO: 79952 - protein, 202 aa, Capsicum annuum
MATEAPPPVDTTEVPPFTAAETAVKQPHKLERKWTFWFDNQSKPKQGAAWGSSLKKAYTFDTVEEFWSLYDQIFKPSKLTVNADFHLFKAGIEPKWEDPECANGGKWTVTSSRKANLETMWLETLMALVGEQFDDSEDICGVVASVRRSQDKLSLWTKTATNEAAQMGIGRKWKEIIDTEKISYSFHDDSKRERSAKSRYTV

SEQ ID NO: 79953 - protein, 501 aa, Kluyveromyces lactis NRRL Y-1140
MESRLGWLTDLSTETGTNLRRTSIICTIGPKTNNPETLVELRKAGMNIVRMNFSHGSYEYHQSVIDNARKSEELYQGRPLAIALDTKGPEIRTGTTTNDVDYPIPPNHEMIFTTDDKYAKACDDKTMYVDYKNITKVIEAGRIIYVDDGVLSFEVLEVIDDNTLKVKSLNAGKICSHKGVNLPGTDVDLPALSEKDKSDLKFGVKNGVHMVFASFIRTAQDVLTIREVLGEQGKDIKIIVKIENQQGVNNFDDILKVTDGVMVARGDLGIEIPAPQVFAVQKKLIAKCNLAGKPVICATQMLESMTYNPRPTRAEVSDVGNAVLDGADCVMLSGETAKGNYPINAVKTMAETALIAEQAIPYIPTYDDLRNLTPKPTSTTETIAAASVSAVFEQKARALIVLSTTGDTPRLVAKYKPNVPIVMVTRNPRAARFSHLYRGVFPFVYDESSDSEWTVDVEKRINFGVKKAKEFGILVDGDTIVTIQGFAAGVGNSNTLRVLTV

SEQ ID NO: 79954 - protein, 182 aa, Brassica rapa subsp. pekinensis
MGILFTRMFSSVFGNKEARILVLGLDNAGKTTILYRLQMGEVVSTIPTIGFNVETVQYNNIKFQVWDLGGQTSIRPYWRCYFPNTQAVIYVVDSSDTDRIGVAKEEFHAILEEEELKGAVVLIFANKQDLPGALDDAAVTEALELHKIKSRQWAIFKTCAVKGEGLFEGLDWLSNTLKSGSG

SEQ ID NO: 79955 - protein, 99 aa, Zea mays
EEFLNGMSFPAPPGIFACPPPGVGFAALFKFRERGVLGRKDRPVVVSTAPGLKFSQWKLDSHASKMGDMACKYSNPPVRVKADFGAVMDVLKKRLKGKF

SEQ ID NO: 79956 - protein, 139 aa, Vitis vinifera
MTLDRSRSPPRAKRLRSSDRASYRDTPYPRHRRVHRQDYLCNKCKRPGHFSRDCPNVTRCNNCGLPGHIAAECNSTTICWNCKESGHLASQFPNDPVCHMCGKMGHLAQDCSCLGLPAHDARLCNNCYKPAPHCYELHQ

SEQ ID NO: 79957 - protein, 489 aa, Dichelobacter nodosus VCS1703A
MSCSQEPFDLLIFGGTGDLAMRKLLPSLFQAHHAGALHENGHIWGISRRALSCEDYRSLVKKNLQIFVPEIAALPEAAIHSFLQRLNFISCDAFQQEDFRLLADAIHFSPEKVLIAYLATSPHIFEHICLNLAAVGLNHQRARIVLEKPLGVDLASNQAINQSVAKFFDESQIYRIDHYQGKESVQNLLMMRFANVLFEPQWRREWIDHVQITIAESVGVGARGAFYDDIGALRDMVQNHLLQLLCMIAMEPPASLSPLAVRNEKLKVLQALKPFTAESVATDVVRGQYAGGVIDGEAVCGFHEELDIAKHSQTETFVALRTEIQNWRWAGVPFFLRTGKRMAKRSAAIVIQFRNVPHHLYPNSVHKMSGNRLVIHLQPEDSVRLHLYAKCPGNTVTLKPVSLDLDFDRHFNERRADAYERLLLDVIQGDQTLFVRRDEQEEAWRWVAPIIEAWEKDPLPPKSYAAGSWGPDAADELLARDGLRWYGEE

SEQ ID NO: 79958 - protein, 420 aa, Oceanicola granulosus HTCC2516
MSTATRDAAPLNGAELECFFCGTRRAPDLLPRCAACGGTLSVAGQGYAAPGADTGIARYRASLPLDGEVVTLGEGGTPLLRLSRLFPDRPVWAKLEFTNPTGSFKDRGSAVAVSAAKALGAEGIVCASTGNNAASVSAYAARAGLPCIVTLGKGTPVAKVLQAKAHGAITVEVAGDFSDAYRMAEEINRADPAWANLTSTYLNPYTTVAHSTILYEVVEEIGAPEAVVVPVGAGPMLDGIVTGARRMQAAGRLETIPRPIGVQGAGCAPIARAFAEGAEEVAAWGEVSGIPGSINDALRGYPEDGTRTLRLIRETAGAAVAVSDDEIRDAMRELGAREGIAAEPASAATLAALRRAPLGELSGPVVLVISGHALKDGPAQPAAADPSIELDTDTGPLEVIERARSRFNANEQAVQGPPDA

SEQ ID NO: 79959 - protein, 266 aa, Oryza sativa Japonica Group
MEWRDSFLDLILIPLSLLVPMAYHVWLWRAVRLTPLRTAAGINSATRRLWAISMTKDNEKKAVLVVQSLRNVIMGSTLVATTAILFCTGIAAVLSSTYTIKKPLSDAVFGAHGEYMMALKYVALLLLFLVAFLSHSLAICFLNEASFLINTSPTLLAGGDGAGDDGGRRLLGLPSTRDYMEEALEKGFTLNFVGNRIFFAGVPLLLWIFGPLLAFLSSLVMIPILYNLDVVNVKSHRGGDCGCGCGNGKSSVDKNGAAAAMDCTLV

SEQ ID NO: 79960 - protein, 267 aa, Dichelobacter nodosus VCS1703A
MHPMLTIARRAAEEAGKVVKRGYRDASRLHFREKRIDFARAVNQSAEQAIRQILNEKYPDYDIIGQEYDDQSVQTTESEYQWLITAIDGGENFLRGLPHFAVSIAASKQGKLEIGLVYNPLTEDWFLAARGQGSQLNGQRIRTNTIREPTRAMIATHFTASDYSSESARTHSVLQNISELRCLGAASLDLCFVACGRLDGYFASKLNNWDIAAAVLIAQESGVIVSDYEGNNAMLETGTVIAANAQLHPSLKKMIHETQITATAAEN

SEQ ID NO: 79961 - protein, 466 aa, Herminiimonas arsenicoxydans
MADGKIVQCIGAVVDVEFPRNAMPKIYDALKMAGSELTLEVQQQLGDGIVRTIALGTSDGLRRGMIIQNTGNPITVPVGKATLGRIMDVLGNPIDECGPVSHERTASIHRKAPAYDELSPSQDLLETGIKVIDLVCPFAKGGKVGLFGGAGVGKTVNMMELINNIAKAHSGLSVFAGVGERTREGNDFYHEMADAKVVDLENPENSKVAMVYGQMNEPPGNRLRVALTGLTMAEAFRDEGKDVLFFVDNIYRFTLAGTEVSALLGRMPSAVGYQPTLAEEMGRLQERITSTKTGSITSIQAVYVPADDLTDPSPATTFAHLDSTVVLSRDIASLGIYPAVDPLDSTSRQLDPLVVGQDHYDTARAVQGTLQRYKELRDIIAILGMDELAPEDKLLVARARKMQRFLSQPFHVAEVFTGAPGKYVSLKDTINGFKMIASGELDHLPEQAFYMVGTIEEAIEKAKKLN

SEQ ID NO: 79962 - protein, 132 aa, Zea mays
RPLEPAGGTSLSRDTTIHLSPPTSLSLAKMSTVTRAYLDQRLAAANRCSKEAAMAGAKAAAVATVAAAVPTLASVRMLPWAKAHLNPTGQALIISTVAGMAYFIVADKTILSMARKHSFDDAPDHLKNTSFH

SEQ ID NO: 79963 - protein, 295 aa, Mycobacterium avium 104
MTPSTEALPTAVKAQVLAEALPWLKQLHGKIVVIKYGGNAMTDDTLRRAFAADMAFLRNCGIHPVVVHGGGPQITAMLRRLGIPGDFKGGFRVTTPEVLDVARMVLFGQVGRELVNLINAHGPYAVGITGEDAQLFTAVRRSVTVDGVTTDIGLVGDVERVNAAAVLDLIAARRIPVVSTLAPDAEGVVHNINADTAAAALAEALGAEKLLMLTDVEGLYTSWPNRDSLVSEIDTATLSQLLPTLEAGMIPKVEACLRAVSAGVPSAHVIDGRVEHCVLVELFTDAGTGTKVVSS

SEQ ID NO: 79964 - protein, 133 aa, Brassica napus
KAKPDPEIKKYIEKARSVSGVSLDPKLAKLTEKEIIEMTFFPVVNEACRVFAEGIAVKAADLDIAGIMGMGFPPYRGGIMFWADSVGSKYIYSKLDEWSKTYGDFFKPCAFLAERGSKGAPLSAPLEQSRSRL

SEQ ID NO: 79965 - protein, 319 aa, Geobacillus stearothermophilus
GLVVGYGLCSAYRSRGAAEAASPRANDAPIVLLHGFTGWGREEMLGFKYWGGVRGDIEQWLNDNGYRTYTLAVGPLSSNWDRACEAYAQLVGGTVDYGAAHAAKHGHARFGRPYPGLLAGIERRKPASIQSVHRPREGRRAGMLGFRSLGETGGQRRGGEYAQGSHNRGRLVGPFVLRGGHPFLCRAVTDHSQTPSGREPTPCKHGLISPDPLFLTCQKGGAWKRRLVRQPTAPYHKRNYTILSLGPMGGLRREPRRIRSTIYFGTAQAPPLSGHRTRYPPRYDLIRSRGLRRGIRLGESQPNTYYLELFYPNGRIEEL

SEQ ID NO: 79966 - protein, 181 aa, Zea mays
  misc_feature (8)..(8): Xaa can be any naturally occurring amino acid
MSSRSPPXDRRMRTERTLYRDAPYRRDRDGRRGPNRSASDLCNNCKRPGHFARDCPNVSVCHACGLPGHIAAECSSKDLCWNCKEPGHMANACPNEGICRNCGKSGHIAKDCTAPPMLPGEVKLCNNCYKPGHIAVECTNEKACNNCRKSGHLARNCTNEPVCNLCHVAGHLARQCPKSDE

SEQ ID NO: 79967 - protein, 458 aa, Oceanicola granulosus HTCC2516
MPARSPASGQPIGTLPRSSREDAQRAVAAARDAQAGWAEVSVWERADACLRIAAELEARRERVADMLVLEQGKPRAEAEGEVGAAVAGFRLAAEEVRQLGGETIPTEDGGKLALTIRQPRGVFAVVTPWNFPINIPVEYLGPAIASGCAVVWTPAPTTAFCAIELAEAIEAAGLPAGVVNLVIGEGPVVGDEIVSHPGTDGIGFTGSTATGQRIAERGAGKQMLLELGGNGPVIVFDDADLDRAAEAAAAAAFLNAGQVCSATERVLVHRDVVDAFADKVARIAKAKVLGDPAARETQMGPLNNAQVAQKTREHVEDALNHGATLLAGGRSRDDLGSELFYEPTVLTGVTADMRINREETFGPVVPILAFDSDDEALALALDNDYGLTSSVFTRDLGRALRFGKSLRSGIVNVNEAPSYWELHLPFGGGAGRKSGTGRIGGRHTLEAMTVIKTIVLQA

SEQ ID NO: 79968 - protein, 246 aa, Dichelobacter nodosus VCS1703A
MKKLVLVRHGQSQWNLENLFTGWTDVDLTEQGQKEAATAAQLLQKEGIFFQTAFTSYLKRAIKTLNIILDVMDLDWIDVHKTWRLNEKHYGALQGLNKKETAAQYGQEQVLLWRRSFDTAPAALEYSDARAPHNDRRYQRVARQDLPLTESLKDTIARIMPYWEVVIKPVLIAENTVLIVAHGNSLRAIIKHLKGISETEITDLNLPTGIPYVFEFDDDMNLCADYFLGDTEAIKKLQESVAKQSQ

SEQ ID NO: 79969 - protein, 367 aa, Glycine max
MDLVSRRYLIYVSQHGSQPQALSPITSPGSSIFHPHQHASSTSFPIIAIAIIGIMATAFLLVSYYIFVIKCCLNWHRIDVLRRFSPSRRREDPPPTYSPATDTRGLDEALIRLIPVTQYKAQQGDDRDFGERRFCECAVCLNEFQEDEKLRVIPNCSHVFHIDCIDVWLQSNANCPLCRTSISLTSRFHIDQLLTLRPSSSSYPHDQTPPRENLIGGDEDFVVIELGSDHDRSQNLQERGNALELPTCPISPSSPRKLLEHRNVQKKKAMKLQKVTSMGDECIDIRAKDDQFFSVQPIRRSFSMDSSGDRRFYLAVQEALRNQNWQVNEVNSIEGCSGIGSRAKRSFFSFGHGSRSRSSVQPVSLDP

SEQ ID NO: 79970 - protein, 161 aa, Oryza sativa Japonica Group
MGGWAAEQASEAGCPTSGGGGSACAATGIPKMVYNCAGDETLDWGRGGAAMVGAGLAGVVVAAVVAVVIDTAIATALSESKPVYISVGCNLAGLSHPTFSREPVPLFISPRLSNKANLEYAVEAAADFLNKAVKPMMVGGPKFRVAKAKKAFAGIAESSGY

SEQ ID NO: 79971 - protein, 159 aa, Desulfovibrio vulgaris subsp. vulgaris str. Hildenborough
MKNTLSVLVRNQVGVVAQATEVFRQHNVNLNSISCAETEAFDVSRLMLTVEGQEHLFDAVKADLASKDFVLEVEDLSARDLVDRELALVKVAVTRETTTQVMQVCEVFRATVVGMGQETMTLEITGDMRKVDGFIRLLRPFGIRSLARTGSVALARGDD

SEQ ID NO: 79972 - protein, 391 aa, Oryza sativa Japonica Group
MGLHDAPSRGGAGGGKLSLLASVGLAGAGGGGSGGVGGGGGGGGGGGGYKELLVMALPKDDDLDAGKVADVLGFRLPDVEGAVRAFFRSREVREFASGALAGAMSKAVLAPLETIRTRMVVGVGSRHIGGSFVEIIEQNGWQGLWAGNTINMIRIIPTQAIELGTFECVKRTMAEAQEKWKEDGCPKIQIGKVKIEFPLQFLSPVAVAGAAAGIAGTLVCHPLEVIKDRLTINREVYPSISVTFSKIYRTDGIRGLYAGLCPTLIGMLPYSTCYYFMYDTIKTSYCRLHKKTSLTRPELLVIGALSGLTASTISFPLEVARKRLMVGALQGKCPPHMIAALAEVIQEEGLPGLYRGWGASCLKVMPNSGITWMFYEACKDILLADKDKRKA

SEQ ID NO: 79973 - protein, 607 aa, Rhodospirillum rubrum ATCC 11170
MKSDAPSDRPSVDRPPTLPPRALRLSGLGVGPGICVGTVHLHEIGSVPVPEYKIPAARVEDECARLAEAAEQGSRQLGMLRGRARELPGGAGEELGYLLDAYQNMLKGSRLLRGVESRIINEKINAEAAIRNEMDAMADVFSAMQDSYLASRIEDVKDVGWRLIRVLTKAAYRPFTLLPRNAVIVAGELSPADTALLDPKQVAGMALSSGGADSHTAIMARSLGLPAVLAIADLMRHVRSGDIICLDGRTGEVVIDPDRETLADFRKRRADFLRGRRNLGRLRDLPAETRDGARVRLMANVELPAEVESARQSGAEGIGLLRSEFMFMNRTVLPDEEEQYHFLRGMVAGMAGRPVTVRTLDVGGDKLSDALGLRDCANPALGLRAIRLSLSRPELLEIQLAAILRAGVHGPVRILLPMISTVEELDAVREIHAKVVARLRQRGVPLPEPLPPLGVMIEVPGAALSADALAWRCDFFAIGTNDLTQYTLAIDRSDESVAHLYNPLHPAVLRLIQFTVEAAERAGIPVSVCGEMAGDPRLAAVLVGLGVTELSMSAANIPRVKQNIRRLSMIDVARQIQAIMAINDAPRIAALADALLIESDRVSEKLA

SEQ ID NO: 79974 - protein, 410 aa, Debaryomyces hansenii CBS767
MNFLRNRRTSDSDDDDNDELNNNNVSSIHKSRKPPNTAFRQQRLKAWQPLLTPKSVIPLLLILTVIFAPLGIAIINTVYNVEVLSIDYSHCNSLHSDDFKSVPGKYTSHHFKKKNDDPEFQWKVVNSTDKFDDLKQTCLIRFNLPKDIKPPVYLYYKLTNFFQNHRKYVESYDLEQLKGIAVTRGDLSDGCKPLRFIDDKIVYPCGLISNSYFNDTISSPVLLNARSGSNNETYELTDEEISWSSDRNHKYKKTKYDPKDIVPPPNWYKMYPDGYTQDNLPDLATWEHLQNWMRTAGLATFYKLYGKNETETLSSGTYEISIEMNYPVSIFGGTKTMVITTNSIFGGRNMSLGVIYIIVAVICLVLGIAFLLQHLIKPRRIGDHNFLQNNSAAPRDGPRLGNPTNFREQL

SEQ ID NO: 79975 - protein, 470 aa, Vibrio parahaemolyticus RIMD 2210633
MNAIAEVDVDNSLQQSLDRLKAAYVAEPYPSLDERKQRLIMLKQALIANKQALVEALSDDFGYRSEFDTAMTDVLPTVSHINYTLKRLKKWCKPSKRESGLLLAPSKVTVQYQPLGVVGIISPWNFPVILSLAPLVTALAAGNRVMMKLSEFTPKTNKVIVNICHELSEYVEVFEGEADVAQAFSQLPFDHLLFTGSTNVGRAVAKAAAENLTPVTLELGGKSPVIITEDADMKKTVDAILFGKCINAGQICVAPDYAFVPQERIEEFITLFLKRFEKLYLKSNKNQKLTHIINQRQYERLTALLEDAKTQGASLHTVEASPQEERLLYPHLVTNVSADMRIMQEEIFGPLLPIKPYKSLEEAIDYINQHQRPLALYVMSDDKSTIKHIVRNTHSGGVGINDTVLHVGAEDAPFGGIGQSGIGHYHGVEGFRTFSHAKTVLHTPKWLPRTGALMRRRAMAIKAIQKIFVR

SEQ ID NO: 79976 - protein, 467 aa, Vibrio parahaemolyticus RIMD 2210633
MNSSQMKMILLVAIGCILWFIPTPEGLTDQAWQMMAIFVTTVLSLILAPLPLGAMALMGLTLATLLGVLPIKTALTGFAHPTIWMIAAAFFISRGFITTGFGRRVGYWFISKLGHNSLGLAYGLVLTDLLFAPATPSTTARCGGIISPLFRSVASAYDSDPEKGTENRIGAFLVQCIFQCNAITCAMFLTSMAGNPLAANFAKEQGVEITWAGWATAAIVPGLLCLFLIPLVMYMVFPPELKKTPEMREIARQKLAEMGKMTRDELMVCITFIGMVSLWVLGPTLGIHATVTALLGLVFLLLTHTITWDAVLGEKEAWHTITWFAVLVMMAAQLNKLGFISWFSESMAESLSGFGWVTTIVVLLLVYYYSHYLMASAMAHISAMYSAFLAIAISAGAPPMLAAIVLGIFSNLYMSTTHYSSGPAPILFGAGFHTLQNWWKIGFIFSLIVIPIFVFVGGAWWKLLGLW

SEQ ID NO: 79977 - protein, 364 aa, Zea mays
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDARFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAWAIEFIK

SEQ ID NO: 79978 - protein, 358 aa, Sinorhizobium meliloti 1021
MARFYPLQVTEVRRDTRDAVVVTLEPREEDRAAFDFTQGQYLTFRRLFGGEELRRSYSICAGLDEGALKVGIKRVDDGCFSSWANEELEPGDTLEAMPPMGAFFTPIEPEAAKHYLGFAGGSGITPVLSLVKTVLAREPRSAFTLVYANRHFSSIMFREELDDLKNLYLGRLSVLHVLESEAQEIDLFSGRLDREKCTALFRSWIDVRSADTAFICGPEPMMLGVAAALRAHGLGDDRIKFELFAASQPGRARRKVESAAGADSRARCEATVTLDGATRSFTFPKEGLSLLEAALENRMDAPFACKAGVCSSCRAKVLEGEVEMESNNALEDYEVEQGYVLTCQSYPLSDRIVVSYDQ

SEQ ID NO: 79979 - protein, 79 aa, Vitis vinifera
MARLKQAKEEAEKEIAAYRAQVELEFQKKLAESSGDSGANVKRLEQETQAKIHHLKTEAGRISHDVVHMLLKHVTTVKN

SEQ ID NO: 79980 - protein, 96 aa, Retama raetam
GRVRCSMEEKPSVQESSPSMGVGASLMAAACAAATMSSPAMALVDERLSTEGTGLPFGLSNNLLGWILFVVFGLIWTFYFIYASSLEEDEESGLSL

SEQ ID NO: 79981 - protein, 506 aa, Herminiimonas arsenicoxydans
MKNSAVSTIEHYINGNLTNTVGGGQQPVFNPATGEISANVVLASDADVQTAVAAAKAAAPAWAEMAPLKRARILFKFKDLIERHHNDLAAAITREHGKVFSDAKGEVTRGLEVVEFACGVPQLLKTQFSDNIGGGIDNWNLRQPLGVTAGITPFNFPFMVPMWMAPVALATGNTFILKPSERDPSPSLMVAELLHQAGLPDGVFNVLQGDKRAVDGLLQHPDIKAVSFVGSTPIAEYIYQAGAARKGSYPLRVQALGGAKNHLVVMPDANLEQAVDALIGAAYGSAGERCMAISVAVAVGSVADKLVAALIPRVKSLKVKNGMESDAEMGPVVSAAHKAKIEGYIEAGIKSGAKLLVDGRGLTVDGHSNGFFLGGCLFDNVTPEMTIYQEEIFGPVLCVVRVPDFSAALDLINAHEFGNGVALFTSDGNTAREFSRRVEIGMVGINVPIPVPMAWHSFGGWKRSMFGDTHAYGEEGIKFYTRYKSIMQRWPESISKGAEFAMPTSK

SEQ ID NO: 79982 - protein, 399 aa, Opitutaceae bacterium TAV2
MASAGLNSASRESGTSANWRFHAREITLSSNLNPQSSTRHPFPIHDTMNFAVIGAGAWGTAFAIHLARLNHTVTLVPRRFEQALALASARENADYLPGIPLPASLQIGHELTPVLMEAEVIVVACPSQALRQTCENIRANLGLATQMKLVVSLAKGLELSTHKRPSEVINEVLPGVIASSLTGPTNAAEVARGKPAAMVFAAALPSAPAALDGDASPPPPLPPPLTEYLKTVQAALSGPTLRVYLGSDIAGVEFGGCLKNIYAIAAGCCDGLRLGDNAKAALLTRALTEMVRVGVALGAQRDTFYGLGGFGDLVATCTGGWSRNRTFGQRLGEGQSAADLIAASKSVVEGYRTTESFYELCQKRGIEAPILTEVHRILYGGRPASDALMALMTRELKHE

SEQ ID NO: 79983 - protein, 187 aa, Brassica napus
  misc_feature (27)..(27): Xaa can be any naturally occurring amino acid
GFPKSVCTSVNECMFHGVPDSRQLQDXDIINIDVAVYLDGYHGDTSKTFLCGDVDESLIQLVKVTEQCLEKGISVCRDGASFKEIGKIISEHAEKHGYNMERFIGHGVGTVLHSEPLIYLHKNYDFEIGYMIEGQTFTLEPILTIGTTEFVTWPDKWTILTADGGPSAQFEHTILITESGAEILTTS

SEQ ID NO: 79984 - protein, 309 aa, Arabidopsis thaliana
MEKYEKLEKVGEGTYGKVYKAMEKGTGKLVALKKTRLEMDEEGIPPTALREISLLQMLSTSIYVVRLLCVEHVHQPSTKSQSTKSNLYLVFEYLDTDLKKFIDSYRKGPNPKPLEPFLIQKLMFQLCKGVAHCHSHGVLHRDLKPQNLLLVKDKELLKIADLGLGRAFTVPLKSYTHEIVTLWYRAPEVLLGSTHYSTGVDMWSVGCIFAEMVRRQALFPGDSEFQQLLHIFRLLGTPTEQQWPGVSTLRDWHVYPKWEPQDLTLAVPSLSPQGVDLLTKMLKYNPAERISAKTALDHPYFDSLDKSQF

SEQ ID NO: 79985 - protein, 196 aa, Acer saccharum
VTGLLDPPELIKPPKILVIEGLHPMYDERVRDLLDFSIYLDISNEVKFAWKIQRDMAERGHSLESIKASIEARKPDFDAYIDPQKQYADTVIEVLPTELIPDDNEGKVLRVKLIMKEGVKHFSPVYLFDEGSTISWIPCGRKLTCSYPGIKFAYGPDTYFDHEVSVLEMDGQFDRLDELIYVESHLSNISTKFYGE

SEQ ID NO: 79986 - protein, 288 aa, Oryza sativa Japonica Group
MEGKEEDVRLGANRYTERQPIGTAAQGAEEKDYREPPAAPVFEVEELTSWSFYRAGIAEFVATFLFLYISILTVMGVNKSASKCATVGIQGIAWSFGGMIFALVYCTAGISGGHINPAVTFGLFLARKLSLTRAVFYMAMQCLGAICGAGVVKGFQRGLYMGSGGGANAVNPGYTKGDGLGAEIVGTFVLVYTVFSATDAKRNARDSHVPILAPLPIGFAVFLVHLATIPITGTGINPARSLGAAIVYNRAHAWHDHWIFWVGPFIGAALAAIYHVVVIRAIPFKSRD

SEQ ID NO: 79987 - protein, 327 aa, Erwinia chrysanthemi
HGRAIGAEGTAVGEVVFNTSMTGYQEILTDPSYSRQIVTLTYPHIGNVGANKADEESPTVHAQGLVIRDLPLIASNYRSEESLSDYLKRNNIVAIADIDTRKLTRLLREKGAQNGCIIAGDAPDAALALEKAKAFPGLKGMDLAKEVTTRSSYSWLQGSWTLEGELPAAKEESELPYHVVAYDYGVKRNILRMLVDRGCRLTVVPAQTPAEAVLKLNPDGIFLSNGPGDPEPCDYAINAIKAFLETDIPVFGICLGHQLLALASGAKTVKMKFGHHGGNHPVKDLDGNRVMITAQNHGFAVDETSLPATLRATHKSLFDGSLQGIHR

SEQ ID NO: 79988 - protein, 352 aa, Haemophilus somnus 129PT
MSINFVKEGNIMSKYVRSVCLVEPKKVDIKTVLYPKKGECDVLIKVESIGICGSDIGAFRGTNPLVTYPRILGHEIVGTVIESGVGMPKNINIGDRVILEPYIYCGHCYPCSISRTNCCEALKVLGVHIDGAMQEIVRHPAHMLIKAPDIPIHELALAEPLTISLHAIRRTKVKAGEHVAIIGAGAIGLMAALVAKAYGATPILIDILDKRLDYAKSIGIPNIINPAKENDLEAIKSITNGRMAEVVIEASGANIAVQNTLKYTSFAGRIALTGWPKNETPLPTNLITFKELNIYGARTSKGEFEEALKLLESRKIEPKNIISKVITFDEIPHYIEELSENPDDYLKIIAVF

SEQ ID NO: 79989 - protein, 559 aa, Zea mays
MGSSGFSWTLPDHPKLPKGKSVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFESGTLHLIGLLSDGGVHSRLDQLQLLLKGVSERGAKKIRVHILTDGRDVLDGSSIGFVETLENDLLELRAKGVDAQIASGGGRMYVTMDRYENDWDVVKRGWDAQVLGEAPYKFKSALEAVKTLRAQPKANDQYLPPFVIVDDSGNAVGPVLDGDAVVTINFRADRMVMLAKALEYADFDNFDRVRVPKIRYAGMLQYDGELKLPSRYLVSPPEIDRTSGEYLVKNGIRTFACSETVKFGHVTFFWNGNRSGYFDATKEEYVEVPSDSGITFNVAPNMKALEIAEKARDALLSGKFDQVRVNLPNGDMVGHTGDIEATVVACKAADEAVKIILDAVEQVGGIYLVTADHGNAEDMVKRNKSGKPLLDKNDRIQILTSHTLQPVPVAIGGPGLHPGVKFRNDIQTPGLANVAATVMNLHGFEAPADYEQTLIEVADN

SEQ ID NO: 79990 - protein, 327 aa, Dickeya paradisiaca
HGRAIGAEGAAVGEVVFNTSMTGYQEILTDPSYSRQIVTLTYPHIGNVGANNADEESPAIHAQGLVIRDLPLIASNYRSEESLSDYLKRHNIVAIADIDTRKLTRLLREKGAQNGCIIAGDAPDAALALEKAKAFPGLKGMDLAKEVTTRESYPWLQGSWTLQGELPPAKAEDELPFHVVAYDYGVKRNILRMLVDRGCRLTVVPATTPADDVLKLNPDGIFLSNGPGDPEPCDYAIAAIKAFLATDIPVFGICLGHQLLALASGAKTVKMKFGHHGGNHPVKDLDGNRVMITAQNHGFAVDETSLPATLRATHKSLFDGSLQGLHR

SEQ ID NO: 79991 - protein, 71 aa, Brassica napus
  misc_feature (10)..(10): Xaa can be any naturally occurring amino acid
  misc_feature (14)..(14): Xaa can be any naturally occurring amino acid
  misc_feature (18)..(19): Xaa can be any naturally occurring amino acid
  misc_feature (28)..(28): Xaa can be any naturally occurring amino acid
  misc_feature (31)..(33): Xaa can be any naturally occurring amino acid
  misc_feature (35)..(35): Xaa can be any naturally occurring amino acid
  misc_feature (38)..(38): Xaa can be any naturally occurring amino acid
  misc_feature (40)..(41): Xaa can be any naturally occurring amino acid
  misc_feature (44)..(44): Xaa can be any naturally occurring amino acid
  misc_feature (48)..(49): Xaa can be any naturally occurring amino acid
  misc_feature (51)..(51): Xaa can be any naturally occurring amino acid
  misc_feature (53)..(53): Xaa can be any naturally occurring amino acid
  misc_feature (58)..(62): Xaa can be any naturally occurring amino acid
  misc_feature (64)..(65): Xaa can be any naturally occurring amino acid
  misc_feature (69)..(69): Xaa can be any naturally occurring amino acid
MVKICCIGAXYVGXPTMXXIALKCPHVXVPXXXIXAPXIXXWNXDQLXXYXPXLEDIXXXXXGXXLFFXTD

SEQ ID NO: 79992 - protein, 327 aa, Yersinia enterocolitica
HGRAIGAEGTAVGEVVFNTSMTGYQEILTDPSYSRQIVTLTYPHIGNVGTNASDEESSAVHAQGLVIRDLPLIASNYRNEEGLSEYLKRHNIVAIADIDTRKLTRLLREKGAQNGCIIVGDLSDAALALEKAKAFPGLKGMDLAKEVTTKEVYQWLQGSWTLEGDLPAAKQPEDLPFHVVAYDYGVKRNILRMLVDRGCRLTIVPAQTPAEDVLKLNPDGIFLSNGPGDPEPCDYAIAAIKRFLETDIPVFGICLGHQLLALASGAKTVKMKFGHHGGNHPVKDLDANCVMITAQNHGFAVDETTLPSNLRTTHVSLFDGSLQGIHR

SEQ ID NO: 79993 - protein, 517 aa, Arabidopsis thaliana
MISPVEHDPQGQVKQQQAAGVGILLQIMMLVLSFVLGHVLRRHRFHYLPEASGSLLIGLIVGILANISDTETSIRTWFNFHEEFFFLFLLPPIIFQSGFSLQPKPFFSNFGAIVTFAIIGTFVASVVTGGLVYLGGSMYLMYKLPFVECLMFGALISATDPVTVLSIFQDVGTDVNLYALVFGESVLNDAMAISLYRTMSLVNRQSSSGEHFFMVVIRFFETFAGSMSAGVGVGFTSALLFKYAGLDTENLQNLECCLFVLFPYFSYMLAEGVGLSGIVSILFTGIVMKRYTFSNLSEASQSFVSSFFHLISSLAETFTFIYMGFDIAMEQHSWSHVGFILFSILFIGVARAVNVFGCAYLVNLFRQENQKIPMKHQKALWYSGLRGAMAFALALQSLHDLPEGHGQIIFTATTTIVVVTVLLIGGSTGKMLEALEVVGDDLDDSMSEGFEESDHQYVPPPFSIGASSDEDTSSSGSRFKMKLKEFHKTTTSFTALDKNFLTPFFTTNSGDGDGDGE

SEQ ID NO: 79994 - protein, 313 aa, Bordetella petrii
MTPPTHQTGPLRHFLQFRDFSPAEIAYVLERARLIKDKFKRYEPHMPLHDRTLAMVFEKASTRTRVSFEAGMYQMGGSVINLTSNDSQLGRSEPIEDTARVISRMVDIVMIRTFEQTRIERFASHSRVPVINGLTNEFHPCQILADIFTYIEHRGPIAGKTVAWIGDANNMSYTWLQAAEMLGFSLHVSTPRGYELDPARVGTPPAGVLRQFDDPIEACRGAHLVTTDVWTSMGYEAENDARRAAFADWCVDAEMMAAADPQAVFMHCLPAHRGEEVTGEVIDGPQSVVWDEAENRLHVQKALMEFLLLGRID

SEQ ID NO: 79995 - protein, 611 aa, Lactobacillus reuteri
MSYQALYRVWRPQRFDDLVGQQIVTRTLKNAIITHQISHAYLFAGPRGTGKTSAAKIFAKAVNCHHSKDGEPCNECEICKAITNGQLNDVIEIDAASNNGVEEIRDIRDKAKYAPTQADYKVYIIDEVHMLSTGAFNALLKTLEEPPANVIFILATTEPHKIPLTIISRVQRFDFRRISAEDAFNRMKYILDQKEVTYDEKALWVIANAAEGGMRDALSILDQVLSFSDNEVKLDDALLVTGSVTKQLLKKYFLEISKHEGATALDTMKDILDEGKDGQRFIEDLISFIRDILLYQESPSLISVESTGLKQEDFEEIVQLASSAPLYQMIDELNNIQEEMRFTTHPDVYLEVLTIKLAQIEPQKNIQSAPAVSSDTNTEATKTIEKLQQEIQQLQQTVKQLQNVPAKASRPSPRQQNEQPRVQQKKVQVNLNKIYPVLENATRQDLINVRELWGDMLNLLSVPQRSLLHVSQPVAASAVGIIVAFDYPFLFQQAADDTTLLENMESALQRLTGNERQVVFVPKDKWPKIRQDFIKDHGFGKNQQKSQPIKQKPQTTEESGQTHAATPAPMEEPPLPPEDETLTEEKSPQEDNQVATAQKLFGSDIVKVEDN

SEQ ID NO: 79996 - protein, 580 aa, Yarrowia lipolytica CLIB122
MVSFKDSPVKGAMSSVEQKLQSLRMPQSPMRGGTSPPRSPLRHEAGSCDPDETTAIISNIESLNIGRPTDKENWAPQQQGHHGSQVTANTHSPSWTSRDYEKFNDPQTKRLVNVTQLYFFDYYFDLLTYVHGRQQRLGKAKAALGGVPQAEAETQWKSYVGRERAHLRKRRTRLKHGDFQILTQVGQGGYGQVFLAKKADTREICALKVLNKKLLLKLDEIRHILTERDILTAARSEWLVKLLYAFQDQESVYLAMEFVPGGDYRTLLNNTGILNPRHARFYISEMFASLEALHKLGYIHRDLKPENFLIDSAGHIKLTDFGLASGAISKDRVESMKIRLDAVKDVQVTHRSLTERQKMYRSLRASDINYASSIVGSPDYMALEVLEGKNYDYTIDYWSLGCMLFETLAGYPPFAGASPDETYSNLRQWKNALRRPKYDDGRYVFSDRTWDLIQRLITSARYRLRSFDEIAKHPYFAEVEWETLREKTPPFIPQLDSDVDAGYFDDFSNEADMEKYQEVMAKRTQVENLADKGNPIPHRAFVGFTFRHSRNPNNNILEETNKGNTHSRREVGRSNFGTMF

SEQ ID NO: 79997 - protein, 489 aa, Vitis vinifera
  misc_feature (229)..(229): Xaa can be any naturally occurring amino acid
MVLSKTASESDVSVHSTFASRYVKASLPRFKLPENSIPKEAAYQIINDELMLDGNPRLNLASFVTTWMEPECDKLMMAAINKNYVDMDEYPNRCVNIIAHLFNAPLEDSEAAVGVGTVGSSEAIMLAGLAFKRKWQNKRKAEGKPYDKPNIVTGANVQVCWEKFARYFEVELKEVKLRDGYYVMDPEKAVEMVDENTICVAAILGSTLNGEFEDVKLLNDLLVEKNKQXGWDTPIHVDAASGGFIAPFLYPELEWDFRLPLVKSINVSGHKYGLVYAGIGWVVWRSKEDLPEELIFHINYLGADQPTFTLNFSKGSSQVIAQYYQLIRLGFEGYRNVMENCQENAMALKEGLEKTGRFNIISKDNGVPLVAFSLKDNSCHDEFEVADMLRRFGWIVPAYTMPPDAQHVTVLRVVVREDFSRTLAERLVFDITKVLHELDMLPAKLSAKISVEEKKQNGTILKKSVIETQREITDAWKKFVMAKKTNGVC

SEQ ID NO: 79998 - protein, 150 aa, Shigella sonnei
VVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGAMHCLENPGKIPLDLIEVRSGSYLEEDDVVRFADRYGRV

SEQ ID NO: 79999 - protein, 331 aa, Dichelobacter nodosus VCS1703A
MHTIAVLGAGSWGTALALQLARNQHRVFLWGHRAAHIEQLIADGANHKYLPDVFFPKNLIPTADLAAAVASAEMVLAVVPSVGFAGLLSDLKPLLGKKPFMWAIKGFEQGSGRLLSDVFTEHFGKHHAHAILAGPSFAREVAAGKPTAVTIAAAHKNDAPAFAEPFHSSNFLCYTSDDLIGAQIGGAVKNVIAIAVGIADGLRCGANTRAALITRGLQEMTRLATALGAQAQTLSGLTGLGDLVLTATDDQSRNRRFGLALGQGKTALEAKALIGQVIEGEGAAHDTWALACRYQVRMPITQYMHQFLNGEIDIQTAVMHLSNRDLKAESA

SEQ ID NO: 80000 - protein, 239 aa, Vitis vinifera
MEKLMTHILLCSFFIVLVLHACPAISQEVEDEKEFDYEKGSDKGPDKWGEIHEEWSTCKHGNMQSPIDLLHERVQVVSHLGRLQRSYKPSQATLKNRGHDMKLSWEGDAGSIQINGTKFDLELHMLHETPSGKTAVVGIMYKIGRADSFLSTLTDHLEALSDSSDQERDVGVVDPRHIKIGSRKYYRYMGSLTTPPCTEDVIWTIVNKVRTVTREQVNLLRVAVHDDINIHVIVLFPCD

SEQ ID NO: 80001 - protein, 163 aa, Schizosaccharomyces pombe 972h-
MSSPGISDESIKGPKDVRLIHLILSSLGVPSYSQTVPLQLLTFAHRYTQQLIQDSQVYAEHSRGQNAPISVEDVRLAVASQINHSFTGPPPKEFLLELAMERNRKPLPQIQPSYGFRLPPEKYCLTQPNWIVSNETQQNQPKEENSSDSRMEEDKLDFSVKSE

SEQ ID NO: 80002 - protein, 488 aa, Streptomyces avermitilis MA-4680
MPDLFIDGEWVRGATGTTREVVNPFDATVVRSVDEGDATDVDRAVTAARRAFHAADWAAAPTQRRADVLFRVAEYLLRDIEEIARDETLNTGKTLAEARIDVKDVSNAFRYFAEMAGKDAGRVVDAGPDVLSRVVHEPVGVCALIAPWNYPLLQASWKVAPALAAGNTFVLKPSEITPLTTIAMMRLIEEAGAPPGVANLVLGAGATVGSAMTVHPEVDLVSFTGGLGTGRRIMESAAREVKNIALELGGKNPNVVFDDADFEAAVDHTLDASFLHSGQVCSAGSRLLVQDSWHDRFVRELADRASRIRLGNGLDPHTESGPLSSAEHRAKVEKYIDLGRSEGARLVTGGRRPDDPDLAHGFFLLPTIFDDCDRSMRIVQEEVFGPVVTVETFRTEDEAVELANDTRYGLAAGVWTGEASRAQRVAARLRHGTVWINDFHPYLPQAEWGGYGQSGVGRELGPTGLREYQEIKHIYQNLSPGPSGWFKG

SEQ ID NO: 80003 - protein, 337 aa, Bradyrhizobium sp. BTAi1
MKSTRPAPDLSKPRLTTSAMIASIASEGQRTRPAPFGHALVELARRRPDVLGMTADLGKYTDLHIFAKEFPERYYQMGMAEQLLFGAASGLAAEGFMPFATTYAVFASRRAYDFIHQTIAEEDRNVKIVCALPGLTSGYGPSHQAAEDLALMRAMPNMTVIDPCDAHEIEQVVPAMAAHQGPVYMRLLRGQVPLVLDEYDYTFELGKAKLLRDGRDVLMISSGLMTMRALEAAKALSDDRVDVAVLHVPTIKPLDAETIRREAGRSGRLVVVAENHTVIGGLGEAVAGLLMRAGVHVPFRQIGLPDAFLDAGALPTLHDRYGISLSEVAKQVKAWLK

SEQ ID NO: 80004 - protein, 242 aa, Fagus sylvatica
STFAAAPLVPIIRDNLNLTKADIGNAGVASVSGSIFSRLAMGAICDLLGPRYGCAFLIMLSAPTVFCMSFVSNAGGYIAVRFMIGFSLATFVSCQYWMSTTFNSKIIGLVNGTAAGWSNMGGGATQLLMPLLYDLIQRAGATPFTAWRIAFFIPGWLHVIMGILVLILGQDLPDGNLSTLQKKGDVAVDKFSRVLWYAVTNYRTWIFVLLYGYSMGVELSIDNVIAEYFYDRFNLKLHTAGL

SEQ ID NO: 80005 - protein, 230 aa, Desulfovibrio vulgaris subsp. vulgaris str. Hildenborough
MACTAGVWPERYLRNTRLLSCAEQVRLLGARVLLVGLGGLGGHVLDMLLRMGVGTIVGCDGDVFEESNLNRQLLSGVDRVGMPKAEAARLHAQAVNPAVIFEPVCTFLRGVDMHRHAKGADVVVDALGGLDDRMALRDAARAAGVPLVTAGVAGLSGWVATVAPEGTAPADLFGQGRAAEDVLGNFAPTVGLAASLQCVQVMQVLTGRSAPAGMLLFDLSDQTFVSLPLA

SEQ ID NO: 80006 - protein, 161 aa, Fagus sylvatica
GWNWETILIGVAFLSFLLFAKFIGKKNKKFFWVPAIAPLISVILSTFFVYITHADKRGVEIVKHIEKGINPPLVNEIYFNGEYLGKGFKIGVVAAMIALTEAIAIGRTFASMKDYQLDGNKEMVALGATNVVGSMTSCYVATGSFSRSAVNYMAGCQTAVS

SEQ ID NO: 80007 - protein, 423 aa, Desulfotalea psychrophila LSv54
MSDIISAVDAMEVLDSRGNPTVRVFVTLDNGTTCAASVPSGASTGENEAIELRDGDASRYLGKGVLKAVDNVKNIIAPAVIGKKITHQAAIDNLMIELDGTETKSSLGANAILGVSMAVARAGARSSRLPLYQYLGGPGARRIPVPAMNIINGGEHADNSVDIQEFMAVPVGAPSFGEGLRYIAETFHNLKKILKSRGLATSVGDEGGFAPNLESNEAAMDIIIEAIEASGYTPGKDIAFALDSAASSFSPDLCGSYDLKWSGGGKKDSADMIAMAQKWIEKYPIVSWEDPLAENDWAGFQKLTAAVGDKIDVVGDDLFVTNTKYIARGIEEKSANSVLIKLNQIGTVTESIDAVRMCREAGWRYFISHRSGETEDTFLADFAVAMDGGQLKTGSASRSERIAKYNRLLEIERELGANALYYW

SEQ ID NO: 80008 - protein, 1092 aa, Vitis vinifera
  misc_feature (650)..(650): Xaa can be any naturally occurring amino acid
  misc_feature (1075)..(1075): Xaa can be any naturally occurring amino acid
MDVQRMTLFLPKPQIALCPKEKCPTFRSPFKHIIRMARSSIDETSESGAFTRTPSAFRSVISRDPNAPFPAESGRCLSYLKIKGLDNVIAFTAVKSKWERTKDGDEHMGWAFPASETEEPGAEPDPLYGARSIRQLYELASANYTGKYSVPVLWDKKLKTIVNNESSEIIRMLNSEFNDMAENAALDLYPPHLQPQIDEINEWIYDRINNGVYKCGFAKKQGPYNEAVGKLYEALDRCEDILSKQRYICGNLLSEADIRLFVTLIRFDEVYAVHFKCNKKLIREYPNLLNYSKDIFQIPGMSSTVNMDHIKRNYYGSHPSIDPLGIIPIGSHLNYSSPHDRAKVRVFGVSLMRREAHRERELRLLALRPFQSGAAAGAQAPDCLRLRGARQRHHALRQRPVQVATGGVPGRPRRDPAVALAQRLVEPLAAGVLKMDRTRLDLRFHHSGSIQSEESALDLERNYCNHPNLPSPSPPPLQAFASGGQLSESNAAYFSWPTSSRLNDAAEDRANYFGNLQKGVLPETLGRLPTGQQATTLLELMTIRAFHSKILRRFSLGTAIGFRIRRGVLTEIPAILVFVARKVHRQWLNHIQCLPAALEGPGGVWCDVDVVEFSYYGAPAPTPKEQLYTELVDGLRGSDPCIGSGSQSIXEDYSCMGKTSGCNLFVQMLLELIDKTNPGVVHVASQETYGTLGAIVKSRTGNQQVGFLTNRHVAVDLDYPSQKMFHPLPPSLGPGVYLGAVERATSFITDDLWYGIFAGTNPETFVRADGAFIPFADDFNVSNVTTTVKGVGEIGEVNIIDLQSPINSLIGRQVVKVGRSSGLTTGTIMAYALEYNDEKGICFFTDFLVVGENQQTFDLEGDSGSLILLTGQNGEKPRPVGIIWGGTANRGRLKLKVGQPPENWTSGVDLGRLLDLLELDLITTSEGLQVLEAKIDLQKGFLTIQMMFFSWFIVNIAAVHEQINASAAGIDSTVGESSPPEPVLLKNKTEENFEPLGINLQQVPIEGESQQAVLPSFIHTEFHIEEGVEAAPNVEEHQFIPSCPGKSPVHQNNKQENPELKNLWALRNTSEEEMXVSLQLGKPEPKRRKQAD

SEQ ID NO: 80009 - protein, 328 aa, Vitis vinifera
MRKKRTLMAWKRNRFKVLLELHQHSVILSPETRTPHSQQNLEDTICMYHMPVLGHSRCLAYLKIKGLDKAISFTSVKPKWERTRDTDEHMGWVFPASDTEEPGAGPDPLNGTRSIRELYELASTNYSGKYTVPVLWDKKLKTIVNNESSEIIRMFNTEFNDIAENPSLDLYPPHLQAQIDKINDWIYSGINNGVYKCGFAKKQEPYDEAVKNLYEALDKCEEILSKQRFLCGNTLTESDIRLFVTLIRFDEVYAVHFKCNKKLLREYPNLFNYTKEIFQIPGMSSTVHVEHIKKHYYGSHPSINPFGIIPQGPDVDYSAPHDRERFSS

SEQ ID NO: 80010 - protein, 331 aa, Flavobacteria bacterium BBFL7
MEKNKKFAVIGGGSWATAIVKMLCENLDQVGWYMRSVYAIEHIKRNDHNPSYLSSVEFDVTQLKLSNDINEIVAEADVCIFAIPSAFLYTELQNLTVDLKGKIIFSAIKGIVPETGLIVGEHFNEHYNIPFEDIGVLTGPCHAEEVALERLSYLTIACADEEKANYVASKLSSDYINCKTTDDIIGTEYAAVLKNIYAIAAGIAHGLGYGDNFQSVLMSNSIREMKRFIKKVHKMKRNINDSAYLGDLLVTGYSVFSRNRLFGNMLGKGYTVRSAQLEMSMIAEGYYATNSAYKINSEKGARTPILDAVYSILYDNKNPKKVFKKLADKLD

SEQ ID NO: 80011 - protein, 418 aa, Ashbya gossypii ATCC 10895
MSAGHCARAAGRSRAGQYICVPRADGGAMRAAARAGAPAARARLGGADGRLRHSNTTRAWKAAFPRARTMWGRDRHGWTTRTWPRWTQWWCQRLKKYRRPAPTLKKRGRRGAQLSLFHQARAMSDSRRGSYVPVEFTAEVEQQCLKQVEFYFSEFNFPFDKFLRTTAEQNEGWVPITTIASFNRMKKFRPVDEVVRTLRTSTVLEVSADGENVKRRVPLSLEDRKVRSERTLAVMNFPRLDDERETVSNEDKLELQERLERFFFGLEAASAAAIQQIRLKRDHRKKFNGTVLLEFAGEDECKAFLEAYGKEDGLSFEGRKLDVLTKQQYDVQREATRSKNFGGNGQRSRSFTGHRKNMPRAKKAKAGEAGAPADAATGAAGAGGENASSDQAAPAAGADAPAAAPAAELVPTTGSVTE

SEQ ID NO: 80012 - protein, 327 aa, Pectobacterium atrosepticum
HGRAIGAEGLAVGEVVFNTSMTGYQEILTDPSYSRQIVTLTYPHIGNVGANANDEESPSVQAQGLVIRDLPLIASNYRSEESLSEYLKRNNIVAIADIDTRKLTRLLREKGAQNGCIIAGDAPDAVVALEKAKAFPGLKGMDLAKEVTTAESYSWLQGSWMLEGELPAAKNESELPYHVVAYDYGVKRNILRMLVDRGCRLTVVPAQTSAEDVLKLNPDGIFLSNGPGDPEPCDYAIRAIKTFLETDIPVFGICLGHQLLALASGAKTIKMKLGHHGGNHPVKDLDNNCVMITAQNHGFAVDEDNLPDTLRVTHKSLFDHTVQGIHR

SEQ ID NO: 80013 - protein, 326 aa, Pectobacterium wasabiae
HGRAIGAEGSAVGEVVFNTSMTGYQEILTDPSYSRQIVTLTYPHIGNVGANANDEESPSVQAQGLVIRDLPLIASNYRSEESLSEYLKRNNIVAIADIDTRKLTRLLREKGAQNGCIIAGDAPDAAVALEKAKAFPGLKGMDLAKEVTTAESYSWLQGSWTLEGELPAAKNESELPYHVVAYDYGVKRNILRMLVDRGCRLTVVPAQTPAEDVLKLNPDGIFLSNGPGDPEPCDYAIRAIKTFLETDIPVFGICLGHQLLALASGTKTIKMKLGHHGGNHPVKDLDNNCVMITAQNHGFAVDEDNLPDTLRVTHKSLFDHTVKGSR

SEQ ID NO: 80014 - protein, 435 aa, Cryptococcus neoformans var. neoformans JEC21
MASLVAILDVKGKSLIQRSYRDDVPTSYIERFLPLILEMEEDNVPVTPCFSDEGVNYMHIRHNNLYLLALSKKNSNAVEVIFFLHRLCSVLTEYFKELEEESIRDNFVIIYELLDEMMDFGYPQTTESKILQEYITQESHKLEVQVRPPMAVTNAVSWRSEGIRYRKNEVFLDVVESVNLLVNASGNVIRSEILGAVKMKCYLSGMPELRLGLNDKVMFETTGRAARGKSIEMEDVKFHQCVRLSRFENDRTISFIPPDGEFELMSYRLSTPVKPLVFVEASVESHRGSRVEYMVKIKGQFKRRSTANNVEIYVPVPDDADSPKFRASVGSVVYAPEKSAFVWKIKQLAGGRDYLMRAHFGLPSVRNEELDKRAPISVKFEIPYFTVSGIQVRYLKIVEKSGYKALPWVRYITQNGDDYVLRTITDAKTAPLMGV

SEQ ID NO: 80015 - protein, 327 aa, Pectobacterium carotovorum
HGRAIGAEGSAVGEVVFNTSMTGYQEILTDPSYSRQIVTLTYPHIGNVGANANDEESPSVQAQGLVIRDLPLIASNYRSEESLSEYLKRNNIVAIADIDTRKLTRLLREKGAQNGCIIAGDAPDAAVALEKAKAFPGLKGMDLAKEVTTAESYSWLQGSWTLEGELPAAKNESELPYHVVAYDYGVKRNILRMLVDRGCRLTVVPAQTPAEDVLKLNPDGIFLSNGPGDPEPCDYAIRAIKTFLETDIPVFGICLGHQLLALASGAKTIKMKLGHHGGNHPVKDLDNNCVMITAQNHGFAVDENNLPATLRVTHKSLFDHTVQGIHR

SEQ ID NO: 80016 - protein, 133 aa, Glycine max
MATISAAITTPSISRATLVQKRVSSPVLGLPAMGKVGRVSCSMEEKPYSVKESSSSMLGMGASLMAAASAAAMSGPAMALVDERLSTEGTGLPFGLSNNLLGWILFGVFGLIWTLYFVYTSTLEEDEESGLSL

SEQ ID NO: 80017 - protein, 361 aa, Arabidopsis thaliana
MIPFPLLPTPIETNYRACTIPYRFPSDNLKKATPTEISWINVFANSIPSFKKRAESDTSVPDAPARAKIFEQRYAGFLEGWKKDPESNGGPPDGVILGRVREHLLRALGFRDIFKKVKDEENAKAISLFPEVVSLSDAIEDDGERLENLVRGIFAGNIFDLGSAQLAEVFSRDGISFLATSQNLVPRPWVIDDLNKFQAKWVKKPWKKAVIFVDNSGADIILGILPFARELLRRGIQVVLAANELPAINDVTYTELTDIVSQLKDGNGQLIGVDTSKLLIANSGNDLAVIDLSRVSHELAYLSSDADLVILEGMGRGIETNLYAQFKCDSLKIGMVKHVEVAQFLGGRLYDCVFKFNEVQS

SEQ ID NO: 80018 - protein, 283 aa, Triticum aestivum
  misc_feature (33)..(33): Xaa can be any naturally occurring amino acid
  misc_feature (50)..(50): Xaa can be any naturally occurring amino acid
  misc_feature (73)..(73): Xaa can be any naturally occurring amino acid
  misc_feature (226)..(226): Xaa can be any naturally occurring amino acid
  misc_feature (252)..(252): Xaa can be any naturally occurring amino acid
  misc_feature (270)..(270): Xaa can be any naturally occurring amino acid
MSAFVGKYAEELIKTAKYIATPGKGILAADESXTGTIGKRLASINVENVXEANRQALREMLFTAPGALEYLSXGVILFEETLYQTAADGTPFVDILKAGNVVPGIKVDKGTVDIAGTVGETTTQGLDSLGARCAKYYEAGARFAKWRAVLKIGPGAEPSELAVKQNAEGLARYALICQENGLVPIVEPEILTDGPHDINACAGASERVLAAVYKSLNDHNVLLEGXTLLKPNMVTPGLDSPKGGAEVIAEYXVGALRGTVPPAGAGVVFXSGGKREQAANLDA

SEQ ID NO: 80019 - protein, 321 aa, Pectobacterium carotovorum subsp. odoriferum
HGRAIGAEGSAVGEVVFNTSMTGYQEILTDPSYSRQIVTLTYPHIGNVGANANDEESPSVQAQGLVIRDLPLIASNYRSEESLSEYLKRNNIVAIADIDTRKLTRLLREKGAQNGCIIAGDASDAAIALEKAKAFPGLKGMDLAKEVTTAESYSWLQGSWTLEGELPAAKNESELPYHVVAYDYGVKRNILRMLVDRGCRLTVVPAQTPAEDVLKLNPDGIFLSNGPGDPEPCDYAIRAIKTFLETDIPVFGICLGHQLLALASGAKTIKMKLGHHGGNHPVKDLDNNCVMITAQNHGFAVDEDNLPDTLRVTHKSLFDHT

SEQ ID NO: 80020 - protein, 405 aa, Coprinopsis cinerea okayama7#130
MSPFTQAPHDLLVIPGPIEVTDSVLYANAHPSMSHVSKDFIPVFGDSIRMTREVLYAGKDTQPFLISGSGTLGWDQVAANLVEDGEEALVLHSGYFADSFADCLETYRAKVTQVKAPIGRAVALAELEKALIQKKNEGKFYKIVAFTHVDTSTAVLSDAKGIAETVRRISPESLVVADCVCSVASEEIRFDDWGLDIVLTASQKGLGTPPGLSVLVASARAIEVFKARKSPPSSYYASWKKWLPIMNAYESGSPAYFATPPVNLIYAYHASLSIITGKRNASAAGQPAEVVVPLEERFALHKAASQRVKAAAAELGLSQLPQADGEAANGMTALYYPEGLGAADVIPRLAQRGVVVAGGLHAQIKDKYFRVGHMGVTVVDKERGDIDRVVKALKEVITEAKAQKS

SEQ ID NO: 80021 - protein, 327 aa, Pectobacterium betavasculorum
HGRAIGAEGSAVGEVVFNTSMTGYQEILTDPSYSRQIVTLTYPHIGNVGANANDEESPSVQAQGLVIRDLPLIASNYRSEESLSEYLKRNNIVAIADIDTRKLTRLLREKGAQNGCIIAGDAPDAAVALEKAKAFPGLKGMDLAKEVTTAESYSWLQGSWTLEGELPAAKNESELPYHVVAYDYGVKRNILRMLVDRGCRLTVVPAQTPAEDVLKLNPDGIFLSNGPGDPEPCDYAIRAIKTFLETDIPVFGICLGHQLLALASGAKTIKMKLGHHGGNHPVKDLDNNCVMITAQNHGFAVDEDNLPDTLRVTHKSLFDHTVQGIHR

SEQ ID NO: 80022 - protein, 238 aa, Haemophilus somnus 129PT
MEGKKVPQVTFRTRQGDQWVDVTTADLFDNKTVVLFSLPGAFTPTCSATHLPRYNELACEFKALGVDDIICVSVNDTFVMNAWKADQESENVTVIPDGNGEFTSGMGMLVDKTELGFGKRSWRYSMLVKNGVVEKMFIEPQEPGDPFKVSDADTMIKYLNPNWTEKPSVSIITKPGCPFCAKAKTLLKEKGYTFEEIILGRDASTISVRAITGKTSVPQVFIGGQYIGGSDDLAQYFA

SEQ ID NO: 80023 - protein, 388 aa, Microcystis aeruginosa PCC 7806
MKNLLSRMDGVQTPIIPVVGQLIKANPGTISLGQGVVSYYPPQEAIESLSLFLANPKNHQYQSVAGIPPLLTVIRQKLAEDNRIEISDKQAIFVTAGSNMAFMNAILAITSPGDEIILNTPFYFNHEMAIKMADCQVILVATDKNYQLRPAAIKEAITEKTKAVVTISPNNPTGVVYPENTLREVNRICQKKGIYHIHDEAYEYFTYNHARHFSPAAIVGSEAWTISLFSLSKAYGFASWRIGYMVVPEHLSEAINKIQDTILICPPVVSQYAALGALQVGKSYPLEQLKTISQVREICLNALESIRDICDVATAEGAFYFFLKIPTDKNDFQLVKSLIEQQRVAVLPGSTFGITEGCYLRLAYGALSPETALAAVERLVKGLRYFSQ

SEQ ID NO: 80024 - protein, 137 aa, Microcystis aeruginosa PCC 7806
MYCDYLVQILTARVYDVAQETPLEFAPNLSQRLHNQLLLKREDMQSVFSFKLRGAYNKMAYLSRDLLQKGVIAASAGNHAQGVALGARQLGTQAIIVMPVTTPQVKIDAVKARGGIVVVMSSCTVTPTMIHTPTRGS

SEQ ID NO: 80025 - protein, 726 aa, Vitis vinifera
MVMKLVLLLIICLLCLCLCLTAEASTPLEYLVKPNCQSQCGNVVIPFPFGIGESCYLNEWYSVNCSNTSGAAKPFLNPTKLNLELLNVSLEYQTVTVYSPIASYDQQKGSSELQTSINLDQSPFLFSTLDNIFVVLGCGHAKLMEHEKIWAGCTSINCSDSFPDQGCYGINCCQTTIPTIDSYYLSTYSVKFTLDDEGNNHSTSTHAFLVDRDWFSRNFTELEDVSVKYAALSLLWMIKEGDNADSSCNGSNYYSLSIGSYVRSSCGCPPRYEGNPYLHDGCDHVVKECANCLKTCDYRYIIDNQSYHIEYYCITKDRLSRPLILGFSIGGGSLLLLLGSFGLYKVVKKKKEIRLKKRFFKRNGGLLLEQQISSDKVAVEKTKIFTSKELEKATDNFNLDRILGQGGQGTVYKGMLTDGRIVAVKKSKIVDESQIEHFINEIVILSQISHRNVVGLLGCCLETEVPLLVYEFISNGTLFQHIHNQDSDFPLSWKMRLQIAIEVAGALAYLHSACSIPIYHRDIKSTNILLDDKHRAKVSDFGTSRSISIEQTHLTTLVHGTFGYLDPEYFQSSQFTEKSDVYSFGVVLVELLTGQKPICSTRSQEEKSLATHFILSLQESRLFDILDAGVVKEGEKEEIMALAYLAYQCLNLSGRKRPTMKEITMELEHIRMSLPPLKVEQNFEENACIEMEIIGPLDSTSSFRRSCLNYPKASSSDEQPLLFNAL

SEQ ID NO: 80026 - protein, 154 aa, Photobacterium phosphoreum
MTLSTAQEIIEDIRQGKMVILMDDEDRENEGDLIIASDKITPEAINFMATYGRGLICLTLNKARCLQLKLPLMVKNNTDKFATPFTLSIEAASGVTTGISVKDRARTVQAAVAAMATSEDIVMPGHIFPLMAQDGGVLTRAGHTEAGCDVARLA

SEQ ID NO: 80027 - protein, 367 aa, Oceanicola granulosus HTCC2516
MDGFEIAVFEGDGIGPEVMRPTVELLTALARGHGRYALNFETLPAGAGHYREHGVSLPGDALARARRADAILLSAMGLPEVRYPDGTEISPQIELRMELGLYAGVRPVFQFGQSCPIARFGGDQRPVDFVIVRESTEGLFYSHGKGEVIDDSEARETLRITRATSEKLFDFAFDLARQRKADGRGAGVVHCVDKANVFQAFAFFRRIFRERAEAFPDIRAEAAYVDATAMWLVEKPQVFDVLVTENMFGDILSDLGAAMMGGLGLAPSADIGERNAVFQPCHGSAPDIAGQGRANPIAMVLSAAMMLDWLGRTRGQEAMRADALRIHEAVREVVTSGGPLTPDLGGTASTGEVVAAVRDAALAAVAA

SEQ ID NO: 80028 - protein, 355 aa, Glycine max
  misc_feature (84)..(84): Xaa can be any naturally occurring amino acid
MVSPMSTVLVTGGAGFIGSHTVLQLLKQGFRVSIIDNLDNSLIEAVHRVRRLVGPHLSNNLTFFHGDLRNVQDLEAVFSKSKHXNRFDAVIHFAGLKGVGESVAKPRRYYDNNLVGTINLFEAMAKYKCKKMVISSSATVYGEADRVPCVEEEVHLQAMNPYGRTKLFVEEIARDIQRAETEWRIILLRYFNPVGAHESGQIGEDPRGIPNNLMPYIHQVAVGRLPQLNVYGHDYPTKDGTPIRDYIHVMDLADGHIAALRKLFATDHIGCSAYNLGTGRGTSVLEMVAAFEKASGKKIPLKMCPRRPGDATAVYASTDKAEKELGWKAKYGIEEMCRDLWNWTSKNPWGYQGKH

SEQ ID NO: 80029 - protein, 386 aa, Debaryomyces hansenii CBS767
MSSPCPYKQPEHKLTMIPGPIEFSDPVLYAMSTPSQAHTSPEFIKTFQTTLQNLRKLFKSTDSKAQPYVLAGSGTLGWDVVGANLVNPGDKVLVLSTGFFSDSFADCLKVYDANVDVITADVGDVLPLDKIAEKLKSEKYTAITITHVDTSTAVVSDIKAISDVVKKESPETLIVVDGVCSVGVENLEFDAWGIDFALTASQKAIGVPAGLSIFYASERAVTKALDRKKDSSFFASMKKWTPIMKAYESGSGAYFATPAVQTITALKVSLDEILGESLKTRFAKHEEISSQFKNHLAKSGLKILPVNDKVAAHGLTAVYFPEGINGADFLGKVAGKGFTIAGGIHKALVGKYFRVGHMGFSVYEGHVDKLTKAIDEALAEVGYKKQ

SEQ ID NO: 80030 - protein, 415 aa, Rhodospirillum rubrum ATCC 11170
MTSLAPPLAAGLASPTPEDLRDYLEVEHRLGAHNYKPLDVVLTRGQGVWVWDVAGRRYLDCLSAYSAVNQGHCHPRILEALIAQAGRLTLTSRAFHNDQLAPFYEEICALTGSHKVLPMNSGAEAVESALKCVRKWGYREKGVAEDQAEIIVCSDNFHGRTIAIVGFSSDPDARRDFGPFAPGFRCVPFGDGDALEAAITPRTVAVLIEPIQGEAGVIIPPPGYLKRVRDLCTAQGVMLILDEIQTGLGRTGALLAEEHEGIEADLTLVGKALSGGFYPVSAVLSNSEVLGVLRPGEHGSTFGGNPLACAVARMALKVLVDEDMIGNAARQGAYFLEKLRGLGNPLIRAVRGRGLMLAVEFAPEAGGARPFCEKLKDKGILCKETHRDIIRFAPPLVITEKEIDWAMERIAEVIG

SEQ ID NO: 80031 - protein, 324 aa, Silicibacter sp. TM1040
MNLIDGIKGNRFAVFGRAGMDMFADPIGTKSEDATTFRADLGGSSANICAGLVKLGAEAALVTSVSDDAVGRFCVNRLRDYGVETRYVRAVGGEARTSLAVYESRIDDFQNVIYRNGAADFQVTKADMDAVDYSAFSALITAGTVFAAEPSRSATFRAFEHARTAGLPVIFDIDYRPYSWPSPEVASEVLTRAGEASDLIVGNDEEFGFMAGHIDKGLEKARALAAQGRMVIYKMGEAGAITIAEGQEIRTGIYPVTAVKPNGAGDSFMAGLLASIAQGHALSDAVLRGSACASIVVSQPGCANAMPTTAELEAFLASHPGPTV

SEQ ID NO: 80032 - protein, 300 aa, Schizosaccharomyces pombe 972h-
MNTTSEVIVGTGFQAIRQQLAQMHPELNFVEQLWLAYYKWFDNDVVATGLMSFLLHELIYFGRCIPWMIIDAMPYFRRWKIQPKKVPTLAEQWECTRLVLLSHFTVELPQIWLFDPMCATFGLSTSVPFPPVTKMIWQITLFFFLEDTWHYWAHRLFHYGIFYRFIHKVHHRYSAPFGLSAEYAHPLEIILLGAGTVFVPLMWCYFTHDLHLVTMYIWITLRLFQAVDSHAGYDFPWSLNKFLPIWAGADHHDYHHMAFKDNFSSSFRWWDAVLKTDQNYHQFKARRLAAKYEAESKKAK

SEQ ID NO: 80033 - protein, 356 aa, Streptomyces peucetius
MTAEPTVAARPQQIDALRTLIRLGSLHTPMVVRTAATLRLVDHILAGARTVKALAARTDTRPEALLRLIRHLVAIGLLEEDAPGEFVPTEVGELLADDHPAAQRAWHDLTQAVARADISFTRLPDAIRTGRPTYESIYGKPFYEDLAGRPDLRASFDSLLACDQDVAFDAPAAAYDWTNVRHVLDVGGGKGGFAAAIARRAPHVSATVLEMAGTVDTARSYLKDEGLSDRVDVVEGDFFEPLPRKADAIILSFVLLNWPDHDAVRILTRCAEALEPGGRILIHERDDLHENSFNEQFTELDLRMLVFLGGALRTREKWDGLAASAGLVVEEVRQLPSPTIPYDLSLLVLAPAATGA

SEQ ID NO: 80034 - protein, 237 aa, Haemophilus influenzae 86-028NP
MNIQHNLNLIQQKIETACKEENRNQNTVKLLAVSKTKPISEILSAYQAGQTAFGENYVQEGVEKIQYFESQGVNLEWHFIGPLQSNKTRLVAEHFDWMQTLDRAKIADRLNEQRPTNKAPLNVLIQINISDEESKSGIQPEEMLTLAKHIENLPHLCLRGLMAIPAPTDKIAEQEAVFRKMSDLFEQLKQALPNQQIDTLSMGMTDDMPSAIKCGSTMVRIGTAIFGARNYSTSQNK

SEQ ID NO: 80035 - protein, 627 aa, Arthrobacter aurescens
MAKMRKVTTVRGYGAFVGANHLEVEETTGTGQEKTGTKKVIAFKRAIIAAGSQAVRLPFMPNDPRVVDSTGALALSGVPKRMLILGGGIIGLEMGTVYSTLGARLDVVEMMDGLMQGADRDLVKIWQKMNAKRFDNIMLKTKTVGAEATPEGIKVTFAPAEEGGTTPEPQVYDLVLQAVGRTPNGKKIAAEKAGVAVTDRGFINVDIQMRTNVPHIFAIGDIVGQPMLAHKAVHEAHVAAEVIAGELQGNKELASAAFNARVIPSVAYTDPEVAWVGLTEDQAKAQGIKVKKGLFPWTASGRAIANGRDEGFTKLLFDDSPEAATPRISSPGVIFHAATGIDAATVAPVQTTLQKRILRAFVARGLLENCDAKDMLGYKHSGFSVDAGVCIEAHDRAALERLLRYCARPPFSMERLRKEGSKLVYRCAKQRSEPTSDKRGAKADELHLTPLELIDRIAALVPPPRTHRHRYFGVLAPNSPLRAAVTALAQPAASQPATVETAQPGAGVPGVAAPGNAATPTPEPEARPKRAAHYLWAVLIARIYEAFPLLCPMCGGQMRIIAFITHSAEIRHILNHIGVESAPPHITPARGPPLWEGCDAPVDDGAQGEPDWDLAAQPDEVDQRVNW

SEQ ID NO: 80036 - protein, 342 aa, Ashbya gossypii ATCC 10895
MATVNPQRRDSAEAIDTDIITLARFILESQRSSAKNATGEFNLLLNSLSFAFKFISQTIRRAELVNLIGLSGASNATGDQQKKLDVLGDEIFINAMKASGNVKVLVSEEQEDLIVFPETGGTYAVCCDPIDGSSNLDAGVSVGTIVSIFKLTPDSSGTIKDVLRSGREIVAACYAMYGASTHVMLTTGQGVNGFTLDTSIGEFILTYRDLKMPALRNIYSINEGNMRFWTDGIRRFVEALKDSDKPYSARYIGSMVADVHRTLLYGGLFSYPLDMKNPNGKLCLLYEAFPMAFLVEQAGGKAVNDRGERILDLTPEHIHDKSSIWLGSAGEVDKYLAHIGRA

SEQ ID NO: 80037 - protein, 392 aa, Streptomyces avermitilis MA-4680
MTAPLMTLAWTDHVTGRQGYLVVDRLVRGVSSGGLRMRPGCTLDEVAGLARGMTMKEALHYNPEGRYIPLGGAKGGIDCDPRSPEAYGLLVRYLRAMRPYIESCWTTGEDLGLTQDLVDRAAAEAGLVSSIQAVYPLLDDEATARKRLADAFAVEVDGIGLDELVGGCGVAESLLAALDRAAVPYAGTRVAVQGLGTMGGATARFLARAGLTIVAVADVKGTIANPEGLDVEALLAARDAYGTVDRSALRPGDRELPGEAWLSVEAEVLVPAAVSYVVDTTNQRRIGARWIVEAANMPVLPEAEALLTERGITVLPDVVVNSGTNAWWWWTLFGDIDADADEAFARTRRSMRALTDLMLARAEADGTTPRAAAHAIVADRLPVIAERFGWYR

SEQ ID NO: 80038 - protein, 277 aa, Brassica napus
PLSSIRGTGPEGRIVKADVEEFLASRGKETTAKPSKPTDSKAPALDYVDIPHTQIRKVTASRLAFSKQTIPHYYLTVDTCVDKLMGLRSQLNSFQEESGGKRISVNDLVIKAAALALRKVPQCNSSWTDEYIRQFSNVNINVAVQTENGLYVPVVKDADKKGLSKIGEEVRFLAQKAKENSLKPEDFEGGTFTVSNLGGPFGIKQFCAVINPPQAAILAIGSAEKRVVAGSGPDQFNGASYMSVTLSCDPRVIDGAIGAEWLKAFKGYIETPEFMLL

SEQ ID NO: 80039 - protein, 361 aa, Ashbya gossypii ATCC 10895
MKGLILVGGYGTRLRPLTLTVPKPLVEFCNRPMILHQIEALAAAGVTDIVLAVNYRPEVMVETLKKYEKQYGVSITFSVETEPLGTAGPLKLAEKVLKKDNSPFFVLNSDVICEYPFKELAAFHRAHGGKGTIVATKVDEPSKYGVIVHDIATPNLIDRFVEKPVEFVGNRINAGLYILNPEVIDLIELRPTSIEKETFPILVEQKSLYSFDLEGYWMDVGQPKDFLAGTVLYLNSLSKRHPEQLAKGDNIVGNVIIDPSAKISGSAKLGPDVVIGPNVTIGEGVRITRSVVLSDSTINDHSLVKSTIVGWHSTVGKWCRLEGCSVLGDDVEVKDEVYVNGGKVLPHKSISANVPKEAIIM

SEQ ID NO: 80040 - protein, 208 aa, Cryptococcus neoformans var. neoformans JEC21
MSNQQVRTHTPRSADMQPEDELAPTRTEGYKLGHSKTVAELAALDQDDESLQRWKQSLGIAAGASAGGEKRVVLKSLFLSSPTLPSEITIDLTQSKDALAKLKKDPVTIKEGVEYSVGITFMIENEIVSGLKYLQVVKRSGITVDKTEAMLGSYGPQPEPFTKVFASEESPSGMLARSGTYVVRSRVIDDDNTIWLDFEWGFKLGKEW

SEQ ID NO: 80041 - protein, 327 aa, Pectobacterium cacticida
HGRAIGAEGSAVGEVVFNTSMTGYQEILTDPSYSRQIVTLTYPHIGNVGANANDEESSSVQAQGLVIRDLPLIASNYRSEESLSEYLKRNNIVAIADIDTRKLTRLLREKGAQNGCIIAGDAPDAAVALEKAQAFPGLKGMDLAKEVTTAQSYSWLQGSWTLDGELPAAKNESELPYHVVAYDYGVKRNILRMLVDRGCRLTVVPAQTPAEEVLKLNPDGIFLSNGPGDPEPCDYAIRAIKTFLDTDIPVFGICLGHQLLALASGAKTLKMKLGHHGGNHPVKDLDHNTVMITAQNHGFAVDEDNLPDTLRVTHKSLFDHTVQGIHR

SEQ ID NO: 80042 - protein, 180 aa, Arabidopsis thaliana
MSGVVALGHASSWGAALVRISPYTFSAIGIAISIGVSVLGAAWGIYITGSSLIGAAIEAPRITSKNLISVIFCEAVAIYGVIVAIILQTKLESVPSSKMYDAESLRAGYAIFASGIIVGFANLVCGLCVGIIGSSCALSDAQNSTLFVKILVIEIFGSALGLFGVIVGIIMSAQATWPTK

SEQ ID NO: 80043 - protein, 327 aa, Samsonia erythrinae
HGRAIGAEGAAVGEVVFNTSMTGYQEILTDPSYSRQIVTLTYPHIGNVGANEADEESPAVQAQGLVIRDLPLIASNYRSEESLSEYLKRNNIVAIADIDTRKLTRLLREKGAQNGCIIAGDKPDAAVALEKAKAFPGLKGMDLAKEVTTAEKYSWLQGSWTLDGELPAAKHESELPYHVVAYDYGVKRNILRMLVDRGCRLTVVPAQTPAEEVLKLNPDGIFLSNGPGDPEPCDYAIRAIKTFLETDIPVFGICLGHQLLALASGARTIKMKLGHHGGNHPVKDLDNNCVMITAQNHGFAVDEDNLPDTLRVTHKSLFDHTVQGIHR

SEQ ID NO: 80044 - protein, 327 aa, Brenneria salicis
HGRAIGAEGSAVGEVVFNTSMTGYQEILTDPSYSRQIVTLTYPHIGNVGANEADEESPAIHAQGLVIRDLPLIASNYRSEETLSDYLKRNNIVAIADIDTRKLTRLLREKGAQNGCIIAGDAPDAALALEKAKAFPGLKGMDLAKEVTTAESYRWLQGSWTLEGELPAAKQESELPFHVVAYDYGVKRNILRLLVDRGCRLTVVPAQTSAQEVLELNPDGIFLSNGPGDPEPCDYAIRAIKTFLETDIPVFGICLGHQLLALASGAKTIKMKLGHHGGNHPVKDLDNNRVMITAQNHGFAVDENNLPDTLRVTHKSLFDHTVQGIHR

SEQ ID NO: 80045 - protein, 428 aa, Flavobacteria bacterium BBFL7
MSTIIDVHARQIFDSRGNPTVEVDVITSNGVMGRAAVPSGASTGEHEAVELRDGGKSYMGKGVGKAVNNVNTIISLELMGTSVFDQQHIDQLMIELDGTPNKANLGANAILGVSLACAKAAAAELNQPLYKYIGGISACTLPVPMMNIINGGSHSDAPIAFQEFMVMPVEAESFSHALQMGTEIFHHLKKVLHDRGLSTAVGDEGGFAPTLDGTEDALDTIIKAIGNAGYTAGKDVMIALDCAAAEFFVDGKYDYTKFEGESGVIRSSKEQAQYLASLAEKYPIISIEDGMDENDWEGWKILTDLAGDKVQLVGDDLFVTNVERLSRGIKEGIANSILIKVNQIGTLTETIAAVTMAHKAGFTSVMSHRSGETEDNTIADLAVALSTGQIKTGSASRSDRMAKYNQLLRIEEELQESAYYPARDAFQI

SEQ ID NO: 80046 - protein, 372 aa, Flavobacteria bacterium BBFL7
MSYLNKKDAVILLADGTIFHGKAIDDGGTATGEICFNTGMSGYQEVFTDPSYTGQIMVTTNAHIGNYGITDDDAESNSVKIAGLICKNFSEEFSRPAAQSDLFAYLKKKNLVILSDVDTRALVRYIRDHGAQNAIISTDVEDMQSLKRKLEDVPSMKGLELASKVSCKEPYFYGDENAKYRIAALDLGIKSNILRNLASRNTYIKVFPYNSSFEEMASFNPDGYFISNGPGDPEPLEAAIKTASEIIESNSPLFGICLGHQVIALAMGVSTYKMHNGHRGINHPIKNLITGKGEITSQNHGFAINKSQAIANDNIEITHLHLNDDTVAGIRLKDKPCFSVQYHPEAGPGPNDATYLFDQFIDLIKNSKKHTA

SEQ ID NO: 80047 - protein, 322 aa, Brenneria rubrifaciens
HGRAIGAQGTAVGEVVFNTSMTGYQEILTDPSYSRQIVTLTYPHIGNVGTNASDEESPSVHAQGLVIRDLPLIASNYRSEENLSDYLKRHNIVAIADIDTRKLTRLLREKGAQNGCIIAADAPDAALALEKAKAFPGLKGMDLAKEVTTADSYGWLQGSWTLEGELPVARQEAELPYHVVAYDYGVKRNILRLLVDRGCRLTVVPAQTFAEDVLKLNPDGIFLSNGPGDPEPCDYAIRAIKTYLETDIPVFGICLGHQLLALASGAQTIKMKLGHHGGNHPVKDLDNNRVMITAQNHGFAVDENNLPDTLRVTHISLSDHTV

SEQ ID NO: 80048 - protein, 178 aa, Acer saccharum
VTGLLDPPELIKPPKILVIEGLHPMYDERVRDLLDFSIYLDISNEVKFAWKIQRDMAERGHSLESIKASIEARKPDFDAYIDPQKQYADTVIEVLPTELIPDDNEGKVLRVKLIMKEGVKHFSPVYLFDEGSTISWIPCGRKLTCSYPGIKFAYGPDTYFDHEVSVLEMDGQFDRLDE

SEQ ID NO: 80049 - protein, 327 aa, Brenneria alni
HGRAIGAEGSAVGEVVFNTSMTGYQEILTDPSYSRQIVTLTYPHIGNVGTNASDEESLSIQAQGLVIRDLPLIASNYRSEESLSEYLKRNNIIGIADIDTRKLTRLLREKGAQNGCIIAGDAPDAAHALEKAKAFPGLKGMDLAKEVTTAESYSWLQGSWTLEGGLPQAKQESELPYHVVAYDYGVKRNILRLLVDRGCRLTVVPAQTSAEEVLKLNPDGIFLSNGPGDPEPCDYAIRAIKTFLEADIPVFGICLGHQLLALASGAKTIKMKLGHHGGNHPVKDLDNNCVMITAQNHGFAVDEHNLPDTLRVTHKSLFDHTVQGIHR

SEQ ID NO: 80050 - protein, 299 aa, Yarrowia lipolytica CLIB122
MGVDIQLKDGYTICFLGCGTMGTAVLGAVLDSLSKGNKEGDAPKPGKFMACVTRQESADRLHKDLTSSAPDIPVEILINDNGSAYKADVFVLGSKPYMAEKILTPLQQMLEGKVLVSLLAGKTIADIESYSGRCPKPLVVRAMTNTPSRIGAGMTVLSFPDNATVDESVVNAVSWIFEQTGKCITLEEKQMDVSTALCGSSPAFCFLIIEALADGAVRMGMPYNTAFQCAAQSMLGAAKMVVESGQHPAVLKSAVCTPGGTTIGGLLALEDKGVRSSVARAVEESTNIAKSLGGGAAKK

SEQ ID NO: 80051 - protein, 179 aa, Acer saccharum
VTGLLDPPELIKPPKILVIEGLHPMYDERVRDLLDFSIYLDISNEVKFAWKIQRDMAERGHSLESIKASIEARKPDFDAYIDPQKQYADTVIEVLPTELIPDDNEGKVLRVKLIMKEGVKHFSPVYLFDEGSTISWIPCGRKLTCSYPGIKFAYGPDTYFDHEVSVLEMDGQFDRLDEL

SEQ ID NO: 80052 - protein, 328 aa, Haemophilus somnus 129PT
MKQNQPHFYRGRFSVAPMLDWTTRHCRFFHRQFSQYTLLYTEMVTTGAIIHAKYDHLAYDVSENPVALQLGGSDPEKLQYCAKKAEERGYQEINLNVGCPSDRVQNGMFGACLMARADLVAECVNAMQSAVNIPVTVKTRLGIDEFDSYEFLCDFIEKVHNIGCQEFIIHARKAWLSGLSPKENREIPPLNYERVYQLKKDFPDLLISINGGIKTLEEIQRHLNYVDGVMVGREAYQNPSLLGYIDQALFDPSCAIITPRQAIENMFPYIEQQLSQGVYLNHIARHLLGAFQQCKGARQWRRYMSENIHKSHAGVEVIEKALTFIEEK

SEQ ID NO: 80053 - protein, 254 aa, Brassica napus
MARKFFVGGNWKCNGTAEEVKKIVNTLNEAQVPSQDVVEVVVSPPYVFLPLVKSILRPDFHVAAQNCWVKKGGAFTGEVSAEMLVNLDIPWVILGHSERRALLNETNEFVGDKVAYALAQGLKVIACVGETLEQRESGSTMDVVAAQTKAIADRVSNWSDVVIAYEPVWAIGTGKVASPAQAQEVHDELRKWLAKNVSADVAATTRIIYGGSVNGGNCKELGGQADVDGFLVGGASLKPEFIDIIKAAEVKKSA

SEQ ID NO: 80054 - protein, 95 aa, Dichelobacter nodosus VCS1703A
MTNIYVGNLSYRTTEDELRNAFSQFGDVQNASIIKDRDSGRSKGFGFVEMPDAEAAKKAIESLNDKDLGGRNLKINEARPREMRPRRDKGSNSHF

SEQ ID NO: 80055 - protein, 434 aa, Microcystis aeruginosa PCC 7806
MTLATNIETPKFIPTFTRLVSKEGGTSYPLKALNICEETFAPLEVDYDYDLIRRTVTRESIQAGPNSIWRYRSFLPVESENPIDVGTGMTPLVKSHRLARRLGLKNLYIKNDAVNMPTLSFKDRVVSVALTRAKELGFTTVSCASTGNLANSTAAIAAHAGLDCCVFIPSDLEAGKILGTLIYNPTVMAVKGNYDQVNRLCSEVGNTYGWGFVNINLRPYYSEGSKTLGFEVAEQLGWKLPDHIVAPLASGSLFTKIYKGFQEFVKVGLVADKAVRFSGAQAEGCSPIAQAFKEGRDFVAPVKPNTIAKSIAIGNPADGVYALDIARKTGGNIESVTDAEIIEGIKLLAETEGIFTETAGGTTIAVLKKLVEAGKIDPEETTVVYITGNGLKTQEAVQGYIGEPLLIEPKLESFERALERSRTLERLEWQQVLV

SEQ ID NO: 80056 - protein, 422 aa, Dichelobacter nodosus VCS1703A
MRLCIANLRRLKVSIEIKVPDIGDFEHVDVIEVLIKAGDKIQAEQSVLVLESDKASMEVPAECGGVVEAVKIKVGDKVSQGDVIAILSGSDAKAEPVAAEKPAASKAESAPKTTAAIDEEAFNRAYASPAVRRLARELGVDLGKITGSGRNQRIVVEDVEAFVNQKAPANAASAVCGRGIPEMPAIDFSQFGEIEEQKLSRINVLTGEAMTRNWLNIPHVTQHDSCDITELEAFRVALKAEAEKRGVKVTMVAFLMKALATALKEFPRFNSSLSPDGSKLILKHYFNIGVAVDTPNGLVVPVIRDVDKKGIFELSADLMAMSKKARDGKLTPTDFAGGSMTISSLGGIGGQHFTPIVNAPEVAILGVSRSMMQPVWDGKAFVPRLMLPLSLSYDHRVIDGALGAKMIVFIGQVLTDMRRSLL

SEQ ID NO: 80057 - protein, 109 aa, Chlamydomonas reinhardtii
MLTLGRVAAIPVLIAAIIGREITMSALREWAATAGPEARQAVAVNAWGKWKTASQMASLTLLLLVKDGGSGAAAEAAAVAGAALLLVASWLTVQSLAIYMRGLGTVGEC

SEQ ID NO: 80058 - protein, 577 aa, Physcomitrella patens subsp. patens
MWVPVRPLKSFAEGAHACMYKNQLQELAQRSCINLPAYACIREGPDHAPRFKATVSFNGEIFESPNYCNTLRQAEHAAAEVALNTLSRRGPSQSLAARILDETGVCKNLLQETAQRAGVSLPVYSTTRSGPGHLPVFTCTVELAKMTFSGEAAKTKKQAEKNAAMAAWSALKQFANQGRSVSLATDAEVSEEQEQNTIAKALAQHFGKEAQQLPQSVQNPSCSVMPIRLRSLSLRDNLQPGSPRLNQSHSGTWTPDLSTEQQQQRHMRNHGHPSVGSVPPPAYRTVGPSRVGSSVTIRDVSAMRDAMMAKKMVERAMGANFVGRHSLVNLQSVPSMRRDRHEVAVPYDVHQRDEDEWLRGDTSKASRDVDNRSDSLEKEHGASAVHGSYNPMSWSGTGGPNWWNTMHRPAMSSASRKTAMPVVLRPAVMVCAAPPRRPEPDGAENEDEAASRQVSPSDVPSLWMDRPPAAALRWIFHPLRWDPLFCSIDFLNKRPLYLPALVEETINADRGFMVKLGYSGGDEGENIDVTRYVWMVEIGLDMLGENVEAFKCSRTFTGPAWGECPGLAGGAESRGSG

SEQ ID NO: 80059 - protein, 199 aa, Spiroplasma citri
MFKFKNANYITSAVNKAGWINDDLFEIAFLGKSNVGKSSFLNMLTNQRQLAKVSQIPGKTRMLNFFSINNNQFRIVDAPGYGFAKVGNQYKMDFAKMMEEYLTQRENLKFVCLLVDLRHPPTQDDYEMYQYLKHFNILTVLIGTKLDKVKKNDIQKHEKMIKAKLNFADSDYFIKTSSRNKIARDECWTLFAKLLNFNE

SEQ ID NO: 80060 - protein, 323 aa, Desulfovibrio vulgaris subsp. vulgaris str. Hildenborough
MKKLDASTAVSLTGMPELERIVESLCTPESYEAVYHQSLHGSPMPSLEALTELMARLRAALFPGYFGASNIVLESMRYHLAANLDSIYRILAEQVRRGGCFACADYATDCQNCESHSQETAMEFMRALPRIRQLLATDVKAAYEGDPAAKSPGETIFCYPSIYAMIHHRIAHELYRLDVPVIPRIISEMAHSRTGIDIHPGATVGEEFFIDHGTGVVIGETCIIGRGCRLYQGVTLGALSFPKDGGGALIKGIPRHPILQDGVTVYAGATILGRVTIGAGAIVGGNVWVTHDVAPGAKVVQQKSSPPAAEDRMVGTKNGTPKA

SEQ ID NO: 80061 - protein, 308 aa, Desulfovibrio vulgaris subsp. vulgaris str. Hildenborough
MDIASSMTDLVGKTPMVRLNKVTLGCVAEVVAKLENFNPCSSVKDRIALNMVEAAIARGEIAPGAVLVEPTSGNTGVGLAFVCAVRGLKLVLTMPESMSAERRALLKAFGTTLVLTPAAKGMRGAVEEAERIVADTPGAVMLQQFANPDNPAAHEATTGPEIWADTDGMIDCFVAGVGTGGTITGTGRYLKGRNPDIRVIAVEPAESAVLSGGAPGPHAIQGIGAGFVPPVLDTSVYDEVMPVPGADALTMARRLLQEEGILCGISSGANVHAAIAYARRPENAGKRVVCIICDTGERYLSTPLFAPE

SEQ ID NO: 80062 - protein, 632 aa, Streptomyces avermitilis MA-4680
MTMLENIRGPRDLKALSEAELGELAEEIREFLVHAVARTGGHLGPNLGVVELSVALHRAFESPVDRILWDTGHQSYVHKLLTGRQDFSKLRSKGGLSGYPSREESEHDVIENSHASTVLGWADGLAKARQVQGEKGHVVAVIGDGALTGGMAWEALNNIAAAKDRPLIIVVNDNERSYSPTIGGLANHLATLRTTDSYEKVLAWGKDVLLRTPVVGNTLYESLHGAKKGFKDAFAPQGMFEDLGLKYVGPIDGHDMKAMESAFRRAKRFHGPVLIHCLTEKGRGYEPALAHDEDRFHTVGVMDPLTCEPLAPSNGPSWTSVFGDEIVRIGEEREDVVAITAAMLHPVGLNKFAEKFPGRVWDVGIAEQHAAVSAAGLATGGLHPVVAVYATFLNRAFDQLLMDVALHRCGVTFVLDRAGVTGVDGASHNGMWDMSILQVVPGLRIAAPRDADQLRAQLREAVAVDDAPTLLRFPKESVGPAIPAVDHVGGMDVLHRFPESPQVLLVAVGVMAPVCLQAAELLEARGIGCTVVDPRWVKPVDPSLPGLAAEHRLVAVVEDNSRAAGVGAAVALALSDAEVDVPVRRFGIPEQFLAHAKRAEVLADIGLTPVEIAGRISAGLATKEELSKEKQE

SEQ ID NO: 80063 - protein, 394 aa, Desulfovibrio vulgaris subsp. vulgaris str. Hildenborough
MKTIYFDNNATTQVDPAVLEAMLPFLTEMYGNPSSMHTFGGKVGRYVTEARAQVAAAIGAAPEEIIFTSCGSESDNTAIRSALQAQPDRRHIITTRVEHPAVLSLAQHLEKNGVEVSLLGVDAKGRMDLDELRAAIRKDTAIISIMTANNETGTIFPIAEAGAIAHEHGVPFHTDAVQAVGKVALDMKTMPVDYLALSGHKLHAPKGVGALYVRRGTAYRPFLRGGHQERGRRAGTENVASIVALGKACELATAAMHEENTQVRALRDRLESGLLAAIPDAVVNGDTANRLPNTSNIAFKYVEGEAILLMLDQHGVCASSGSACTSGSLEPSHVLRAMGVPFTFAHGSIRFSLSRFNTMEDVEYVVRELPPIIRRLREISPFRGEMTGKPACTC

SEQ ID NO: 80064 - protein, 406 aa, Arabidopsis thaliana
MASSTATMLKASPVKSDWVKGQSLLLRQPSSVSAIRSHVAPSALTVRAASAYADELVKTAVINSIIQKTIASPGHGIMAMDESNATCGKRLASIGLENTEANRQAYRTLLVSAPGLGQYISGAILFEETLYQSTTDGKKMVDVLVEQNIVPGIKVDKGLVPLVGSYDESWCQGLDGLASRTAAYYQQGARFAKWRTVVSIPNGPSALAVKEAAWGLARYAAISQDSGLVPIVEPEIMLDGEHGIDRTYDVAEKVWAEVFFYLAQNNVMFEGILLKPSMVTPGAEATDRATPEQVASYTLKLLRNRIPPAVPGIMFLSGGQSELEATLNLNAMNQAPNPWHVSFSYARALQNTCLKTWGGKEENVKAAQDILLARAKANSLAQLGKYTGEGESEEAKEGMFVKGYTY

SEQ ID NO: 80065 - protein, 281 aa, Desulfovibrio vulgaris subsp. vulgaris str. Hildenborough
MWDYTDKVREHFLNPRNVGSLDDANAIGEVGSLACGDALKLYLKIDDEGRIQDARFQTFGCASAIASSSALTELIKGMLVEDALKISNKDIAAHLGGLPKEKMHCSVMGQEALEAAIRNWRGEPAVEHAHEGKLVCKCFGITDEQIIRAIRENNLKTVEDITHFTKAGGGCGDCLEEIRHILDVELGKEPECLTPLEPPKKLTNVQRMQLVMKVLDGEIRPRLQQDGGDIELVDMNGTEVMVALRGMCTSCPSSQLTLKEFVERTLRDHVDQEIVVREVSA

SEQ ID NO: 80066 - protein, 430 aa, Xanthomonas axonopodis pv. citri str. 306
MSFSDLSLSPQLQPFFDTALAKAGLRTPTPIQQQAIPPMLDGRDLIAMAQTGSGKTLAYALPLLQQRCLAPDTAPRVLGALVLVPTRELAAQVEDALRQLAAHLPRRLKSVVATGGSSINPQLLALRGGADLVVATPGRLLDLVEHNALRLNGVTTLVLDEADRLLELGFGAELDRILALLPAQRQTVLFSATFPPAIASLAKRRLRDPLRVTIDATPEQAPAIAQCAIAVDAGQRTQLLRHLLQEHAWPQLLVFVASRHSADKVAEKLSKTGIAALPLHGELSQGRRERTLRAFKQADVQVLVATDLAGRGIDIDALPAVLNYDLPRSTVDYTHRIGRTARAGASGVAISFVTADSAQQWRLIEKRQGLRVPTSVIEGFEPTPVEAPASDNAPGTAMRAPNDNGGIKGKRPSKKDKLRAAAQAQTGKPG

SEQ ID NO: 80067 - protein, 88 aa, Triticum aestivum
GEFGGGHPAGAVNIPYMHSTGSGMAKNSGFLEQVSAIFRREDEIIIGCQSGRRSLMAAAELCSAGYTGVTDIAGGYSAWKENELPINQ

SEQ ID NO: 80068 - protein, 868 aa, Cryptococcus neoformans var. neoformans JEC21
MSPAPVAPIRQPRGPSTNSFSQAASPPSSTSAGNSGTAAATGPPAPDTDSLRRANTVSNPRHQPSASISASSAASSAFHGVPPSAASTSASSSRGVRGVSRFRSGSLSNALPDPGLVRRASGREVAKEVVLENEGEGEGIEAASWGKGLGRQSSLPSRRGLSLAQAANQGAPEPVPPPRPPRRIAINTTTVSGPTPPVSAHSASHSLSSLSMLHRPTYSSQLSQDEPIPSATSGGVSRTQSLRAQAKHSDVGGLGRSISLKAVGEHTYRQSTSQQASSGQSSGVISSPSSVAFSPPAPPPVSSTAALPPFQLPLPDSSYVSTTTGGADVKRHQSLTQGYGSSSRVRDRLERSPAITLEPREPRDTSGVRVRIDTRFEDEPPTSPIGPSVWSNTLSRTDDGWGSAPLNQSARNASQQLQDAFEAMTLGRNMMAPDGNAMLANDFDPRERLSLETDIMRHPQPSSNNTLPSGGQGLQRINSGAEEPSWVNKLVGGDSTPMVGNVMPRSSSALGWSERARQNETQRFPYGAYNMPFGNGFNMGLKPQMGQMGMPQMGPVGMNGMPMGMPMGMGPMNMGFPMGMNMGFGQMGANGFGQFAPGHPGQAQNQHPGQGYPPPSSSAAPTGHGMGAQDREVIELARKKGLNPATFNCKPQNARFFVIKSYTEEDVQKSLKHEIWSSTVLGNKRLDAAYRETANKGPIYLFFSVNGSRHFCGVAEMTTPVDETKTSKVWAQDKWKGIFEVKWIFVRDVPSAALRHIRLTNTPECKPITNSRDTQELPYEAGTEVLQIFLDHQTKSKTSLLQDFAYYEQLSVNRQNQNSPQNGNSQNQQPSSYQQFQQKPGNAIAPPMSNSHSGPTIPPVPAIPDKFR

SEQ ID NO: 80069 - protein, 276 aa, Cryptococcus neoformans var. neoformans JEC21
MEYSEIFDFAYGLAEKASKIILDASAKRWISTADLNEKKNSVDLVTETDELVERMIKSAVAKKYPQHKFIGEESYAAGDRPPLTDEFTWIVDPIDGTMNFVHSYPFVACSIGVAHKSRPVIGVIALPFLNQIFSARLGGGAYMNRDIPLPLTGGIPQPLSDLSRCMIGAEWGSDRGLSTFKHKASSFTKLAGDPSKGVDGGVMVHALRTIILNETGGFFAGGKDSLDAPVGRIMMGRRYIFVRAVPATESSSQIQHRLARELYDVVEEWTNEDMMD

SEQ ID NO: 80070 - protein, 327 aa, Brenneria nigrifluens
HGRAIGAEGSAVGEVVFNTSMTGYQEILTDPSYSRQIVTLTYPHIGNVGANDADEESPAIQAQGLVIRDLPLIASNYRSEESLSDYLKRHNIVAIADIDTRKLTRLLREKGAQSGCIIAGDAPDAALALEKARAFPGLKGMDLAKEVTTAESYGWTQGSWTLEGGLPAAKAQSELPYHVVAYDYGVKRNILRLLVDRGCRLTVVPAQTPAEEVLKLDPDGIFLSNGPGDPQPCDYAIRAIKAFLDTDIPVFGICLGHQLLALASGAKTVKMKLGHHGGNHPVKDLDNNRVMITAQNHGFAVDENDLPATLRVTHKSLFDHTVQGIHR

SEQ ID NO: 80071 - protein, 120 aa, Triticum aestivum
  misc_feature (83)..(83): Xaa can be any naturally occurring amino acid
  misc_feature (94)..(95): Xaa can be any naturally occurring amino acid
YFSNLRRTLGPGIDGWEVSLKGMMSIVVLLGLVITSIYWGVNKYVLNDPSLSKADRKMKKELPKLGMKESLKVLLSSRYVRDXLSTLVVAYGIXXNLVEFTWKSILRHSSLCPKEFLFFH

SEQ ID NO: 80072 - protein, 327 aa, Rahnella aquatilis
HGRAIGAEGSAVGEVVFNTSMTGYQEILTDPSYSRQIVTLTYPHIGNVGTNAADAESSAVHAQGLVIRDLPLIASNYRSEENLSDYLKRNNIVAIADIDTRKLTRLLREKGAQNGCIIAGDSPDAELALQKAKAFPGLKGMDLAKEVTTTESYSWQQGSWTLEGELPEAKKSEELPFHVVAYDYGAKRNILRMLVDRGCRLTVVPAQTPAEEVLKMNPDGIFLSNGPGDPEPCDYAIAAIKSFLETDIPVFGICLGHQLLALASGAKTVKMKLGHHGGNHPVKDIDKDIVMITAQNHGFAVDETGLPANLRVTHKSLFDHTVQGIHR

SEQ ID NO: 80073 - protein, 129 aa, Arabidopsis thaliana
MAASSLNLLLILSLLTFISLQRSESLSDNPSLTLLPDGFDWPISHSDEFDIIDGEESFEVTEEDDGVTDRRSLYWRRTKYYISYGALSANRVPCPPRSGRSYYTHNCFRARGPVHPYSLGCSSITRCRR

SEQ ID NO: 80074 - protein, 484 aa, Zea mays
  misc_feature (150)..(150): Xaa can be any naturally occurring amino acid
  misc_feature (159)..(159): Xaa can be any naturally occurring amino acid
MSMHYLAALSAVALGAILLLRSAFKWMNGARTGKDEGRMLPPGSRGLPLLGETLEFFAASPTLELVPFFKRRLERFGPIFRTNIVGEDLIVSLDPELNARVLQQEERGFQIWYPSSFMRVFGDDNIISALGPLHRHIRNLVLRLFGPEAXLRLVMLRDXVSGAARDELRSWLDHPDVEVRTATSRMIFAVTAKKLISHDDAASGGSLWKCFDAWTKGLLSFPLCVPGTAFYKCMQGRKNVMKILKQQLDERRNTAERRTVDFFDLVIDELNKPDPIMNENIALDLLFLLLFASHETTSMGLTAILKFLTDNPKALQELTEEHEKIVETRVDPDSDITWEEYKSMRFTSHVIHESLRLANIAPVVFRQANQDVYIKGYTIPEGSKIMICPSAAHLNSKVYEDPTAFNPWRWKDTPEPVGGSKDFMAFGGGLRLCVGADFAKLQMAMFIHCLVTKYSWKPISKGTMVFYPGLRFPEGFHIQLLAKA

SEQ ID NO: 80075 - protein, 326 aa, Pantoea stewartii
HGRAIGATGSAVGEVVFNTSMTGYQEILTDPSYSRQIVTLTYPHIGNVGANPADEESSQIHAQGLVIRDLPLIASNYRSEESLSAYLQRNNIVAIADIDTRKLTRLLREKGAQNGCIIAGDNPDAALALQKAQAFPGLKGMDLAKEVTTAETYTWLQGSWTLEGDLPAQTSAEALPYHVVAYDYGAKRNILRMLVDRGCRLTVVPAKTPAETVLAMNPDGIFLSNGPGDPEPCDYAIEAIEAFLKTDIPVFGICLGHQLLALASGAKTVKMKLGHHGGNHPVKDLDNNRVMITAQNHGFAVDETHLPANLRVTHISLFDKTVQGIH

SEQ ID NO: 80076 - protein, 289 aa, Brassica napus
  misc_feature (284)..(284): Xaa can be any naturally occurring amino acid
  misc_feature (286)..(286): Xaa can be any naturally occurring amino acid
MISRRTISKEYSIICERTTFSLRKQLRLSLSSIPTTRNPFGPETMTITSNISVQNDNLVVQGKTILTKIPDNIILTPVAGAGSDSGAFIGATFKQSKSLHVFPIGVLEGLRFMCCFRFKLWWMTQRMGTSGKDIPLETQFMLLESRDEVNGDDAPTVYTVFLPLLEGQFRAVLQGNEKNEIEICLESGDKAVETSQGTHLVYVHAGTNPFEVITQSVKAAERHMQTFHHREKKKLPSFVDWFGWCTWDAFYTDVTAEGVDEGLRSLSEGGTPPRFLIIDDGWQXIXNKE

SEQ ID NO: 80077 - protein, 423 aa, Yarrowia lipolytica CLIB122
MSEPIKSKRIEQLSSIAPTPQNTPASNASSFLQRAANPGVSTIAEDGQGEVDLGALSRDPALLSHLAGRLNQMAGTSSGYVDSLPLAVRRRIDGLKALHQQASVVEDEFHKEMLELERKFQAKFAPIYAERAAVIGGEKEVSEEQVEAGKKYEQERMERMFGVDGDDVEEDEDEEDEDAKDEEEEKEGDDKSDAKGIPYFWLTAIQNLPGASGLISERDSEALKSLMNVRMEYLDDKPGFVLIFDFAENEFFTNKQLKKSYFYLDKVSDTGELMYDHAEGEEIDWKSPEQNLTMEITKRKQRNKHTKATRIVEKAVPTESFFTFFSPPKALDEEEEDEDEEVDHEERDNALQLDYQIGEEIKEQLIPRAVDWFTGFALEMEMEHGDMGEFEDEDDDEDEDDDDDDDEDDEEGGKKEAQECKQS

SEQ ID NO: 80078 - protein, 327 aa, Pantoea ananatis
HGRAIGATGSAVGEVVFNTSMTGYQEILTDPSYSRQIVTLTYPHIGNVGANAADEESSQIHAQGLVIRDLPLIASNYRSEESLSAYLQRNNIVAIADIDTRKLTRLLREKGAQNGCIIAGDNLDAALALQKAQAFPGLKGMDLAKEVTTAETYAWQQGSWTLEGDLPEQKQAEALPYHVVAYDYGAKRNILRMLVDRGCRLTVVPAKTPAETVLAMNPDGIFLSNGPGDPEPCDYAIEAIQAFLKTDIPVFGICLGHQLLALASGAKTVKMKLGHHGGNHPVKDLDNNRVMITAQNHGFAVDEANLPANLRVTHISLFDKTVQGIHR

SEQ ID NO: 80079 - protein, 425 aa, Chlamydomonas reinhardtii
MAISAIFFLDIKGRIIIFRDYRGDVSPKYAEKFMSKINEMEEAGKLSPVIYDEGVTYLYLQVSNLYLLAVTRTNVNACSTLVFLHRMVDVFKHYFQELEEESLRDNFVIVYELLDEVMDFGYPQFTEAKILAEYIKTDAYKMEVAVKPPMAVTNAVSWRMEGIRHKKNEVFLDVVESVNLLVSSSGQVVLSEVVGVLKMRTYLSGMPECKLGLNDKVLFESQGRSSKQKSVELEDIKFHQCVRLARFENDRTISFIPPDGAFDLMTYRISQNIKPLIMVDCIVERPSRSRTEYLVKARSQFKERSQANTVEIMLPLPADAISPSMKCSQGSAAYVPEKSALVWTIKSFPGGKEYTLRCHFGLPSVEAEDEGKGKMPPIKVKFEIPFFTVSGVQVRYLKVIEKSGYQALPWVRYITTSGNYEIRMI

SEQ ID NO: 80080 - protein, 360 aa, Oceanicola granulosus HTCC2516
MTKVKAAICRAFGAPLTIEDVELRAPVAGEIEVALEAVAICHSDISYADGAWGGPLPAVYGHEAAGRITAIGPGVTGLREGDRVVVTLIRACRTCAQCGSGRPTLCEDPTSDAPAPMTLPDGDPLWAAMNCGAFAERVVVDQSQAVVVGDDLAPGPAALLACGVVTGVGAVVNSAGLRPGEDALVIGAGGVGLNAIQGARIAGARRIVAVDLAPEKLDAARQFGATDTVLATDPAPWQRVRAAIGRGVDAVFVSVGVAAAYDSAPNYLAPGGRVVMVGMPASGKVSTYEAGNIAAAGQAMIGSKMGDTVIRRDIPWLVDLYGQGRLKLDELVSRQWRLEEINEAIADTKSGGARRNVIVF

SEQ ID NO: 80081 - protein, 573 aa, Pseudomonas syringae pv. syringae B728a
MSRRKRRLEKMTKTSRPLYISYAGPSLLEMPLLNKGSAFTPQERVEFNLIGLLPQNVETIEEQVTRVYSQYKQCASDLDKHIYLRSIQDNNETLFFRLLDSHLDEMLPIIYTPTVGQACQEFSKIYRTHRGLFISYPERDRIDDILRSATKDRIKIIVVTDSERILGLGDQGIGGMGIPIGKLSLYTACGGISPAYTLPIVLDVGTNNRELLDDPMYMGWRHERVSGKEYEDFIALFIDAVQRRWPDVLLQFEDFAQSNAMPLLEKYRDELCCFNDDIQGTASVAVGTLLAACKAKNETLGQQKVVFVGAGSAGCGIAEHIIAAMRIEGLSESEARKRIFMVDRFGLLTESMDNLLDFQKRLAQKTADVSGWTAGSEAFPQLLDVVTHAGATVMIGVSGQRGLFTEQVIRELHKHCAKPLVMPLSNPTSKVEATPEEILRWTDGNALVATGSPFAPVEINGRTVHIAQCNNSYIFPGIGLGVVACKASRITDRMLMAASNALAECSPMVTGKGDAVLPPLKEIQQVSRKIALAVAREAQAEGLALETTEEALLEAIERNFWLPGYRAYRRRSV

SEQ ID NO: 80082 - protein, 534 aa, Silicibacter pomeroyi DSS-3
MKLTSKAMPASEGFKANRAAHLDALAQIGAAAEAARLGGGEKSRARHESRGKMLPRRRVANLLDAGSPFLEIGATAAFDMYDNAAPAAGVVAGIGRVEGQEVMVVCNDATVKGGTYYPMTVKKHLRAQEIAEENNLPCIYLVDSGGANLPNQDEVFPDRDHFGRIFYNQARMSAKGIPQIAVVMGSCTAGGAYVPAMSDVTIIVKEQGTIFLAGPPLVKAATGEVVSAEDLGGGDVHTRLSGVADYLAEDDAHALALARRAVRSLNRRKPLTVDWASPEEPAYDPEEILGVVPADLKTPYDIREVIARLVDGSRFDEFKPRFGETIVCGFAHLKGCPIGIIANNGVIFSEAAQKAAHFVELCSQRKIPLVFLQNITGFMVGRKYENEGIARHGAKMVTAVATTAVPKITMLVGGSFGAGNYGMAGRAYQPRFLWTWPNSRISVMGGEQAAGVLATVKRDGIERQGGSWSAEEEAEFKRPTLEMFERQSHPLYASARLWDDGIIDPRKSRDVLALSLSAALNAPIEDTRFGVFRM

SEQ ID NO: 80083 - protein, 578 aa, Spiroplasma citri
MSKKLHGIGASNGIAIAKVFKLEEPKYEISNNTVSDSAKEIKILEAAMQNANTDIEKLQKIALEKLGAEKAAIFEAHKEILRDPAMIDEAKNIIIKSNNNNAAYAIHTVAQKFITMFASMDDPYFKERAADVKDVTDRLIKYILNVPVLDLATIHEEVIIVAEDLTPSQTAQLNPKFVKGFSCDMGGRTSHAAIMARSLEIPAVLGLKDITKQANHHELVMINGTTGEVILNPMSTEVKTWTAEKEKFLQLQQELLGFKYKPTVSKDGYQKFVLEGNIGAPKDVQGVLDNGGQGIGLFRSEFLYMNNDHFPTEDEQYEAYKGVLEGMQGRPVIIRTLDIGGDKKLSYFKFPEEMNPFLGYRAIRLCLDKTDVFRTQLRALLRASVHGKIGIMFPMIATIDEFNSAKKITLEEKATLIKEGHKVADNIEIGMMMEIPAAAMLADQFAKHADFFSIGTNDLIQYTMAADRMSQFVAYLYQPYNPSVLRLIKTIINGAHKEGKWVGMCGEMAGEEQAIPLLMGMKLDYFSMSATSILNARRIISKLEVSAMEKLVTEALECQTADEVLALVEKSTKNALKA

SEQ ID NO: 80084 - protein, 440 aa, Cochliobolus lunatus
MAITKIHARSVYDSRGNPTVEVDIVTETGLHRAIVPSGASTGSHEACELRDGDKTKWGGKGVTKAVANVNDIIAPALIKEKLDVKDQSAVDAFLNKLDGTENKTKLGANAILGVSMAIAKAAAAEKGVPLYAHISDLAGTKKPYVFRFLSKNVLNGGSHAGGFLLFQEFMIAPAKTFAEALRIRQGAEVYQKLKALTKKTYGQSAGNYGDEGGVAPDIQTAEEALDLIVDAIEAAGHTGQIKIAMDVASSEFFKDDEKKYDLDFKNPDSDKSKWLTYPQLAEMYKSLAEKYPIVSIEDPFAEDDWEAWSHFYKDGDFQIVGDDLTVTNPEFIKTAIELKSCNALLLKVNQIGTISEAINAAKDAFGAGWGVMVSHRSGETEDVTIADIVVGLRSGQIKTNAPARSERLAKYNQILRIEEELGDKRLFAGNKFHTAINLYL

SEQ ID NO: 80085 - protein, 123 aa, Arabidopsis thaliana
  misc_feature (27)..(27): Xaa can be any naturally occurring amino acid
  misc_feature (50)..(50): Xaa can be any naturally occurring amino acid
  misc_feature (88)..(88): Xaa can be any naturally occurring amino acid
  misc_feature (93)..(93): Xaa can be any naturally occurring amino acid
  misc_feature (106)..(106): Xaa can be any naturally occurring amino acid
MVSSMFSSTGVVTPRLKPQWLAPFTGXLKSSASFPVTRKANNDITSITSXGGRVSCMKVWPPIGKKKFETLSYLPELSEVELAKEVDXYLLRXNKWTSLCLNFELXTDLCTVSTETLPDNMMD

SEQ ID NO: 80086 - protein, 124 aa, Crocosphaera watsonii WH 8501
MTATYKVRLIKTVKRKNKETGKKEEINQLDISLDVPEDEYILEAFEDAINHDQIEYPDGLEELPSSCRAGSCSSCLGRMVEGEVDQEDQSFLDDEQLEKGWVLLCVAYPRSDCTIKTHQEANLV

SEQ ID NO: 80087 - protein, 476 aa, Flavobacteria bacterium BBFL7
MPKTKKTKIVATLGPATSSKEVLLGMMKAGVNVFRINFSHADHEDVKERVQMIRDLNEEHGFATGILGDLQGPKLRVGVMKEEVVVNPGDIITISTGEPFKGTAERVYMNYEHFPRDVKAGERILLDDGKLMFEVVSTDGVKDVVTKVIQGGPLRSKKGVNLPQTDISLPALTEKDVVDAIFACELQVDWMALSFVRHSRDLMELQDLIKEHSEHKIPIIAKIEKPEAVTNIDKIVAYCDGLMVARGDLGVEVPAHEVPLIQKQLVLKAKQARIPVIIATQMMETMITSLTPTRAEVNDVANSVMDGADAVMLSGETSVGQYPIQVIEKMTSICLSVENSDLINVPHSAPHIKTKRYITKSICYHAAKMADEIDAKAITTMTNSGYTAFQISAWRPDAHILTFTSNKRILTQLSLLWGVKAFLYDRFVSTDETIEDVNQFAKDKKFVRKGDFLINLAAMPVTDKGMVNTLRVTEIE

SEQ ID NO: 80088 - protein, 711 aa, Haemophilus influenzae 86-028NP
MKQLFATTSRGFEELLKVELTELGAQEAKVVQGGVHYQADDETLYRTLLWSRLASRILFPLIETKIYSDLDLYAAVSGFNWLGLFDERVTFFVDFNGTNQEIRHTQFGAMRVKDGIVDYFERQGKARPDVDKIQPDVRIHAYLNRENLVISLDLSGEALHLRGYREDAGQAPLRETLAAAIVLRSGWQVGSPLVDPMCGSGTLLIEAAQMEAKIAPQLYRLHWGFDFWKAHNQSAWEKVKNEAIELAEEKQREIQPHFYGFDLDHRVLKKAQKNAQNAGVSHLIKWQQGDVAALKNPRLNEVGTVICNPPYGERLGTTPALIALYSVFGQRLKKEFCGWNVSVFSSESTLLDCLRMRASRQFKAKNGPLDCVQKNYQVSERKSDEITAENELEFNRTSEVATDFANRLQKNIKKISKWAKQQGLDAYRLYDADLPEYNLAVDRYADYIVVQEYAAPKNIDENKARQRLLDAVTATLHVTGVETNKLILKVRQKQKGTNQYEKLANKGEYFYVNEYGAQLWVNLTDYLDTGLFLDHRLTRKMIGALAKGKDFLNLFAYTGSATVHAALGGAKSTTTVDMSNTYLNWAEQNLILNDIEGKQHKLIQADCLQWLEKCDRQFDLIFVDPPTFSNSKRMEDSWDVQRDHVKLMRNLKRVLSNNGTIVFSNNKRGFKMNLVALEELGLSAVEISHKTLPLDFERNKQIHNCWMIQHI

SEQ ID NO: 80089 - protein, 174 aa, Triticum aestivum
MASLLEIFVGSCSSSAPPVDWEAEAYPEYADYAVLPLLLAFFPALRLLLNQFLFEVLARRLIFGKGYDKLAETDERRKKINKFKESAWKFVYYLSAELFSLSVTYNESWFTNTRYFWVGPGEQLWPDQKMKLKLKAVYMYAAGFYVYSIFDLLLWETRRKDFGVMMSHHVATIV

SEQ ID NO: 80090 - protein, 105 aa, Lactobacillus reuteri
MAIDATAETFDKDVQGSMTIVDFWAPWCGPCKMMEPAMQNLEKQYGDKIKFVRMNVDGNQEIAQRYKVMSVPSLVLFKDGQAREKVTGYYPEAKLAHYFERKITE

SEQ ID NO: 80091 - protein, 628 aa, Arabidopsis thaliana
MALSVFAFPSYINRNPSLKYLKPSSMSSTKYSKVRATTFSEKGEYYSNRPPTPLLDTINHPMHMKNLSIKELKVLSDELRSDVIFNVSKTGGHLGSNLGVVELTVALHYIFNTPHDKILWDVGHQSYPHKILTGRRGKMKTIRQTNGLSGYTKRRESEHDSFGTGHSSTTLSAGLGMAVGRDLKGMNNSVVSVIGDGAMTAGQAYEAMNNAGYLHSNMIVILNDNKQVSLPTANLDGPTQPVGALSCALSRLQSNRGMIRETSSTLFEELGFHYVGPVDGHNIDDLVSILETLKSTKTIGPVLIHVVTEKGRGYPYAERADDKYHVLKFDPETGKQFKNISKTQSYTSCFVEALIAEAEADKDIVAIHAAMGGGTMLNLFESRFPTRCFDVGIAEQHAVTFAAGLACEGLKPFCTIYSSFMQRAYDQVVHDVDLQKLPVRFAIDRAGLMGADGPTHCGAFDVTFMACLPNMIVMAPSDEAELFNMVATAAAIDDRPSCFRYHRGNGIGVSLPPGNKGVPLQIGRGRILRDGERVALLGYGSAVQRCLEAASMLSERGLKITVADARFCKPLDVALIRSLAKSHEVLITVEEGSIGGFGSHVVQFLALDGLLDGKLKVYRTWITNGSTS

SEQ ID NO: 80092 - protein, 327 aa, Pantoea agglomerans
HGRAIGATGSAVGEVVFNTSMTGYQEILTDPSYSRQIVTLTYPHIGNVGTNAADEESSQIHAQGLVIRDLPLIASNFRSEEGLSAYLQRNNIVAIADIDTRKLTRLLREKGAQNGCIIAGDNPDAALALQKAQAFPGLKGMDLAKEVCTTETYSWQQGSWTLEGGLPEQADAESLPYHVVAYDYSAKRNILRMLVDRGCRLTVVPAQTPAEEVLKLNPDGIFLSNGPGDPEPCDYAISAIQAFLKTEIPVFGICLGHQLLALASGAKTVKMKLGHHGGNHPVKDLDNNRVMITAQNHGFAVDENNLPANLRVTHISLFDKTVQGIHR

SEQ ID NO: 80093 - protein, 435 aa, Methanococcus maripaludis S2
MNELGNLKIAVFGQGKMGLPLASVFAEYGINVIGVDINQMVVDNLNNGINHITEEPGLSELVSKNVENKKYTATTDGVGAATDADIIVILVPTLIDDRGNIKLDPVYSVSEIISKGLKKGNIVITEATMPPGTTEKLIPILEKSGLKLGEFGLAHAPERTMTGTALRDIKGQYPKIIGCSDERTHNIVSKLYDLINKKGTIKMSSIKAAETVKVFEGVYRDVNIGLSNEMALWCEEHSINALEVFEAANTQPFCHFHTPGAGVGGHCIPVYPWFVINTSNEVNPRITKTARELNDYMAHHIVELTIKGLNEFKKCLNGSKILVLGLTFRGGVKEFMKSAAIPIINELNSLGANVYSYDPLCDELDAKKYNSKLKTDFNGIDAIIVTSDHEEFKHLDFEKISKEVSTKLIVDGRNIINVSNATENGFRVIKVGNLK

SEQ ID NO: 80094 - protein, 327 aa, Pectobacterium cypripedii
HGRAIGATGSAVGEVVFNTSMTGYQEILTDPSYSRQIVTLTYPHIGNVGANAADEESSQIHAQGLVIRDLPLITSNFRSEESLSAYLQRNNIVAIADIDTRKLTRLLREKGAQNGCIIAGDKPDAALALQKAQAFPGLKGMDLAKEVTTAETYAWQQGSWTLQGDLPEQKSAEELPFHVVAYDFGAKRNILRMLVDRGCRLTVVPAQTSAEEVLKLNPDGIFLSNGPGDPEPCDYAINAIQAFLNTDIPVFGICLGHQLLALASGAKTIKMKLGHHGGNHPVKDLDNNTVMITAQNHGFAVDESNLPANLRVTHVSLFDQTVQGIHR

SEQ ID NO: 80095 - protein, 327 aa, Erwinia amylovora
HGRAIWATGSAVGEVVFNTSMTGYQEILTDPSYSRQIVTLTYPHIGNVGTNSADEESTQVHAAGLVIRDLPLIASNYRNEEGLSEYLTRHNIVAIADIDTRKLTRLLREKGAQNGCIIAGEAPDAAAALEKARTFPGLKGMDLAKEVTTPDAYTWLQGSWTLETALPTAKAEGELPYHVVAYDYGVKRNILRMLVDRGCRLTVVPAQTSAEEVLKLNPDGVFLSNGPGDPEPCDYAITAINRLLETNIPLFGICLGHQLLALASGAKTVKMKLGHHGGNHPVKDHDNNTVMITAQNHGFAVDDSNLPANLRVTHTSLFDHTVQGIHR

SEQ ID NO: 80096 - protein, 327 aa, Erwinia pyrifoliae
HGRAIGATGSAVGEVVFNTSMTGYQEILTDPSYSRQIVTLTYPHIGNVGTNSGDEESTQVHAAGLVIRDLPLIASNYRNEEGLSDYLTRHNIVAIADIDTRKLTRLLREKGAQNGCIIAGEAPDAAFALEKARAFPGLKGMDLAKEVTTPDAYTWLQGSWTLETELPTAKAEGELPYHVVAYDYGVKRNILRMLVDRGCRLTVVPAQTPAEEVLKLNPDGVFLSNGPGDPEPCDYAMTAINRLLETNIPLFGICLGHQLLALASGAKTVKMKLGHHGGNHPVKDHDNNTVMITAQNHGFAVDDRNLPANLRVTHTSLFDHTVQGIHR

SEQ ID NO: 80097 - protein, 327 aa, Erwinia rhapontici
HGRAIGATGSAVGEVVFNTSMTGYQEILTDPSYSRQIVTLTYPHIGNVGTNSADAESSQVHASGLVIRDLPLIASNYRNEEGLSDYLTRHNIVAIADIDTRKLTRLLREKGAQNGCIIAGDALDAAVALEKAKAFPGLKGMDLAKEVTTKDAYQWLQGSWTLEGELPAPKTDADLPFHVVAYDYGVKRNILRMLVDRGCRLTVVPAQTSAEDVLKLNPDGVFLSNGPGDPEPCDYAITAIKRLLETDIPVFGICLGHQLLALASGAKTVKMKLGHHGGNHPVKDHDNNTVMITAQNHGFAVDDSQLPSNLRVTHTSLFDHTVQGIHR

SEQ ID NO: 80098 - protein, 481 aa, Elaeis guineensis
LTFVDLSRNNLSGEIPAEIAGIRILNYLNVSRNHLEGSIPPSIATMQSLTAVDFSYNNLSGLVPSTGQFSYFNVTSFVGNAELCGPYLGPCGFTNSSGSTHARGPLSASFKLLLGHWSPPLFHCLRHRRHHQKLGSFEEGRARPGHGSLTAFQRLDFTCDDVLDWLKEENIIGKGGAGIVFQGCDAQRRTVAVKKLPAINPGSSHEHGFSAEIQTLGRIRHRHIVRLLGFCSNHETNLLVYEYMPNGSLGEVLHGKKGGHLRWDTRYKIAVEAAKGLCYLHHDCSPLILHRDVKSNNILLDSDFEAHVADFGLAKFLQDSGTSECISAIAGSYGYIAPEYATLKVDEKSDVYSFGVVLLELVTGRKPVGEFGDGVDIVQWVRKVTDTNKEGILKIIDPRLSSVPLHEAMHVFYVAMLCVEEQSVERPTMREVVQILTELPGTPAKQGEDPPPPPPVGGETPPRESKPRQEQQSPPPDLLSI

SEQ ID NO: 80099 - protein, 133 aa, Brassica napus
  misc_feature (46)..(46): Xaa can be any naturally occurring amino acid
MAPRGGHAAASSGSEDEEEEAEAGFSRSYFLAKEKEPSSAKKRARXAAAVGKLSNLNLVDEQVLRASLAEIPPKHEKEVEALTRSYKDQYRNWLFELRCGFGLLMYGFGSKKLLLEDFASTTLTDFTVIVVNG

SEQ ID NO: 80100 - protein, 254 aa, Escherichia coli
MRHPLVMGNWKLNGSRHMVHELVSNLRKELAGVAGCAVAIAPPEMYIDMAKREAEGSHIMLGAQNVDLNLSGAFTGETSAAMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKVDANIAEQVIIQYGGSVNASNAAELFAQHDVDGFLVGGASLKPEFVDIINAAEAAKQA

SEQ ID NO: 80101 - protein, 322 aa, Microcystis aeruginosa PCC 7806
MDIKHGFVDAVGNTPLIRLNSFSEETGCEILGKAEFLNPGGSVKDRAALYIIQEAEKAGTLQPGGTVVEGTAGNTGIGLAHICNAKGYKCLIIIPDTQSQEKIDLLRTLGAEVRTVPAVPYRDANNYVKLSGRLASEMENAIWANQFDNLANRRAHYETTGREIWEQTDGKIDAWVAATGTGGTYAGVAMFLKDQNPQVRCVVADPMGSGLYSYVKTGTITLEGSSITEGIGNSRITANMEGAPIDDAIQIDDPTAIKVVYQLLQKDGLFMGGSVGINVGAAVALAKQMGPGHTIVTVLCDGGSRYQSRLYNPQWLAEKGLA

SEQ ID NO: 80102 - protein, 592 aa, Pseudomonas syringae pv. syringae B728a
MPTRTSRRTFVKGLAASGLLGGLGLWRSPAWAVANPGQPNGLSGTEFDLYIGETQVNITGNAKTAQTINGGIPGPLLRWREGDTVTLRVKNRLDEATSIHWHGIILPANMDGVPGLSFDGIAPDGMYVYRFKVRQHGTYWYHSHSGFQEQSGVYGPLVIDPKEPEPFEYDREHVIMLSDWTDEEPVQLMKTLKKQSDYYNNNQRTVGDFINDVGEKGWSETTRDRWMWAQMRMDPTDLADVSGATYTYLMNGQAPNMNWTGLFKPGERIRLRLINGSAMTYFDVRIPGLKMTVVASDGLHVKPVTVDELRIAVAETFDVIVEPAEGAYTLFAQSMDRTGYARGTLASRPGLQAAVPPLDPRPLSSMDDMGMAGMEHGSMNHAAAPATHDMSGMDHSKMGHDAMPGMDHAQTPAQKTPTPQSHPESENNNPLVDMQAMSTSPKLDDPGIGLRGNGRRVLTYADLRSTFEDPDGREPSRTIELHLTGHMEKYAWSFDGVKFSDAKPLMLKYGERVRVVLVNDTMMTHPIHLHGMWSDLEDENGQFMVRKHTIDMPPGSRRSYRVTADALGRWAYHCHMLYHMEMGMFREVRVEE

SEQ ID NO: 80103 - protein, 683 aa, Physcomitrella patens subsp. patens
MLSLSLSLSLSLSTLALSPAIDGVDVSAYVVKAAPHSGAVSFPQSLGPLKRWTVGVVREWAFDCMYKNQLQELAQRSCFNLPAYACIREGPDHAPRFKATVNFNGEVFESPNYCNTLRQAEHAAAEVALNTLSRRGPSQSLAARILDETGVCKNLLQETAQRAGVSLPVYATTRSGPGHLPVFTCTVEVANMSFSGEAAKTKKQAEKNAAMAAWSAIQQLANQGRGVPLATEGEVSEEQEQNTIARALAQHYGKESQQLPHSTQNPSSSVMPIRLRTLTSRDGLQPGSPRLNQSHSGPWATDLSMEQQRHTRNQGHSSVGPVASPAYRPVGTSRIGSSVTIRDVTGHRDSAALRDASAMRDAALAKRAVERAMCGNFVGRHSPVNLRPVPQMRRDRHEVAVHYDNHQRDEDEWLRGESTKASRDVDCLNDSLEELGASAVHGSYNPMSWSGAGVSNWWNMHPAAMPRASSRAAMPVVLRPAVMVCAAPPLRPEPDDAENEGEAATHQGMLTRSSGDVSVRVHRMDSCLQVSLSVILTVYGSCKRDGECGGIFVSGASCGAISHVYSNGIVLIGDFVLTEGRQPRKGNSNIQLLQALAGRIGNASQVQLGCDDDDCVRVKRELYFRTKLWHTIVDQLVTAGIGISSRVGVAGHRDAELCAAWQNPREVHICVIAWKQLSFVFAV

SEQ ID NO: 80104 - protein, 196 aa, Haloquadratum walsbyi
MVDINFLGVGIGATLTLLAVSLHYARGTGWTPTADISQEVLEKRASTVPETEFPEPMNRSIGGGAIPAGSVTGGGGELEETDTEVDESEQVPGDIPDEEAEYFEVEFEKQGSTIEVASNQTVLTAGENESWDLPYACRQGQCVSCAGQITSGGNAEDYVEHDNQQMLDDAELEHGYTLTCVAYPKDDFTIETGEAP

SEQ ID NO: 80105 - protein, 158 aa, Linum usitatissimum
GWIYGSITEDILTGFKMHCHGWRSIYCIPERPAFKGSAPINLSDRLHQVLRWALGSMEIFLSRHCPLWYGYGGRLKLLERLSYINATIYPLTSIPLLIYCTLPAVCFLTGKFIIPELNNAANLWFLSLFICIFATSLLEMRWSGVGIDEWWRNEQFWV

SEQ ID NO: 80106 - protein, 306 aa, Haloquadratum walsbyi
MQLGVVGLGRMGQIVVDRLVTAGHDIVAFDLDAEAVATAADIGATPADSLDTLLDTLGETKRLWLMVPAGEAVDATLTQLEPSLTETDIIVDGGNSHFEASIRRAETSDATYLDCGTSGGPAGAELGFSLMIGGQQWAYDELIPVFDAIATGPDGHDRMGPVGSGHYVKMVHNGVEYALMQTYGEGFELLANGRYDLDLAAVARTWNNGAVIRSWLLELCEEAFRAEGVDLGNVADYIAGGSTGTWTVQEALEQEVPVPLIYQALAERFGSRATGATGDPDGRFSRRVANRLRYGFGRHDVARRDE

SEQ ID NO: 80107 - protein, 236 aa, Crocosphaera watsonii WH 8501
MFGSLPVRERHGSPSKSSIAEARTSEANLLSVLRQDFQIIFKRDPAAHHWLEVVCCYPGLHALAIHRLSHYLWQRHLPFFPRLLSHIARFLTGIEIHPGATIGKGVFIDHGMGVVIGETAIIGDDCLIYQNVTLGGTGKESGKRHPTLGHSVIVGAGSKVLGNICIGSQVRIGAGSVVLDDVPHDCTVVGVPGRIISRSGPFCPLEHGKLPDVEGQVIRTLLDRIEKLEQKIQKLS

SEQ ID NO: 80108 - protein, 335 aa, Ashbya gossypii ATCC 10895
MGVTVIGSLNYDLVTYTDKVPGAGETFAGEHFETHVGGKGLNQAIAVSKLQADAGDEKVRIVGNVGRDPFGDEILEVARQNRVQVEHVGVVAGTKTGTATILVERKTGQNRIVIVSGANAKTVLEESNMEQVFPKNTSPGQHYIILQHEISDPVAYMRWLKLNRPAYQIVFNPSPFQELPADAWKDVDVLVVNEVEAFQLYMCITGSGSSKFSESEPDNMVDKFRVILSELMERGVLGKSRSGTIIVTLGEYGVLYASAASSRVLYVPAEQVVKVVDTTAAGDTFLGGLVAQLDSGSTLDDAVRFAVQASAIAVTREGASSSIPTHAEVEGKYHL

SEQ ID NO: 80109 - protein, 541 aa, Zea mays
MSLAGRRKSSHAGAGAGAGAGALDASATKHATTSLRKGGRLPVYVASVFFFLCVVVMYGEDIRSLTIEPLTRVPAPAVPGTTGAGGRQVVVVPRRDISASEKPAAVLHRGEQEKPKKHAVTTTTTTTAPPVAVEKPQQKVVATAAAKSERNTAKKAAAKKKKKPRRQQRAAKKTVVPPALGVPETCDLSKGRWVFDNTSYPLYREEECEFLTSQVTCMKNGRRDDTYQKWRWQPKGCSMPRFDAKLFMERLRGKRFMFVGDSLNRNQWESMVCLVQSASPPGKKYVTWEGQRVVFHAWEYNATVEFYWAPFLVESNSDDPKIHSIQHRIIKADTIGAHAENWRGVDYLVFNTYMWWMNTLDMKVMRPGAKSWEEHDEVVRIEAYRKVLMTWASWVNDNVDPARTSVFFMSMSPLHISPQVWGNPDGIRCAKETMPLLDWHGPLWLGMDWDMFHQARNVSRGGGASPRVPITFLDITTMSERRKDGHTSVHTIRQGKVLGPEEQADPATYADCIHWCLPGVPDIWNLMLYTRILSRPAVQFQ

SEQ ID NO: 80110 - protein, 118 aa, Glycine max
YLICSHRFKIKGRVYPAILPVQNNKVNGRVLLGISGVELEILDEFEDVEYTRTDVEVSLKDKSEKLQVCAYVWSNPNDPNLNAEWDFEEWKQVHLNDFVKMTGGFMQELELPESKPRV

SEQ ID NO: 80111 - protein, 327 aa, Erwinia persicina
HGRAIGATGSAVGEVVFNTSMTGYQEILTDPSYSRQIVTLTYPHIGNVGTNAADAESTQVHAQGLVIRDLPLIASNYRNEEGLSDYLTRHNIVAIADIDTRKLTRLLREKGAQNGCIIAGDAPDAAEALAKAKAFPGLKGMDLAKEVTVAQPYSWQQGSWTLEGELPAPAAAADLPFHVVAYDYGVKRNILRMLVDRGCRLTVVRAQTSAEDVLKLNPDGVFLSNGPGDPEPCDYAITAIKRLLETDIPVFGICLGHQLLALASGAKTVKMKLGHHGGNHPVKDHDNNTVMITAQNHGFAVDDSNLPANLRVTHTSLFDHTVQGIHR

SEQ ID NO: 80112 - protein, 182 aa, Cryptococcus neoformans var. neoformans JEC21
MGLSVSKLLNGLFGKKEMRILMVGLDAAGKTTILYKLKLGEIVTTIPTIGFNVETVEYKNISFTVWDVGGQDKIRPLWRHYFQNTQGIIFVVDSNDRERITEAREELQRMLSEDELRDALLLVFANKQDLPNAMNAAEITDKLGLHSLRQRSWYIQAACATSGDGLYEGLEWLSANLKRKSP

SEQ ID NO: 80113 - protein, 258 aa, Arabidopsis thaliana
MSAFEDDSFVILNDDASESVPVSGSFDATESFSAFDGSLQVEDSVDDVFAAPSSDYGAYSNGDGIFGSNGDHDGPILPPPSEMESDEGFALREWRRQNAIQLEEKEKREKELLKQIIEEADQYKEEFHKKIEVTCENNKAANREKEKLYLENQEKFYAESSKNYWKAIAELVPKEVPTIEKRRGKKEQQDPKKPTVSVIQGPKPGKPTDLTRMRQILVKLKHNPPSHLKLTSQPPSEEAAAPPKNVPETKPTEAVTAA

SEQ ID NO: 80114 - protein, 326 aa, Erwinia tracheiphila
HGRAIGALGSAVGEVVFNTSMTGYQEILTDPSYSRQIVTLTYPHIGNVGTNSADQESSQVHAQGLIIRDLPLITSNFRSEEGLSAYLERHNIVAIADIDTRKLTRLLREKGAQNGCIIAGDAPNAALALQQAQAFPGLKGMDLAKEVTTSETYSWLQGSWQLEGLPAPKNEDGQSFHVVAYDYGVKRNILRMLVDRGCRLTVVPAQTPAEEVFKLNPDGVFLSNGPGDPEPCDYAITAIQKLLETDVPVFGICLGHQLLALASGAKTVKMKLGHHGGNHPVKDLDNNTVMITAQNHGFAVDDRNLPANLRVTHTSLFDHTVQGIHR

SEQ ID NO: 80115 - protein, 326 aa, Erwinia psidii
HGRAIGALGSAVGEVVFNTSMTGYQEILTDPSYSRQIVTLTYPHIGNVGTNSADEESSQVHAQGLVIRDLPLIASNFRSEEGLSAYLERHNIVAIADIDTRKLTRLLREKGAQNGCIIAGDAPDATLALQKAQAFPGLKGMDLAKEVTTSETWCWLQGSWQLDGLPAPVDEDEQPLHVVAYDYGVKRNILRMLVDRGCRLTVVPAQTPAEEVLKLNPDGVFLSNGPGDPEPCDYAITAIRKLLETDVPIFGICLGHQLLALASGAKTVKMKLGHHGGNHPVKDLDNNTVMITAQNHGFAVDEHDLPACLRVTHTSLFDQTVQGIHR

SEQ ID NO: 80116 - protein, 452 aa, Rhodobacter sphaeroides 2.4.1
MAFDYDLFVIGGGSGGVRAARIAASEGGATVALAEESRMGGTCVIRGCVPKKLMVFASGYPDAVEDARAYGWDASIGGFDWPAFRGKLDRELDRLEAAYRSGLTSAGVEIFDERATVADAHTVALASGRKVTAKHILIATGGRPFVPDFPGCELAMSSDDVFQLESLPTSILVVGGGYIASEFACILHGLGVEVCQFYRGAQILRGFDDEARGHVASAMIDRGIHIKCGTDVIRLEKTERGVRAVTTDGSDQEFGAVLYATGRRPNTRGLGLEALGIELGRHGQIPVDGWSQTSVPSIYAVGDVTDRINLTPVAIREGHAFADTVFKGEPRQADHELVASAVFTQPELGSVGLSEEAAREQEPIEVYAAAFRPMQSLFAGRPDRVLMKLIVSQASRKVLGCHIVAPNAGEMIQLAAIAVKMGATKEDFDRTVAVHPTMAEELVTLRKPIRTA

SEQ ID NO: 80117 - protein, 326 aa, Erwinia mallotivora
HGRAIGATGSAVGEVVFNTSMTGYQEILTDPSYSRQIVTLTYPHIGNVGTNSADEESSQVHAQGLVIRDLPLITSNFRSEEGLSAYLERHNIVAIADIDTRKLTRLLREKGAQNGCIIAGDAPDAALALQKAQAFPGLKGMDLAKEVATKETYSWLQGSWQLEGLPAPKSEAELPYHVVAYDYGVKRNILRMLVDRGCRLTVVPAQTSAEDVLKLNPDGVFLSNGPGDPEPCDYAITAIKKLLETDVPLFGICLGHQLLALASGAKTVKMKLGHHGGNHPVKDLDKNTVMITAQNHGFAVDNNNLPDNLRVTHTSLFDHTVQGIHR

SEQ ID NO: 80118 - protein, 192 aa, Yarrowia lipolytica CLIB122
MSDPINANPEVIDVSALPTRNKGQSQLDLPLGAFLDTHPTPLSLIQNESASGSDDDDDDDEPEPIDSQEIYDLIATISDPEHPLTLGQLAVVKLEDIWVHDTGDKNKMAEIVVKITPTITHCSLATLIGLGIRVRLERALPPRFRFTITVKEGTHQSENQVNKQLNDKERVAAACENEQLLGVISGMLATCQ

SEQ ID NO: 80119 - protein, 363 aa, Salmonella typhimurium LT2
MSKNYHIAVLPGDGIGPEVMAQALKVMDAVRSRFDMRITTSHYDVGGIAIDNHGHPLPKATVEGCEQADAILFGSVGGPKWENLPPESQPERGALLPLRKHFKLFSNLRPAKLYQGLEAFCPLRADIAANGFDILCVRELTGGIYFGQPKGREGSGQYEKAFDTEVYHRFEIERIARIAFESARKRRRKVTSIDKANVLQSSILWREIVNDVAKTYPDVELAHMYIDNATMQLIKDPSQFDVLLCSNLFGDILSDECAMITGSMGMLPSASLNEQGFGLYEPAGGSAPDIAGKNIANPIAQILSLALLLRYSLDANDAATAIEQAINRALEEGVRTGDLARGAAAVSTDEMGDIIARYVAEGV

SEQ ID NO: 80120 - protein, 327 aa, Enterobacter cloacae subsp. dissolvens
IGRAIGATGSAVGEVVFNTSMTGYQEILTDPSYSRQIVTLTYPHIGNVGTNAADEESSQVHAQGLVIRDLPLIASNFRNTEDLSSYLKRHNIVAIADIDTRKLTRLLREKGAQNGCIIAGDNLDAALALEKAKAFPGLNGMDLAKEVTTTEAYSWTQGSWTLEGDLPEAKPESELPFHVVAYDFGAKRNILRMLVDRGCRLTVVPAQTSAEEVLKMNPDGIFLSNGPGDPAPCDYAINAITSFLETDIPVFGICLGHQLLALASGANTIKMKFGHHGGNHPVKDIDNNTVMITAQNHGFAVDEASMPSNLRVTHKSLFDGTLQGIHR

SEQ ID NO: 80121 - protein, 405 aa, Triticum aestivum
  misc_feature (160)..(160): Xaa can be any naturally occurring amino acid
KCSVWHGELFSVNKDDGIEIRSEYTLYIRLAARDFPSSTRDKRKPVLTGVVIAASVIGFGLLMLMLLLVISRNRFSWCGVSSNATNEGSVGVVAFGYANLGRATKNFTEKLGAGGFGTVFKGALSDLTSVAVKRLEGARQGEKQFRAEVSALGLIQHINXLVKLVGFCCHGDKRLLVYEHMCNGSLDPHLFQSNGTVLDWSTRYQIAIGVARGLSYLHHSCRECIIHCDIKPENVLLDESFVPKIADFGLASVIGRDFSRVLTTFRGTTGYLAPEWLSGVAITSKVDVYSFGMVLMEIISGRRNASVVHTSGSDHVAYFPVQAINKLHEGDVQSLVDPQLYGDFSLDEVERVCNVACWCIQDNELDRPTMGEVVRVLEGVKELDMPPMPRLLAAMTAECSDVASM

SEQ ID NO: 80122 - protein, 163 aa, Salmonella typhimurium LT2
MRRILSVLLENESGALSRVIGLFSQRGYNIESLTVAPTDDPTLSRMTIQTVGDEKVLEQIEKQLHKLVDVLRVSELGQGAHVEREIMLVKIQASGYGREEVKRNTEIFRGQIIDVTPTLYTVQLAGTSDKLDAFLASLRDVAKIVEVARSGVVGLSRGDKIMR

SEQ ID NO: 80123 - protein, 640 aa, Magnaporthe grisea 70-15
MHLIQSLVWALPLALPLVAADIEDVGDKPRKFEYTITWEKGSPDGFEREMAFINGRFPGPVVEANQGDNIEIVVTNQMPFNTTIHWHGIEQKGTPWSDGVPGLTQRYIMPGKNFTYKWKAEQYGSYWYHAHARGQIDDGLYGGILIHPSNTTQDSLSLIARNASQLAAMRTAVRNVQPIILSDWRHLKSMDAWQINVDSKLETPCYDSLLVNGKGQVNCWSQQKINQLTNGIQRRFLQTANMQQMTAKGCLPAKAVQMTFARNMPGNLSAIPKEVFDVCTPTQGQQSVIKVKQAAGATEYWQAFDIVGTFGLVNAAVSMDEHPMYVYAVDGGYIQPQLVQAISVSNADRYSVLVKVDRPGDYTLRVASNSVIQMMSVTATVRILGANSAETADGSDNFITPTSANATSASGSSPAPSNVRRQLPGASSTPYINDVGQGTSQSVTFFSQNNQRQYPADPPGQTVAQTFKMQLRHDGSAYKWALNDTIYPLNADDAYPVLFKPPVNRQDGTTITTRNNTWVDFIFESSTFPTPPHPVHKHGTHMYLIGSGQGNFTWNTVAEAARANPGRFNLQNPPKRDSFQSVPAVVQPSWIAVRYFSSDPGPWLMHCHIQTHLEGGMAMAIIEGPEVWPATPETYLNYDQ

SEQ ID NO: 80124 - protein, 158 aa, Linum usitatissimum
GWIYGSVTEDILTGFKMHCHGWRSVYCIPKRPAFKGSAPINLSDRLHQVLRWALGSVEIFFSRHCPIWYGYGGGLKWLERFSYINSVVYPWTSIPLLVYCTLPAVCFLTGKFIIPELNNAANLWFLSLFICIFATSLLEMRWSGVGIDEWWSNEQFWV

SEQ ID NO: 80125 - protein, 381 aa, Synechococcus sp. WH 7805
MMTASSVNPAMLMLADGTVFQGLACGAVGSAVGEVVFNTGMTGYQEVMTDPSYSGQLVTFTYPELGNTGVNDHDQEADHAHVRGLIARQLSPVSSSWRSTQSLQAWLEQQGVVGIQGIDTRALVRHLRETGAMNGIISSSGRSPADLREELRAAPSMEGLNLADRVTTQTPYTWEKPCSVAFDRRLQSSRSERPYRVVAIDFGIKRAILDRLVSHGCAVTVVPASVDLNTVLAHEPEGVFLSNGPGDPAAVTHGIDLARGLLEHQALPLFGICLGHQILGLALGGETFKLGYGHRGLNHPCGTSGQVEITSQNHGFALDASSLPQDKVEITHLNLNDRTVAAIAHRHQPVFSVQYHPEASPGPHDADHHFSRFVTLMSDRR

SEQ ID NO: 80126 - protein, 158 aa, Linum usitatissimum
GWIYGSVTEDILTGFKMHCRGWKSVYCCPERAAFRGSAPINLSDRLHQVLRWALGSIEIFMSHHCPLWYGWGGKLKFLQRLAYINTVVYPFTSIPLLAYCTIPAVCLLTGKFIIPQISNLASIWFLALFLSIIATSVLELRWSGVSIEDLWSNEQFWV

SEQ ID NO: 80127 - protein, 441 aa, Bacillus cereus ATCC 14579
MKITIVGTGYVGLITGVGLAKLGHSVTCFDIDDEKIERIKQGDLPIYEVRLHELINYAYENNALIFTSNKEEAFDDVEFIFIAVGTPPLLDGTADLTYIQSACNDIGLYATNDIIVVTKSTVPVGTNDVMKGWIEEKLKGRHTVHIVSNPEFLREGSGIYDFFHGDRIVIGADSEEVARRVESLYSELCLETYVTDIKSAEMIKYASNAFLATKISFINEISNICEKVGANVLDVAKGMGMDKRIGASFLNAGIGYGGSCFPKDTKALVQIAGNVAHDFRLLKAVIEVNNKQQLLLIEKAKKVMNMSKKRIAVLGASFKPNTDDIREASSLIIIEALLNIGAEIVLYDPKAIQYVKNIFGDAIQYSRCIDESIRDASAVFIVTEWEDIQTYPLEKYVQLMREPILFDGRNCYTDEDVKKQKIDYYSVGRKSICNRKVSVMR

SEQ ID NO: 80128 - protein, 639 aa, Oryza sativa Japonica Group
MAVAAPSFPGMVQWWEEWQLRVLALTSLFLQLFLLVSATFRKYRVPALLRSCIWLAYLGGDALAIYALATVFNRHRQTASTDHGSVLEVMWVPVFLVHLGGQDSITAYNIEDNELWARHAVAMSSEAAVAVYVFWRSWSGGQVPESSPALLLFAAGFLKLGERLWALRRASFTRLAAVRSSAAGRRTPAREEEEDAGDDHIPLESYVHLASGYVQSQATGDHVPRPKDNYVFHVHPLIEPELQDVLMELFVDFPAPYPRRLAYLRSFLALEDDDAYEELCALLNQAFQFFYTKKEAAFNDSRKDGFDGSDVVVSYVLLCSTLVLEICALLWLADWRFVTSRIQPEMQRTVAQFNLIGFATRRRWPTMVVMRIAALFRCKKYVNQHWYLGHLSSTPIIIEFIGKDLKSRWVDDLTNAAAYRRFNDRRGQWTLRRERCYQELGWSVTELPFDEAVLVWHIATDIYLDCNNGIENPPATADERAAVKCSREISNYMMYLLLFQPDMLMPGTRQSLFAVACREIKHALRDQRQRLDERGVARWISENPNAAQPGDHLAAARRLAEAMMQMNDAGRMLKVISGVWVEMICYSASRCRGFLHAKSLGAGGEFLTVVWLLLHRMGMEVLADKLQKPEIPRHVQILP

SEQ ID NO: 80129 - protein, 195 aa, Thermoanaerobacter tengcongensis
MSLVPIVVEQTNRGERAYDIFSRLLKDRIVFLGDEINDTTASLVIAQMLFLEAEDPDKDIWLYINSPGGSITAGLAIYDTMQYIKPDVVTLCVGMAASMAAFLLAAGAKGKRFALPNSEIMIHQPWGGMQGQATDIKIHAERLLRLRDKLERILSENTGQPLEKIKADMERDYFMTAEEAKTYGIIDDILVRHKK

SEQ ID NO: 80130 - protein, 342 aa, Bordetella petrii
MKRKTLTQYLVEQQRSANALGPEVRLLIEVVARACKAISHAVSKGALGGVLGSLESENVQGEVQKKLDVLSNEILLEANEWGGHLAAMASEEMETIHLIPNRYPKGEYLLLFDPLDGSSNIDVNVSIGTIFSVLHAPHRVAGAEEVCEQDFLQPGSQQVAAGYAVYGPQTMLVLTIGTGVVGFTLDREMGSWVLTHENMRVPEDTKEFAINMSNMRHWAPPVRRYIDECLAGTTGPLGKDYNMRWIASMVADVHRIMTRGGIFMYPWDAREPGKAGKLRLMYEANPMSMIIEQAGGAAIDGTRRILDIQPDKLHQRVSVILGSKNEVERVGRYHAEAAQAPA

SEQ ID NO: 80131 - protein, 279 aa, Oryza sativa
LLSYGRIVNICFAFIRWFRISSVLEVRRDTGSLATQYLTSGPNTCGLSVISDSLRENYSGLNLKTPKAERDLSTSIVNDFGDGTYTVAFDEDKIYTTVTDSGEEVEEWLDEIVRIHHRRLDHLIVGLDVEWNPASGFCALGPVAVLQICVGRRCLVFQIIHADYVPDQLGDFLGDGRFTFVGVGIHDDVDKLREHYDLEVENAVDLRYLAAQTIGKPALRSTGLQGLVWEVMDVWMEKPHHVRVSAWDSRQLTLDQVMYACADAFASFEVGRSLYDDYE

SEQ ID NO: 80132 - protein, 324 aa, Pseudomonas syringae pv. syringae B728a
MSRIYADNAHSIGNTPLVQINRIAPRGVTILAKIEGRNPGYSVKCRIGANMIWDAESSGRLKPGMTIVEPTSGNTGIGLAFVAAARGYKLMLTMPASMSIERRKVLKALGAELVLTEAAKGMKGAIAKAEELLAGNPGKYFMPAQFENPANPAIHEKTTGPEIWADTDGAIDVLVAGVGTGGTITGISRYIKHTEGKPILSVAVEPDGSPIITQAMAGETITPSPHKIQGIGAGFIPKNLDLSIVDRVERVTDEESKAMARRLMQEEGILCGISCGAAMAAAVRLAEKPEMQGKTIVVVLPDSGERYLSSMLFSDLFTDQELSQ

SEQ ID NO: 80133 - protein, 1003 aa, Silicibacter sp. TM1040
MDHWASAMEQHWGIQAELRQLDGEYDLNFLAETPEGTGYVVKAMRPDCEDWLVDMQIRTLDHISAADADLPCPRVIPARSGQKMLRLEDAHGNARLVWVIERLAGKCYAEAAPKTDALIAQVGQILARTTVSLQDFDHPHLARDFKWDLMQADWVNGALDCLEDGARRALIADIGDQFTALKPALAKLPQQAIHNDANDYNILVNGGAGTGIEPKISGLIDFGDMCRAPRICDLAIAAAYVVLDHPKPEAALTALVSGYHAENPLSAPELDLLWPLLRMRLAVSVVNSTLMATENPHDPYVTISQAPAWRFLEGHDLNGDLMAARLRAACGLPVVEGADRVMAWLDEARGSFAPLMGQDLTDVPMGSLSVEKSLWPQNPFDMPLAEAARVGEEFNTEDQIWLGYYHEPRLIYTAPAFRNGPWKASDRRTVHLAVDGFAPAGTTLHAPLEGEVWVVENRDSHLDYGGVIILRHKTPEGDPFYTLYGHLDPEVVTRLQPGDPITKGEAFCRLGTAEENGGWAPHVHFQLALSCDGIETDWPGVGSPDDMYLWRALCPNPAALLNLPDDKTCYRPTDKSTVLEKRRAHFGGNLSLTYSDPVMLVRGWKHHLFDEWGRPYLDAYNNVPHVGHAHPRIQAVAADQLRRMNSNTRYLHPAQTAFADKVLSKLPDHFEVCFFVNSGTEANELALRLARAHTGAKGMVTPDHGYHGNTTGAIDLSAYKFNKPGGVGQADWVELVEVADDYRGSFRRDDPDRAQKFADLVDPAIATLNSKGHGIAGFIAETFPSVGGQIIPPKGYLPAVYEKIRAAGGVCIADEVQTGLGRLGEYYFGFEHQGALPDIVVMGKPIGNGHPLGVLVTTKAIAESFDNGIEFFSTFGGSTLSCRIGKEVLDIVDDEGLQENARARGAELISGLRALERKYACVGDVRGVGLFLGLELIHADGSEATEICSYVKNRMRDHRILIGSEGPKDNILKIRPPLTIEAEDVEMLVSVLDEVLAEINPAE

SEQ ID NO: 80134 - protein, 360 aa, Kluyveromyces lactis NRRL Y-1140
MAPRIDLKTITDLSVLFGTAISVYYLVNRLLTEAEGGPLSGNSKEKKERQSLVWQRLCAANPELDDVSLNAYERSVLASVITPQDIDVSFEDIGGLEDVIEELTESVIYPLTSPEIFSESALLEAPKGVLLYGPPGCGKTMIAKALAHESGANFISIRMSSIMDKWYGESNKIVDAMFSLANKIQPCIIFIDEIDSFLRQRASSDHEVTSMLKAEFMTLWDGLTSNGKVMVLGATNRINDIDSAFLRRLPKRFPVALPNAQQRHKILKVFLKDTKSDPRDFDLDYIVQCTSQMSGSDLKELCRDAALTAAREYIKEKRKLTETGKTDNLSRLKMRPLTNEDFLKNLKIDAGATFSRAALD

SEQ ID NO: 80135 - protein, 492 aa, Vibrio parahaemolyticus RIMD 2210633
MCKTKIVATLGPASESRETLTKLIRAGANVVRLNFSHGTAQEHIARANLVREIAAELDTYVGVLVDLQGPKIRISCFENGAVLLNQGDVFTLSGTLDAQSGTQEMVGLDYPELIQDVNEGDILLLDDGRIQLKVSQLHRDEQWIKTTVLNSGKLSNRKGINLLGGGLSAPALTAKDIQDIDTAAKLRADFLAISFPRNAQDIEYARSLAQKAGCHAKIVAKVERAEVVETKEAMDDVIKASDIIMVARGDLGVEIGDARLPMVQKSLINRSKHWGKPVITATQMLESMIENPLPTRAEVLDVANAIIDGTDAVMLSAESAAGKYPIEAVEAMVRIAQGAEHELECNHDCWDTLQHLCSNPGKSFALSSMISASRVHQDLGVAILTQHGETPLLMSRCQSKTKIWALSDNPALLAQMTILRGVEPLYFKAAESHVDLAPQLVECLRQKANEAHISSILMTQLDSIEGMGEINACRLLSLNVSSHMKPAEEIAA

SEQ ID NO: 80136 - protein, 378 aa, Synechococcus sp. WH 5701
MADLIRRLLISRWSLLLPFTLLTLLSVAFPAQERIPVLLSFGLHGLGLVPLGRMIAVLVDALAQRLGNRLGGLVGVALGNLVELVVSFTALNSGLYPLVVTSLAGAVITNCLLVLGLSTLVASRRVIAVPIHAHSTQLQTQQLLISTILLSVPSIFLLHQGEGISAGSDRFEGFALYSALVAALVLGYYLLSFVYQLGTHRRLFAGVEASGGIQMVSAHGRQRASLATILVLIALVSLLLVGVSEALVSSLEQLVAQLDLNPLFVGLVLLPLFGSFAEAVVAVQAGRNGTMDLAMSSTVESSLQLLLFVLPVLVLSGMVMERYLHLAFPPVALACLGCTVLMVDWISKDRQLSWYEGLQLLLLYASFAIGALLLPAAP

SEQ ID NO: 80137 - protein, 262 aa, Rhodobacter sphaeroides 2.4.1
MPAELSPIDTAKFAAARRAVDLVQDGMKLGLGTGSTAAWMVRCLAERVREEGLRVQGVPTSTRTAELARALGIQVVTLDEAKWLDLTIDGADEFDADFNLIKGGGAALLQEKIVATASDRMVVIADAAKEVAHLGAFPLPVEVIPFGWQSTKMLIEETLEGMDVLGREVTLRLSGDAPLLTDEKNYILDLHLKRIGEPRPLALALNQIAGVVENGLFIDICDTVVVGHGDGRVSLRDLQSGQAEEGSIDMDRARNIFADLGD

SEQ ID NO: 80138 - protein, 409 aa, Ashbya gossypii ATCC 10895
MGTKRTHKEVDVTAVTTNPSVAVASFFNGFRPSEDATFELYKTKAADSYVLHGENQKLEYEGRVDNNKGYQYMLGVYDPSSKSIELYQAPVLPTSVISKSKKRLAGKDIKQADARASTMRTALGQAFGTKKAKKAIADLERNRIDSDKLVGSVVDIVGSVRAAAKDLPTQQEMAATISEDRPIPPPNVDATDVEQIYPVRSIIPQHEWNFIRVGPIMKEKDAQQRLQMLPYTKSAYITKKLPTLTQSVQMEKLQLLYYLSLLLGVYNNRRVSNKENLLEKLNSPADTLVDGILERFTVVRPGQFGRSKDRSFAIDPQREDKLLCYILALIMHLDNFIVEISPFAHELGLKPSKLVNLLRTMGATVKGATVAQAQAFGIPKSAASTYKIATLKVPFKLPELNKRGKAARR

SEQ ID NO: 80139 - protein, 369 aa, Rubrobacter xylanophilus DSM 9941
MEYGRNRALLVLEDGAVFEGWTFAGEGEAAGEVVFTTSMVGYQETITDPSYRGQIVVFTYPLIGNYGVIPGDEESPRVQPAAVVVREYTPYHSNWASERSLAALLSEAGVPGIEGVDTRALTRHIRDKGAMRGVISTLERDVAALRERARAHPPMVGLDLASSSSELSEPTLLPALGEERCRVVALDYGVKQSIYRELRRRGAAVLALPGGEGLEEALEEGADGLFISNGPGDPAALDRAVERLRPVLGEVPTFGICLGHQLLGLALGCETYKMPFGHHGANHPVRNLETGRIEITSQNHGFALREESLPEGVRLTHRNLYDGTVEGIEHAGLRAWSVQYHPESSPGPRDSGYLFDAFVQRISENEERG

SEQ ID NO: 80140 - protein, 223 aa, Xanthomonas axonopodis pv. citri str. 306
MQPTAIAPSILSADFARLGEEVNNVLKAGADWVHFDVMDNHYVPNLTIGPMVCQALRKHGITAPIDVHLMVEPVDRIVPDFANAGATTISFHPEASRHVHRTIQLIKSHGCQAGLVLNPATPVDILDWVLPELDLVLVMSVNPGFGGQAFIPSALDKLRAIRSKIDATGKPIRLEIDGGVKADNIGAIAAAGADTFVAGSAIFNAPDYAQVIAQMRAAVDAVR

SEQ ID NO: 80141 - protein, 354 aa, Emericella nidulans
MVQQMPPQGGSRKISFNVSDQYEIQDVIGEGAYGVVCSAIHKPSGQKVAIKKITPFDHSMFCLRTLREMKLLRYFNHENIISILDIQRPRNYESFNEVYLIQELMETDMHRVIRTQDLSDDHCQYFIYQTLRALKAMHSANVLHRDLKPSNLLLNANCDLKVCDFGLARSAASTDDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPFKALFPKSNDLALDLLEKLLAFNPTKRITVEEALRHPYLEPYHDPDDEPTAPPIPEGFFDFDKNKDALSKEQLKILIYEEIMR

SEQ ID NO: 80142 - protein, 451 aa, Lactobacillus sakei
MIILSQATDYVQHVYQVIEHRDPNQTEFLEAINDVFKTITPVLEQHPEYIEANILERLTEPERIIQFRVPWLDDAGHARVNRGFRVQFNSAIGPYKGGLRLHPSVNLSIVKFLGFEQIFKNALTGLPIGGGKGGSDFDPKGKSDNEIMRFCQSFMTELSKYIGLDTDVPAGDIGVGGREIGFLYGQYKRLRGADRGVLTGKGLNYGGSLARTEATGYGLAYYTNEMLKANQLSFPGQRVAISGAGNVAIYAIQKVEELGGKVITCSDSNGYVIDENGIDFKIVKQIKEVERGRIKDYADRVASASYYEGSVWDAQVAYDIALPCATQNEISGDQAKNLIANGAKVVAEGANMPSSPEAIATYQAASLLYGPAKAANAGGVAVSALEMSQNSMRLSWTFEEVDNRLKQIMQDIFAHSVAAADEYHVSGDYLSGANIAGFTKIADAMLAQGLV

SEQ ID NO: 80143 - protein, 324 aa, Enterobacter cancerogenus
IGRAIGATGSAVGEVVFNTSMTGYQEILTDPSYSRQIVTLTYPHIGNVGTNAADEESSQVHAQGLVIRDLPLIASNFRNTEDLSSYLKRHNIVAIADIDTRKLTRLLREKGAQNGCIIAGDNLDAALALEKAKAFPGLNGMDLAKEVTTAEAYSWTQGSWTLEGDLPEAKQESELPFHVVAYDFGAKRNILRMLVDRGCRLTVVPAKTSAEEVLKMNPDGIFLSNGPGDPAPCDYAIDAIKAFLETDIPVFGICLGHQLLALASGANTVKMKFGHHGGNHPVKDIDNDTVMITAQNHGFAVDESTMPANLRVTHKSLVDGNLQG

SEQ ID NO: 80144 - protein, 474 aa, Magnaporthe grisea 70-15
MRLIASLALAASLASSITNGSTIPRRASGTPAAPRVIGLETERQHIPNPLERDRLRRRAAVMATLDNEQTLYFVNVSIGTPPQKLRLHLDTGSSDLWVNTPDSKLCSVSSQPCRFAGTFSANSSSTYQYINSVFNISYVDGSGANGDYVSDMVTVGNTKIDRLQFGIGYTSSSAQGILGVGYEANEVQVGRAQLKPYRNLPSRMVEEGLIASNAYSLYLNDLQSNKGSILFGGIDTEQYTGTLQTVPIQPNGGRMAEFLITLTSVSLTSASIGGDKLALAVLLDSGSSLTYLPDDIVKNMYSAVGAQYDSNEGAAYVPCSLARDQANSLTFSFSGIPIVVPMNELVLDLVTSNGRRPSFRNGVPACLFGVAPAGKGTNVLGDTFLRSAYVVYDLENNAISLAQTSFNATKSNVKEIGKGSNPVPGAVAVSQPVAATSGLSQNGGNRSGSGAIARAVPTLLLVGGIFSGSLLTLF

SEQ ID NO: 80145 - protein, 436 aa, Thermoplasma acidophilum DSM 1728
MYDAIIIGSGPGGYAAAIRLGQRQKKVALIEKDKIGGECLNYGCIPSKALIELANSINYLREMPGVSLNYSIDMKKWQEWKWSMINRLTGGVETLCKGYGVDVIRGEAYIVDATHVKIGEKVIEGKNLVIATGSKPVRIKGIDDVMYNREVLDLDHIPESTAIIGGGYIGVEIGTALAKLGSKVTIIEMMPSILPGTDQELVRHVERRLSQLGVRVMTGKKVLNTQHGDKIRVNMEGGEYVEAEKVLMTVGRVPNTEGFGLENLKLEMDGRFIKTDAHKRTSVPNVYAIGDVSGQPMLAHKAYYDADIAADNICGMDSVVEYRAMPYVIYSDPEIAYTGSKSAKSTRFPVAANGRSLTMNESIGTFNIYYDEKGIVTGAGLAAPHASELISELSLAVESGLMAMDIGLTIHPHPTVSEGVKETAEEAYGKPLHFKI

SEQ ID NO: 80146 - protein, 400 aa, Thermoplasma acidophilum DSM 1728
MYEFKLPDIGEGVTEGEIVRWDVKEGDMVEKDQDLVEVMTDKVTVKIPSPVRGKIVKILYREGQVVPVGSTLLQIDTGEEAPVQQPAGRAESTVQVAEVKQVPLPEVSGHVLASPAVRRIARENGIDLSKVGGTGEGGRVTLDDLERYMKSPAPSPAPSAGKAEAVHTAPQIPAQKPAPGREEILEMHGLRRIIFDKMTKAKQIMPHFTVMEEVDVTSMVSILDSAKARNRKVTVTGFLARIVPSILKQYPYLNAIYDETRRVYILKKYYNIGIAVDTPDGLNVFVIKDADRKSMVEISAEISDKASRARENKLQLDEVQDSTFTITNVGTIGGIMSTPIINYPEVAILGVHRILEREGRKYMYLSLSCDHRLIDGAVATRFIVDLKKVIEDPNAIIYEI

SEQ ID NO: 80147 - protein, 321 aa, Enterobacter aerogenes
HGRAIGATGTAVGEVVFNTSMTGYQEILTDPSYSRQIVTLTYPHIGNVGTNAADEESSQVHAQGLVIRDLPLIASNFRNTEDLSSYLKRHNIVAIADIDTRKLTRLLREKGAQNGCIIAGDNLDAQLALEKAQAFPGLNGMDLAKEVTTAETYAWTQGSWTLAGDLPEAKAESDLPFHVVAYDFGAKRNILRMLVDRGCRLTIVPAQTSAEDVLKLNPDGISWSNGPGDPAPCDYAIAAIEKFLTTDIPVFGICLGHQLLALASGAKTIKMKFGHHGGNHPVKDIDNNVVMITAQNHGFAVDEATLPANLRVTHKSLFDGT

SEQ ID NO: 80148 - protein, 253 aa, Helicobacter pylori 26695
MAISIKSPKEIKALRKAGELTAQALALLEREVRPGVSLLELDKMAEDFIKSSHARPAFKGLYGFPNSVCMSLNEVVIHGIPTDYVLQEGDIIGLDLGVEVDGYYGDSALTLPIGAISPQDEKLLACSKESLMHAINSIRVGMHFKELSQILESTITERGFVPLKGFCGHGIGKKPHEEPEIPNYLEKGVKPNSGPKIKEGMVFCLEPMVCQKQGEPKILADKWSVVSVDGLNTSHHEHTIAIVGNKAVILTER

SEQ ID NO: 80149 - protein, 293 aa, Thermoplasma acidophilum DSM 1728
MNIMDAEIKRKYLEAGRIGKKALEIGASMIEPGARLLDVANAMEKFVKDEGALPAFPVNLSINNDAAHYTPAINDKKTFKTGDVVKVDFGAHIDGYMSDTAITVEVGEQGKHSDLIDAARQALNAAIELVRPMKSVNEIGRRIAEVISSYGFKPVRNLGGHGVERYDLHASIFIPNYDDGNVVRLQPDHAIAIEPFASTGIGMIHEGQPGNIYMIDRPKPREDEIIYRNFNKLPFAERWLEGLVEDPKSYIKRMMASKELYSFPVLKEHNGAFIAQFEHTMIVLNDEVIVTTR

SEQ ID NO: 80150 - protein, 327 aa, Klebsiella pneumoniae
HGRAIGATGTAVGEVVFNTSMTGYQEILTDPSYSRQIVTLTYPHIGNVGTNAADEESSQVHAQGLVIRDLPLIASNFRSTEDLSSYLKRHNIVAIADIDTRKLTRLLREKGAQNGCIIAGDSPDAQLALEKAKAFPGLNGMDLAKEVTTAETYSWTQGSWTLAGDLPEAKAESELPFHVVAYDFGAKRNILRMLVDRGCRLTVVPAKTSAADVLALNPDGIFLSNGPGDPAPCDYAIEAIEKFLETDIPVFGICLGHQLLALASGAKTIKMKFGHHGGNHPVKDIDNNVVMITAQNHGFAVDEATLPANLRVTHKSLFDGTLQGIHR

SEQ ID NO: 80151 - protein, 71 aa, Guillardia theta
MIIPVRCFTCGKIIGNKWEIYLRLLNENYSESSALDTLGLQRYCCRRMILTHVDLIEKLLQYNGYINFKNS

SEQ ID NO: 80152 - protein, 326 aa, Shigella flexneri
HGRAIGATGSAVGEVVFNTSMTGYQEILTDPSYSRQIVTLTYPHIGNVGTNDADEESSQVHAQGLVIRDLPLIASNFRNTEDLSSYLKRHNIVAIADIDTRKLTRLLREKGAQNGCIIAGDNPDAALALEKARAFPGLNGMDLAKEVTTAEAYSWTQGSWTLTGGLPEAKKEDELPFHVVAYDFGAKRNILRMLVDRGCRLTIVPAQTSAEDVLKMNPDGIFLSNGPGDPAPCDYAITAIQKFLETDIPVFGICLGHQLLALASGAKTVKMKFGHHGGNHPVKDVEKNVVMITAQNHGFAVDEATLPANLRVTHKSLFDGTLQGIH

SEQ ID NO: 80153 - protein, 163 aa, Thermotoga maritima
MSLRVRIAVIGKLDGFIKEGIKHYEKFLRRFCKPEVLEIKRVHRGSIEEIVRKETEDLTNRILPGSFVMVMDKRGEEVSSEEFADFLKDLEMKGKDITILIGGPYGLNEEIFAKAHRVFSLSKMTFTHGMTVLIVLEQIFRAFKIIHGENYHYEGGSHHHHHH

SEQ ID NO: 80154 - protein, 327 aa, Shigella dysenteriae
HGRAIGATGSAVGEVVFNTSMTGYQEILTDPSYSRQIVTLTYPHIGNVGTNDADEESSQVHAQGLVIRDLPLIASNFRNTEDLSSYLKRHNIVAIADIDTRKLTRLLREKGAQNGCIIAGDNPDAALALEKARAFPGLNGMDLAKEVTTAETYSWTQGSWTLTGGLPEAKKEDELPFHVVAYDFGAKRNILRMLVDRGCRLTIVPAQTSAEDVLKMNPDGIFLSNGPGDPAPCDYAITAIQKFLETDIPVFGICLGHQLLALASGAKTVKMKFGHHGGNHPVKDVEKNVVMITAQNHGFAVDEATLPANLRVTHKSLFDGTLQGIHR

SEQ ID NO: 80155 - protein, 385 aa, Streptococcus pyogenes MGAS8232
MKITVVGIGYVGLSIGLLLAKEHDVTFFDIDNKKIDLINKRQSPLKEAAINKLLCKAKNINATSSEELAYKDATFIILSLPTNLKVNKLDTSIIEISVSNILKINKKATIVIKSTVPIGFTEYLRNRFHYNDIIFSPEFLREGSTIHDQLYPSRTIVGNESRNSQLFLDILTDISVEKDSPSLLVGSSETEAIKLFSNAYLAQKIAFFNELDTFAEMQNLDSKKIIEAMGYDQRIGNSHNNPSFGFGGYCLPKDIKQLEYHFKEIPAPIITSISESNLLRKIHIAKMILNSSAKTIGIYRINSKKDSDNCRESSTIDVVKLLKSSGKDVIIFEPLINQKKFLGCPLINDFNEFIKYSDIIVANRIDDALRKCNSKVFTRDIFQYD

SEQ ID NO: 80156 - protein, 395 aa, Bordetella petrii
MRKFSRIERLPPYVFNITGELKMAARRRGEDIIDMSMGNPDGPTPKHIVDKLVEASSRPTTHGYSVSKGIPRLRKAICDWYQRRYAVEFDPDSEAIVTIGSKEGLAHLMLATLDRGDTVLVPNPSYPIHIYGAVIAGANIRSVRMTPGVDFFEELERAVRESIPKPKMMILGFPSNPTAQCVDLSFFERVVALAKEHDILVVHDLAYADICFDGYVAPSIMQVPGARDVAVEFFTMSKSYNMAGWRIGYMVGNRELVNALARIKSYHDYGTFTPIQVASIAALDGPQDCVGEVVEQYRSRRDVLARGLHEAGWNVEIPKASMYIWAQIPEPYRAMGSLEFAKRVLSDAKVAVSPGIGFGEYGDEYVRFALIENEQRTRQAVRGIKDMFRKDGLLK

SEQ ID NO: 80157 - protein, 315 aa, Pseudomonas syringae pv. syringae B728a
MRALAALSRFVGNTFAYWVLLFAILAFLFPQAFIGLKSWIVPLLGLVMFGMGLTLKLEDFSEVARNPWRVALGVIAHFVIMPGVAWLLCQVFQLPPEIAVGVILVGCCPSGTSSNVMAWLAKGDLALAVAIAAVTTLLAPLLTPTLIWFLASAWLPVSFLDMFWSILQLVMLPIVLGVIAQRLLGARVSYAVDVLPLVSVVSIVMIVCAVVAASQAKIAESGLLIMAVVILHNTFGFLLGYFTGKVFKLPLAQRKSLALEVGMQNSGLGAALASAHFSPLAAVPSALFSVWHNISGALLSTYFRKMPEEENTSVR

SEQ ID NO: 80158 - protein, 318 aa, Aspergillus oryzae
MSAGGEHLKDEGTRRQVVLAGGIAGLVSRFCVAPLDVVKIRLQLQIHSLSDPTSHQNIKGPVYKGTLPTIRSIVREEGITGLWKGNIPAELMYVCYGAIQFAAYRTTTQALSQLDPYRLPPPAESFVAGATAGGLATASTYPLDLLRTRFAAQGTERVYTSLYASVRDIAQNEGPKGFFRGCSAAVGQIVPYMGLFFATYESLRPVMSGLHDLPFGSGDAAAGVVASVLAKTGVFPLDLVRKRLQVQGPTRSKYVHRNIPEYQGVYNTMAMIVRTQGMRGLYRGLTVSLFKAAPASAVTMWTYEKSLHYLRELEVASE

SEQ ID NO: 80159 - protein, 785 aa, Schizosaccharomyces pombe 972h-
MQRSAKLKIRAPRKFSANQVDFATHWEVLQRAIGDIFQKSTSQLSFEELYRNAYILVLHKYGEKLYNHVQDVIRSRLKEETVPAIYKNYDASLLGNALLDIRKNDSYSTSWSRSLEAAHRFLSSLVNSWKDHIVSMQMISSVLKYLDKVYSKSADKVPVNENGIYIFREVVLLNSFEIGEKCVETILILVYLERKGNTINRPLINDCLDMLNSLPSENKKETLYDVLFAPKFLSYTRNFYEIESSTVIGVFGVVEYLKKAEKRFEEEKERSKNYLFTKIASPLLSVVEDELLSKHLDDLLENQSTGFFSMIDSSNFEGLQLVYESFSRVELGVKSLKKYLAKYVAHHGKLINETTSQALEGKMAVGRLSSNATMATLWVQKVLALWDRLNTIISTTMDADRSILNSLSDAFVTFVDGYTRAPEYISLFIDDNLKKDARKAIEGSIEATLQNSVTLFRFISEKDVFEKYYKTHLAKRLLNNRSISSDAELGMISRLKQEAGNVFTQKLEGMFNDMNLSQELLQEYKHNSALQSAKPALDLNVSILASTFWPIDLSPHKIKCNFPKVLLAQIDQFTDFYLSKHTGRKLLWYPSMGSADVRVNFKDRKYDLNVSTIASVILLLFQDLKENQCLIFEEILEKTNIEVGDLKRNLQSLACAKYKILLKDPKGREVNAGDKFYFNENFVSNLARIKISTVAQTRVEDDSERKRTLEKVDESRKHQADACIVRVMKDRKVCEHNQLMAEVTRQLNPRFHPSPMMIKRRIEALIEREYLQRQADNGRIYEYLA

SEQ ID NO: 80160 - protein, 501 aa, Neurospora crassa
MIRNVVVLSGNSHPKFVDSVCNYLGIPPASRVLEKFSSGETRCEIRDSIRGKDVYIIQSFGVGTNRNAANSNNNNNNNDGSSTSATAETGHVTVNDYFIELCIMISACKTGSARRVTAVLPFFPYSRQPDLPYASTGAPLVSRNHDAVTMTVTEGQGSVSYTFESVPPTPAAHIPRTAGLANGMSRLANGLSGSSITRGSDIRDMAKVMVTGPASDAGSKSLGEKQPQQQKANDKFTTHDFENPAMAMAFQQKVGFKPMMAQAGSLIADLLTCAGADRIVTCDLHESTYQGFFDIPVDHLIARPLLKRYIQHHIENYKEAVIVSPDAGGAKRAAAIADSLGLQFALIHKERRRPSKTHPNYPSMMLVGNVANRICILVDDLADTVNTITRAAKLLKREGAVQVVALITHGVFSGDAIQRINASALDRVVVTNTVAQHRHLEAFGAARAGGTKEMPDKNKNDVDPRVVCGKLEVLDIAPFFAEAIRRIVFGESISMLVRDGD

SEQ ID NO: 80161 - protein, 447 aa, Flavobacteria bacterium BBFL7
MEKNIESFIDLIKSKNPNEPEFIQAVSEVAEAVIPFIENNPQYASDKLLERMAEPERVTMFRVPWTDDNGEVQVNRGYRIQMNSAIGPYKGGLRFHPSVNLSILKFLAFEQVFKNSLTTLPMGGGKGGADFNPKGKSDREVMRFCQSFMVELQRVIGADTDVPAGDIGVGGREIGYLFGYYKKLRNEFTGILTGKGRSYGGSLIRPEATGYGNVYFAENMLKTRGESITGKTTVISGSGNVAQYAAEKILQLGGKVVTMSDSGGYIHDADGIDADKLAFVMDLKNNRRGRISEYVSQYPSATYHEGERPWSVKCDIALPCATQNELNGDEAKTLVSNGCMCVSEGANMPSTPDAIEHFIDNKILFAPGKASNAGGVATSGLEMSQNSMRYSWTAEEVDNKLHGIMNDIHEACVEYGKDSDGFVDYVKGANIAGFVKVADAMLAQGIV

SEQ ID NO: 80162 - protein, 475 aa, Staphylococcus aureus subsp. aureus Mu50
MRDYTKQYINGEWVESNSNETIEVINPATEEVIGKVAKGNKADVDKAVEAADDVYLEFRHTSVKERQALLDKIVKEYENRKDDIVQAITDELGAPLSLSERVHYQMGLNHFVAARDALDNYEFEERRGDDLVVKEAIGVSGLITPWNFPTNQTSLKLAAAFAAGSPVVLKPSEETPFAAVILAEIFDKVGVPKGVFNLVNGDGAGVGNPLSEHPKVRMMSFTGSGPTGSKIMEKAAKDFKKVSLELGGKSPYIVLDDVDIKEAAKATTGKVVNNTGQVCTAGTRVLVPNKIKDAFLAELKEQFSQVRVGNPREDGTQVGPIISKKQFDQVQNYINKGIEEGAELFYGGPGKPEGLEKGYFARPTIFINVDNQMTIAQEEIFGPVMSVITYNDLDEAIQIANDTKYGLAGYVIGKDKETLHKVARSIEAGTVEINEAGRKPDLPFGGYKQSGLGREWGDYGIEEFLEVKSIAGYFK

SEQ ID NO: 80163 - protein, 533 aa, Pseudomonas aeruginosa PAO1
MTTCGEFLVKQLEAWGVETVFGIPGVHTVELYRGLPGSRIRHVTPRHEQGAGFMADGYARVTGKPGVCFIITGPGMTNILTAMAQAYADSIPMLVISSVNERARLAHGNGYLHELPNQRNLVGNVCAFSHTLMSAEELPAVLARAFAVFDSERPRPVHIELPLDVITAPAEHLALRPRTVTSRPAPALAPLREAAARLRNAKKPLLLLGGGCVEAAAEARALAAALDAPTALTINAKGLLPADHPLLLGSNQSCVPVRELATEADVVLAIGTELGETDYDVVFDGGFALDGELIRIDIDPQQLMRNYTPSLAIHSDARLAMRVLLAELPGGEASPDSPGARRAAAVRQRLAEDFAGWSHYRQLFAAILAEWPDARFVGDSTQTVYSGNHLVDLDEPRRWFNASTGYGTLGYGLPAAIGAKLGEPGRPVVSLMGDGGLQFTLPELASAVEAKVGIVVLLWNNHGYGEIKRYMERREITPLGVDIYTPDFLAIARGFGCAAERARDLEHLRELLRGAPADRPLIVEVLQAAPFHP

SEQ ID NO: 80164 - protein, 1151 aa, Neurospora crassa
MSSTTEALLVSQNSPSTLPEAISRTMAPNTSPSRRARPAHVQTALTLQPQAFTNVSPLSAISTSSASPTSQQPSPALTPDTAGAIFTESSSLQGSPATFVSSTTKGMDSYASTIKGMEEPVTPLNLPEPLAPAPLSSKKSSNSLKRNGEKSGEKIPRQQNAMGEALSKSSFAGSLVRRASNTVNKARDILTRRASMNIVNRDADPMVASLRRGSNTFPLGEHNYRGHLLESDDECAIDDAGPLDGLRDAQIPLSIGPEIPVALRQGVMLKKISKKKKEKRITLTLDPDTSKIWWDKSRTGRKSVFIDDIKEVRTAEDIRQYRLDAGVEESEEPRFFSILYTVPEKSGTKVLHLIALNSTDFRNWTTTLDAILQYRQDFTTNLMAFNEKAVHEFWQRQMRKKYADRVIPAEGETIELPDIERICRSLHMHLSPTEIRDNFNAAKAAKATSNGVCDPTSPSSLNFNEFKEFVRLLKARSEISHVFKNHTTNPKAGMTRQEFIQFLKEIQCEDVEEDSTHWNNIFSQFARRRRSKDAEQTISGDESLTISEAGFTGFLNSHFNSLLIQEPSEYVLDRPMNEYYISSSHNTYLLGRQVRGISSVEGYISALERGCRCVEVDCWDGPNDEPYVSHGHTWTTRIKFEEVIKTINKYAFVKSRFPLWISLEVRCNAATQANMAKIMIDIFGDKLVRAPLDPSSDRLPSPSDLIERILIKVKKSQPVPNTPSEESLKTERPGRRRGNSLPSPYQRPSPLPSPMDNTSVAVPGSPSLSPSPMLRATRQINTITEGEVHSHGGPSNSPSEYESDAEKDSGKKVVSKINPILGELGVYCMGVHFDGFDSPDAKKFNHIFSFKEKTFAERSQPGEAKRALYRHNMRYLMRVYPNGGRISSSNFDPLLYWKRGVQMAALNWQTFDLGMQLNQAMFDSGTDLSGYVLKPLEGRQIQVVPTDAAGQLSGKRPRKRISFKIEVISAQQLMRPLNLPKGRTLDPYVEVEIFLADDKRNKQDGATNAPAQETQLKYRTDIVKDNGFNPVFKGNNSYEFIVTTKYPDLIFVRWSVKLGDNKGYNDRSPPLATFTAKLGGLKQGYRTIPLLDHNGYNYLFSTLFCKITKSQPTDIMVTYSSEVPRNSVSRIKNIFNQSGISPKSSMDSGRA

SEQ ID NO: 80165 - protein, 404 aa, Vibrio parahaemolyticus RIMD 2210633
MQDALAVILAGGMGSRLSPLTDDRAKPAVPFGGKYRIIDFTLTNCLNSGLRKILVLTQYKSHSLQKHLRDGWSIFNPELGEYITAVPPQMRKGGAWYEGTADAIYHNLWLLSRNDAKYVVVLSGDHIYRMDYAAMLEEHKEKGAKLTVACMDVPVKDASAFGVMGIAENGLVKSFVEKPENPPTLPDDNAKSLASMGIYIFDMDVLKEALTEDAKLETSSHDFGNDIIPKLIDTESVYAYKFCGSKGRVDKDCYWRDVGTIDSFYEANMDLLEPVPPMNLYQSNWAIRTYEPQFPPARTVSSATGNEGIFINSIIATGVINSGGSVQHSIISSNVRIQDSATVVDSIIFDDVEVGEGSQLVNCIVDKHVRIPPNTQIGINKVEDAKRFKISEKGIVVIPESYQF

SEQ ID NO: 80166 - protein, 312 aa, Bacillus halodurans C-125
MKIVNNIAELIGDTPLVRLNRLPNPKGAAVYLKMEMFNPSGSVKDRAAYQMIVQAEKDGYLKPGSTIIEPTSGNTGIGLAMNAAARGYRAILTMPDTMSEERINLLKAYGAEVVLTEGEKKMPGAIEKAHELVREIPNSFMPMQFENSANPDAHRFTTAVEIKKALDSIGKKLSAFVAASGTGGTITGTGEELKKFYPNVEIHVVEPFGSPVLSGGKPGPHKLVGTSPGFVPPILNQDVYDVIDKIKDEDAYEAARNLARLEGILVGPSSGAACYAAMKVAERLAPDEVVVCIACDTGERYLSTDLFDFESQ

SEQ ID NO: 80167 - protein, 192 aa, Xanthomonas axonopodis pv. citri str. 306
MLLMLDNYDSFTYNLVQYLQALGAEVTVVRNDAMSVDQIAALRPERIVISPGPCTPNEAGISLQLIEQLGQTTPILGVCLGHQSIGQVYGGDVIRAGNIMHGKTSPIRHQGKGVFAGLPDSYEATRYHSLVVDKTTLPDALEVTAWTENPDGSMEEVMGLRHRQFPVEGVQFHPESILTQHGHALLKNFLQR

SEQ ID NO: 80168 - protein, 233 aa, Synechococcus sp. WH 5701
MTCAEARAYASAFLPLLGNLPSDREVVLAPPFTAIAALSEALEGSAVKIASQNVHWDDVGAYTGMISAPMLLEHGVSHAIVGHSEPRKYYSETDEQINLRARTAQKSGMIPILCVGESDSQREAGEAERVIRRQVDQGLEGLDPTQLVVAYEPIWAIGTGKTCGAEEANRLCALIRGWVGYEDVVIQYGGSVKAENIDLLMAQPDIDGVLVGGASLDPTGFARIARYQVPVAA

SEQ ID NO: 80169 - protein, 445 aa, Flavobacteria bacterium BBFL7
MENFDVFIFGTGTAGQLVAKECAATGKKVGIIDIREYGGVCSQRGCDPKKLLLASSEAFELSKNMKTDGIAGALKINWRDAFNYARRYTSDIPQNTEKDLKKKGIKCYHGEASFKDSHTIILDGEEIRADHFVIATGMQPLSLGIPGEKYALTSGEFFNLKDVPEKVVFVGGGYIGMEFGHMLCRAGSKVTIIDKGDQILSPFEAFTSNLLEEESIKMGINIIKNAQVSSIEKIDNRYCVHYAIDDQIHQVTTDCVFNTAGRVPSIDKLNLALANVVTNQDGILVNSKLQSTSQAHIYACGDISSKSLPLTPLSSIEAKVVADNLNGKNRDLEIPSIPSSVFTIPQCSGIGLTENQAVAENKSFHTIEKDTSGWFNNKRINSPLYGYKIIIENETHKILGAHIVGPEAAEQINMFAIAMKADMSFENLKNVIFNYPTWGNDIKSF

SEQ ID NO: 80170 - protein, 520 aa, Trametes villosa
MSRFHSLLAFVVASLTAVAHAGIGPVADLTITNAAVSPDGFSRQAVVVNGGTPGPLITGNMGDRFQLNVIDNLTNHTMVKSTSIHWHGFFQKGTNWADGPAFINQCPISSGHSFLYDFQVPDQAGTFWYHSHLSTQYCDGLRGPFVVYDPNDPAADLYDVDNDDTVITLVDWYHVAAKLGPAFPLGADATLINGKGRSPSTTTADLSVISVTPGKRYRFRLVSLSCDPNYTFSIDGHNMTIIETDSINTAPLVVDSIQIFAAQRYSFVLEANQAVDNYWIRANPNFGNVGFTGGINSAILRYDGAAAVEPTTTQTTSTAPLNEVNLHPLVTTAVPGSPVAGGVDLAINMAFNFNGTNFFINGTSFTPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPTYDALDPSDQ

SEQ ID NO: 80171 - protein, 277 aa, Oryza sativa Indica Group
MAQPQPQRMEDQLQSQAQGQGQGQTEAIKYGHVFAVTGELAGQPIAPRDAAAMRSAEESVPGVPVPQDIGGGYSAGVAMETAAAYNQAVGAVRPGQASDAATNQGIAVTQTSVPGGRIITEFVAGQVVGQYSVADQAVEQDATKITVGEALEATALAAGERPVDRTDVEAIRAAEMAAQGSDVTMPGGLADQAQAAARSNADADRDDDKITVGDVLTDATAKLAGDKVAGAEDAAKVVQAEAYSDAAARTRAGGVGAAVSTAARLNQADDDADDDAE

SEQ ID NO: 80172 - protein, 262 aa, Rubrobacter xylanophilus DSM 9941
MRRVGVIGAGKIGGSLLSRLAESGDFELAVSDVHPEQVERFRRYDRVRPASSNLELAEASEIVIVAVKPWDVAGVLEEISPAMGSGGRSVTSVAAGVEIRTIESYLPEGTPVLRVMPNVCASVGLGAAVITANEPGRRVLPEVMDIFGRVGEVMELPERLFDAATALHGSGPAYVALFADALIQAGVREGLPREVARRLVVGTLAGTAVLLKDRSAHQVRDEVMTPGGTTAAAFVAMEKAGFVGAVYDGVNAATRRARELGG

SEQ ID NO: 80173 - protein, 363 aa, Vibrio parahaemolyticus RIMD 2210633
MTDKSYKIAVLPGDGIGPEVMAQAHKVLDAIEQKHGISFEREEHDVGGIAIDNHGCPLPESTVTACEESDAVLFGSVGGPKWEHLPPNDQPERGALLPLRKHFQLFCNLRPAQIHAGLEAFSPLRADISGRGFDIVVVRELTGGIYFGQPKGREGEGANEKAFDTEVYHRYEIERIAKIAFESARLRRKKVCSIDKANVLQSSILWREVVEEIAKDYPDVELSHMYIDNATMQLIKDPAQFDVMLCSNIFGDIISDECAMITGSMGMLPSASLNESKFGLYEPAGGSAPDIAGKNIANPVAQILSAALMLRYSLGEEAAAQDIESAVSKALSAGELTADLASDKPALTTSEMGDKIAEYILNS

SEQ ID NO: 80174 - protein, 163 aa, Ashbya gossypii ATCC 10895
MSQKACYVCGKLGHLADNCDSERLCYNCNMPGHIQSECTLPRSAEHKQCYNCGETGHVRGECNIQKCFNCSQAGHVSRDCTEPRRSRFSNSSRSSFSGRLNKVSCYRCGGPNHMAKDCLQDETKCYSCGKSGHISRDCPSGPSEKTCYNCNESGHISRDCPVH

SEQ ID NO: 80175 - protein, 519 aa, Trametes villosa
MGLQRFSFFVTLALVARSLAAIGPVASLVVANAPVSPDGFLRDAIVVNGVVPSPLITGKKGDRFQLNVVDTLTNHSMLKSTSIHWHGFFQAGTNWAEGPAFVNQCPIASGHSFLYDFHVPDQAGTFWYHSHLSTQYCDGLRGPFVVYDPKDPHASRYDVDNESTVITLTDWYHTAARLGPKFPLGADATLINGLGRSASTPTAALAVINVQHGKRYRFRLVSISCDPNYTFSIDGHNLTVIEVDGINSQPLLVDSIQIFAAQRYSFVLNANQTVGNYWVRANPNFGTVGFAGGINSAILRYQGAPVAEPTTTQTPSVIPLIETNLHPLARMPVPGSPTPGGVDKALNLAFNFNGTNFFINNATFTPPTVPVLLQILSGAQTAQDLLPAGSVYPLPAHSTIEITLPATALAPGAPHPFHLHGHAFAVVRSAGSTTYNYNDPIFRDVVSTGTPAAGDNVTIRFQTDNPGPWFLHCHIDFHLDAGFAIVFAEDVADVKAANPVPKAWSDLCPIYDGLSEANQ

SEQ ID NO: 80176 - protein, 473 aa, Trametes villosa
MSFSSLRRALVFLGACSSALASIGPVTELDIVNKVIAPDGVARDTVLAGGTFPGPLITGKKGDNFRINVVDKLVNQTMLTSTTIHWHGMFQHTTNWADGPAFVTQCPITTGDDFLYNFRVPDQTGTYWYHSHLALQYCDGLRGPLVIYDPHDPQAYLYDVDDESTVITLADWYHTPAPLLPPAATLINGLGRWPGNPTADLAVIEVQHGKRYRFRLVSTSCDPNYNFTIDGHTMTIIEADGQNTQPHQVDGLQIFAAQRYSFVLNANQAVNNYWIRANPNRANTTGFANGINSAILRYKGAPIKEPTTNQTTIRNFLWETDLHPLTDPRAPGLPFKGGVDHALNLNLTFNGSEFFINDAPFVPPTVPVLLQILNGTLDANDLLPPGSVYNLPPDSTIELSIPGGVTGGPHPFHLHGTDNPGPWFLHCHIDFHLQAGLAIVFAEDAQDTKLVNPVPEDWNKLCPTFDKAMNITV

SEQ ID NO: 80177 - protein, 240 aa, Rubrobacter xylanophilus DSM 9941
MSVRASAAGIRERLKLVQENISRALERSGRRDRPRVLVATKYYEPEQISALREAGVRLVGENRAQDLIRKQELFGDAFEWHFIGHLQRRKAKLVVPRVSLIHSVDSVRLVEELARRAPEGGTDVLVQVNVSGEESKYGVSPGEVERLLEAAAASGKVRVRGFMTLAPLVEDPEDVRYVFAQLREIRDRLRGSWRPHFDLSELSMGMSNDYPVAVEEGATLVRVGRTLIEEDGSARRQDGS

SEQ ID NO: 80178 - protein, 430 aa, Crocosphaera watsonii WH 8501
MNIAVVGLSHKTAPVEVREKLSIQEAKIEEALIHLKGYPHIEEVAVISTCNRLEIYAVVTDTEKGVVEITQFLSETGHIPLNYLRRYLFTLLHQDAVRHLLRVAAGLESLVLGEGQILAQVKTTHKLSQKYKGIGRLLDRLFKQAITAGKRVRSETNIGTGAVSISSAAVELAVTKVDDLASRRVSIIGAGKMACLLVKHLVAKGATSITIVNRSQRRAEELAKKFPQAELTLVSLDEMMTVVGNSHMVFTSTGATQPILHQDNLKEVVSVEQGLMLFDISVPRNVATNVQDMEMVEAYNVDDLKAVVAQNQASRRQMALEAEGLLEEEVEAFELWWRSLETVPTISCLRTKVEGIREQELEKALSRLGTEFAEKHQEVIEALTRGIVNKILHEPMVQLRAQQDIEARQKCLQSLQMLFDLEIEIEKQFG

SEQ ID NO: 80179 - protein, 520 aa, Trametes villosa
MGRFSSLCALTAVIHSFGRVSAAIGPVTDLTISNGDVSPDGFTRAAVLANGVFPGPLITGNKGDNFQINVIDNLSNETMLKSTSIHWHGFFQKGTNWADGAAFVNQCPIATGNSFLYDFTATDQAGTFWYHSHLSTQYCDGLRGPMVVYDPSDPHADLYDVDDETTIITLSDWYHTAASLGAAFPIGSDSTLINGLGRFAGGDSTDLAVITVEQGKRYRMRLLSLSCDPNYVFSIDGHNMTIIEADAVNHEPLTVDSIQIYAGQRYSFVLTADQDIDNYFIRALPSAGTTSFDGGINSAILRYSGASEVDPTTTETTSVLPLDEANLVPLDSPAAPGDPNIGGVDYALNLDFNFDGTNFFINDVSFVSPTVPVLLQILSGTTSAADLLPSGSLFAVPSNSTIEISFPITATNAPGAPHPFHLHGHTFSIVRTAGSTDTNFVNPVRRDVVNTGTVGDNVTIRFTTDNPGPWFLHCHIDFHLEAGFAIVFSEDTADVSNTTTPSTAWEDLCPTYNALDSSDL

SEQ ID NO: 80180 - protein, 561 aa, Enterobacter cloacae
MTTLKITGMTCDSCAAHVKEALEKVPGVQSALVSYPKGTAQLAIEAGTSSDALTTAVAGLGYEATLADAPPTDNRAGLLDKMRGWIGAADKPSGNERPLQVVVIGSGGAAMAAALKAVEQGAQVTLIERGTIGGTCVNVGCVPSKIMIRVAHIAHLRRESPFDGGMPPTPPTILRERLLAQQQARVEELRHAKYEGILDGNSAITVLHGEARFKDDQSLIVSLNEGGERVVMFDRCLVATGASPAVPPIPGLKESPYWTSTEALASDTIPERLAVIGSSVVALELAQAFARLGSKVTALARNTLFFREDPAIGEAVTAAFRAEGIEVLEHTQASQVAHMDGEFVLTTTHGELRADKLLVATGRTPNTRSLALEAAGVAVNAQGAIVIDKGMRTSSPNIYAAGDCTDQPQFVYVAAAAGTRAAINMTGGDAALDLTAMPAVVFTDPQVATVGYSEAEAHHDGIETDSRLLTLDNVPRALANFDTRGFIKLVIEEGSGRLIGVQAVAPEAGELIQTAVLAIRNRMTVQELADQLFPYLTMVEGLKLAAQTFSKDVKQLSCCAG

SEQ ID NO: 80181 - protein, 384 aa, Magnetospirillum magnetotacticum MS-1
MAKTVVLVVAAGRGRRFGGDLPKQYHDLAGRMVLRHTLAAFATNPEIAAVRAVIHPDDRQLYDMAAAGLNLLEPVHGGATRQDSVRLGLESLKDLAPANVLIHDGARPFIDHGTIGRVIRALDNHPGALPVVPVADTLKRGQDGFVADTVDRSNLFRAQTPQGFRYADIIAAHQAVIGNELTDDAAVAEKAGLAVELVNGAEDNVKITTSADLERARRLFDGPGEVRSASGYDVHRFDPAKKSVWLCGVEIPHEAGLEGHSDADVSLHALTDAVLGAISAGDIGHHFPPTDPKWKGAASDQFLAHAGSLVTAKGGRIVNVDVTIICERPKVGPHRAAMAARVAEILGISQDRVSVKATTTEGLGFTGRREGIAAQAMASVWLPR

SEQ ID NO: 80182 - protein, 619 aa, Vitis vinifera
  misc_feature (30)..(30): Xaa can be any naturally occurring amino acid
MATTSTRLRRLGTVAAAVALSAGVTLRDPXISSSDRGGPSLDAVRRKIADSNGVVPSRAVQESALIGSSAVNPLDILVVGGGATGCGVALDAATRGLRVGLVEREDFSSGTSSRSTKLLHGGVRYLEKAVFNLDYGQLKLVFHALEERKQVIENAPHLCQALPCMTPCFDWFEVVYYWMGLKLYDLVAGSRLLHLSRYYSAQESVELFPTLARNGKDRSLRGTVVYYDGQMNDSRLNVALACTAALAGAAVLNHAEVVSLLMDEVSNQIIGARIRDNLSGKEFDTYAKVVVNAAGPFCDSPMICPSSGVHIVLPDYYSPEGMGLIVPKTKDGRVVFMLPWLGRTVAGTTDSNTSITMLPEPHEDEIQFILDAISDYLNVKVRRTDVLSAWSGIRPLAVDPKAKSTESISRDHVVCEDHPGLVTITGGKWTTYRSMAEDAVDAAIKSGKLSPTNECLTNNLHLSGSEDWDPASFTVLAQQYVRMKRSHSGKVVPGVMDTAAAKHLSHAYGTMADRVAAIAQDEHLGKRLAHGYPFLEAEVAYCARNEYCESAIDFIARRSRLAFLDTDAASRALPRIIEILATEHNWDRTRKKKELQKAKEFLETFKSSRNAQFYDGKHK

SEQ ID NO: 80183 - protein, 327 aa, Escherichia coli
HGRAIGATGSAVGEVVFNTSMTGYQEILTDPSYSRQIVTLTYPHIGNVGTNDADEESSQVHAQGLVIRDLPLIASNFRNTEDLSSYLKRHNIVAIADIDTRKLTRLLREKGAQNGCIIAGDNPDAALALEKARAFPGLNGMDLAKEVTTAEPYSWTQGSWTLTGGLPEAKKEDELPYHVVAYDFGAKRNILRMLVDRGCRLTIVPAQTSAEDVLKMNPDGIFLSNGPGDPAPCDYAITAIQKFLETDIPVFGICLGHQLLALASGAKTVKMKFGHHGGNHPVKDVEKNVVMITAQNHGFAVDEATLPANLRVTHKSLFDGTLQGIHR

SEQ ID NO: 80184 - protein, 327 aa, Citrobacter freundii
HGRAIGATGSAVGEVVFNTSMTGYQEILTDPSYSRQIVTLTYPHIGNVGTNEADAESSQVHAQGLVIRDLPLIASNFRDTEDLSSYLKRHNIVAIADIDTRKLTRLLREKGAQNGCIIAGDNPDAALALEKAKAFPGLNGMDLAKEVTTAEPYSWTQGSWTLAGDLPEAKSADELPFHVVAYDFGAKRNILRMLADRGCRLTVVPAKTSAEDVLKMNPDGIFLSNGPGDPAPCDYAITAIQKFLETDIPVFGICLGHQLLALASGAKTIKMKFGHHGGNHPVKDIDNNTVMITAQNHGFAVDEASMPANLRVTHKSLFDGTLQGIHR

SEQ ID NO: 80185 - protein, 445 aa, Rhodobacter sphaeroides 2.4.1
MKDWLRKHPQVRTIRVAAADLNGQARGKRIPARFADKVVKDGTRFPFSVLNLDIWGEDIDDSPLVFEQGDADGILRPTERGFMPMPWLEAPTALLPIWMFREDGRPYEGDPRHALRAVLDRYKARGLTPVVAVELEFFLIDDSGKTLQVPPSPRSGKRRKAAEALSIRALDAFDIFFTDLYDACEEMDIPADTATSETGLGQFEVNLMHCDDALRAADDAWFFKLLVKGLARRHGFAASFMAKPYPEYSGSGLHMHFSVLDAQGRNVFDNGGPTGTAMMRHAVAGCLNAMHDSTLVFAPHANSYDRLVPGMHAPTAISWGYENRTTAVRIPAGNPAARRIEHRVAGGDVNPYLLVATILGAALTGIEDQEEPPQAIMGNAYALEDLPQIPPSWEAAIQSFENSAIMPRILPRELIRNYVLTKRQELHYLAELSPEEQVELYLDTV

SEQ ID NO: 80186 - protein, 459 aa, Flavobacteria bacterium BBFL7
MSDKVTTINPATGKEIKSYDLMTEDQTLQAVEKCHKAFENWKATPIKERGEIIKKIGEKFKEHQDEFAQLMTEEMGKLFKHGKQELDLCAGICEYTAAIGPEELANEEVDLQNGGKGIVTYSPLGVIYGIQPWNFPAYQVVRYSIVNLMAGNGILLKHAANVTGSALKLKEIYEEAGLPKDLFTVLIIDHDVSEKIIEHDLVRGVTFTGSAGAGSKIGEQAGKNIKKTVLELGSNDAYIVLEDADVELAVKTCTRGRIYNNGETCVAAKRFIVVDAVYEEFKKGFVERMSNIKHGDPMDENSQLGPMARKDLREKIHNQVQESIENGAEVLCGGEIPDGDGYYYPSTVLGNVTPGQPAYDDELFGPVASLIKAKDQEDAMRIANDSRFGLGGGIFSKDEDKAVELAQNHFDTGMVFINSFGLAQVDMPFGGVKDSGFGREHGGFGIKEFVNAKAINILK

SEQ ID NO: 80187 - protein, 498 aa, Dunaliella salina
MARLALLGAALLCALAVSTQGSPEGHGTKTEMMGAGRLLQQGPHTNSDPPYNYNCHGFDWAASSSSAEITELCDSPASSFPVADCDGDMQSPINIVTSELADPTDRSGVSGINLRGMGSSDFVLRSNVKLNIEQDMKISWDAPTSGNLPTIMIDGTEQRFQPIQLYFHHFASEHTINGQLYPLDAHLVMASLDDPNQLAVIGTMYKYGNGDDFLARLFGKVEDALEERDDVSYGSKEVPIDMEISPKDHVLPQSSLEYAGYDGSLTTPPCSEVVKWHVFTSPRTISIDQLKTFERVSFNAHPNEAIPTNNRVIQPLGTRAVYRYEATAMDDSGDGTGNADELSSPTTVTATYDIMVSGTASSLADMFNNGARLDNGGFGPDDQAEADLLRQIQRRARANSGAEGAEVVRMMKFTAALGRRRLNQQGAAAEMDIRYYFEGSTDQEEATSAVNGMNPSSLGSSSSGLTDVQQTEVTSSASSLRAGLGLVVAAFFGAALAL

SEQ ID NO: 80188 - protein, 314 aa, Vibrio vulnificus YJ016
MPDMKLFAGNATPELAQRIADRLYISLGDATVSRFSDGEVAVQINENVRGSDVFIIQSTCAPTNDNLMELVVMIDAMRRASAGRITAVIPYFGYARQDRRVRSARVPITAKVVADFLSNVGVDRVLTIDLHAEQIQGFFDVPVDNIFGTPVLLEDMHARGLEDPVVVSPDLGGVVRARATAKALGDIDIAIVDKRRPRANVSEVMNLIGDVEGRDCVIVDDMIDTGGTLCKAAEALKERGAKRVFAYATHAVFSGNAAKNIKNSVLDQVIVTDSITLSKEMAATGKVTQLTLSGMLAEAIRRISNEESISAMFN

SEQ ID NO: 80189 - protein, 504 aa, Cryptococcus neoformans var. neoformans JEC21
MAAPSNNKSGTIPSMEASGEALTDETVVIVLGASGDLAKKKTFPALFALFTQGLLPKDVHIVGYARTKMDKDEFHRREIQYIKGDQEKIKQFQELSSYVSGPYDEDAGYKELLKHVEELERDRKTRNRIFYMALPPSVFTTVAKGLKKNCYSSQGTNRIIIEKPFGKDLESCRQMMSELKSQWAENETYRIDHYLGKEMVKNLLVLRFGNVFLDASFNKNFVSNVQITFKEPFGTEGRGGYFDEFGIIRDVCQNHLMQALSILAMERPVSFSAEDIRDEKVKVLRCIPAIDRKDVLFGQYVAAGDKPGYLEDDTVPKDSICPTFAAMTLWINNPRWEGVPFIMKAGKALNEAKVEIRVQYKDATQGIFTDISRDELVMRIQPDEAVYLKMNNKLPGFHTRAVPVELDLTYKKRFTDANIPQAYEALILDALKGDHSNFVRDDELDVAWKIFTPILHWIDSKDAPKPEPYPYGSRGPKQIDEFAAKYGFKRSPQTYSWPKTSASL

SEQ ID NO: 80190 - protein, 327 aa, Serratia marcescens
HGRAIGAEGTAVGEVVFNTSMTGYQEILTDPSYSRQIVTLTYPHIGNVGTNASDEESSAVHAQGLVIRDLPLIASNYRNEESLSDYLKRHNIVAIADIDTRKLTRLLREKGAQNGCIIAADSPDAALALAKAQGFPGLKGMDLAKEVTTQEAYSWQQGSWTLEGDLPEAKTAAELPFHVVAYDYGAKRNILRMLVDRGCRLTVVPAQTPADDVLKMNPDGIFLSNGPGDPEPCDYAITAIKQFLETDIPVFGICLGHQLLALASGAKTMKMKLGHHGGNHPVKDLDNNTVMITAQNHGFAVDENNLPANLRVTHKSLFDHTVQGIHR

SEQ ID NO: 80191 - protein, 311 aa, Yarrowia lipolytica CLIB122
MQITIVGSLNYDLVTISNRLPNAGETMFSQGFETHCGGKGANQALATARLSSKVPDVNVKMYGKVGKDNFGTQLKNNLKDSGVDVSAIHELDTKSGVAVIFVDQDSGENRIMVYAGANGEWTEADLTDDLFDTDMLIFQNEIPIDIVYKAIEKAGSKKPKVVYNPSPVDERGNIPAAVLNSIDFLVVNVTEATLISGVEINEEASKEEIWKQADQAADTLFKMGIKEAVVVTLGGNGVIYKTKTDSGHVPSNKVEKIVDTTGAGDTFLGGFSTSIIQGKTVSEAIAFGNKAGGIAVTRRGAAEGIPYDHEL

SEQ ID NO: 80192 - protein, 327 aa, Brenneria quercina
HGRAIGAEGSAVGEVVFNTSMTGYQEILTDPSYSRQIVTLTYPHIGNVGVNASDEESSSIQAQGLIIRDLPLIASNYRSQETLSNYLQRNNIVAIADIDTRKLTRLLREKGAQNGCIIVGDAPDAALALEKAQSFPGLKGMDLAKEVTTTASYEWRQGSWTLQGDLPTVKDESELPYHVVAYDYGAKRNILRMLVDRGCRLTVVPAQTSAEDVLKLRPDGVFLSNGPGDPAPCDYAIDAIKTLLDTEIPIFGICLGHQLLALASGADTIKMKFGHHGGNHPVKDLDAGRVMITAQNHGFAVDEATLPANLRVTHKSLFDGSFEGIHR

SEQ ID NO: 80193 - protein, 419 aa, Vibrio vulnificus YJ016
MSLLAIGINHHTASVDLREKVAFGPDKLANALQQLSQHEAVNGSVILSTCNRTEVYCDVKSGARSKVIDWLSQFHQIGLEELKPSLYVYEEQAAIRHLMRVSCGLDSLVLGEPQILGQVKQAYSDSREQQAVDASLEKLFQKTFSVAKRVRTETDIGGNAVSVAYAACTLAKHIFESLEKSTVLLVGAGETIELVAKHLHANGCSKMIVANRTRERALTLAEQFDAQVISLQDIPNHLAKADIVISSTASPLPIIGKGMVETALKQRRHQPMLLVDIAVPRDVEAQVGELNDAYLYTVDDLQSIIDNNIEQRKVEAIQAEAIVAEESAAFMSWLRSLQAVDSIREYRQSANDIREELLSKALLSLESGGDPEKVLRELSNRLTNKLIHAPTRALQLAAEQGEPAKLTVIRQSLGLDELK

SEQ ID NO: 80194 - protein, 272 aa, Aspergillus oryzae
MTTLFTVPISSTGGSFVCSNPTASEKEKNIYLLTFTSPKDNRLTPTFIDAFILALDIIEHRYPKGVVITTSGIPKFYSNGLDLELALSTEGFLDKWLWKLFRRFLTFPMPTICLLNGHAFAGGLMLAMYHDYRIQNPSKGLLCINELEFGVPLQSPMMSIFREKLTPSSFRDLILEAKRFGGPESVKAGLVDGVGGLEEVLTLIRERGLQKKAATGIYGTMKEEMYRHSLDILDGHTANLAWREQLEDKKDQAQRDGLKAVEAFEKQRNAKL

SEQ ID NO: 80195 - protein, 304 aa, Zea mays
MAATSTFLFSSNLHSLNSQPFSSSLSFFRNVHSTLSFPSSKPSRGVVAMAGSGKFFVGGNWKCNGTKDSIRKLVSDLNSATLESDVDVVVAPPFVYIDQVKNSITDRIEISAQNSWVGKGGAFTGEISVEQLKDLGCKWVILGHSERRHVIGENDEFIGKKAVYALSEGLGVIACIGELLQEREAGKTFDVCFQQLKAFADVVPSWDNIVIAYEPVWAIGTGKVATPEQAQEVHAAVRDWLKKNVSAEVSSKTRIIYGGSVNASNSAELAKQEDIDGFLVGGASLKGPEFATIINSVTSKKVVA

SEQ ID NO: 80196 - protein, 238 aa, Oryza sativa Japonica Group
MVGGGGGGGGGSGSAAPSGAKLLQILNVRVVGSGERVVVLSHGFGTDQSAWSRVLPYLTRDHRVVLYDLVCAGSVNPDHFDFRRYDNLDAYVDDLLAILDALRIPRCAFVGHSVSAMIGILASIRRPDLFAKLVLIGASPRFLNDSDYHGGFELEEIQQVFDAMGANYSAWATGYAPLAVGADVPAAVQEFSRTLFNMRPDISLHVCQTVFKTDLRGVLGMAVISTAAVEITLHFLYG

SEQ ID NO: 80197 - protein, 331 aa, Campylobacter coli RM2228
MAEAKPKIAILATGGTIAGSIDSAVATTGYTAGVVGVDVLIKAVPQIQDLANISGEQVANIDSSNMRDEIWLKLAKKINKLFDEGVDGVVITHGTDTMEETAYFLNLTIKSDKPVVLVGAMRPSTAISADGPKNLYNAVALAADKEAKNKGVMVAMNDKILSARGVVKTHSLNVDAFSSPDFGDLGYIVDGKVFFYNNISKAHTKNSPFDVSKLTSLPKVDILYTYSNDGSAIAAKALFDNGTKGIVVAGSGAGSIHEDQKNTLKELIKQGLDVVVSSRVAAGRVAVSDADKKLGFISAEDLNPQKARVLLMLALTKTNDPKKIQEYFLKY

SEQ ID NO: 80198 - protein, 570 aa, Bacillus pumilus SAFR-032
MSYQALYRVFRPQVFEDVVGQEHITKTLQNALLQKKFSHAYLFSGPRGTGKTSAAKIFAKAVNCEKSPVSEPCNECDACKGITNGSISDVIEIDAASNNGVDEIRDIRDKVKFAPSAVTYKVYIIDEVHMLSIGAFNALLKTLEEPPAHCIFILATTEPHKIPLTIISRCQRFDFKRITTKDIVGRMQKIVDAESLNVQEGSLEIIASAADGGMRDALSLLDQAISFSGEQLTIDDALLITGAVSQQFISQLAEAIFDQNIAVALDTLNELLQQGKDAAKLIEDMIFYFRDMLLYKTAPDLEGVLEKVKVDENFVTLSDRVTPQFLYETIEVLNKSHQEMKWTNHPRIFFEVAVVKLCQATAGIPQAHANADLTTLTDKIDRLEQELSRIKAEGVPMSHSQHPQEKKEAPRPQTSNKNGYRAPVGRIHEILKEAKRPELEKIKGKWGELLAHLKQQNKVSHAALLTDSEPVAAATHAFVLKFKFEIHCKMVAEDKSGVRTNLEQLLESMLGKRVELVGVPDAQWGKIREEFLRDHQPDEQADGQGTPAEEDPLIAEAKKLVGTDLIEIKD

SEQ ID NO: 80199 - protein, 545 aa, Flavobacteria bacterium BBFL7
MKNINPTETNAWLQLEKHFEGFDDFSLREEFKKDASRAQKLTIIDKDFYVDFSKNLITESTRTHLTALATECGLKEAINSYFTGAVINATEKRSVLHTALRTPQAHADKSLESNVSDAIASKQKMFDYVDGILNGDTLSANGKKFDTIVNIGIGGSDLGPVMIYEALQAYKNNMTLHFVSNVEGDHVEEVLKKINPDTTLFVIVSKSFGTQETLTNATTIRNWFTEKLEASAVSKHFIAVSSNVDKAVNFGIDHKNIFPMFDWVGGRFSLWSTVGMSVALGIGTDNFQALLDGAHEMDNHFRNTDFEKNIPVQLALMTIWYNNFYRAQSEVIIPYTQYLHRLPAYLQQAIMESNGKCVDRDGNSVTYDTGNIVWGEPGTNSQHAFFQLIHQGTKLIPAHFIAFAKAKYNQPDHHNKLMANFIAQTEALMNGKTRSEAKKDLERSGKSKDEIDMLLPFKVFEGDQPTTTILIDELTPQSIGKLIAMYEHKIFTEGIIWNIYSYDQWGVELGKVLADTILDNIENKEYADHDSSTSAILKRFGNLNS

SEQ ID NO: 80200 - protein, 880 aa, Coccidioides immitis RS
MSSWIQRQTNSQYAQLAGAALLSGTAVAGAILGYQAIKRKAAVEELKKSIPGLDDSNRALKLSEFGVAPPPSAQQRKEDEHRAAIARRAQDGYYDEEKLRSSFIIVVGCGGVGSHASAALARSGVGRIRLIDFDQVTLSSLNRHAVATLADVGMPKVRCLQKRLEQIAPWVRFDPQNTLFAASAADQLLGPWSMPGDDNTSKPDFVLDCIDNISSKVDLLRYCHSQGIPVISSMGAGCKSDPTRILVGDISTSLEDPLSRSTRRRLKALGVTSGIPVVYSTEKPGPGKAALLPLPEEEFTKGEVGELSVLPDFRVRILPVLGTMPAVFGYTLANHVICDIAGYPNDYNSGIKGREKLYDSVLGALQGTEERLAKHDNKDPVGLRIPITKDDVGYLLEEVWRGKSVVSGLTTRLALVRWERPGEGFGADPKWDQHGQKGVKMRLRDLVCMTKEEAQRHEREVLKGGKKPAELYDESVLIKVQQRMREEEEFESRIIIQAFERASRQPLLNLASNVWFNKPLDHNKPSMSGSNLILALITAPRFRRYLIVYLVLCCICGLGWVGIASPRLKEHKEVLRALDVNNRQRVGGWFGSNSLPKFTDLVHLEALDERLLPSARQVDSLLDKASFNRQTDHLIFTGNIITNGPKSVETVQLARKYNASCVRGNNEDRILLYRHELLTTGVLTGPNPRPNAKFESGGSAFEAGKTKPPEGDQEILPYGDYKEHVLAQKLSDDDAAWLHKCPVILKVGQINDLGEVVVVHGGLVPGVELENQDPLAVMTMRTLDVDTHVPSPRAKGMDWAKIFNKQQSLTVSTSKNPPSSQLTTVIYGHTPHRSPAIRRFTKGLDTGCVRGGKLTALIITEGGTTRIEQVRCKNYVSKRR

SEQ ID NO: 80201 - protein, 280 aa, Brassica napus
  misc_feature (70)..(70): Xaa can be any naturally occurring amino acid
  misc_feature (268)..(268): Xaa can be any naturally occurring amino acid
MDHEADAYRTDLMTITRFVLNEQSKYPESRGDFTILLSNIVLGCKFVCSAVNKAGLAKLIGLAGETNIQXGEEQKKLDVLSNDVFVKALVSSGRTSVLVSEEDEEATLVESSKRGKYCVVFDPLDGSSNIDCGVSIGTIFGIYTMSHNDEPTTEDVLKPGNEMVAAGYCMYGSSCMLVLSTGTGVNGFTLDPSLGEFILTHPDIKIPKKGNIYSVNEGNAQNWDGPTTKYVERCKFPKDGSPAKSLRYVGSMVADVHPTLLYGGIFLXPADKKSPNGKLR

SEQ ID NO: 80202 - protein, 336 aa, Glycine max
MAPKGLTFLAVLICVSALSLSPSVAGEGQNNGLVMNFYKESCPQAEDIITEQVKLLYKRHKNTAFSWLRNIFHDCAVQSCDASLLLDSTRRSLSEKETDRSFGLRNFRYIETIKEALERECPGVVSCADILVLSARDGIVSLGGPHIPLKTGRRDGRRSRADVVEQFLPDHNESISAVLDKFGAMGIDTPGVVALLGAHSVGRTHCVKLVHRLYPEIDPALNPDHVPHILKKCPDAIPDPKAVQYVRNDRGTPMILDNNYYRNILDSKGLLIVDHQLANDKRTKPYVKKMAKSQDYFFKEFSRAITLLSENNPLTGTKGEVRKQCNVANKHHDQDP

SEQ ID NO: 80203 - protein, 242 aa, Haemophilus influenzae 86-028NP
MQGKIALVTGASRGIGRAIAEELSSKGAFVIGTATSEKGAEAISAYLGDKGKGLVLNVTDKESIETLLEQIKNDFGDIDILVNNAGITRDNLLMRMKDEEWFDIMQTNLTSVYHLSKAMLRSMMKKRFGRIINIGSVVGSTGNPGQTNYCAAKAGVVGFSKSLAKEVAARGVTVNVVAPGFIATDMTEVLTDEQKAGILSNVPAGRLGEAKDIAKAVAFLASDDAGYITGTTLHVNGGLYLS

SEQ ID NO: 80204 - protein, 184 aa, Zea mays
  misc_feature (30)..(30): Xaa can be any naturally occurring amino acid
  misc_feature (54)..(54): Xaa can be any naturally occurring amino acid
  misc_feature (63)..(63): Xaa can be any naturally occurring amino acid
  misc_feature (110)..(110): Xaa can be any naturally occurring amino acid
  misc_feature (114)..(114): Xaa can be any naturally occurring amino acid
  misc_feature (173)..(173): Xaa can be any naturally occurring amino acid
GSNDISNELTLIAPRPSDHKMTSHDCSHAXDKLFDMPPDELIHTYIDLGTHLYXSWVYQSLDXLDLNAESAPPKIQIFMSVRYEHYCGYEIKIDPIHAFATHKLVDNLLXAYKXIHVDAIDSEGRTALHWSIHREHLNVAEALIANKADVSAKDHEWQTSLHYVDVCERKALXEFLMKQKLILH

SEQ ID NO: 80205 - protein, 385 aa, Vitis vinifera
MYKNQLQELAQRSCFNLPSYTCIREGPDHAPRFKATVNFNGEIFESPNYCTTLRQAEHSAAEVALNSLSNRGPSHSLAARILDETGVYKNLLQEIAQRVGAPLPQYTTFRSGLGHLPVFTGTVELAGITFTGEPAKNKKQAEKNAAMAAWSSLKQLAKEAANSSSETENNDELEQITIARALLNYRLKEKMAIANSPSGTLSFPKKFPIQNSRLFSPQLPPVATSKILPLICQKTPPRNRPPSPTANDEPSATITASSTGRSCRAVPYVPIRQFRTPYHGIAPPVTIRNAVPVFSAPPSGLPPQVIRAPHMRIAPPVCVRQAVPVFAAPPVRKEDPLVVRKEDPSAASLPSLPTKSPAHVEETGSATANDLQEFEAVKSLEQLKI

SEQ ID NO: 80206 - protein, 310 aa, Zea mays
MDAGRGSSATIFPVPQVPALALLFPPPPPAAAALPSSSLSLSSSSSSRHAPSITSFPILVLTVLGILAACVLILAYYVFVIRCCLTWHRDRSASDAVSRRPQRARARVRTSTGGTPASSAEPRGLEDAVIRALPAFSYRKKPADLPPSAPAPASECAVCLGEFEEGDSVRMLPACLHVFHVGCVDAWLQGNASCPLCRARADVDAASCCRLLPPPPPEEEEDVAAIQVVVVVPGAEEDDRQGTVPQRQRETTVAPAAAAEVEGEDPPQVGGEKERRKDGDVAPRTRSFSTDGDGGEEVQSILQRNGQGLP

SEQ ID NO: 80207 - protein, 192 aa, Schizosaccharomyces pombe 972h-
MSVFRRSVQCVGVLPSILAQRSSLLARPANLQFLKTNSSKFVPQVTANVSRRMYHKNVLDHYNNPRNVGTLPKGDPDVGIGLVGAPACGDVMRLAIRVNKDGVIEDVKFKTFGCGSAIASSSYVTTMVKGMTLEEASKIKNTQIAKELCLPPVKLHCSMLAEDAIKSAVKHYRSKQLTPVGTTAGAIESATA

SEQ ID NO: 80208 - protein, 435 aa, Crocosphaera watsonii WH 8501
MTQATQTQTAPGFAPTFTHLVSKEGGVKYPLKALHVCEETFSPLEVAYDYEAIRNQVSRATIEAGPNSIWRYKAFLPVESQNPIDVGTGMTPLVKSHRLARRLGLKNLYIKNDAVNMPTLSFKDRVVSVALTRAKELGFTTVSCASTGNLANSTAAIAAHAGLDCCVFIPSDLEAGKVLGTLVYNPTLMAVKGNYDQVNRLCCEVGNTYGWGFVNINLRPYYSEGSKTLGFEVAEQLGWKLPDHVVAPLASGSLYTKIYKGFQEFIKTGLVEDKAVRFSGAQAEGCSPIATAFKEGRDFVTPVKPNTIAKSIAIGNPADGYYALDIARKTNGNIESVTDPEIIEGIKLLAETEGIFTETAGGTTVAVLKKLVEAGKIDPEETTVIYITGNGLKTQEAVQEYVGQPLTIEPKLDSFERALERSRTLERLDWQQVLV

SEQ ID NO: 80209 - protein, 164 aa, Vibrio parahaemolyticus RIMD 2210633
MRHIISLLLENQPGALSRVVGLFSQRGYNIESLTVSPTDDETLSRLNITTTSDEMQLEQIQKQLHKLIDVLKVQEVTEFEHIERELMMVKVKASGFARAEVKRTADIFRGQIVDVTASQYTVQLAGTSEKLDAFIQAISEVTEVVEVARSGVVGIARGERALKP

SEQ ID NO: 80210 - protein, 176 aa, Wolbachia endosymbiont of Dirofilaria immitis
GKLNNKSNRITSKLVICPPFTSLPDTIELNSNINIGAQNCHHKKYGSYTGEVSAKMLRELECTYVILGHSERVNEIDSEIKLKLEIAMESGLRPIVCVGENVEDCKSGKTREVIAYQCKNRLLVYGEYIVAYEPLWAIGTGYVPSNDKIAEVIEVIKSCVGNKQVIYGGSVNLENI

SEQ ID NO: 80211 - protein, 455 aa, Rhodobacter sphaeroides 2.4.1
MRDDAPNSWESRADASSFYGFTDLPSVHQRGTVVLTHGKGPYIYDVHGRAYLDANSGLWNMVAGFDHPGLIEAAKAQYERFPGYHAFFGRMSDQTVMLSEKLVEVSPFARGRVFYTNSGSEANDTMVKMLWFLGAAEGHPERRKIITRVNSYHGVTAVSASMTGKPYNSLFGLPLPGFIHVGCPHYWRFGQAGETEAEFTQRLARELEATIIKEGPDTIAGFFAEPVMGAGGVIPPSEGYFQAVQPVLKRYGIPLIADEVICGFGRTGNTWGCQTYDFMPDGIISSKNITAGFFPMGAVILGPELADRLQAASEAVEEFPHGFTASGHPVGCAIALKAIDVVMNEGLAENVRALTPKFEAGLAYLAENPNIGEWRGKGLMGALEAVKDKATKTPFPGDLSVSERIANSCTDHGLICRPLGQSIVLCPPFIMTEAQMDEMFEKLGAALKKVFAEVA

SEQ ID NO: 80212 - protein, 294 aa, Ashbya gossypii ATCC 10895
MTYNPYYEQSQAAQARYPQGQRQMQQTPADPRYQQQYGQTAPQGPAYAGFADPRASMAFQFGQSALNQFIGSENFNQFQETVQRATGGGDLSHYFQVSNSYVFQKLKVMLLPMLHKQWQRIPDTNNSFQPPRSDINSPDMYVPLMGLVTYILAWNLEQGLHGSFDPENLYFKLSSTLAYLVLDLAILKLGLYLLVPINSKTTSLVELACYVGYKFVPLIFAMLLPRQPVWATVLGKFYLFMAFGIFLLRSVKFNLFNDTANDVNTVKKSVVKKCNYFLFFYGVVLQSGLMWLMG

SEQ ID NO: 80213 - protein, 456 aa, Haemophilus influenzae 86-028NP
MTKHYDYIAIGGGSGGIASLNRAASYGKKCAIIEAKHLGGTCVNVGCVPKKVMFYGAHIAEAINNYAPDYGFDVEVKKFDFSKLIESRQAYISRIHTSYNNVLAKNNIDVINGFGKFVDAHTIEVTLADGTKEQVTADHILIATGGRPYRPNIKGQEYGIDSDGFFALTELPKRAVVIGAGYIAVELSGVLNSLGVETHLLVRRHAPMRNQDPLIVETLVEVLAQDGIQLHTNSTPSEIVKNADGSLTVKCDGQSDVTVDCVIWAAGRVPTTDKIGLENAGVETNEHGYVKVDKYQNTNVKGIYAVGDIIENGIELTPVAVAAGRRLSERLFNNKPTEYLDYSLVPTVVFSHPPIGTVGLTEPQAIEQYGAENVKVYKSSFTAMYTAVTQHRQPCKMKLVCVGKDEKVMGLHGIGFGVDEMIQGFAVAIKMGATKADFDNTVAIHPTGSEEFVTMR

SEQ ID NO: 80214 - protein, 382 aa, Methanococcus maripaludis S2
MKQMDTEKLLMIPGPTMVPSRVLNTMALPIIGHRTSDFGDLTGDTVDMMKKVFQTENDTYIITGSGTAVMDMAISNTLDKGDKVINITNGNFGERFYKISSVYKADTIKYEPEWGDLADPKKLRELLEENEGIKAVTVVHNETSTGAKNPIEDLGNVVKDFDAIYIVDTISSLGGDYVNVDKFNIDICVTGSQKCIAAPPGLAAITVGEKAWDVVSKTETKSFYLDLNAYKKSWDAKKETPYTPSVSLTYAMNEALEMVLEEGLENRFKRHDLLARATRAGLEAMGLELFAKERARSVTVTSAKYPEGIDDKKFRGLLAEKYNIRVAGGQSHLAGKIFRVGHMGSAKEYQVLGTLAAIELAFKELGYNAEGGVAAAKKVLSN

SEQ ID NO: 80215 - protein, 738 aa, Glycine max
MERKIIDFDQGWDYMQKGITKLKKILEGAPETPFSSEEYMMLYTTIYNMCTQKPPNDFSQQLYDKYKDAFDEYIKITVLPSLREKHDEFMLRELVQRWLNHKVMVRWLSRFFHYLDRYFISRRSLPGLGAVGLTCFRESVYMEVRVNARKAVIALIDKEREGEQIDRSLLKNVLDIFVEIGMGEMGQYEQDFEVHMLEDTADYYKSKAANWIEIDSCPDYMLKAEDCLRRERDRVSHYLHCSTEQKLVEKVQLELLVTHANQLLEKENSGCHALLRDDKVEDLSRMYRLYHKIPKGLDPVANVFKQHITAEGTSLVQQAEEATSNQTTNGSGFQEQVLVRKFLELHDKYMAYVNDCFMNHTLFHKALKEAFEIFCNKTVGGSSSAELLSTFCDNILKKGGSEKLSDEAIEDTLEKVVKLLAYISDKDLFAEFYRKKLARRLLFDRSANDDHEKCILTKLKQQCGGQFTSKMEGMVVDLTLARDNQLKFEEYLRDNSHVNPGIDLTVTVLTTGFWPSYKSFDLNLPSEMIRCLEVFKGFYETRTKHRKLTWIYSLGTCHVTGKFETKNIELIVPTYPAAALLLFNNADRLSYSEIMTQLNLGHEDVARLLHSLSSAKYKILIKEPNNKVISQSDIFEFNYKFTDKMRRIKIPLPPADERKKVIEDVDKDRRYAIDAAIVRIMKSRKILGHQQLVLECVEQLGRMFKPDIKAIKKRIEDLITRDYLERDKDNPNTFRYLA

SEQ ID NO: 80216 - protein, 538 aa, Triticum aestivum
  misc_feature (500)..(500): Xaa can be any naturally occurring amino acid
GLCRCGVVVGPGSWADFGPEELELAARAHMKDPAHRTKVVLRRLPPAIAQQAVVDQVDARFAGRYDWACFRPGNASQKNHRYSRLYLNFKSPEDVVEFAEFFNGHVFVNEKGAQFKALVEYAPSQQVPKSNIKKDARQGTITKDPEYLEFLELISKPTEHLPSAEIQLERKEAERAAAGKVPPVVTPLMVYVRQQRAAKSMAQRSVSSRLSRKVAGVVTSSSSPSKRSSERRRASTSTQYVVRDNAKEKPTYILAPKRDDHTHREKIIAGTSDATSGGPSGSAQVIDGKKDKIVLLKGRARVDSNISDSSTPQQSLPPPRNTPPSTSRQDQRNEASVRIIKTILSNKEGRHAIASSQHEQEGHIISAEKDKRPPRAPNSRSTVKDQTVENAEKNHYDDKHNHLHGSGPIGEKIERHARNRDRPDRGVWAPRRYDKSASGGSTQASSSEFPLMQSHSMDNFSQQVDGHGERKIDTRSPGGRGGLVENGNRHANRRGPPRGXKEMEIPPITSDGKPSKRGPANYVAHERQVWVQKSSSGS

SEQ ID NO: 80217 - protein, 133 aa, Zea mays
  misc_feature (64)..(64): Xaa can be any naturally occurring amino acid
  misc_feature (74)..(74): Xaa can be any naturally occurring amino acid
  misc_feature (96)..(96): Xaa can be any naturally occurring amino acid
  misc_feature (123)..(123): Xaa can be any naturally occurring amino acid
STFIMIMPDYAQRPLLGEILLPFMRTTPSHLKDLMLGNAQRTFAEKTYADLPSWPFFHGLVDYXISGPVEAMVXDVYSVVTTGRNDIGGSHSPLAXSSPEHIRGNFAGNLGTNVIHGSDCIEXANLEIALRFP

SEQ ID NO: 80218 - protein, 366 aa, Escherichia coli
GILDGNSAITVLHGEARFKDDQSLIVSLNEGGERVVMFDRCLVATGASPAVPPIPGLKESPYWTSTEALASDTIPERLAVIGSSVVALELAQAFARLGSKVTALARNTLFFREDPAIGEAVTAAFRAEGIEVLEHTQASQVAHMDGEFVLTTTHGELRADKLLVATGRTPNTRSLALEAAGVAVNAQGAIVIDKGMRTSSPNIYAAGDCTDQPQFVYVAAAAGTRAAINMTGGDAALDLTAMPAVVFTDPQVATVGYSEAEAHHDGIETDSRLLTLDNVPRALANFDTRGFIKLVIEEGSGRLIGVQAVAPEAGELIQTAVLAIRNRMTVQELADQLFPYLTMVEGLKLAAQTFSKDVKQLSCCAG

SEQ ID NO: 80219 - protein, 327 aa, Hafnia alvei
HGRAIGAEGTAVGEVVFNTSMTGYQEILTDPSYSRQIVTLTYPHIGNVGTNAADEESSAVHAQGLVIRDLPLIASNYRSTENLSDYLKRHNIVAIADIDTRKLTRVLREKGAQNGCIIAGDSVDAVLALEKAKAFPGLKGMDLAKEVTTKESYSWQQGSWTLEGELPEAKAAEECKFHVVAYDYGAKRNILRMLVDRGCRLTVVPAQTPAEDVLKLNPDGIFLSNGPGDPEPCDYAIDAIKAFLETDIPVFGICLGHQLLALASGAKTLKMKLGHHGGNHPVKDLDNNVVMITAQNHGFAVDENDLPANLRVTHKSLFDHTVQGIHR

SEQ ID NO: 80220 - protein, 559 aa, Pseudomonas sp.
MTELKIIGMTCASCVVHVKEALEKIPGVHRADVSYASGKAELKVDEGASREQMQAAVEALGYRAAFEDAMVQARPGLLDKARGWLSSTDAGKEGDKLHVAVIGSGGAAMAAALKVVEGGARVTLIERGIIGGTCVNVGCVPSKIMIRAAHVAHLRRESPFDAGLSAMTPTVLRERLLAQQQDRVAELRHAKYESILESTPAISVLRGTARFQDGHTLSVKLAEGGEHIVAFDRCLVATGASAAVPPIPGLKDTPYWTSDQALASDTIPKRLAVIGASVVAVELAQAFARLGSEVTILARSAMFFHEDPAIGAAVTEAFRMEGIEVLEQTQASQVSHANGEFVLATNHGELRADQLLVATGRTPNTQGLNLEAADVQLDERGGIQIDERMRTSAADIYAAGDCTDQPQFVYVAAAAGTRAAINMTGGEAKLNLDVMPAVVFTDPQVATVGYSEAEAQHAGIETDSRTLTLDNVPRALANFDTRGFIKLVAEAGSGRLLGVQAVAPEAGELIQTAVLAIRNRMTVQELADQLFPYLTMVEGLKLAAQTFNKDVKQLSCCAG

SEQ ID NO: 80221 - protein, 241 aa, Brassica napus
MRGMKSLTIWAIFAAVLSQQLFASVASIKFEDEKTYYSPPDPNAGSPPSGTPPSHGGYTPTPPTPSHTPPSNCGSPPYDPTPPSHTPTPSTPSHTPSTPSHTPSHTSPPCHCGTPPSHPSTPSHPSRPSHPSRPSRPSTPSNPPSGGYYSSPPPSTPVVVTPPTPIVDPGTPSTGGTPPSSGGYYSSPPPSTPVVETPPTPIVDPGTPIIGETPPTPSGGYYSSPPPSTPIVVTPPTPMVD

SEQ ID NO: 80222 - protein, 430 aa, Methanococcus maripaludis S2
MLRNMDDSFDIYEIKARQVLDSRGNPTVEAEVLTAGGGYGHTIVPSGASTGTFEAVELRDKKEKYGGKSVLNAVSNVNDIIAQELIGEDARNQRLIDQIMLNLDGTENKGNLGANAILAVSLAVAKAAADTASLPLYKYIGGSNAYVMPAPMMNVLNGGQHAGNALDFQEFMIMPVGADSFAEAVRMCSETYQSLKKVVAEKYGKDAVNVGDEGGFAPPVKTIDEALAVLLEGVKKAGYEDEIVFTIDSAASEFYDEKSGSYMIAGEKVSTDKLIDIYKEMVEQYPIVSIEDPLFEEDFEGFKTATKELKGIQIVGDDLFVTNTKRLKKGIEMGAANSLLLKVNQIGTLSESIDAANMAFRNGYSLVVSHRSGESEDSTIADLAVALNAGQIKTGAPARGERTAKYNQLMRIEEELQISKYAGKDFKIPF

SEQ ID NO: 80223 - protein, 142 aa, Methanococcoides burtonii DSM 6242
MKQKINRSEEEWKKLLTPEQYAILREKKTEIPFTGELLRNDRPGVYSCGACGQEIFSSKNKFDSSSGWPSFYEVISNDRVELVIDDSYFMKRIEIQCSNCGSHLGHVFDDGPQSTGKRYCINSASLGFTEGSEKEKEKKNDK

SEQ ID NO: 80224 - protein, 457 aa, Prochlorococcus marinus subsp. marinus str. CCMP1375
MLFSPVISVLSTHDIEVAETLIGVIRFLLIFVAARTLAEILVRLSLPTIVGELLAGVLIGASGLHLLIPPSAHASLNNGLINIISSLASIPKEAVPDLYFETFPSLQAVATLGLYALLFLTGLESELEELVAVGTQAFTVAMAGVILPFAFGTLGLMFIFHVDLIPAIFAGASMTATSIGITASVFGELGYLKTREGQIVIGAAVLDDILGIVILAVVVALATGGSLEIAPIVKLVVAATVFVIAPIGLSRTAAPAFDWLLDRLKAPGAVVVASFVILVLSCFVATAIGLEAALGAFAAGLILSSSKNNHAIQQSVLPLVSLFATIFFVLVGAGMDLSVINPLDPASRSALIVAGFLLIVAIIGKIAAGWSFVIDKPTNRLVVGLGMMPRGEVGLIFLGLGTSAGLLTPSLEAAILLMVIGTTFLAPVLLRIVLKDKKPGGGNAIPDDIAADPVGLL

SEQ ID NO: 80225 - protein, 479 aa, Aspergillus oryzae
MASRRLAFNFNQALRSRAALKSIQPVKRGFSSPVTLPSTTQSTTLSNGFTIATEYSPWAQTSTVGVWIDAGSRAETDKTNGTAHFLEHLAFKGTNKRSQHQLELEIENMGAHLNAYTSRENTVYYAKSFNNDVPKAVDILADILQNSKLEPGAIERERDVILREQEEVDKQFEEVVFDHLHATAYQNQPLGRTILGPKENIQTISRDNLVDYIKTNYTADRMVLVGAGGIPHEQLVRLAEEHFGSLPSKPPTSAALALTAEQKRTPEFIGSEVRLRDDTIPTAHIALAVEGVSWKDDDYFTALVAQAIVGNWDRAMGNSPYLGSKLSSLVEHHGLANSFMSFSTSYSDTGLWGIYLVSENLTALDDLTHFAMREWSRLCFNVTSAEVERAKAQLKASILLSLDGTTAVAEDIGRQIITTGRRLSPEDIERTIGQISEKDVMDFANRRIWDQDVAVSAFGSVEGLLDYNRIRADTSRNTL

SEQ ID NO: 80226 - protein, 569 aa, Methanococcoides burtonii DSM 6242
MTLSDEDKITIEKFALQNAVKYGKAPQLGAVMGKVMGLCPHLRPLSKEVGPVIQHVLDEVMKEVPEEWQARLEVIAPELIEELNTKKEPDKGLKPLDVKEGESVVMRFAPNPNGPPTLGSTRGIVVNSEYVKRYGGKFIIRFDDTDPQTKRPMLEAYDWYLEDCEWLDAKPDEVVIASDNMEVYYDYARQLLEMGHAYVCFCEGGDFKKFKDAKEPCPHRGHAPEVNLEHWDKMLAGEYEEKAAVVRIKTDIEHKDPAMRDFGAFRIVKTAHPRPEVDDKYVVWPLLDFEGAIEDHVLGMTHIIRGKDLMDSEKRQGYIYNYLGWEYPKTTHWGRVKMHEFGKFSTSGLRQSIEDGEYSGWDDPRLPTLRALRRRGIKPEAIRKFMIDMGVGETDVSLSMDTLYAENRKIIDTIANRYFFVWDPVELEVEDAVCCTVNPSLHPSEDRGVRCIDIGSKLLVCKSDVESAELGDMLRMKYLYNIEITSVSPLKCKCIGDSMEDAKSNKMRIIHWVPEDGIPVKVLAPQGEFIGMGEKQIVDELDNVVQFERFGFCRIDSVDDGVVAYFTHK

SEQ ID NO: 80227 - protein, 429 aa, Pseudomonas syringae pv. syringae B728a
MRAELNKGLIDFLKASPTPFHATATLVQHFEAAGFQRLDERDTWAVETGGRYFVTRNDSSIVAFRMGRQSPLSGGIRMVGAHTDSPCLRVKPQPELQRQGFWQLGVEVYGGALLAPWFDRDLSLAGRVTFRRDGKVESQLIDFKLPIAVIPNLAIHLNRTANEGWAINAQNELPPILAQVAGDERADFRALLTDQLAREHGLNADVVLDYELSFYDTQGAAVVGLNGDFLAGARLDNLLSCFAGMQALLNTESDETALLVCTDHEEVGSSSACGADGAMLEQIVQRLLPSSEDYVRTIQKSLLISADNAHGIHPNYADKHDANHGPKLNAGPVIKVNSNQRYATNSETAGFFRHLCMAEEVPVQSFVVRSDMGCGSTIGPITASHLGIRTVDIGLPTFAMHSIRELAGSHDLAHLVKVLSAFYASHELP

SEQ ID NO: 80228 - protein, 319 aa, Colwellia psychrerythraea 34H
MHKPLSKIQKLEHPLFDKYNLDVRVKRDDLLHNIISGNKWRKLKHNLEQLKTNDYQGALTFGGSYSNHIHAFAYACKQHNIPCIGVIRGEANYANNFTLSWARHWGMQCHFVDRKTYRRRFETNFIDELKTLYPNYFVIPEGGSNSLAIPGVAEVLTELNSQVDFDTLITPVGSGGTLAGLISGDSVANQKQHKILGIAVLKQAEYLVDDIKRLLTEEAKNHENWKLLTNFHRGGYGKFSEDDVKRIITFNQQTGVCFEPVYSGKMVLALLDLITQGYFQPQERIVLLHTGGLQGLGGMIEQGRLDANDWPPLSSVDNE

SEQ ID NO: 80229 - protein, 292 aa, Zea mays
  misc_feature (124)..(124): Xaa can be any naturally occurring amino acid
  misc_feature (284)..(284): Xaa can be any naturally occurring amino acid
MGKDDVIESGAGGGEFAAKDYTDPPPAPLIDAAELGSWSLYRAVIAEFIATLLFLYITVATVIGYKHQTDASASGADAACGGVGVLGIAWAFGGMIFVLVYCTAGISGGHINPAVTFGLFLARXKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKAXLGSFRSNA

SEQ ID NO: 80230 - protein, 142 aa, Bordetella petrii
MAYSSKVLDHYENPRNVGSFDKGDESVGTGMVGAPACGDVMKLQIKVSESGVIEDARFKTYGCGSAIASSSLVTEWVKGKTLDEALDIRNTQIAEELALPPVKIHCSILAEDAIKAAVKDYKDKHAAPADAQGETAAAAVAN

SEQ ID NO: 80231 - protein, 640 aa, Bacillus pumilus SAFR-032
MMILQVNQLSKSFGADTVLTNIKLEVKARDRIAIVGRNGAGKSTLLKIIAGQLSYEQGEIIKPKDLSIGYLAQHTDVTSTRTLKDELLSVFDHLKKMEQEMRTIEEKMASSTGAELDSLMKTYDRLQQEFKDQGGYQYEADVRSILHGLGFSHFENETTVQSLSGGQKTRLALGKLLLMKPQLLILDEPTNHLDIDTLSWLEQYLQNYTGAILIVSHDRYFLDKVVNHVYEVSRTAMKKFAGNYSKYLDLKAEQLERDMKLYEKQQEEISKLQDFVDRNLARASTTKRAQSRRKQLERMDRLDKPLGDEKSANFHFDITRQSGNDVLKVHDLDIRYDEKIPLLSSLSFQIKREDSVALIGPNGIGKSTLLKTLTNTLKPAKGDITFGSHVTIGYYDQEQAKLTSSKKVLNELWDDYPHMNEKDIRTCLGNFLFSGDDVLKPVHALSGGEKARLALAKLMLQKANFLILDEPTNHLDLDSKEILENALIDYPGTILFVSHDRYFINRLATKVFELSPTETREYLGDYDYYLEKKDEQLELEAIQENEALKKQAAKPVETAKLSYAEEKELKKKERQKQRRIEEIEERIAIIEAKLGDNEELLCDPAIFQDHEKVQNIQIENDTFHQELESLFAEWEELSES

SEQ ID NO: 80232 - protein, 276 aa, Zea mays
MATAARSLHLPGPTPPKSSTPSSHRLPVPCHLRPQRRRLAASSSDLTSFPEPPPAPNGVYVPWAAASSVAAAAASIVVDAATEAELRENGFRSTRRTKLVCTVGPATCGAAELEALAVGGMNVARVNMCHGDREWHREVIRAVRRLNDEKGFAVAVMMDTEGSEIHMGDLGGAPSAKAEDGEVWTFSVRSSDTSLPDRIIHVNYDGFAEDVKAGDELFADGGMARFEVIEKLGPDVKCRCTDPGLLLPRANLTIWRDGSVVRERNAMLPTISSKSK

SEQ ID NO: 80233 - protein, 403 aa, Bordetella petrii
MTTRPIYLDYSATTPVDPRVVEKMVPWLYDNFGNPASRSHAFGWEAEDAVENARQEVAQLVNADPREIIWTSGATESDNLAIKGAANFYAERGKHIITVKTEHKAVLDTCRELERQGFEVTYLDVRDDGLIDLDAFKAALRPDTILVSVMLVNNEIGVIQDIETLGEICREKGIVFHVDAAQATGKVAIDLQKLKVDLMSFSAHKTYGPKGIGALYVRRKPRVRIEAQMHGGGHERGFRSGTLATHQIVGMGEAFRLAREEMGTENERIRMLRDRLWAGLSQIEETYLNGSLEQRVPHNLNVSFNYVEGESLIMAIKELAVSSGSACTSASLEPSYVLRALGRNDELAHSSIRFTLGRFTTEQEIDFTIELIKSRVGKLRDMSPLWEMAQAGIDLNTVQWAAH

SEQ ID NO: 80234 - protein, 301 aa, Kluyveromyces lactis NRRL Y-1140
MVSEQEILESYPQVCPSGSLSGTPGNLDSEQEAKLKEFRELLESLGYKERLDDSTLLRFLRARKFDLEASKIMYENCEKWRKEFGVDTIFEDFHYEEKPLVAKYYPQYYHKTDNDGRPVYIEELGSVNLTQMYKITTQERMLKNLVWEYEAFVRYRLPACSRKAGYLVETSCTILDLKGISISSAAQVLSYVREASNIGQNYYPERMGKFYLINAPFGFSTAFRLFKPFLDPVTVSKIFILGSSYQKDLLKQIPAENLPKKFGGQSEVSEAEGGLYLSDIGPWREEEYIGPEGEAPKAFQL

SEQ ID NO: 80235 - protein, 470 aa, Vibrio parahaemolyticus RIMD 2210633
MKKTKIVCTIGPKTESVEKLTELVNAGMNVMRLNFSHGDYEEHGTRIANFRKVMEATGKQLAILLDTKGPEIRTIKLEGGNDVDLVAGQEFTFTTDTSVVGNKDKVAVTYAGFAADLNVGNTILVDDGLIEMEVIATTDTEVKCKVLNNGALGENKGVNLPGVSVNLPALSEKDKNDLKFGCEQGVDFVAASFIRKASDVQEIREVLAANGGENIHIISKIENQEGVDNFDEILELSDGIMVARGDLGVEIPAEEVIFAQKMMIEKCNRARKMVITATQMLDSMINNPRPTRAEAGDVANAVMDGTDAVMLSGETAKGKYPVEAVTIMAQIAKRTDSVLKAELGSRLDSPRLRITEAVCKGAVDTAEKLAAPLIVVATEGGKSARSVRKYFPTANILALTTNKKTAAQLVLTKGVTPVVVDAIESTDAFYVAGKELALESGLGNKGDIVVMVSGALVASGTTNTASVHVL

SEQ ID NO: 80236 - protein, 174 aa, Bacillus halodurans C-125
MLYPYKDKKPKIAENVFLADYVTITGDVTIGADSSIWYNTVIRGDVSPTFIGERVNIQDNSVLHQSPRTPLVIEDDVTVGHQVILHSCTIRKEALIGMGSIILDGAEVGEGAFIGAGSLVPQGKKIPANSLAFGRPAKVVRTLTEEDRKDMARIRREYVEKGQYYKQVQQEYRS

SEQ ID NO: 80237 - protein, 277 aa, Bacillus cereus
MILTSLKDYTTLHNGVKMPWFGLGVFKVEDGSEVIDSVKAAIKNGYRSIDTAAIYQNEEGVGQAIRESGVSREELFITSKVWNSDQGYETTLQAFETTLEKLGLEYLDLYLVHWPVKGKYTESWKALEKLYKDGRVRAIGVSNFHIHHLQDVFEIAEIKPMVNQVEYHPRLAQEELHAFCKEHNIQLEAWSPLMQGQLLDNPTLQEIATKYNKSTAQIILRWDLQNEVVTIPKSIKEHRIIENANIFDFELSADDMKAIQALNEDRRVGPDPDNFNF

SEQ ID NO: 80238 - protein, 334 aa, Colwellia psychrerythraea 34H
MKYLVTGAAGFIGSAVVERLCAAGHDVVGIDNINDYYDIALKQARLARIEHASFSFIKMDIADRNVMAELFTAQQFDKVVHLAAQAGVRYSIENPMAYADSNLIGHLNVLEGCRNNQVKHLIYASSSSVYGLNNKVPFSTKDTVDHPVSLYAATKKSNELMAHSYSHLYNIPTTGLRFFTVYGSWGRPDMAPYIFTKKILNGDTIDINNNGDMWRDFTHVDDIVEGVIRIADVIPERDAEWKVESGSPATSSAPYSVYNIGHGSPISLMDFVKAIEDELGIEAKKNFREMQPGDVYQTYADTQDLFKATNYVPKISVKEGVAELVVWFKDFYKI

SEQ ID NO: 80239 - protein, 438 aa, Penicillium citrinum
MPIAKVHARSVYVSRGNPTVEVDVVTETGLHRAIVPSGASTGQHEAVELRDGDKAKWGGKGVLKAVKNVNETIGPALIKENIDVKDQAKVDEFLNKLDGTANKGNLGANAILGVSLAIAKAAAAEKGVPLYVHISDLAGTKKPYVLPVPFQNVLNGGSHAGGRLAFQEFMIVPDTAESFSEGLRQGAEVYQKLKALAKKKYGQSAGNVGDEGGVAPDIQTAEEALDLITEAIEQAGYTGKISIAMDVASSEFYKTDAKKYDLDFKNPDSDPTKWLTYEQLADLYKSLAAKYPIVSIEDPFAEDDWEAWSYFYKTSDFQIVGDDLTVTNPLRIKKAIELKSCNALLLKVNQIGTLTESIQAAKDSYADNWGVMVSHRSGETEDVTIADIAVGLRSGQIKTGAPARSERLAKLNQILRIEEELGENAIYAGKNFRTSVNL

SEQ ID NO: 80240 - protein, 276 aa, Bacillus subtilis
MPTRLKDTVKLHNGVEMPWFGLGVFKVENGNEATESVKAAIKNGYRSIDTAAIYKNEEGVGIGIKESGVAREELFITSKVWNEDQGYETTLAAFEKSLERLQLDYLDLYLIHWPGKDKYKDTWRALEKLYKDGKIRAIGVSNFQVHHLEELLKDAEIKPMVNQVEFHPRLTQKELRDYCKAQGIQLEAWSPLMQGQLLDNEVLTQIAEKHNKSVAQVILRWDLQHEVVTIPKSIKEHRIIENADIFDFELSQEDMDKIDALNKDERVGPNPDELLF

SEQ ID NO: 80241 - protein, 300 aa, Synechococcus sp. WH 5701
MAVAVSTEFDFAAYLESARGQVELALEAALGPERPESLREAMRYSLLAGGKRLRPILCLAACELAGGEVALALPTAVALEMIHTMSLIHDDLPAMDNDDLRRGRPTNHKVYGDAQAILAGDALLTRAFEMVALRSPGVPAERLLQVVGELSLAAGAPGLVGGQVVDLESEGKDVDLATLEYIHLHKTGALLQACVLTGAMIAGAPEPLLQGLRTYSRGIGLAFQIIDDILDVTASSEVLGKTAGKDLTADKTTYPKLLGLEESRQRADALVAEAKAALQPWQASAQPLLALADYITSRDR

SEQ ID NO: 80242 - protein, 126 aa, Oryza sativa
  misc_feature (30)..(30): Xaa can be any naturally occurring amino acid
MIICCPLLMVLPRPDGSLLHSTSLTGWTIXQLEEANSAKKLVVIDFTASWCGPCRIIAPVFADLAKKHTNAVFLKVDVDELKPIAEQFSVEAMPTFLFMKEGDVKDRVVGAMKDELASKLELHMAM

SEQ ID NO: 80243 - protein, 517 aa, Staphylococcus aureus subsp. aureus COL
MSEEKHVVEHEQQKKEKTKKQYKPFWIVMSFIILIVVLLLPAPSSLPIMAKAVLAILAFAVIMWVTEAVSYPVSATLIIGLMILLLGFSPVQNLGEKLGNPKSGSAILAGSDLLGTNHALSLAFSGFATSAVALVAAALFLAAAMQETNLHKRLALLVLSIVGNKTRNIVIGAIIVSIVLAFFVPSATARAGAVVPILLGMIAAFKVSKDSKLASLLIITSVQAVSIWNIGIKTAAAQNIVAINFINHQLGFDVSWGEWFLYAAPWSIVMSVALYFIMIKVMPPEINTIEGGKDLIKEELHKLGPVSPREWRLIVISMLLLLFWSTEKVLHPIDSASITIIALGVMLMPKIGVMTWKHVENKIPWGTIIVFGVGISLGNVLLKTGAAQWLSDQTFGVLGLKHLPIIATIALITLFNILIHLGFASATSLSSALIPVFISLTSTLHLGDQSIGFVLIQQFVISFGFLLPVSAPQNMLAYGTGTFTVKDFLKAGIPLTIVGYILVIVFSMTYWKWLGLL

SEQ ID NO: 80244 - protein, 255 aa, Populus trichocarpa
MADMKRVVRSLLDLPFDVKKRNLDVISGSGYMAPSQVNPLYEALGLYDMGSSQAVETFCSQLDASSYQREVIEMYAKAIHGVAKDVARKLAESLGLSGDFFESWVCQFRINKYNFTPETIGSSGVQIHTDSGFLTILQDDKNVGGLEVMNPSGVYVAVDPVPGTLLINLGDIAKAWSNGRFRNVQHRVQCKEATIRISIASFLLASDEEVEAPPELVDSEHPRLYVPFTYEDYRKLRLTTKLQAGEALELKRIKS

SEQ ID NO: 80245 - protein, 334 aa, Flavobacteria bacterium BBFL7
MSKKLKLAINGFGRIGRIVFRATLERANVEVVAINDLVDVEQLAYLLEYDSVHGRYGGSIEIKDGNLIIDGVQVRVTSERDPKNLKWDEVDVDVVADCTGIFTDLDSAQAHIDAGAKKVVISAPSKTAPMFVMGVNDNELTADHKIVSNASCTTNCLAPMAKILDDNFGIAEALMTTVHATTATQATVDGPSKKNYRLGRSAMNNIIPATTGAAVAVTKVIPALKGKLTGMAFRVPTVDVSVVDLTVKLSKETSLEEINKAFKDASTGAMAGVVGYTDEAVVSQDFVSDARTSIYDAGAAIELNSTFFKLVSWYDNEFGYSNKLVDLAEKVHSL

SEQ ID NO: 80246 - protein, 427 aa, Glycine max
MASAMFRRNIITHYSKFASSLSSLPRHSSIYNPLSMSVSSFHSESVGGGGGLPSSMRGAVYWEPNKPLTIEEFHMPRPKAGEVLIKTKACGVCHSDLHVMKGEIPFTSPCVVGHEITGEVVEHGALTDSKTIERLPVGSRVVGAFIMPCGNCSYCSKGHDDLCEAFFAYNRAKGTLYDGETRLFFRNSGKPAYMYSMGGLAEYCVVPANGVSVLPDSLPYTESAILGCAVFTAYGAMAHAAQVRPGDSVAVIGTGGVGSSCLQIARAFGASDIIAVDVRDEKLQKAKTFGATHTVNSAKEDPIEKILEITGGKGVDVAVEALGKPQTFAQCTQSVKDGGKAVMIGLAQAGSLGEVDINRLVRRKIQVIGSYGGRARQDLPKLIRLAETGIFNLGHAVSRTYTFEEAGKAFQDLNEGKIVGRAVIEII

SEQ ID NO: 80247 - protein, 475 aa, Rhodobacter sphaeroides 2.4.1
MQAAEPSFRESVDLMFNRAVALMDLSPGLEEKIRVCNSTYTVRFGVRLRGKIFTFTGYRSVHSEHMEPVKGGIRYALSVSQDEVEALAALMTYKCALVETPFGGSKGGLCIDPREWDEHELEQITRRFAYELAKRDLIHPAQNVPAPDMGTGEREMAWIADQYARMNTADINARACVTGKPINAGGIHGRVEATGRGVQFALREFFRHAEDKARAGLSGDLDGKRIIVQGLGNVGYHAAKFLTEEDGAKVTGVIERDGALVNPAGIPVEELRHWMMKTGSIRGFSQADFVEDGRKLLEEECDILIPAAMEGVITRENAARIKAPLIIEAANGPITFGADEILRQKGTVIVPDLYANAGGVTVSYFEWVKNLSHIRFGRMQRRAEEARSRALVEELERLSADQGLGWQLAPDFKQKFMQGSDELALVRSGLDDTMRIAYQSMREVWHGAEGAQDLRVAAYIVAIRRVAATYRSKGL

SEQ ID NO: 80248 - protein, 140 aa, Populus trichocarpa
MDFVDAHDIKLFQFGIEGKTESSSTSIPNHTITGALKVLIDVRNHPVLIHCKRGKHRTGCLVGCFRKLQTWCLSSVFEEYQRFAGVKWRATDLRFIETFEVMCLRQCLYSIIYQYQGYGSNKRRLLYQEESIQKPKIKSI

SEQ ID NO: 80249 - protein, 478 aa, Prochlorococcus marinus subsp. marinus str. CCMP1375
MTQSSLIPVILCGGSGTRLWPLSRESYPKQFWDLTGDSNKTLLQQTHQRIQNIRGLQEPYLICNEKHRFIVAEQMREINVQPQAIFLEPVGRDTAPAVTIAALKAQEKGEDPLLLVLSSDHIIANNENFTKAIDEGRQAAESGKLVTFGIYPTAPETGYGYIEATENDNKSLIALPIKRFVEKPDLKTAEQFLKDSRFTWNSGMFLFKASVILQEIERFSPEILSHCKKALKDNSKDLDFLRLNVQAFHKCPSLSIDKAVMEKTNLGAVLQLNAGWNDIGSWQSLWETSTKDKNGNVLKGKVILEDSKNCYLRSEKRLVVGLGVKDLIVVETDDAVLVADRQQSQKVKSIVATLKNNKSAEAKAHTKIYRPWGHYTSIVQGKRWQVKKIEVKSGASLSLQMHHHRSEHWVVVKGTALVERDGEKQLLEENQSTYIPLGCKHRLTNPGKIPLELIEVQSGAYIGEDDIVRIDDNYGRKN

SEQ ID NO: 80250 - protein, 196 aa, Yarrowia lipolytica CLIB122
MVATVQHPAPDFKKTAVSGGVFEEVSLDQFKGKWVVLAFIPLAFTFVCPTEIIAYSDAVSQFKERGAEVLFASTDSEYSLLAWTNVARKDGGLGPVNIPLLADTNHTLSKDYGVLIPEAGVALRGIFIIDPKGVVRQITINDLPVGRSVEETLRLIDAFQFTEKHGEVCPANWQKGSDTIKADPVNAKEYFEKANK

SEQ ID NO: 80251 - protein, 457 aa, Salmonella typhimurium LT2
MMDSQQHGEQLKRGLKNRHIQLIALGGAIGTGLFLGSASVIQSAGPGIILGYAIAGFIAFLIMRQLGEMVVEEPVAGSFSHFAYKYWGGFAGFASGWNYWVLYVLVAMAELTAVGKYIQFWYPEIPTWASAAAFFVIINAINLTNVKVFGEMEFWFAIIKVIAVIAMILFGAWLLFSDTAGPQATVRNLWEQGGFLPHGWTGLVMMMAIIMFSFGGLELVGITAAEADNPEQSIPKATNQVIYRILIFYIGSLAVLLSLLPWTRVTADTSPFVLIFHELGDTFVANALNIVVLTAALSVYNSCVYCNSRMLFGLAQQGNAPKALLNVDKRGVPVSSILVSAVVTALCVLLNYLAPESAFGLLMALVVSALVINWAMISLAHMMFRRAKQQQGVKTRFPALFYPFGNVLCLLFMAAVLIIMLMTPGMAISVWLIPVWLLILGVGYLCKEKTAKTVKAH

SEQ ID NO: 80252 - protein, 369 aa, Helicobacter pylori 26695
MELSYYEILEVEKHSNQETIKKSYRKLALKYHPDRNAGDKEAEEKFKLINEAYGVLSDEKKRALYDRYGKKGLNQAGASQGDFSDFFEDLGSFFEDAFGFGARGSKRQKSSIAPDYLQTLELSFKEAVFGCKKTIKVQYQSVCESCDGTGAKDKALETCKQCNGQGQVFMRQGFMSFAQTCGACQGKGKIVKTPCQACKGKTYILKDEEIDAIIPEGIDDQNRMVLKNKGNEYEKGKRGDLYLEAQVKEDEHFKREGCDLFIKAPVFFTTIALGHTIKVPSLKGDELELKIPRNARDKQTFAFRNEGVKHPESSYRGSLIVELQVIYPKSLNKEQQELLEKLHASFGYEGEPHKSVLETCISKIKDWFK

SEQ ID NO: 80253 - protein, 629 aa, Salmonella typhimurium LT2
MAIEIKVPDIGTDEVEITEILVKVGDKVEAEQSLITVEGDKASMEVPSPQAGVVKEIKVSVGDKTETGALIMIFDSAEGAADAAPAKAEEKKEAAPAAAPAAAAAKDVHVPDIGSDEVEVTEVMVKVGDTVEAEQSLITVEGDKASMEVPAPFAGTVKEIKVNTGDKVSTGSLIMVFEVAGEAGAAAPAKAEAAPAAAAPAAATGVKDVNVPDIGGDEVEVTEVMVKVGDKVTAEQSLITVEGDKASMEVPAPFAGTVKEIKISTGDKVKTGSLIMVFEVEGAAPAAAPAKQEAAAPAPAAKAEKPAAPAAKAEGKSEFAENDAYVHATPLIRRLAREFGVNLAKVKGTGRKGRILREDVQAYVKDAIKRAERAPAAAGGGIPGMLPWPKVDFSKFGEVEEVELGRIQKISGANLSRNWVMIPHVTHFDKTDITDLEAFRKQQNAEAEKRKLDVKYTPVVFIMKAVAAALEQMPRFNSSLSEDGQRLTLKKYINIGVAVDTPNGLVVPVFKDVNKKSVTELSRELTTISKKARDGKLTAGEMQGGCFTISSIGGLGTTHFAPIVNAPEVAILGVSKSAMEPVWNGKEFVPRLMMPISLSFDHRVIDGADGARFITIINNMLSDIRRLVM

SEQ ID NO: 80254 - protein, 80 aa, Prochlorococcus marinus subsp. marinus str. CCMP1375
MSQEAILEKVRSIVAEQLSVEASEIKPDSNFQNDLGADSLDTVELVMALEEAFDIEIPDEAAEGITTVGDAVKYIEDKQS

SEQ ID NO: 80255 - protein, 474 aa, Salmonella typhimurium LT2
MSTEIKTQVVVLGAGPAGYSAAFRCADLGLETVIVERYNTLGGVCLNVGCIPSKALLHVAKVIEEAKALAEHGIVFGEPKTDIDKIRTWKEKVITQLTGGLAGMAKGRKVKVVNGLGKFTGANTLEVEGENGKTVINFDNAIIAAGSRPIQLPFIPHEDPRVWDSTDALELKEVPKRMLVMGGGIIGLEMGTVYHALGSEIDVVEMFDQVIPAADKDIVKVFTKRISKKFNLMLETKVTAVEAKEDGIYVSMEGKKAPAEAQRYDAVLVAIGRVPNGKNLDAGKAGVEVDDRGFIRVDKQLRTNVPHIFAIGDIVGQPMLAHKGVHEGHVAAEVIAGKKHYFDPKVIPSIAYTEPEVAWVGLTEKEAKEKGISYETATFPWAASGRAIASDCADGMTKLIFDKESHRVIGGAIVGTNGGELLGEIGLAIEMGCDAEDIALTIHAHPTLHESVGLAAEVFEGSITDLPNPKAKKK

SEQ ID NO: 80256 - protein, 364 aa, Oryza sativa
  misc_feature (102)..(102): Xaa can be any naturally occurring amino acid
MSTVLRTASCELMNPRSNMSTMEEHLLPVVHRDQVYSSRQDRRKSSDVPNRFVTSFHPSTNSKGNPNTPNHPLHTSGNGNIVTAQNFQRVHSSPSMFTSIKXTPCADEFNEQSHAAQHVPSFARQAIVSVILYISIGVLVYITNVEGFKGRSTLKLVDGLYFTIISLCTIGYGDIVPCTTFTKVFTCLFLLIGVRFVDIVLNELLTNVLDKQRTVLLSTMDDNKLNRVFDTYMIDAEKKRSRGRMKVLLALGVVVGTISICTIIVHEVEGLNWIDSFYLSVISVTTVGYGDYGFSTPAGRLSATVCLLVSTLAVAKAFLFLTDLRMDRRNRKTTKWILQKKMDNEPLAADLDHDASVRYCTNFP

SEQ ID NO: 80257 - protein, 372 aa, Streptococcus mutans UA159
MNTIKTRAAVAWAPNEPLKIEELDLMMPQKGEVMVHITATGVCHTDAYTLSGKDAEGVFPCVLGHEGAGIVEAVGEGVTEFQVGDHVIPLYTAECGKCEFCLSGKTNLCSAVRETQGRGVMPDGTVRFFKDGQPIYHYMGTSTFAEHTVVSEYSLVKIQDNAPLEEVCLLGCGVTTGMGAVLNTAKVEEGATVAIFGLGGIGLAAIIGARMAKASRIIAIDINPDKFDKARKLGATDLVNPNNHAKPIQEVIIDITNGGVDYSFECIGNVEVMRAALECCHKGWGESTIIGVAPAGAEIHTRPFQLVTGRVWRGSAFGGVKGKTQLPGIVGQYMAGEFALSDFITHTMPLEQINDAFDLMHEGKSIRTVIHY

SEQ ID NO: 80258 - protein, 530 aa, Yarrowia lipolytica CLIB122
MNFPRNKMTGLRDENTSASMRLPRAKTAEPSDMDISIGENGALNARPALNDLSNVGLSGNVFKHTAASQARRALTSKTTNGAATNKPAVKPTFSAAVAGLSRTRQPYSNNPNTQQPSNITRASSTTTNPYTRPQRASLQTKSVSADFSIPVFQSKTGPLDVPPMTRKRPSQGAKDMEMPRLAARGGKHHQTMETFAYREEGPLAKKHKQEEDKTAVALEAEQEEVIRRPLIQVLAPGATGIDVEHDDLDAEDIDDPMAAGEYVDEIFTHLYNLEEEYQPNPRYIDDQKSLSWNTRAVLIDWLVEVHQKFRLLPETLFLAVNIVDRFMSRRVVALNKVQLVGITSLLLATKYEEVFTPALSNFVYVVDGSYPEDEILRAERFILQVLQFNLSYPNPMNFLRRISKADDFDIHSRTFGKYLCEIALVDHTFMEFKHSLVAAAAMHVGRMMLARSQWTNNLVYYSGGYTQKDIAPVCRKIFQFLIGPVEHEAFFKKYATKKFLKASIIAREWALGVQEQIKNGVNSYETNLFI

SEQ ID NO: 80259 - protein, 203 aa, Arabidopsis thaliana
MPTLYKKAGCLGIREFMDSSTSTKKNTKLFVRNQTCFKKSSLSSSNAKKTTNLSMREQTMFKKALELSTLCDIEVCVIYYGRDGKLIKTWPEDQSKVRDMAERFSRLHERERCKKRTNLSLFLRKQILHDKKLSEKVLEMEDSLESGLRVLQDKLLLLQPEKNQTELGQSCAVYSTTYPLSSPSLIEDHQHQQQWTEPLSNTE

SEQ ID NO: 80260 - protein, 69 aa, Glycine max
MVADHYSPSLFSVAPMMDWTDYHYRTLARLISKHAWLYTDMLAAETIVYQKGNLDRILAYSLDHHPIVP

SEQ ID NO: 80261 - protein, 229 aa, Cytophaga hutchinsonii ATCC 33406
MINQNEFRKFAVKDQGISSLAVDSYINQIQSIAPNYIVGMTPNVVEERQMRATVIDVFSRLMGDRIIFLGTGIDDYVANVVNAQLLFLESVDPKKDIMMYINSPGGSVYAGLGIYDTMHYINPDVSTTCVGLAASMGAVLLCGGAAKKRSALPHSRIMIHQPLGGAQGQASDIEITAREILKLKGELYEILAKHSGKDIETIEKHSDRDYWLKAAEAKEYGIIDEVLVK

SEQ ID NO: 80262 - protein, 602 aa, Campylobacter coli RM2228
MEKKKIPMLILCVLIALAFWIIPTPIGLEENSWHFLGLFIAVIMAVILQVMPLGAVCMIAIAIVALSGITTTQSSVRATHIKTLEAIVLKDNSNIYKVTMEQKSQASILENLIKANVAKNLEPKVNEILKSNSNIEYQIDSLNKLYAKATSKVAAQKLIDESKIAALNSLALEFMSQKDIDEKVNTAISSLKSKTGIKDALSGFSNSLIWLIVVSIIVARGVIKTGLGERLAYYFISIFGKKTLGIAYSIAFCETILAPVTPSNTARAGAIINPIVQAISRSFKSTPEDGTQNKIGTYLSLVNFQANPISSAMFITATAPNPLVVDLVAQATNLEVHLTWGQWALGMFLPGIAAMLLMPLVIYFLSPPEIKSTPNAKIFAKGKLEELGAMKGSEKIMLGVFVLLLLLWAGALGFLFGISLDATSVALLGLSLVLVSGVLTFGEVLAEKAAWNTLVWFSALVMMATLLGKLGVTQFLAEALGEFASAMGLGEISIMIFLSLAFLYTHYFFASTTAHISAMFFVFYSAGLALGAPPLLYAFIMIASGNVMMALTHYATGTAPVIFGTGYVSLKKWWSVGFVISVIDITVMILVGLVWWKFLGFY

SEQ ID NO: 80263 - protein, 507 aa, Synechococcus sp. WH 5701
MTVTLTNPLRVGLRQERVVSPQCLVIFGASGDLTHRKLVPALFELFRQRRLPTEFAVLGCARRPWSDEDFRGHMAEGLGDLVNEHRGAWEQFASSLFYEPVDLQQPEHLVRLAQRLEVIDCQRATRSNRTFYLSVSPKFYGSGCSALAAAGLLNDPERSRVVIEKPFGRDYGSAQELNRIVQASAKESQVFRIDHYLGKETVQNILVLRFANTIFEPIWNRNYIASVEITAAETVGVEERAGYYESSGALRDMVQNHLTQMLALTTMEAPGHFDPEAIRNEKAKVLQSARLADELEPWNCCVRGQYGPGGTASSPLAGYRQEPGVNPNSTTETYVAMKLFIDNWRWQGVPFYLRTGKRLPKRMSEVVLTFREAPVHLFDAAGGSPTANQLILRIQPDEGAGFRFEVKSPGSGMRSRPVDMHFSYDESFGEPSDEGYVRLLADAMLGDPTLFTRGDEVEAAWRLYTPLLELIEDSPWQLPVHPYEARTWGPAAADNLLGRDGLMWRRP

SEQ ID NO: 80264 - protein, 538 aa, Vibrio parahaemolyticus RIMD 2210633
MASNQIEGAVVGIRVNDGIAAAPVVLFTHEMPAVPERDFQSEQGEIERVKRAIGVVVQHLQEQAKQPKGEIFSAHSMMLSDPELWASVESRIQTGMIAEQAWIESLQTLADEFRQAESQYMREREADVHDIARQVMVEMTGVTPNAIDIQEPSILLARDLMPSDVAGLDKSKVLGICLSEGGKTSHSAILARAMGIPAMVKAQGCLDAVRAGQVVTIDGFRGHLWFSPSDAIQQELEAQQIEWQSTRQSALASAQQAAATCDGVHIPVFANIGGPKDIDDALTSGAEGVGLFRTEFLFQNSDELPTEEAQYQVYRDIAAALGDKPLTIRSLDVGGDKPLAAYPMPAEDNPFLGLRGVRLCLQHESLFTAQLRAILRAFHEQPNIQLMIPMVAQVEEVRKVKALLAHQANQLGLDATHLPVGIMIEVPAAVLNADALAQEVDFFSIGTNDLTQYVMAADRGNAAVAELVNYFEPSVLKAIELTCAAGDRAGIPVSMCGEMAGDPNATETLLRVGLQKFSASPSLLPGLKAQIRQLSVDV

SEQ ID NO: 80265 - protein, 209 aa, Kluyveromyces lactis NRRL Y-1140
MLHRIVINIAGGHYAGALQTTKEIESKLLGIFKHDVRVIDLDERAIAPRQYSDKDYDFESIIHEIKNVSSKGDLVIILVCGCYSLFDSKLCDLSSLKVFVDSDGDKRLINLIQQKHVITGDDLESCISYYMDHLRPEMINYIDPSKTKADIIIPSANDALGTAIIVDGIVKVVEQYQGGGSNDTKKLFPQLDFNLERMELQKERYYELS

SEQ ID NO: 80266 - protein, 375 aa, Rubrobacter xylanophilus DSM 9941
MPAGKRDYYEVLGLSRDASEQDIKRAYRRLARKYHPDANPNDPEAEERFKELNEAYEVLSNPEARRAYDTYGHQVPSGASGRPGGDPFGGFQDIFEAFFGDRFGDPFFDLGRRRQPSRGGDTEAEVEISLEEAAFGTEREVQVQTIRNCPACDGAGGTETRLCGACGGSGVVRTVRETLLGQVMHQQTCSACGGSGRVVVDRCRECRGSGRVSEVVGRRIRIPAGIEDGMRLRVPGWGHAGEPGASSGDLYVKIRVKEHPELMRDGEDLIHRASVTFVQAALGTEVEVPTLEGTETVRIEPGTQPGTTLVLRGEGMPRMRGVGRGDLKVVVDVMVPTRLTGEQRKLLERFEAASGEETYNGRSGSFFDRLRGVFR

SEQ ID NO: 80267 - protein, 534 aa, Crocosphaera watsonii WH 8501
MCNDLPSPHKVLGKLETIEGAKKKPMVTLLENPFRVGLRQERTPEPLILVIFGASGDLTQRKLVPALYKMKQERRLPPELTVVGVARRDWSHDYFREKMREGIEEFSDGIKNEELWNDFAEGLYYCSGNMDDTESYQKLKAFLEELDGKRGTRGNRVFYLSVSPQFFPPGIKQLGAAGMLSDPLKHRIVIEKPFGKDLSSAQVLNRVVQNVCKEEQVYRIDHYLGKETVQNLLVFRFANAIFEPLWNRQFVDHVQITVAETVGVEDRAGYYDTSGALRDMLQNHLMQLFCLTAMEPPNALNADSIRNEKVKVLQATHLFDVHNLEKSAIRGQYKAGWMKGKPVPGYLEEPGVGENSSTPTYVAMKLMVDNWRWKGVPFYLRTGKRLPKKVTEISIQFKDVPLLIFQSAAHQTNPNVLSMRIQPNEGIALKFEAKMPGSELRTRSVEMDFSYGSSFGMASADAYHRLLLDAMLGDQTLFTRADEVEEAWRVVTPVLSAWNGPAEPYSVPQYEAGTWEPTEAEFLMNRDGRRWRRL

SEQ ID NO: 80268 - protein, 274 aa, Vitis vinifera
MEKLMTHILLCSFFIVLVLHACPAISQEVEDEKEFDYEKGSDKGPDKWGEIHEEWSTCKHGNMQSPIDLLHERVQVVSHLGRLQRSYKPSQATLKNRGHDMKLSWEGDAGSIQINGTKYELKQCHWHSPSEHTVNGKRFDLELHMLHETPSGKTSVVGIMYKIGRADSFLSTLTDHLEALSDSSDQERDVGVVDPRHIKIGSRKYYRYMGSLTTPPCTEDVIWTIVNKVRTVTREQVNLLRVAVHDDSGSNARPIQPINRRSVHFYRPRVEDKN

SEQ ID NO: 80269 - protein, 307 aa, Zea mays
RPTRPRETPEGRKAVQALKDVYAHWVPEDRILTTNLWSAELSKLAANAFLAQRISSVNAISALCEATGANVSEVAYAVGKDTRIGPKFLNASVGFGGSCFQKDILNLVYICECNGLPEVANYWKQVIKINDYQKSRFVNRVVASMFNTVAGKKIAVLGFAFKKDTGDTRETPAIDVCKGLLGDKAQISIYDPQVTEDQIQRDLAMNKFDWDHPMHLQPTSPTAIKQVSCVWDAYEATKGAHGVCILTEWDEFKTLDYQKIFDNMQKPAFVFDGRNIVDPEKLREIGFIVYSIGKPLDAWLKDMPAVA

SEQ ID NO: 80270 - protein, 365 aa, Ashbya gossypii ATCC 10895
MRKRRERIARMKHCSILSLVPLLAGVLCSIGDRLGEFVECNRVCRVRRGCEQHGGEGAFPDDSPFAAYTFVDTPAAYRALLWDCSADCDYQCQQAITHQRLLAGEPPVQFHGKWPFVRMLGMQEFFASLFSVANFVPHLQATASCGASWLGRLVWAAPACWLRKYQSLAVVGMLAWISSAVFHARDMPLTEKLDYFFAGATVLAGFHALYIRVRRLDLAQTRRRCFSLAVLLVFVLHIVRLYRNWNYTYNMRFNICFGLLQYLLLLLQALQNFGSLRRQRQKAGLGLYAQQPGMQFQLVLVPVLLVLYTGLAMSSELFDFFSYHWQIDSHALWHFLTVAPSFMLYDFFLKDYRYLNTLSSHSAPE

SEQ ID NO: 80271 - protein, 287 aa, Methanococcus maripaludis S2
MIIIPGLNSQNLAKEVAKLTNSELARVESKQFPDGEIYVRVHNELKGKDAVIIQTQNTQNDSIVEAILMCEALRDEGVKSITLVAPYLAYARQDKKFNAGEPISIKALAKVYSNICDRIITINPHETHIKEFFDIPFIYGDAIPKLAEHAGVKLVKPLVLSPDKGAVALAKRAAEELNCECDYLEKTRISPTEIKIAPKNLDVSGKDVLIVDDIISTGGTMATAISMLIEQGARTVIAACVHPVLIGDALNKLHLGGASEIVGTNTYPSEVSKVCVSTIIADILNGE

SEQ ID NO: 80272 - protein, 372 aa, Camellia sinensis
MKRMSPYPEQDSHLQNPMFVFDGLYCEEEHFEDDLGEYGLEQGSDNCDENVKGPLVFLEHDWDWDDDELVSLISKEKETHLGLSVLNSDESLMVARRESVDWILRVIAHYGFTVLTTVLAVNYFDRFISSLSFQREKPWMSQLVAVACLSLAAKVEETQVPLLLDFQVEESKFVFEAKTIQRMELLVLSTLQWKMNPVTPLSFVDHIVRRFGFKTNLHLEFLWRCERLLLSAITDSRFGCYLPSVLAAATMLHVIKEVEPSNVLDCQNELMDVLKMSKDKVDDCYKLILELPGNNSQMQCQTHKRKYQSIPNSPNGVIDVNFSCDSSNDSWAVTSSVSSSPEPLFKKSRVHGQQMRLAPLRHMSVGVVGSPR

SEQ ID NO: 80273 - protein, 1151 aa, Vitis vinifera
  misc_feature (134)..(134): Xaa can be any naturally occurring amino acid
  misc_feature (146)..(146): Xaa can be any naturally occurring amino acid
  misc_feature (1149)..(1149): Xaa can be any naturally occurring amino acid
  misc_feature (1151)..(1151): Xaa can be any naturally occurring amino acid
MGQSHSSSSAGAAPAPPAIPMGPVVPTSLLAPAMSSAPGMYLRESNSSLRSTARSPLYISMPETDDCVESSEVDGPDYTSDLPDDILACIFQFLSTGDRKRCSLVCQRWLLVEGRSRHRLSLNAQSEIIPLIPXIFFRFDSVSKLXLKCDRRSISISDDALILISNLSKNLTRLKLRGCRELTDVGMAALAKNCKGLKKLSCGSCTFGTKGINAVLDHCSALEELSVKRLRGMNDRGVAEPIGPGVAASSLKSLCLKELYNGQCFERLVVASKKLRTLKLFGCFGDWDRFLETVTDGNSNLVEIHLERLQVTDMGLSAISKCLNLEILHILRTPECTNLGLVSVAGNCKLLRKLHIDGWRTNRIGDEGLIAVAKQCTNLQELVLIGVNPTSSSITAVASNCQKLERLALCGSQTIGDKEISSIAAKCTALRKLCIKGCPISDHGMEALAWGCPNLVKVKVKKCPGVTCEAVDSLRARREALIVNLDAVAVETLDASTSDGGAQEDGQEPPPMVSQVTVVDGPSGSNGLSALFKSKFGHFAGRNLVACAFGRWSNSREPIPDPGVGVCLALSVWPRNPMGHNEDVVSAWGGICDVPHRIGEEVPGAIYVEAPLNQVLVEMVKLAQKRGLEGSKGSWKDFLSTYDRKLGPSLSDPSRRPVDTLFFAKILQCYANRKVVEEFKTKSHGKESPEQRLIRLTLEHPQYPLDYSFPSHEEGWMVTKIRQKFKFTRSNAMLAVDCEMVLCEDGTEGLVRVCVVDRNLQVKLNELVKPHKAVVDYRTEITGVSAKDFDETTSSLVDIQSILGYEVRQKDAPHNCLDDASAAMKLVLAKLEQGLDDAIPFVHEDVPENEMAKLLLHRIPTDVPIEELNRIIPGEFTMEHQSESPSLREVLLLPFNQPSLKISSLPHSYSLLIYEELSKRIRIWSANKRCDTSIPSPPLPSILKSPSLALFTILMSASIAKKPRKKVRGEYYSALAIFRNSQEAYEAFENIRGTQGKDSSGRSQKSVSFQLGTGATASLYVRKMAHNDSLGQVSSRKRSPQVEEISGDSKKLKTEEKTGDKEMMVDTNQCEDHMKEIERTCGWNYLEKVWLGRTANWLIDKIWVDEYAAESGRKWRRYRRHLFVVLGLREEFQVLALLRSLLQPPRCNXHX

SEQ ID NO: 80274 - protein, 303 aa, Guillardia theta
MDNYKRIEILGQGAYGKVYKAQDLRNGNLVALKKALSSSDEEGIPPTTLREISILKSVSECEFIVKLLDVVNTKSKNGKISIYIVFQYLDSDLKSYMISNYGKGRGMDENSAKKFCFQLLIGMYHCHKLGIIHRDLKPQNILIEKGEKLKIADFGLSRNFSIPVGKYTHEVVTLWYRAPEILLGARTYSSPVDIWSIGCIFAEMLTGNPLFCGESEIEQLLSIFKTIGTPTSQTWPEVLNFKDWHEFPIWPQINLKYSFENISEETLEFIQVFLRLNPNKRISILGAITNTYFEHFFKDYNLY

SEQ ID NO: 80275 - protein, 286 aa, Triticum aestivum
  misc_feature (107)..(108): Xaa can be any naturally occurring amino acid
VLYDVDLATRSRQISFCLDSIKPMNLRGHVDSMVKEVEDYFTKWEQHGVVDIKHEMGNLILLIANRCLLGKQFRENMFEEVSTLAHDIFDNGFHLISLFFPYLPIPXXHRRDKARAKLGEMIHEVVRSRRSSGQAENDVLQKFVDSKYINGRSMTENEIAGLLICMMFAAQHTSSATSTWTGACLLSHGESYLAAAIEEQKRIMERHGEHIDYTILQEMGTLHCCIKEALRLHSPAILLIRHASKSFSVRTREGYKIDIPQGHTLATCTSTPLMVVRVSMPTLLTL

SEQ ID NO: 80276 - protein, 455 aa, Streptococcus mutans UA159
MAVEIIMPKLGVDMQEGEIIEWKKQEGDEVKEGEILLEIMSDKTNMEIEAEDSGVLLKIVKGNGQVVPVTEVIGYIGQAGEVLEIADVPASTVPKENSAAPAEKTKAMSSPTVAAAPQGKIRATPAARKAARDLGVNLNQVSGTGAKGRVHKEDVESFKAAQPKATPLARKIAIDKGIDLASVSGTGFGGKIIKEDILNLFEAAQPVNDVSDPAKEAAALPEGVEVIKMSAMRKAVAKSMVNSYLTAPTFTLNYDIDMTEMIALRKKLIDPIMEKTGFKVSFTDLIGLAVVKTLMKPEHRYLNASLINDATEIELHQFVNLGIAVGLDEGLLVPVVHGADKMSLSDFVIASKDVIKKAQTGKLKATEMSGSTFSITNLGMFGTKTFNPIINQPNSAILGVGATIQTPTVVDGEIKIRPIMALCLTIDHRLVDGMNGAKFMVDLKKLMENPFTLLI

SEQ ID NO: 80277 - protein, 85 aa, Triticum aestivum
HFIIVMHQVKLMHQAGYELGNLDATLILQKPKISPFKETIRSNLCELLGADPSVVNLKAKTHEKVDSLGENRSIAAHTVVLLMRK

SEQ ID NO: 80278 - protein, 581 aa, Streptococcus mutans UA159
MAVEIIMPKLGVDMQEGEIIEWKKQEGDEVKEGDILLEIMSDKTNMEIEAEDSGVLLKIVKGNGQVVPVTEVIGYIGSAGETIETNAAPAASADDLKAAGLEVPDTLGESAAPAAQKTPLADDEYDMIVVGGGPAGYYAAIRGAQLGGKVAIVEKSEFGGTCLNKGCIPTKTYLKNAEILDGIKIAAGRGINFASTNYTIDMDKTVAFKDTVVKTLTSGVQGLLKANKVTIFNGLGQVNPDKTVTVGSETIKGHNIILATGSKVSRINIPGIDSPLVLTSDDILDLREIPKSLAVMGGGVVGIELGLVYASYGTEVTVIEMADRIIPAMDKEVSLELQKILSKKGMNIKTSVGVAEIVEANNQLTLKLNDGSEVVAEKALLSIGRVPQLSGLENLNLELERGRIKVDDYQETSISGIYAPGDVNGRKMLAHAAYRMGEVAAENAIWGNVRKANLKYTPAAVYTHPEVAMCGITEEQARQEYGNVLVGKSSFSGNGRAIASNEAQGFVKVVADAKYHEILGVHIIGPAAAEMINEASTIMENELTVDELLRSIHGHPTFSEVMYEAFADVLGEAIHNPPKRR

SEQ ID NO: 80279 - protein, 402 aa, Helicobacter pylori 26695
MLAKMSFMQNVKNIQEVEVSHKRVLIRVDFNVPLDENLNITDDTRIRESLPTIQYCIDNKAKDIILVSHLGRPKGVEEKLSLKPFLKRLERLLNHEVVFSQNIVQLKQALNENAPTRIFLLENIRFLRGEEENDENLAKDLASLCDVFVNDAFGTSHRKHASTYGTAKFAPIKVSGFLLKKEIDSFYQAFNHPLRPLLLIVGGAKVSSKLTLLKNILDLIDKLIIAGAMSNTFLKALGYDVQDSSVEDALINDALELLQSAKEKKVKVYLPIDAVTTDDILNPKHIKISPVQDIEPKHKIADIGPASLKLFSEVIESAPTILWNGPLGVHEKQEFARGTTFLAHKIADTYAFSLIGGGDTIDAINRAGEKDNMSFISTGGGASLELLEGKILPCFEVLDKRH

SEQ ID NO: 80280 - protein, 330 aa, Helicobacter pylori 26695
MPIRIAINGTGRIGLCAIRVASQRKDIEIVAINSTAELETLLHLIRHDSVHGHFEAQLNADRTLNIGHSKNILVLSERDINKLDFSAANAEIIIECTGKFNSLEASSAHLKNSVKKVIISAPAQNTPTFVYGVNHKNYHNESVISNASCTTNASAPLLKILDEAFKVENALLTTIHSYTNDQNLLDTKHKDIRRARAAGLNLIPTSTGVSKAISLVLPHLGPKVTGLAIRVPTPNVSLVDLSLNFKKSVSKASVQHALKDACKHAFKGVVSIDEERLVSSDFISSPFSAIVIDDQIMTIGEKNAKVLAWYDNEMGYSERLIDMAQYIAQN

SEQ ID NO: 80281 - protein, 193 aa, Escherichia coli
GIDTANMFEFWDWVGGRYSLWSAIGLSIVLSIGFDNFVELLSGAHAMDKHFSTTPAEKNLPVLLALVGIWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQEYRD

SEQ ID NO: 80282 - protein, 228 aa, Rhodobacter capsulatus
MTFDRSIKIAPSILSADFADFGREIQAIEAQGADWVHVDVMDGHFVPNLTFGPPAVAAFRKHVKTVMDVHLMISPVDAYIDAYAQAGADVLTAHVEAGPHIHRTLQAIRAAGMKSGVAINPGTPAEAIEHVLDIADVVCVMTVNPGFGGQKYIDMTAKVRKLRAMIGDRPVHIEIDGGMDPVTAPLMAAAGADVFVAGSGVFKGGSVSTPEVYGKNIAAIRAAAQAAL

SEQ ID NO: 80283 - protein, 602 aa, Oryza sativa
MADGGEMDEEAMRAFFPMSFGKAPTRAGAAASAHASTLRKPPQNPSAKPSTSSAAAAAAAGDDDDDDDDDDDEGPMVGPPRPPPQPAGGGEGEDDEEGGGVMIGPPRPPPRSSSRGEGEDADGGMIGPPRPPPVKDDDEEDEDDDDDDGDDSDDEMEDDGERYNRIPLSNEVVLRGHTKVVSALAVDHTGSRVLSGSYDYTVSQAKIYDRDGLTLGEFIKGDMYIRDLKNTKGHISGLTGGEWNPKSKETILTSSEDGSIRLWDVSDFKSQKQVIKPKLARPMRIPVTSCAWDHEGKRIVGGIGDGSIQLWTVKTGWGSRPDIHVEKTHTEDITGVKFSTDGQILLSRSMDSTLKIWDLRKMKTPLKVFEDLPNHYAETNVAFSPDEQLIFTGTSIEKDGENGGLLCFFDRRKLELVSRVGISPHYSVIRCLWHPRINQVFATVGDKKEGGTHILYDPSISQRGALVCVGRAPRKKSVDDFEVQPVIHNPHALPLFRDQPSRKRQREKILKDPLKSHKPEAPVNGPGFGGRVGTTKGSLLTQYLLKEGGLIKETWMDEDPREAILKYADAAEKDPKFIAPAYSQTQPKPVFAESDSEGEEKK

SEQ ID NO: 80284 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPL

SEQ ID NO: 80285 - protein, 468 aa, Bacillus pumilus SAFR-032
MFGGKDMSNMTNGLQKNLKTRHISMISIAGVIGAGLFVGSGAVIHSAGPGSILSYSFAGLLVIFIMRMLGEMACAYPTSGSFSQYASDAIGPWAGFTIGWLYWFFWVIVIAIEAIAGAAIIQYWYGDAPVWLTSLILTILLTLTNIFSVKSFGEFEYWFSLIKVVSIILFLLIGFAFIFGFGGHHTVGLANLTGNGGFLPNGFSSVLLGIVVVIFSFMGTEIVAIAAGESADPVKSVTTATRSVVWRIIVFYVGSIAVVVTLLPWNSASILTSPFVAVLEYIGVPSAAQVMNVIVLTAVLSCLNSGLYTTSRMLYSLAERGEAPKRFMKISKRGVPVAATVAGTFFSYIAVMMNYFYPETIFLFLVNASGAIALLVYLVIAVSQLRMRRKIEKENPEQLKIKMWLFPYLTYFTILVICAILISMLFIESMRPQLILTSIITFSVLAAYFIFKPNKKAPANATLENKHP

SEQ ID NO: 80286 - protein, 179 aa, Hyphomonas neptunium ATCC 15444
MDLSKISAGNNPPDDINVLIEVPLGGDAIKYEIDKASGAMFVDRFLYTEMRYPCNYGFVPHTLSLDGDPIDVMVVGNRPLVPGCVLRVRPVGVLMMTDDKGQDEKILAVPHPKLTGYYDKISTYHDLPQTLCDKIQHFFEHYKDLEKGKWTRIDGWHGIEKARELIRDAVAREQANLKG

SEQ ID NO: 80287 - protein, 263 aa, Hyphomonas neptunium ATCC 15444
MTKTPDELAAMAHSGRLLASVFGLIDQMQLIGMSTLEVNDRVERFIVDELKSRPASKGQYGFEYVLNSSVNDVVCHAIPSAREILKDGDIVNFDITLEKNGYIADSSKTYMLGNVATPARRLVRTTYEAMWKGIRAVRPGATLGDIGHAIERHAKQAGYSIVREFCGHGIGREMHEEPSVLHFGRRGTGLPLRPGMTFTIEPMLNEGRRGVYTEEDDWTVRTEDGKLSAQFEHTIAVTERGVDVLTLRPEEAHLVKEATRRAG

SEQ ID NO: 80288 - protein, 398 aa, Synechococcus sp. WH 7805
MVSGLPMTHSLPQVESRHRRSVGPINTPDRLLLGPGPSNAHPTVLSALARTPIGHLDPLYVDLMGEVQELLRYAWQTDNRLTLPMSGTGSAAMEATLANTVEPGDRVLVAVKGYFGNRLADMAGRYRADVRVIEKPWGEAFTLDELAAALEHHKPAILAMVHAETSTGVCQPMDGVGDLCRQHDCLLLLDTVTSLGGVPLYLDEWKVDMAYSCSQKGLSCPPGLGPFTMGTRAEAKLAARKDKVPNWYLDVSLLNQYWGSDRVYHHTAPVNMNFGMREALRLLAEEGLENAWSRHRRNAEALWNGLQSLGLEMHVPEELRLPTLSTVKIPDDVDGKAFSSHLLNTHGIEVGGGLGVLAGKIWRIGLMGYNSTPENVDRLLNLFESELPRFREGSCVAA

SEQ ID NO: 80289 - protein, 354 aa, Staphylococcus aureus subsp. aureus Mu50
MLTVDQVKELVGEIKDPIIDVPLKETEGIVEVSIKEEKEHVSVKLAMAQLGGAPQLDLQMAVVNALKENGAKTVGIRFETLPEEKVNQFKPKEENKPKTIEGLLSQNNPVEFIAIASGKGGVGKSTVAVNLAVALAREGKKVGLVDADIYGFSVPDMMGIDEKPGIKGKEVIPVERHGVKVISMAFFVEENAPVIWRGPMLGKMLTNFFTEVKWGDIEYLILDLPPGTGDVALDVHTMLPSSKEIIVTTPHPTAAFVAARAGAMAKHTDHSILGVIENMSYFESKETGNKEYVFGKGGGTKLADELNTQLLGELPLEQPSWNPKDFAPSIYQSDDRLGKIYSSIAQKVIAATNK

SEQ ID NO: 80290 - protein, 406 aa, Zea mays
  misc_feature (192)..(192): Xaa can be any naturally occurring amino acid
  misc_feature (212)..(212): Xaa can be any naturally occurring amino acid
  misc_feature (231)..(231): Xaa can be any naturally occurring amino acid
  misc_feature (288)..(288): Xaa can be any naturally occurring amino acid
  misc_feature (306)..(306): Xaa can be any naturally occurring amino acid
  misc_feature (345)..(345): Xaa can be any naturally occurring amino acid
MSETESAAAAPVAAAESKPRRLRGHKKGAVTCCVASSARPGVVASSGEDGCLCWFDLRTKDVLLTMEAANKPISSICFKPGNEDFVYISAGNEILSFDVRMGTQTKPLETYNYNRDEINQIAVSSKGFLAAADDSGDVKIVNTIQKCLYKRLREAHTSICSSVQFIPWRPWTAITGGLDSKLAAWDFSKGRXWIDDGLPVFEHVVSLNTAGXSYDPASVHSPAGSEEGFCXGLYKVCAVARGDGAVNAIDLEYELAPGKSKGPPRAAILTTRSLGAELAYGSCNQSHXKTIHLEYTMGCHTLAVPXVPFSPFGEKGKFLISGGTDASPKLWDWSKGFYSETNSTXDLVLDIAAKKMANWLCTAPTDSDNLIVCDTSNGAKVHSLPVDGSRCSLSYVRQLSEGVKLV

SEQ ID NO: 80291 - protein, 449 aa, Haemophilus influenzae 86-028NP
MSKVASLDAFLTKVAQRDGYQPEFLQAVREVFTSIWPFLEANPKYRSEALLERLVEPERAFQFRVAWTDDKGQVQVNRAFRVQFNSAIGPFKGGMRFHPSVNLSILKFLGFEQIFKNALTTLPMGGAKGGSDFDPKGKSDAEVMRFCQALMAELYRHVGADTDVPAGDIGVGGREVGYLAGYMKKLSNQSACVFTGRGLSFGGSLIRPEATGYGLIYFAQAMLAEKGDSFAGKVVSVSGSGNVAQYAIEKALSLGAKVVTCSDSSGYVYDPNGFTTEKLAALLEIKNVKRGRVKDYAELFGLQYFEGKRPWEVQVDIALPCATQNELELSDAQRLIKNGVKLVAEGANMPTTIEATEALLAADVLFGPGKAANAGGVATSGLEMAQSSQRLYWTAEEVDAQLHRIMLDIHANCKKYGTIEGQENINYVVGANVAGFVKVADAMLAQGVY

SEQ ID NO: 80292 - protein, 589 aa, Candida albicans
MTRTTRIDTQEATKHKDLPPVPSPLSLSSNPNPECLMESKSLGRKNFKKLSLDASPVKSTSGSLRSSDMMSIKEPTSLRQKRTRPPPILHLPTASSSATSTPTSNITGSSSASSIQFAQKSPGSGVIVSQTLSRPSSAGGIPSSGYSSLNVNQSNRNVDPDNVVSTDMILNQISNLDLTSMNHHRQHYQNSHHHLPTTNRKRQTVISSISPTKSSAASSPLEPQIQSLPASSQSPIATTSSLKLNNKDLLTLKQLGSGNSGSVSKILHIPTQKTMAKKIIHIDSKSVIQTQIIRELRILHECHSPYIIEFYGACLNNNNTIVICMEYCNCGSLDKILPLCENKQFPTFVLKKLSFAILSGLTYLYTTHKIIHRDIKPNNVLMTHKGEFKLCDFGVSRELTNSLAMADTFVGTSMYMSPERIQGLDYGVKSDVWSTGLMLIELASGVPVWSEDDNNNDDDEDDEDDAYVRQGSIAAERNGQNSPSRSRKNKQKGNGYNSYNGPEGILDLLQRIVNEDAPTLTNKINPVTKLPYDKYLCQFIDLCLIKDDSVRKTPWQLLEDKEHFFKGVEEGVYDKEHKSWAKKIRKCKV

SEQ ID NO: 80293 - protein, 241 aa, Methanococcus maripaludis S2
MLVIPAVDMKNKKCVQLIQGNPDKKHVELDNPPEIAKKWVNEGAEMLHLVDLDGALDGKRVNDEFIEEIIKKSGVPVQIGGGIRSIEDAEYLVEKGAKKVIIGTIAVENPEIIKELSKRIGSEKIMVSLDAKDGKVVIKGWKEKTKYTPVQIGKILEEMGAGSILFTNVDSEGLLNGINIEPTKELVDNLKIPIVASGGVTTIDDLLKLKEIGVYGVVVGSAIYKNMINLKDAIEAVNKSN

SEQ ID NO: 80294 - protein, 415 aa, Vitis vinifera
MATNIGMMDSAYFVGRSEILSWINSTLQLNLSKVEEACSGAVHCQLMDSVHPGIVPMHKVNFDAKNEYEMIQNYKVLQDVFNKLKITKVIDLFILVEGFQHIEVSKLVKGRPLDNLEFMQWMKRYCDSVNGGLLNSYNPLERREASKGGKEASKKPSQPSAKSSTAAPKAQPSHNARKNDASSASTTNLSVKVSRPGSSGGPAYDEKITELKLSIDSLEKERDFYFAKLRDIEILCQCPEIEHLTVVGAIKRILYATDDNASVVAEAQAMVSSLHQEGAEPLSPISELPEEKPKPETQKRKIIMNHEVDVAAITTLSPRQRISDASDVHCTFTFSIKFHEFYHQVTQTTNEQGDLETRVDTVECRSSPGQVQETRRAEVVHQPHPGSATTGGVLVDAAAAVANTLQSAKDAVSQK

SEQ ID NO: 80295 - protein, 475 aa, Bacillus halodurans C-125
MFRGKLYIDGTWTGDLLDTFDVKNPATGEVVGVMPNGGKAEAAAAIEAAQRAFLKWRKYTAAERANFLMTWHDLLLQQKEEIAEMLTMEMGKPLAEARGEIEYSASFIRWFAEEGKRVYGRTVPASAENKRIHVQKQPVGVVAAITPWNFPAAMIVRKMAPALAAGCTFVGKPAELTPLTAVKIVELCEEAGFPKGVVNLVCGDAKEIGEEMTSHEHVRKLTFTGSTAVGKLLMKQSAGRMLNLSLELGGQAPMIICDDADLDKAVAGVVASKYRNAGQTCVCGNRIYVQETIVDEFVKRLTGKVVQLKVGNGLEEGVHIGPLIEKKGYEKVKAHVDDAVAKGARVVIGGKGQEGNDSYFYDPTILTDVHDEMLVMQEETFGPVAPIQTFATDEDVIEKANGTRYGLAAYFFTENYARGIRLSEALDFGIVGWNDGAPSIAQAPFGGMKESGLGREGGQEGIEAFLETKFVSIGL

SEQ ID NO: 80296 - protein, 302 aa, Methanococcus maripaludis S2
MDKIGKITAVGHIALDYIFNVDKFPELNTSMQIPTAKKYYGGAACNVAAEIANLGVKSEILSCVGTDFKASGYGEYLEKLGVSTKNVYVSEEEETPKAWIFTDPQNNQITYFLWGAAKHYPEIEVPEFDSEIVHLATGDPNYNLKCAQKASSKGIFVSFDPGQDLTLYSKENMENIIENVDFLFMNNHEFQRTLDLLNISEKELISRVKVLIVTYGKQGSIIYSEDEAIKVPAILTQAKDPTGAGDSYRAGFLTAYLKGHDLKNCGLAGSCVASFVVEQVGCQTNLPSWEMVIERLNENNLL

SEQ ID NO: 80297 - protein, 346 aa, Streptomyces cinnamonensis
MTTRPDTKTALSQKTALSQLLTEIEHRNPAQPEFHQAAREVLETLAPVIAARPEYAEAGLIERLCEPERQIVFRVPWQDDHGRVRVNRGFRVEFNSALGPYKGGLRFHPSVNLGVIKFLGFEQIFKNALTGLGIGGGKGGSDFDPRGRSDAEVMRFCQSFMTELYRHIGEHTDVPAGDIGVGGREIGYLFGQYRRITNRWEAGVLTGKGRNWGGSLIRPEATGYGNVLFAAAMLRERGETLEGRTAVVSGSGNVAIYTIQKLAALGANAVTCSDSSGYVVDEKGIDLDLLKQVKEVERARVDTYAQRRGASARFVPGRRVWEVPADIALPSATQNELDADDATALI

SEQ ID NO: 80298 - protein, 232 aa, Oryza sativa Japonica Group
MFGCANDYPRDDVKEIKCYVCNQKGHLCCADFSDICPKEVSCYNCAQPGHTGLGCAKQRREASTAATPTLCYKCGEEGHFARGCTKNTKSDRMNGESSAYSRKKGKGKKDFGTRSAPHDARKTSKRKSPLFEERRNSSHFKSKARGGWIADDADDQPYKKCKPNVWASPSTPKKQYNNHQFSSGGDYSTPQSSRWQKHGFASPSATYSPNTRKHSFSSSRFASNTHVRFGRS

SEQ ID NO: 80299 - protein, 625 aa, Staphylococcus aureus subsp. aureus COL
MEAYKIEHLNKSYADKTIFDNLDLSISEGEKIGLVGINGTGKSTLLKVIGGIDDDFTANVMHPNQYRIRYSSQKQDLNEDMTVFDAVLSSDTTTLRIIKQYEQAVQAYADDQSDKLFKRMMDAQDAMDQHDAWDYNAEIKTILSKLGIHDTTKYIKELSGGQQKRVVLAKTLIEQPDLLLLDEPTNHLDFESISWLINYVKQYPHTVLFVTHDRYFLNEVSTRIIELNRGKLASYPGNYESYIEMRAEREVTLQKQQQKQRALYKEELAWMRAGAKARTTKQQARINRFNDLENEVNQQYKDDKGELNLAYSRLGKQVFELEDLSKAINDKVLFEHLTEIIQKGERIGVVGPNGAGKTTLLNILSGEDQQFEGKLKTGQTVKVAYFKQTDETLDRDIRMIDYLREENEIAKEKDGTSVSITQLLERFLFPSATHGKKVYKLSGGEQKRLYLLRLLVHQPNVLLLDEPTNDLDTETLTILEDYIHTFGGTVITVSHDRYFLNKVAQSYWFIHDGQMEKIIGTFEDYESYKKSLDKNKSTLKQQSKSSTTVRKKNGLSYKEKLEYEQLMKRIEQAEVRMEEIDVLMIEASADYGKIKELNEEKEQLEIQYDLDITRWSELEEIKEQQ

SEQ ID NO: 80300 - protein, 377 aa, Oryza sativa
MSTQGKVIKCKAAVAWGAKQQLKIEEIEVDPPKAGEVRIKITATGVCHTDAYTLGGEDSEAVFPVILGHEGAGVVESVGEGVTSVAPGDHVIPLYTPQCKNCEYCRSPKTNLCVKIRATQGKGLMPDGTTRFSINGQRLYHYMGCSTFSEYTVVADISVAKINPAAPLDKIGLIGCGISTGYGAALVTAKVEKGSTVGVWGLGAVGLAVIMGAKAAGAKEIVGIDINPNKFKTAIEFGATQCVNPNDFPDKPFQQTLIEKFDGGFDYTFECIGNVNTMRCALEASHRGWGVSVIIGVAGAGKEIATRPFQLVTGRTWKGTAFGGWKSVDQVPELVEKYLTKELKVDEFITHTMPLAEINKAFDLMHSGESLRSMIQF

SEQ ID NO: 80301 - protein, 133 aa, Rubrobacter xylanophilus DSM 9941
MEQTLVLIKGDGVRRRLIGEIIRRLENKGLAIRDLKMMRVSRELAEEHYAEHREKPFFGELVEFITSAPVVAMRVEGEGAIGVVRNLMGATDPAKAAPGTIRGDLALSMPDNLVHGSDSPQSAARELRLFFGG

SEQ ID NO: 80302 - protein, 491 aa, Candida albicans
MVALKREAEPRENGKSKKAKTSLATSSFVLHSYSKLPNINEYAKAKSTPLDVFVWGTGSMCELGLGPSAKNKEVKRPRLNPYLTEEKLGGTKIVDFAVGGMHTLALDGKNRIWSWGGNDSGVLGRDTSQAKEVLKDIDGKNGNDDDDDDDDEDGDLNEAESTPALVENLPEGEIVQLAATDNLSAALLSNGDVYAWGCFRCNEGLLGFLRDEIKLQKTPLKIKELKNIVQLAAGKDHLLALDSKGIVYAWGNGQQYQLGRRILERHRYRSLEPQQFGLYNIKYIASGDFHCFAIDHSDNVYAWGLNQYGQCALTGDNGELEDGSVLMKPTLIPELSHKGIKEIAAGEHHTLALTEDGQVYAWGRYDMKEIGIPKDKLPKSTFKDQHGNPRSVPVPTKLEFAVKIKTIGVGSHHSFAVTEDGVVYAWGFAETYGPGLGPSIDDVEKPTRIVNTATKNEDILLIGAGGQFSVSGGVKSKTKRKQKLNLISMKI

SEQ ID NO: 80303 - protein, 341 aa, Actinomadura hibisca
MTEPEGPHAASLRLQSLLDGMRVAKVVQVLAELQVADAVADGPCKPAEIAADVGADPDALYRVLRCAASFGVFTEDEDGRFGLTPMAALLRTGTDDSHRDLFMMAAGDLWWRPYGELLETVRTGRPAAELAFGMPFYDYLGTDPAAAGLFDRAMTQVSKGQAKAILGRCSFERYARIADVGGGHGYFLAQVLRSSPRTEGVLLDLPHVVAGAPAVLEKHEVADRVQVVPGSFFDALPTGCDAYLLKAILINWPDADAERILHRVREAIGTDRDARLLVVEPVVPPGDVRDYSKATDIDMLAIIGGRQRTVAEWRRLLRAGGFELVGEPTPGRREVMECRPI

SEQ ID NO: 80304 - protein, 540 aa, Streptococcus mutans UA159
MYAHDILNDPFLNKGTAFTMEERKKFGLIGLLPPHIQTLKEQAEQTYAQMQTKANNLEKRLFLMEIFNTNRTLFYYLFSQHLEELNPIVYDPTIADTIEGYSDLFVDPQYAGYLDINHPENIEATLKNAAGDRDIRLIVVTDAEGILGIGDWGTNGVDISVGKLMVYTGAAGIDPVTVLPLVIDAGTNREELRNNPNYLGNRHERVRGERYYDFVDQFVQTAERLFPKLYLHWEDFGRSNAANILEKYRKEIPTFNDDIQGTGIVTLGGIFAAMDITGEKLTDQVYLCYGGGTAGAGIASRVLREMVSEGLPEDEAYKRFFMVDKQGLLFDDMDDLTPEQKPFAKKRADFPNADQLTDLLQVVKTVKPTILVGTSTNPGAFTKEVVEAMCENTERPVIFPISNPTKLAEASAQDLITWSDGKAFVATGIPADTVSYKGVDYVIGQANNALIYPGLGLGMLASEASLLTDEMIGAAAHSLSGIIDITKPGAPVLPPFKYVGDVSIKVAEAVAKKAQEQGLARAEETDMAKAVRDFKWYPEY

SEQ ID NO: 80305 - protein, 338 aa, Prochlorococcus marinus subsp. marinus str. CCMP1375
MKNPNVICFGEALVDRLGPLGGDPASDKPVDDCLGGAPANVASGLARLGINAAFVGCLGNDSIGNQFRELFMARGVNFAGLQIHESLLSRIVLVYRDLNGERSFGGFAGDQSNIFADQYLDLNVHKKIFPSLLDEAKWLLLGTIPLAVEHSREVVQWTIEQSLNNGLQIAFDLNWRPTFWDINMTPNNPPDTKTCSLITSFLEHASLIKLAKEEAEWFFNSKDPWEISNALPEKPSVIVTDGAQPINWVLGGFSGQTPALSPQKVVDTTGAGDAFMAGLMTQIISFSSQPKLFSEAEAMIQFSAGCGALVCGAPGAIEPQPSYSEVQSLLSSFLNDRS

SEQ ID NO: 80306 - protein, 110 aa, Vitis vinifera
MEANRGQNGIQQLLAVEQEAQHIVNAARNAKMARLKQAKEEAEKEIAEFRVRMEKEFQRKVAESSGDSGANVKRLELETDAKIQNLKVEAARISHDVVHMLLKHVNTVRT

SEQ ID NO: 80307 - protein, 548 aa, Oryza sativa Japonica Group
MASRDLAESLLPVGGGAATATATATAHDEYDERAYDSDDKVSIAVSDSDSEDGGGGGGDAMRPAFSWRKLWRFTGPGKYNDASRAICAGHYTCYLRKTTTPRVQRAQLPILTSLLSPDPSISSHSLAHLAVAALPPTMASRDLAESLLPVGGGAATATATATAHDEYDERAYDSDDKVSIAVSDSDSEDGGGGGGDAMPPALFVAQAVALLSARLGVATGKHLAELCREEYPPWATRALWAMTELALVGADIQEVIGSAIAIKILSAGTVPLWGGVVITAFDCFIFLFLENYGVRKLEAFFGVLIAVMAVSFAIMFGETKPSGKELLIGLVVPKLSSRTIKQAVGIVGCIIMPHNVFLHSALVQSRKIDTNKKSRVQEAVFYYNIESILALIVSFFINICVTTVFAKGFYGSEQADGIGLENAGQYLQQKYGTAFFPILYIWAIGLLASGQSSTITGTYAGQFVMGGFLNLRLKKWLRAMITRSFAIIPTMIVALFFDTEDPTMDILNEALNVLQSIQIPFALIPLITLVSKEQVMGSFVVGPITKVM

SEQ ID NO: 80308 - protein, 513 aa, Bacillus pumilus SAFR-032
MTNLVNEMILVLDFGSQYNQLITRRIREFGVYSELHPHTLTAEEIKEMAPKGIILSGGPNSVYDEGSFRCDEKIFDLDIPVLGICYGMQLMTHYLGGKVEAASQREYGKADIHINGTPALFKDLPTDQVVWMSHGDLVVEVPEGFTVDATSAHCPNSAMSLAEKNFYGVQFHPEVRHSEYGNDLLKNFVFGVCDCDGKWSMENFIEIEMQKIRETVGDKQVLCALSGGVDSSVVAVLIHKAIGDQLTCIFVDHGLLRKGEAEGVMKTFSEGFNMNVIKVDAKDRFLNKLKGVSDPEQKRKIIGNEFIYVFDDESDKLKGIDYLAQGTLYTDIIESGTATAQTIKSHHNVGGLPEDMQFELIEPLNTLFKDEVRALGSELGIPDDIVWRQPFPGPGLGIRVLGEISEEKLEIVRESDAILREEIANFGLERDIWQYFTVLPDIRSVGVMGDARTYDYTIGIRAVTSIDGMTSDWARIPWDVLEKISTRIVNEVKHVNRVVYDITSKPPATIEWE

SEQ ID NO: 80309 - protein, 196 aa, Methanococcoides burtonii DSM 6242
MKVLFINNRDSFVWNLVDYVSMYESDTVVVPNTISVEEVRDIKPDAIVISPGPGNPGNARDIGNCLYIIREFGVNVPILGVCLGHQSINTVYGGTIGHSPDGPVHGKASMISHDGSELFEGISGTFAAGRYHSLSIHELAKDVNVIAENDNGLIMGIKHRSYPVYGVQFHPESILTPEGLKLVGNFLKLAGMRTKD

SEQ ID NO: 80310 - protein, 203 aa, Rhizobium leguminosarum bv. viciae 3841
MREAMQLVPMVIEQSSRGERSFDIYSRLLRERIIFLNGEVNDTVSALVCAQLLFLEAENSKKPINLYINSPGGVVTSGLAMYDTMRFIRAPVHTLCMGTARSMGSFLLMAGEAGGRAALPNASILIHQPSGGFQGQASDMMIHAEEILKTKQRMTRLYAEHCGRSYEDFERGMDRDRFMTAEEALEWGLIDRILTVREGEIPD

SEQ ID NO: 80311 - protein, 904 aa, Oryza sativa Japonica Group
MPPKPERRLFQYVSKPRRPAREPAPAPEVCGGGGEEVVASDADADAVYRMVTAAPTPSAMESALSASGVAISAPLLDLVLRRFRFAHGDPLRALSLLSLALDRHGVAPSPFALDTALYVLGRARRFAHMWDLLRSSRRLVPDAVTPRTAMVVLGRVAKVCSVRETVDSFRRLSRMLRGRGDDQEGQLFNALLRTLCQEKSMSDARNVYHALKYEFKVNRQTFNILLSGWKSAEDAEAFVAEMRELGVEPDLVTYNSLIDCHCKNRGVENAYKLLDEMREKDISPDVITYTSLIGGLGLIGQPDKAKHLLKEMHELGCYPDVPAYNTAIRNFVIAKRLGDAFALMEEMASKGLMPNATTYNLFFRCYYWAYDIGSAWQLYERMRSEGCFPNTQSCMFIVRLCHRHGRVAQALELWSDMVNNGFGSFTLVSDVLFDLLCDEGKLDEAERCFHQMIELGQKPSNVAFRRIKILMQLANREESIARLTAQMAQFGREITEKESSVLRYVVQAEDEVGGQDGGRGGGCGGGGGGIPTAWRARPSPPLRPKPPPKVRVSRTQVKLRGSPDAGQASREPGAAGPSREPDVAGPSREPDAAGPSREPGAAGGSREPGAAGGSRQPVPDAAQLAVVPYVEDIDRYLRSLEAEQTRRPMINYVQEIQGGIINMDVRGILVDWMADVAYVFNLQEETLHHAVSYVDRFLSKIAFPGDKLKLLGTTALFVASKYEEIHPPHVRNFSAVTVNTYTTQQVSKMELDILRFLNFDVGSPTVITFLRKFLTSCCGGNNSSNRKLELMCNYLAELSLLDDYYIRFLPSIVAAACLFVGKFTLNPNTRPWFGSVSTITPPENIKGGVEKYMVSRIYMCVFDLPMLFLMETWSSSGVSNHTKLQLKQNMMELPIENPTFISAS

SEQ ID NO: 80312 - protein, 1182 aa, Magnaporthe grisea
MDDRIQDIYKKIEREKALINAANLMRQQTNNDAVRSKLDTQMREGRRNLEFFEGTLREMQMRSMGQGMDNLSIGGSTLAASASSSSRPRSAVEEDGPMPPPKDGGYGAGGDGYGQTQYSQIGEHGDLMPPRGPFANQGPGSHIPKTRPNFTKLDLIKYDTPYLGPRIQLMLSQIQFKLNVEEQYLKGIEKMVQLYQMEGDKKSRADAAARRVESKQKIVLLKQALRRYEELHIDIDSGDSPDDDSINMPNLRKPLTGQLSIRVIAIKDVDHAPTGRFARGPDTFVAIKVEDNIAARTRVSRTDRWENEYHNVEVDKANEIELTVYDKPGEHSIPIGMLWVRISDIAEELRRKKIEAETNSLGWVSADRMGDVNPAARVPPPQFPMNTQQRQPGGPVSPGIQGQQQGYGQPGDPQQPGQQGQMGQVQEPITGWFNLELTGSIQLSLNFFKQSKDRRPVDLGLGRKGAIRQRKEEVHEMYGHKFVERQFYNIMRCALCGDFLKGGSGMQCEDCKYTCHIKCYTSVVTKCISKSNAETDPDEEKINHRIPHRFVAFSNLTANWCCHCGYLLPFGKKNCRKCSECQMAAHAGCVHLVPDFCGMSMAVANQILEGIRSQKQRQQKASSMSDRTLRSGKMSPPGSGHASSASFSQGMGSSYGQASPEATEAAKFMYSSQTSPQRITSPDRTSSSSQAAAAATAAMTGLPGAMSSQPGRQGQQPITDYGSASGGRYGSYGPHDDPYAQPQQSPPPQQQAAYGQPQQRKYNPADYANISGGYGSQPQMAQQPQQARPQQQQQQPLYSPQQHASQAQQPLSPVKQQHQEQQIISPTAGTVIPTSARRPLPSATDPGTGQRIGLDHFNFLAVLGKGNFGKVMLAESKKTRKLYAIKVLKKEFIIENDEVESIRSEKRVFLIANRERHPFLTNLHACFQTETRVYFVEEYISGGDLMLHIQRGQFGTRRAQFYAAEVCLALKYFHENGVIYRDLKLDNILLTLDGHIKIADYGLCKEDMWYGSTTSTFCGTPEFMAPEILLDKKYGRAVDWWAFGVLIYQMLLQQSPFRGEDEDEIYDAILADEPLYPIHMPRDSVSILQKLLTREPDQRLGSGPTDAQEVMSQPFFRNIVWDDIYHKRVAPPFLPQIKSATDTSNFDSEFTSVTPVLTPVQSVLSQAMQEEFRGFSYTADFD

SEQ ID NO: 80313 - protein, 1788 aa, Oryza sativa Japonica Group
MATVVDDDGKERWTDQHVQQSTRNSSGHSPCAMHMDTGSDTHECVLTICNLPVAWQLARHRTTSHVFGQIFLCTAVDTINSTTPLSGTQKIVSKGGRFALGFYTPPQGNNTASGTGNYYIAIWYNNIPLQTTVWTANSDVPVSDPTTASLSIGSDGNLVLLDQSKNRQLWSTNVSVASNSTVAVIQDGGSLDLMDATNSSIVYWRSIDHPTNTWLPGGKLGLNKTTGVSQRLVPWRNNANPSPGLFSLELDPNGTTQYFIQWNDSITYWTSGPWNGNIFSLVPEMTAGYNYNFRFINNVSESYFIYSMKDDSIISRFTIDVNGQIKQWTWVPASENWILFWSQPRTQCEVYGLCGAYGSCNLNVLPFCNCIKGFSQKFQSDWDLQDFTGGCKRNVPLQCQTNSSSAQTQPDKFYSMVSVRLPDNAQSAVAASSQACQVACLNNCSCNAYTYNSSGCFVWHGDLINLQDQYNGNGGGTLFLRLAASELPDSKKSKKMIIGAVVGGVAAALIILAIVLFIVFQKCRRDRTLRISKTTGGALIAFRYSDLQHVTSNFSEKLGGGAFGTVFKGKLPDSTAIAVKRLDGLSQGEKQFRAEVSTIGTIQHVNLVRLLGFCSEGSRRLLVYEYMPKGSLELQLFHGETTALNWAIRYQIALGTARGLNYLHEKCRDCIIHCDVKPDNILLDESFVPKVSDFGLAKLLGRDFSRVLTTMRGTRGYLAPEWISGVPITPKADVFSYGMMLFELISGRRNADLGEEGKSSFFPTLAVNKLQEGDVQTLLDPRLNGDASADELTKACKVACWCIQDDENGRPTMGQVVQILEGFLDVNMPPVPRSLKMHNSTASSQTKSSTSGNTGNLYVGIWFRTTSKKAVIWVANRDNPVTSATSPELKISEDGNLVLLNKFGEPKWSSNGTWNKPRKSIVAVLLDNGNLILRDQGNSSDVIWQSFDHPTDTILSGQRFGINKITGEYQDRVSWKDPEDPAPGPFSNHVDLIRLNQYVSLWNQSKVYWQSGNWTGQAFTSIPGMPLNTEYNYVFINNSHQLKFIYTTKDVSIITRIVLTVNGQLQCHTWSNKSEEWIVQWSLPAALCAVYSVCGPFGVCKTGFDEKCYCLPGFRPVSSRSWDLGAWNQGCVRKTDISCVDSNKHNGQQEKHAFLKIANIKVPGNPMQLNVQSEEECRSICLNNCICTAYAHQHECIVWNSELRDLKQLSAGNVDAIDIYVRLAASDLQVQYNEHKTHHMRLIAVLGSTFVALCAFGAIIWTFRKRNATQKAFSNDDSLILYSYSFLQHCTKNFSDKLGQGSFGSVYKGSLPNSQMIAVKKLQGMRQREKQFQTEIFLDVDHVLHEAPAQESRVDDNSLNASLDDNAISCIAEPSDGSDCVNDLCNDAITIIAEPNVGSDCLASLENNATTIIAEPSVGSDCVTSLDNDGIAEPSGGSDCIASLENSIIEDIAELNDGSDCITSESEIALSPKTESQIGHVDVGKDDDNVLRDSSEIESKVAMHIYQRPYPEHVDSVPYPQGFEVPNFTKFTGENAMTTMEHIDRFIDQCGKAGSDDLHANLMEKRPVDDSSVTCEIISVTSMPKTGVVSDPLSVSPIDVDKKKGRRVIIGDPRPKNRIKNAKAEDHKDAKDESSSFQRTKKPKLTFEMLMAKYNKGLAGQRLDNQTSDSKRPRSSCRKRFGQIPKQSEPSTIPTPYKPPVVMPWYPYPMSLYGYPFMYYMPWMHQPPMPYYQEWKESPRSTSSHSSNSRQDRFPQKNRSGGSKVKKVKVWVRKEAKAPEVVAINEES

SEQ ID NO: 80314 - protein, 330 aa, Bacillus cereus ATCC 14579
MNSILICGGAGYIGSHAVKKLVDEGLSVVVVDNLQTGHEDAITEGAKFYNGDLRDKSFLRDVFKQENIEAVMHFAADSLVGVSMEKPLQYYNNNVYGALCLLEVMDEFKVDKFIFSSTAATYGEVDVDLITEETMTNPTNTYGETKLAIEKMLHWYSQASNLRYKIFRYFNVAGATPNGIIGEDHRPETHLIPLVLQVALGQREKIMMFGDDYNTPDGTCIRDYIHVEDLVAAHFLGLKDLQNGGESDFYNLGNGNGFSVKEIVDAVREVTNHEIPAEVAPRRAGDPARLVASSKKAKEKLGWDPKYVNVKTIIEHAWNWHQKQPNGYAK

SEQ ID NO: 80315 - protein, 291 aa, Glycine max
MASVASSSSFSTRLLLHSHTPLVCRRRCRPNFLRMVTRSCLDDSSALLRAAQHTVDTYVKSGMVVGLGSGHASGMAIQHLGSQLRTGNLKDIVGIPMSVSSASEAAKAGIPLDTYQGSSQIDFAFDDADVIEEGTLVAIIGRRKLQGGESIIQEKSIINSANKCVFIIEENQYKGGLEGSIPVLIQSLNWMTIAEEIDDMFLGDAEVWRRPSIGQAGPLGGDFPVVTKEGHNILDVIFTSPIENLAEVAKSLDKVDGVVDHGVVSKIPCTVVIASQTGLNILDKLTADIVG

SEQ ID NO: 80316 - protein, 200 aa, Rubrobacter xylanophilus DSM 9941
MSYYDPQGVIPYVIEQSPRGERAMDIYSRLLKDRIIFLGTPVDDQVANAIMAQLLHLESEDPEQDINLYINSPGGSVSAGLAIYDTMQFVKPDIVTTALGMAASMGAFLLAAGTKGKRFALPNTRILLHQPAVGGLAGQASDVEIHARELIRTKRRLNEILSEHTGQPYDKIERDTDRDFIMGAEEAIEYGLIDDIVRHH

SEQ ID NO: 80317 - protein, 499 aa, Vitis vinifera
  misc_feature (236)..(236): Xaa can be any naturally occurring amino acid
  misc_feature (450)..(450): Xaa can be any naturally occurring amino acid
MGSALSLNGSKTRFEEHSEVSVDETCKRQRLSSSISEENENVRLIPNLPDEISFQILARVPRIFYLNMRLVSRSWKGAIMSTELFNLRKELGTTEEWLYILTKIKDDKLLWYSLDPLSRRWQRLPPMPNVAHEDGYRKGFSGLRMLNMVGSSNKIADVIRGWLGRRDELDRIPFCGSAIGTVDGCLYVLGGFSRASALTSVWRYDPVQNGWSEVSPMSIGRAYCKTGVLNNKLYVXGGVTRGRGGLIPLQSAEVFDPRTGVWSQIPSMPFAKAQVLPTAFLADLLKPIATGMTSYKGKLFVPQSLYYWPFFVDVGGEVYDPETNSWFEMPVGMGEGWPARQAGTKLGAIVDDELYALDPSSSADIATIKVYDYQCDSWKVVSTDVPIHDFAEAESPYLLASFLGKLHVITKDANNNFTVLQANMQNHLHSFPLTPLSPLGNNSSEQTESXAESETDVWKVIAARSAGACELHSDGVPSEQYLSRRPIVTETKMVEAKLN

SEQ ID NO: 80318 - protein, 93 aa, Bacillus halodurans C-125
MEDTVAGMSWVMALNILAVAAGAPPLLSALLLGFFSNLFSCTIHYGSGPAPVFFGTGYVDQKKWWSIGFFISIIHIVVWLGIGGAWWKVLGLW

SEQ ID NO: 80319 - protein, 392 aa, Vitis vinifera
  misc_feature (338)..(338): Xaa can be any naturally occurring amino acid
MYKLSTFSSMPPAIFLQPRMSHARIALRELEHMKKYPNAKVISLGIGDTTEPIPDIVTSSMANHARRLSTVEGYRGYGAEQGNKALRKAIAETLYGDLPIKDTEIFVSDGSQCDISRLQAYIDSSVIIGQTGDFQDETGKYQNIKYMPCRPQNNFFPDLTTTATTDVIFICSPNNPTGHAASRKQLEQLVEFARANRSIIIFDSAYAAYVTDESPRSIFEIPGAREVAIEISSFSKFAGFTGVRLGWTVVPDELLFSNGFPVIKDYNRIVCTCFNGASSIAQAGGLACLSSDGLMAVQSVVDYYKENAKILGDTFTSLGLDVYGGINAPYAWVHFPGXKSWDVFTELLEKTHIITVPGCGFGPGGEEHIRVSAFGHRECILEASRRLKSLLS

SEQ ID NO: 80320 - protein, 368 aa, Candida albicans
MATLKNKNNHLKACSTYTDNENHFLVDSRYEIVRVLGKGSYGVVCSAIDTKSSVSAMEHKIAIKKVTKIFNKDILLIRAIRELKFMMFFRGHKNLDVVYVKPYEGLYCFQELADLDLARVLYSNVQFSEFHIQSFMYQVLCGLKYIHSADVIHRDLKPGNILVTTQGTLKICDFGLARGINPVYFRNRSAVITNYVATRWYRAPELIMSTKNYTKAVDIWAVGCILGELFGRRPLFPGKNSHEQIHELFKIIGNPPIETIKKYNWKVEGLLWVKYRPVKWKSLYPFAPLNALELLDSLLQWDYKARLGVEQILEPEFFKNLRNVHGEPSSKAIFDFSFEEKGKSIPQLKEILETEVRVFKEISKTGIE

SEQ ID NO: 80321 - protein, 123 aa, Brassica napus
MGGVTSSMAAKLAFFPPNPPSYKIIRDEATELLLMDPFPHRENVDVLRLPTRRGTEIVAMYIRYPMAVTTLLYSHGNAADIGQMYELFIELSIHLRVNLMGYDYSGYGQSSGKPSEQNTYADI

SEQ ID NO: 80322 - protein, 430 aa, Neptuniibacter caesariensis
MAQIANIKAREVLDSRGNPTVEADVILESGVIGSACAPSGASTGSREALELRDGDKSRYLGKGVQNAVAAVNGEIREALTGMDVTDQRALDNKMLELDGTENKEKLGANAILAVSLAAAKAAATEKGVPLYAHIAEINGTAGQFSLPLPMMNILNGGEHADNNVDIQEFMVQPVNFDKFSEGLRCGAEIFHALKAVLKAKGLNTAVGDEGGFAPNLASNEEALVVIKEAIEKAGYELGKDVTLALDCAASEFYKEGKYDLSGEGKVFDAEGFGDYLAALTENYPIVSIEDGLDESDWDGWAYLTKKIGDKVQLVGDDLFVTNTKILSRGIEQSIGNSILIKFNQIGSLSETLDAIKMAKDAGFTAVISHRSGETEDTTIADLAVGTAAGQIKTGSLCRSDRVAKYNRLLRIEEELGAAAIYNGLSEIKGQ

SEQ ID NO: 80323 - protein, 372 aa, Candida albicans
MKKFTGPTQTRQVVFNISQNFKVLKILGEGAYGIVALAVHLPTETKVAIKKIEPFERPLFCLRTLREIKLLTKFKNHDNIVRLYDVQKPMNYDSFNEVYLIQGYMPSDLHNLIHTHLLSDQHVQYFIYQILKGLKMIHSARVIHRDLKPSNILVNEKCDLKICDFGLARLDTKHYNFDEAPRISMLTEYVATRWYRAPEIMLSASNYSTAIDLWSVGCILAELLTYRALFPGSDYINQLKLIFEVLGTPTDEDLQIIKSERAQKFIRSLPTKVKIDLSEFINNHPYRNIKHRGRDQVNPLAIDLLEKLLVFDPAKRITVQDALEHPYLNSYHEQLDEPVTSPIPIEEFDFDIDKKNLDTNDLKKQIFEIVMS

SEQ ID NO: 80324 - protein, 832 aa, Rhodobacter sphaeroides 2.4.1
MNIVLLVTALAVLFIVIAACEPVAARLRLPYSVVLAVVGAMLGTLALWLQRSGVAASFPPEVADLLALPIRSSVFLYIFLPTLLFQVSLSLNIRRMIDDWVPILVMAVVAVLVSTLAIGFALQPFSSMSLAACLLLGSIVSTTDPSAVVSIFRSIAAPQRLTRIVEGESLLNDAAAIALFGFFLTFVMAGVPDPTLRQALVEFPLLILGGLGLGYLMARIALFLMTRMASHPTAQLSLSLALPYLTYVLAEQGFHASGVIAVVTAGIAMNLTGPGRLSPATWKLLSDIWEMLSHWAGSLIFIVAALLIPRLIGRATGWDLLLIGVVALAAVVARGVMLSGLLPLLTRFNLSPRVERPYRVAILWGGLRGAVTLALALAVTENPMVPPHVKREVGILATGFVLFTLLAQGTTLRWVIRRLGLARLTPLDLALSNQVIAVALQNVREGVAETVRERELDPQIVRSEAKGFGQRLARAVELADDSADDIPDRDRITLGLVALAGRERDAILAAFRQQIISPRLAEAMLVDVDRLIERTRLQGRDGYRAAGRRALGLGRQHRIAVWAHNRLKITRWLSQLTSDRFEMLLTQRLILGDLHGLIDGKIRRIHGRRVAEILHEMLKRREEETEQALEALRLQYPGYSEEMVRSFIRRTALQLELREYEMLHDDGLIGQELFMTLRQRIQVARGKKERRPHLDLAVQKVELVRQFPLFAEMEEDQLRALERLLQTVYVRPGDVLLRRGDVPRKVFFIASGAVESDVAGQKVRLGRGEMFGQLAILTRKTRKAQVTAISHGTLLSLDEARFLELLRRNRTLQEAAVESAARRNVTIDLSAI

SEQ ID NO: 80325 - protein, 574 aa, Vibrio vulnificus YJ016
MISGILASPGIAIGKALLLQEDEIVLNTNTITEAQVEAEVQRFYDARSKSSAQLETIKQKALETFGEEKEAIFEGHIMLLEDEELEEEILALIKKEKMTADNAIYTVIEEQATALESLDDEYLKERATDIRDIGSRFVKNALGINIVSLSDINEQVILVAYDLTPSETAQINLDYVLGFACDIGGRTSHTSIMARSLELPAIVGTNDITKKVKNGDMLILDAMNNKIIVNPSEAQIEEAKAVKASFLAEKEELAKLKDLHAETLDGHRVEVCGNIGTVKDCDGIIRNGGEGVGLYRTEFLFMDRDALPTEEEQYQAYKEVAEAMEGQAVIIRTMDIGGDKDLPYMDLPKEMNPFLGWRAVRISLDRREILRDQLRGILRASAHGKLRIMFPMIISVEEIRALKEAIEEYKAELRAEGLAFDENIEIGVMVETPAAAAVAHHLAKEVSFFSIGTNDLTQYTLAVDRGNEMISHLYNPLSPAVLTVIKQVIDASHAEGKWTGMCGELAGDERATLLLLGMGLDEFSMSGISIPKVKKVIRNANFAAVKAMAEEALSLPTAAEIEACVEKFIAEHSK

SEQ ID NO: 80326 - protein, 322 aa, Vibrio vulnificus YJ016
MSKIYEDNSLTIGNTPLVRLNKVSNGKVLAKIEARNPSFSVKCRIGANMIWEAEKEGKLKPGVELVEPTSGNTGIALAFVAAARGYKLTLTMPESMSLERRKLLKALGANLELTEAAKGMKGAIAKAEEIVASNPEKYLLLQQFNNPANPEIHEKTTGPEIWEATDGAIDVFVAGVGTGGTITGTSRYIKGEKGKQILSVAVEPTESPVISQALAGEEIKPAPHKIQGIGAGFIPGNLDLSLIDRVEKVTSEEAIEMARRLMEEEGILAGISSGAAVVAANRLAELPEFEGKTIVTVLPSSGERYLSTALFAGIFTEKENQQ

SEQ ID NO: 80327 - protein, 480 aa, Triticum aestivum
  misc_feature (291)..(291): Xaa can be any naturally occurring amino acid
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSGNFVKMVHNGIEYGDMQLIAEAYDVLKSVGKLTNGELQQVFAEWNKGELLSFLVEITADIFSIKDDQGEGYLVDKVLDKTGMKGTGKWTVQQAAELSVAAPTIEASLDSXRFLSGLKDERVAASKIFQGDYSSGETVDKAQLIEDVRKALYASKICSYAQGMNIIKAKSTEKGWGLNLGELARIWKGGCIIRASFLDRIKKAYDRNGELANLLIDPEFAQEIMDRQAAWRRVVCLAINNGVSTPGMSASLAYFDSYRRDRLPANLVQAQRDYFGAHTYERVDMPGSFHTEWYKIANSKI

SEQ ID NO: 80328 - protein, 243 aa, Glycine max
  misc_feature (171)..(171): Xaa can be any naturally occurring amino acid
  misc_feature (191)..(191): Xaa can be any naturally occurring amino acid
MSAAVSSTTSHLEEELKNNNNNNNNVGGESDQPPYNEGANSDVAEETEPEEDDDSKLESNKELDLGPQFTLKEQLEKDKDDVSLRKWKEQLLGSVDMSVVGSESKDPEVKILSLIITSPDKPDLTLPIPFTTDAKKSLFILKEGSKCQMKFTFTVSNNIVSGLKYTNVVWXTGVRVDSRKKMLGTFSPKQXPYTFELEEETIPSGMFVRGTYAARTKFVDDDRKCYLDVSYYFEIQKNRPTPQ

SEQ ID NO: 80329 - protein, 248 aa, Prochlorococcus marinus subsp. marinus str. CCMP1375
MLKSFHSDLEIIRERDPAARGFIEILLCYPGFQALILHRISHKLWNIGLPLFPRVLSQITRSLTGIEIHPGAKIGKGVFIDHGMGVVIGETAEIGNRCLLYQGVTLGGTGKSHGKRHPTLSENVVVGAGAKVLGAIAVGANTRIGAGSVVVRDVEADSTVVGIPGRIIHQSGVRINPLAHSALPDAEATVIRNLMKRIDYLESQVQLLTNNLQTISKGNMPNKIISGEAQNLKDREIIEFLGDTLKED

SEQ ID NO: 80330 - protein, 779 aa, Arabidopsis thaliana
MKKETQNLQCIPLVISVLSLFGVSSARKPPYLCNRVCGGISIPFPFGIGGKECYLNPWYEVVCNTTTSVPFLSRINRELVNIYLPDPTEYYSNGVVHIKGPVTSSGCSTGTSQPLTPQPLNVAGQGSPYFLTDKNLLMAVGCNVKAVMMDVKSQIIGCESSCDERNSSSQVVRNKICSGNKCCQTRIPEGQPQVIGVNIEIPENKNTTEGGCKVAFLTSNKYSSLNVTEPEEFHSDGYAVVELGWYFDTSDSRVLSPIGCMNVSDASQDGGYGSETICVCSYGYFSGFSYRSCYCNSMGYAGNPFLPGGCVDIDECKLEIGRKRCKDQSCVNKPGWFTCEPKKPGQIKPVFQGKSQFDFILNVVLKILLFCVLIGSALLLFAFGIFGLYKFIKKQRRSSRMRVFFRRNGGMLLKQQLARKEGNVEMSKIFSSNELEKATDNFNTNRVLGQGGQGTVYKGMLVDGRIVAVKRSKAMDEDKVEEFINEVVVLAQINHRNIVKLLGCCLETEVPVLVYEFVPNGDLCKRLRDECDDYIMTWEVRLHIAIEIAGALSYLHSAASFPIYHRDIKTTNILLDEKYQVKVSDFGTSRSVTIDQTHLTTQVAGTFGYVDPEYFQSSKFTDKSDVYSFGVVLVELITGKNPSSRVQSEENRGFAAHFVAAVKENRFLDIVDERIKDECNLDQVMAVAKLAKRCLNRKGKKRPNMREVSVELERIRSSSYKSEIHNDDDDDDDDDDEDDQAMELNIEETWDVGMTAPASMFNNGSPASDVEPLVPLRTW

SEQ ID NO: 80331 - protein, 80 aa, Pseudomonas syringae pv. syringae B728a
MSTTSIEERVKKIVAEQLGVKQEEVVNTASFVEDLGADSLDTVELVMALEEEFETEIPDEEAEKITTVQAAIDYVTSHQA

SEQ ID NO: 80332 - protein, 390 aa, Oryza sativa Japonica Group
MEQMNTAAAKSIRCRAAVSRVAGQPLEMEEVEVAPPRAHEVRIKILCTSICHTDITFWRMEGNHPSIFGHEAVGVVESVGEHVQEVAVGDMVVPVFAAQCSECPDCLSDRSNLCSKLPNVAGLMPRDRTTRFSSVSTGEPIRHFLSVSSFAEYTVVDITHIVKLDVGFPPAMACLLSCGISTGVGAAWKVAAVEPGSSVAVFGLGAVGLAVAQGARMRGAKRIIGVDLNPDKFDVGKRLGMTDFINPNDTGGKTVSEVIKEMTGGGGADYCFECIGSTSVMAEAFQSTRNGWGKTILLGVSGNKAPISIPSHEILRGRSVIGSLFGGIKPKNDIPMLAQKYLDKELELEEFITHEMGFEEINRAFELLTQGKSIRCIIWMDGAKVIDNGE

SEQ ID NO: 80333 - protein, 314 aa, Vibrio campbellii AND4
MGKLIKGVWHDVWYETKSSGGKFIREDAGFRGWIKNKPDAGFLPESGRYHLYVSLACPWAHRTLIFRQLKGLERHIDVTVVCPDMLSEGWQVGLPEPLFGHTRMHQIYTQAKPDYTGRVTVPVLWDKKTNTIVSNESSEIIRMFNSEFNELTGNNDDYYPEQLQSVIDEWNDYVYPNVNNGVYRCGFATTQEAYEEAFDSLFTALDKIDAHLATHRYLAGNKITEADWRLFTTLVRFDAVYVGHFKCNKQRIADYPNIQGYLKELYQVEGVAETTDFYHIKRHYYFSHIGINPTQVVPKGPELDLNSPHGRDLI

SEQ ID NO: 80334 - protein, 721 aa, Vibrio campbellii AND4
MSRTIMLIPASAGVGLTSVSMGVLRAMERKGVKVSFYKPISQPRSGGDQPDLTSTIVGCNSDMKIGQPLAMSVAENLIGNDNMDELLETVVERYNQINKDADVTLIEGLVPTRKHPFANQVNAEIAATLGAEIVLVATPGTDNPAQLKERIEVACSNFGGTKNKNISGVIINKLNAPVDEAGRTRPDLSEIFDDADSAKQNEMKVMEIFNTSPIRVLGCVPWSIDLIATRATDMAKHLNADIINEGEINTRRIKSITFCARSLPNMIAHFRPGSLLVTSADRPDVIVAASLAAMNGVDIGAILLTGGYDIPEEIEGLCKPAFETGLPIFKAQGNTWQTSLNLQSFSIEVPADDKERIEFINEHVAGHIDGNWIESMTEGTQKSRRLSPPAFRYQLTEFARKAGKRIVLPEGDEPRTVKAAAICAERGIAECVLLGNPDEIRRVAEQQGVTLGAGVTIINSDEVRENYVARLVELRGAKGMTEVVAREKLQDSVFLGTMMLENNEVDGLVSGAVHTTANTIVPPFQIIKTAPDASIVSSVFFMLLPDQVLVYGDCAINPDPTAEQLAEIAIQSADSAAAFGIDPRVAMISYSTGESGKGADVDKVREATKIAQEKRPDLVIDGPLQYDAAIMENVAASKAPNSPVAGKATVFVFPDLNTGNTTYKAVQRSADLVSIGPMLQGMRKPVNDLSRGALVDDIVYTVALTAIQADQADQAREKVVN

SEQ ID NO: 80335 - protein, 374 aa, Leptospira interrogans serovar Lai str. 56601
MSFHFQTFYGIFSLEFTDPQKNSVGIIFLEESMSVHPTQTLSLSQYLIEEQLKLPQATGDFTALMSHLVYAAKIVSREVRKAGLLENILGATETVNVQGETQMKLDEYADKVFNHTLTRSGHLCILGSEEHEETVPVPNGYKIGKYTIAIDPLDGSSNIDANVSIGTIFSVHLRKSPAGTPGTLSDLLQQGSGQRAAGYVLYGSSTMLILCTGKGVSGFTLDPSCGEFILSHPDMQIPETGGIYSINEGNYNYWSDEVKNYIRDIKSIEGGRKPQSGRYIGSLVADFHRNLLKGGIFLYPNDTKSTKYPNGKLRLLYEAAPMAFIAEQAGGMAVTVYGERILDLTPKELHERTTLVVGSKKEVEHFLKFAPKKS

SEQ ID NO: 80336 - protein, 515 aa, Candida albicans SC5314
MSVPTFDDLSFYSNDQELTKSRYLKLVEIFQSNFPNASIDFFARSPGRVNLIGDHIDYNFFPVLPMAISNDVIVAVNVNDEPEIVITNTDSKNFAKETIPLTNNNDGFEIDSQHHSWANYFKCALIVANNYLTEQNLKGQLKGMKLTFDGNVPTGGGLSSSAAFCVASTLAILHANGVKDISKADLTRITVVCEHYVGVNTGGMDQCASVYGEPDKALLIQFKPKLIGKPFKFPVENLTFVITNSLQVSNKHETAPIHYNLRVVEMAIAADVLVKKLNLGTLVPQDSNIGTSSLRGVMDAVFNTCKWDGNDIDVGIDQLKKMIAIVETELNNNQEGYTVDQCLTVLDLSLDEFKSKYLQAYPVKFDVLKLYQRAKHVYQESLRVLETLKLLSTTQTSSNSKDDDESFLVKFGELMNQSQSDLDKLNESSNDKLNEICSIALQNGSYGSRITGAGWGGSIVHLTTLDKSKQLIQGLIKNYYQLEFPNIKLDELLNDAIIDSKPSMGSCIVTTKFLQ

SEQ ID NO: 80337 - protein, 497 aa, Bradyrhizobium sp. ORS278
MTPPAAARASDAASSLRDRLKDPSLLREQCYIDGAWVGTPEFAVNNPATGAELARIAQLGAAETTQAVEAAARAFPLWAKQTAKQRSNILRKWFELIIANREDLALILTSEQGKPLAEALGEVDIGAAYIEFFAEEARRVYGETIPTQKPDARLLALKQPIGVCGAITPWNFPNSMITRKVSPALAAGCTVVLKPANETPLSALALAVLAERAGIPKGALNIVTGDAPPIGKVLCEHPAVRFVGFTGSTEVGKILYRQSAGTVKKLGLELGGNAPFVVFDDADVDAAVEGAIVSKYRNMGQTCVCANRLYAQDGIYDAFVDKLAAKVAAMKIGEGTEAGVTQGPLINEDAVEKVERHIADAVKGGAKIVTGGKRHALGRTFFEPTVLRDVKADALVAHEETFGPLAPVIRFKDEADVIAMCNASPFGLASYFYARDLGRVWRVAEALESGMVGVNTGLITTEVAPFGGVKESGLGREGSHHGIEEYLEIKYVMMAGV

SEQ ID NO: 80338 - protein, 489 aa, Bacillus sp. SG-1
MSITVETKTYLNFINGEWVKSSGSEISESINPNDASEVVGKVQKSTREDLDNAVQAAKNAKTSWRKLPGAERGNFLYKAADILDSRLDEIAETMTREMGKTLPEAKGETARGVALLRYYAGEGMRKVGDVIPSTDKDGFMFTTRVPLGVVGVITPWNFPVAIPIWKIAPALIYGNTVVFKPAGEAVVTAAKVVECLVDAGLPKGVMNFVTGSGSVVGQGIIDNLDISGITFTGSDSVGKQVGQGAFARGAKYQLEMGGKNPVIIAKDADLDLAVDGTISGAFRSTGQKCTATSRVIVESEVYNEFKEKLLAKVKGIKIGNGLEEGVWMGPSASEGQLETVLSYIEKGKEDGAKLIHGGKRLTGNGLEKGFFIEPAVFDGVTNEMRIAQEEIFGPVIALMKVNSLEEGIELANSVEYGLSASIYTTNIQNMLDFVSDLEAGLVRVNAESAGVELQAPFGGMKKSSSHSREQGQAAQEFFTSIKTVFVKGK

SEQ ID NO: 80339 - protein, 372 aa, Campylobacter coli RM2228
MKAYIYIENDIFLTAKAFGKGGTFFGELVFNTSLTGYQEIISDPSYAGQFIVFSMPEIGIVGTNENDNESKEIFASGVLMRELSPTFSNFRAQKSLQEYLEEHGKIGVYGLDTRYLVKMLRDSGNLRAVISTEISSKEELKAALEKSAKIDEINFVKEVSTKKSYAHKHGVWNNATQSYNKAKKNTKKVAVIDYGVKANILNELVEVGLEVEVFPYNTKAEELIKLYQKGQIQGVFLSNGPGEPKILKQEIAEIKKLAEAKIPMLGICLGHQLLSNAFGYETYKMKFGQHGANHPVINLENKSVEITAQNHNYNVPEELCEVAIITHRNLFGDNVEGVRYKDYPIISVQHHPESSSGPHESKYIFKEFMNLM

SEQ ID NO: 80340 - protein, 2238 aa, Streptomyces cinnamonensis
MASEEQLVEYLRRVTTELHDTRRRLVQEEDRRQEPVALVGMACRFPGGVASPEDLWDLVAAGKDAIEDFPTDRGWDLEALYDPDPAAYGTSYVRHGGFVDDAGSFDADFFGISPREALAMDPQQRLMLETSWELFERAGIEPVSLKGSRTGVYAGVSSEDYMSQLPRIPEGFEGHATTGSLTSVISGRVAYNYGLEGPAVTVDTACSASLVAIHLASQALRQRECDLALAGGVLVLSSPLMFTEFCRQRGLAPDGRCKPFAAAADGTGFSEGIGLLLLERLSDARRNGHKVLAVIRGSAVNQDGASNGLTAPNDAAQEQVIRAALDNARLTPSEVDAVEAHGTGTKLGDPIEAGALLATYGQHRARPLLLGSLKSNIGHTHATAGVAGVIKTVMAIRNGLLPATLHVEELSPHVDWDAGAVEVVTEPTPWPETGHPRRAGVSAFGISGTNAHLILEEAPPEEDVPAPVVVESGGVVPWVVSGRTPEALREQARRLGEFVAGDTDALPNEVGWSLATTRSVFEHRAVVVGRDRDALTAGLGALAAGEASAGVVAGVAGDVGPGPVLVFPGQGAQWVGMGAQLLDESAVFAARIAECERALSAHVDWSLSAVLRGDGSELSRVEVVQPVLWAVMVSLAAVWADYGVTPAAVIGHSQGEMAAACVAGALSLEDAARIVAVRSDALRQLQGHGDMASLSTGAEQAAELIGDRPGVVVAAVNGPSSTVISGPPEHVAAVVADAEARGLRARVIDVGYASHGPQIDQLHDLLTERLADIRPTNTDVAFYSTVTAERLTDTTALDTDYWVTNLRQPVRFADTIEALLADGYRLFIEASAHPVLGLGMEETIEQADMPATVVPTLRRDHGDTTQLTRAAAHAFTAGADVDWRRWFPADPAPRTIDLPTYAFQRRRYWLADTVKRDSGWDPAGSGHAQLPTAVALADGGVVLNGRVSAERGGWLGGHVVAGTVLVPGAALVEWVLRAGDEAGCPSLEELTLQAPLVLPESGGLQVQVVVGAADEQGGRRDVHVYSRSEQDASAVWQCHAVGELGRASVARPVRQAGQWPPAGAEPVEVGGFYEGVAAAGYEYGPAFRGLRAMWRHGDDLLAEVELPEEAGSPAGFGIHPALLDAALHPLLAQRSRDGAGAGAHGGQVLLPFSWSGVSLWASEATTVRVRLTGLGGGDDETVSLTVTDPAGGPVVDVAELRLRSTSARQVRGSAGPGADGLYELRWTPLPEPLPVPAPANGRDVAADLSGCAVLGELVAEPGPGIDLEGCPCYPGVGALADNASPPSMILAPVHSDTTGGDGLALTERVLRVIQDFLAAPSLEQKQTRLAFVTRGAADTGSTTGGSAAPAEAVDPAVAAVWGLVRSAQSENPGRFVLLDTDAPLDQASVAPLVDAVRSAVEADEPQVALRGGRLLVPRWARAGEPVELAGPAGARAWRLVGGDSGTLEAVVAEACDDIVLRPLAPGQVRVAVHTAGVNFRDVLIALGMYPDPDALPGTEAAGVVTEVGPGVTRLSVGDRVMGMMDGAFGPWAVADARMLAPVPPGWGTRQAAAAPAAFLTAWYGLVELAGLKAGERVLIHAATGGVGMAAVQIARHVGAEVFATASPGKHAVLEEMGIDAAHRASSRDLAFEDAFRQATDGRGVDVVLNSLTGELLDASLRLLGDGGRFVEMGKSDPRDPELVALEHPGVSYEAFDLVADAGPERLGLMLDRLGELFAGGSLVPLPVTAWPLGRAREALRHMSQARHTGKLVLDVPAPLDPDGTVLVTGGTGTIGAAVAEHLARTGESKHLLIVSRSGPAAHGAEELVSRIAEFGAEATFVAADVSEPDAVAALIEGIDPAHPLTGVVHAAGVLDNALIGSQTTESLTRVWAAKAAAAQQLHEATRESRLGLFVMFSSFASTMGTPGQANYSAANAYCDALAALRRAEGLAGLSVAWGLWEATSGLTGTLSAADRARIDRYGIRPTSAARGCALLAAARAHGRPDLLAMDLDARVPAASDAPVPAVLRTLAAAGAPATARPTAAAAADGATDWSGRLAGLTEEARLELLTELVCTHAAGVLGHADAGAVQVDAPFKELGFDSLTAVELRNRIAAATGLKLPAALVFDYPQARVLAAHLAERLVPEGAGAMGGVSGAEGVRDAYGAGGPGGDMTAQVLLEVARVEHTLSAAVPHGLDRAAVAARLEALLARCTATTAATGAAGAAVEGDGDSDGDGAVDQLETATAEQVLDFIDNELGV

SEQ ID NO: 80341 - protein, 333 aa, Bradyrhizobium sp. ORS278
MTDAKYDVLGIGNAIFDVLVQADEAFLAKHGMTKGGMALIDEARAAAIYADMGPATEMSGGSGANTIVGLASLGARAAYVGKVKGDQIGKMYTHDIRAAGVAFETAPATDGPATGCSYIIVTPDGERTMNTYLGAAQNLTVADIDPAQIAAARIVYLEGYLWDPKDAKDAFVKAATIAHDAGREVALTLSDAFCVDRYREEFLDLMRGGTVDLVFANEAELHSLYQTSDFDGALKQLREDATLGIVTRSDKGCVVVSNDGVIAVPAHPIKTLVDTTGAGDLFAAGFLFGLVRKTGYEIAGKLGGLAAAEVIQHIGARPQVSLKELAAQNRLKV

SEQ ID NO: 80342 - protein, 647 aa, Zea mays
  misc_feature (121)..(121): Xaa can be any naturally occurring amino acid
  misc_feature (146)..(146): Xaa can be any naturally occurring amino acid
MATMSAASHRCCASSLRALTVLFVLAALVSDVGGRHHHHVCPHYFSCGGLSNISYPFRRQGDPSGCGVQSYELVCTDTDATIRIGSGTYKVLSINSTYSHFWVVDADLDIQSSCPLPRWDXMLVGSISTYIVGGLCRANIISILLXFYMDSWRWAIFVNCSQPIENNDTDKYHIYEPVSCLSNSSFIYLVPDYWYAGLVPAGSLEPSCGYLAMTPLGGPGMQVPSNTSYPDVVKFMRSGFALGFPSYGDNIRECLAKDMRTFHKEPRNSTGIRQQILDILTVVDIFWACVIYQLQSTNYNGVTTVVIGIIETIQYVSGVLDYTAGVCRFVLMPLAVLVFLVYKYWKTRITVDAVEKFLRMQQMLVPMRYAYTNIIAITGHFRDKLGQGGYGSVYKGVLQPGEVHVAVKMLGNSNCNGDEFISEVATIGKIHHVNVVRLIGFCSEENIRALIYEFMPRGSLDKYIFSSEKSFSWDKLNEIALGIARGLNYLHHGCDMQIVHFDIKPHNILLDSNFVPKVADFGLAKLFPRDDSFVPLSAMRGTIGYIAPEMVSRSFGVISSKSDVYSFGMLLLEMTGGRRNADPHAGSSSQAYYPSLVYSQLSQGDANGISEGVNMHDLEKKLCTIGLWCIQMKPADRPTMSEVIEMA

SEQ ID NO: 80343 - protein, 4132 aa, Streptomyces cinnamonensis
MVSEEKLVDYLKRVSADLHATRQRLREAEERGQEPVAVVEAACRYPGGIRTPEDLWDLVAAGGNALGAFPDNRGWDLRRLFHPDPDHPGTTYAREGGFLHDADLFDPEFFGISPREAAVLDPQQRLLLECAWEALERAGIDPRSLQGSRTGVYAGAALPGFGTPHIDPAAEGHLVTGSAPSVLSGRLAYTFGLEGPAVTIDTACSSSLVAVHLAAHALRQRECDLALAGGVTVMTTPYVFTEFSRQRGLAADGRCKPFAAAADGTAFSEGAGLLVLERLSDARRAGHRVLAVIRGSAVNQDGASNGLTAPNGPAQQRVIRAALAGARLSPAEVDAVEAHGTGTRLGDPIEADALLATYGQERHGGRPLWLGSVKSNIGHTQGAAGAAGLIKMVQALRHETLPATLYADEPTPHADWESGAVRLLSAPVAWPRGEHGEHTRRAGISSFGISGTNAHLILEEAPAADAEGAGGDGDGDGGGVRPVVRVGATGPREEQGQGQGQEQHQQQRQQRQRSSMMPTPHLPWLLSARSPAALRAQADALANHVAHADHSIADIGGTLLRRTLFEHRAVVLGTDRDERAAALAALAAGRAHPALTRAAGPARNGGTAFLFTGQGSQRPGMGRQLYDTFDVFAESLDETCARLDPLLEQPLKPVLFAPADTAQAAVLHGTGMTQAALFALEVALYRQVTSFGIAPSHLTGHSVGEIAAAHVAGVFSLADACTLVAARGRLMQALPAGGAMLAVQAAEDDVLPLLAGQEERLSLAAVNGPTAVVVSGEAAAVGEVEKALRGRGLKTKRLNVSHAFHSPLIEPMLDDFREVARGLTFHAPTLPVVSNLTGRLADAELMADAEYWVRHVRRPVRFHDGLRALSEQGVVRYLELGPDPVLATMVQDGLPAPAEGEEPEPVVAAALRSKHDEGRTLLGAVAALHTDGQPADLTALFPADAGQVPLPTYRFQRRRYWRVAPDAAAPARAAGLQETGHPLLPAVIRQADGGILLAGRLSLRTHPWLADHTIAGGVPLPATAFVELALLAGRHAACDTIDDLTLETPLLLDDTGTGVGAAVGAGADALVDAIEVQLALGAPDGSGRRALTVHSRPADDAADDGDAADAADAAGRGGPGGSGDLGDPGDPGDLGDGGGSRGWRRHATGILSAGPAAEPAAPDAAPWPPADATALDVDALYARLDAQGYSYGPAFRAVHAAWRHGDDLYADVRLADEQRAEADAFALHPALLDAALHAVDELYRGSEGRGQEQGQGGQEPEQGRGDADAPVRLPFSFSDIRHHATGATRLWVRLSPQGDDRLRLSLTDGEGGQVATVDALQLRLIPADRWRAARPTTAAPLYHLDWHELPLPEPAETDPAAHSWAVLGAHDAGLAPAAHYPDLAALKAAVEAGEPVPDIVFAPFPAQGTETDVPAQVRAHARHALELLRDWLTTEAFAAARLVVLTTGAVTARPEDGPADLATAPVWGLVRAAQAEQPDHVVLVDIDKDIDKDTDEETDQATDAGTASRHALPAALAAAAAQAETQLALRAGTVLVPRLAVVPPRTDTPALHATAPESTTDTVDSTGIAGAAESGGTVLITGGTGGLGQAVARHLAAAHGARHLLLVSRRGDAAEGVAELRADLADDGVDVRVAACDITDRDALAGLLADIPAAHPLTAVVHTAGVIDDSLITAMTPERLDAVLAPKADAAWHLHELTRDKDLSAFVLFSSGASVLGNGGQANYAAANTFLNTLAEHRRAAGLAATSVAWGLWESASGGMAARLGDADRARIHRTGVTGLTDEQALALFDAALTAEHPTVLATRFDRAVLRGQAAARTLQPALRGLVRTPRPTASAGAIGSTAATGSATDENAPSSWAARLARLSAADRDRALNELIREQIATVLAHPSPDTIELGRAFQELGFDSLTALELRNRLSTATGIRLPATLVFDHPSPTALVRHLHSHLPDEAQHTSPTAPGASAEGTAATATGIDDDPIAIVGMACRYPGGVTSPEQLWQLVATGTDAIGPFPEDRGWDTAGLFDPDPDQVGHSYTREGGFLYDAARFDAGFFGISPREAAATDPQQRLLLETAWQAFEHAGIDPAALRGTPCGVITGIMYDDYGSRFLARKPDGFEGRIMTGSTPSVASGRVAYTFGLEGPAITVDTACSSSLVAMHLAAQALRQGECELALAGGVTVMATPNTFVEFSRQRGLAPDGRCKPFAAAADGTGWGEGAGLVVLERLSDARRKGHRVLALLRGSAVNQDGASNGMTAPNGPSQERVIRTALAGAGRGPEDIDVVEAHGTGTTLGDPIEAQALLATYGQGRPEDRPLWLGSVKSNIGHTQAAAGVAGVIKMVMALRHEQLPTTLHADEPTPHVQWDGGGVRLLTEPVPWSRGERTRRAGVSSFGISGTNAHLILEEPPEEDLPEPVAAEPGGVVPWVVSGRTPDALREQARRLGEFVVGAGDVSAAEVGWSLATTRSVFEHRAVVAGRDRDDLVAGMQALAAGETPTDVVSGAAASSGAGPVLVFPGQGSQWVGMGAQLLDESPVFAARIAECEQALSAYVDWSLSDVLRGDGSELSRVEVVQPVLWAVMVSLAAVWADYGVTPAAVVGHSQGEMAAACVAGALSLEDAARIVAVRSDALRQLQGHGDMASLGTGAEQAAELIGDRPGVVVAAVNGPSSTVISGPPEHVAAVVAEAEARGLRARVIDVGYASHGPQIDQLHDLLTEGLADIRPANTDVAFYSTVTAERLTDTTALDTDYWVTNLRQPVRFADTIEALLADGYRLFIEASAHPVLGLGMEETIEQADIPATVVPTLRRDHGDTTQLTRAAAHAFTAGADVDWRRWFPADPTPRTVDLPTYAFQHQHYWLEEPSGLTGDAADLGMVAAGHPLLGACVELAESDSYLFTGRLSRRAPSWLAEHVVAGTVLVPGAALVEWVLRAGDEAGCPTIEELTLQAPLVLPESGGLQVQVVVGATDEQSGRRDVHVYSRSEQDASAVWVCHAVGVVSSEMPEAAAELSGQWPPAGAEAVDVEDFYARAAEAGYAYGPAFQGLRALWRHGTELFAEVVLPEQAGGHDGFGIHPALLDAALHPLMLLDRPADGQMWLPFAWSGVSLNADRATHVRVRLSPRGEAAERDLRVVIADATGAPVLTVDALTLRAADPGRLGAAARGGVDGLYTVDWTPLPLPQPLPLPRTDAGGSADWVILSDNSSAALADAVSSATAAGGGAPWALLAPVGGGSADDGLPVVRRTLSLVQEFLAAPELTESRLVIVTRGAVATDADGDVAASAAAVWGLIRSAQSENPGRFVLLDVEEEHLHPDGGELPYAALRHAVEELDEPQLALRSGKFLVPRMTPAAAPEELVPPVGTSGWRLGTSGTATLENLSVIDAPEAFAPLEPGQVRISVRAAGMNFRDVLIALGMYPDKGTFAGSEGAGHVTEVGPGVTHLSVGDRVMGLFEGAFAPLAVADARMVVPIPEGWSFQEAAAVPVVFLTAWYGLVDLGRLRAGESLLIHAGTGGVGMAATQIARHLGAEVFATASPAKHGVLDGMGIDAAHRASSRDLDFEETLRAATGGRGMDVVLNSLAGEFTDASLRLLAEGGRMVDMGKTDKRDPDRVAAEHAGAWYRAFDLVPHAGPDRIGEMLAELGELFASGALAPLPVQTWPLGRAREAFRFMSQAKHTGKLVLEIPPALDPDGTVLITGGTGVLAAAVAEHLVREWGVRHLLLAGRRGSEAPGSSELAEELTELGAEVTFAAADVSDPDAVAELVGKTDPAHPLTGVIHAAGVLDDAVVTAQTPESLARVWAAKATAAHLLHEATREARLGLFLVFSSAAATLGSPGQANYAAANAYCDALVRQRRAEGLAGLSIGWGLWQTASGMTGHLGETDLARMKRTGFTPLTTEGGLALLDAARAHGRPHVVAVDLDARAVAAQPAPSRPALLRALAAGATPGARTARRTAAAGSVAPAGGLADRLAGLPHPERRRLLLDLVRGNVAGVLGHSDHDAVRPDTSFKELGFDSLTAVELRNRLAAATGLKLPAALVFDYPESATLVDHLLERLSPDGAPPPVKDAADPVLNDLGRIESSLDALALDADARSRVTRRLNTLLSKLNGAATAGSPADVTDLDALDALDDVSDDEMFEFIDREL

SEQ ID NO: 80344 - protein, 668 aa, Vitis vinifera
MATSVGAANAAVFKDPKIQTQIQTFKAFKPWTALPVTTSRSRPRSSPSVIRAVSTPVKPDTTTSEPKRSKVEIFKEQSNFIRYPLNEELLTDAPNINEAATQLIKFHGSYQQANRDERGPKSYSFMLRTKNPCGKVPNKLYLAMDDLADEFGIGTLRLTTRQTFQLHGVLKKDLKTVMSTIIRSMGSTLGACGDLNRNVLAPAAPFARKDYLFAQETADNIAALLTPQSGFYYDMWVDGERLMSAEPPEPIYGTQFLPRKFKVAVTVPTDNSVDIFTNDVGVVVVSDANGEPLGFNIYVGGGMGRTHRLETTFPRLSESLGFVRKEDILYAVKAIVVTQRENGRRDDRKYSRMKYLIDSWGIEKFRSVVEQYYGKKFEPIHELPEWEFKSYLGWHEQGDGGLFCGLHVDNGRIGGKMKKTLREVIEKYNLDVRLTPNQNIILCNIRSAWKRPITTALAQAGLLHPRYVDPLNLTAMACPALPLCPLAITEAERGIPDLLKRVRAVFEKVGLKYNESVVIRVTGCPNGCARPYMAELGLVGDGPNSYQIWLGGTPNQTSLARTFMNKVKIQDLEKVFEPLFYYWKRKRQTKESFGNFTNRMGFEKLQELVDKWEGPVMSPSRFNLKLFADKETYEAVDALAKLQNKNAHQLAMEVIRNFVAAQQNGKGE

SEQ ID NO: 80345 - protein, 259 aa, Rubrobacter xylanophilus DSM 9941
MRGEFEVALEAARAAGGVLLAGFGRRGEVRYKGEVDLVTETDVRAERLLKERLLGAFPGYGVLAEESGQTAGEGDVRWVVDPLDGTVNFAHGLPIFAVSVALQRGREVVLGAVYDPVRDEMFAARRGGGATLNGEPISTSDNGELIRALVATGFPYDRAKMPEALELFGRFATRTRGMRRLGSSALDLCYVACGRLDGYYERGVWAWDVAAAALILEEAGGRVSDYRGGPLDVEGREIVASNGPLHAAMLDLTRPFSGR

SEQ ID NO: 80346 - protein, 415 aa, Magnetospirillum magnetotacticum MS-1
MPALSPTMTEGNLAKWLKNEGDAVKSGDILCEIETDKATMEFEAVDEGVLGKILVAGGTSGVAVNTPIAVLLEEGEDASAISAAPAPKAVAAPASVAAAPIAAAPAAAPAAAHGGDRVVASPLAKRIAKDGNVDLKAVKGSGPHGRIVKADVEAAIKAGPAKPAAATPAAAAAAPKPAPAPASASPFEPAFEEIPNSSMRKVIARRLTEAKSTIPHFYLSIDCELDSLLKVRADLNGRSDAYKLSVNDFVVRAVALALKKVPAANASWGEDAIKRYKDVDISVAVATPSGLITPIVHHADHKGLAEISNEMKALAGKARDNKLKPEEFQGGGFTISNLGMFGIKDFAAIINPPQGCILAVGAGEQRPVVKAGALAVATVMTCTLSVDHRVVDGAVGAEFLAAFKKLIEDPLSMLL

SEQ ID NO: 80347 - protein, 189 aa, Bradyrhizobium sp. ORS278
MFIQTEATPNPATLKFIPGRVVLPAGTMEFASRDAAARSPLAERLFAVDGVTGVFYGADFITVTKSDGEWQHLKPAILGAIMEHYMSGAPLLADGSAANDASADEDDEFFDEADTETVGMIKDLIESRVRPAVANDGGDITFRGFKDGIVYLNMKGACSGCPSSTATLQHGIQNLLKHFVPEVVEVRPM

SEQ ID NO: 80348 - protein, 130 aa, Triticum aestivum
  misc_feature (86)..(86): Xaa can be any naturally occurring amino acid
  misc_feature (110)..(110): Xaa can be any naturally occurring amino acid
MAEQTFIMIKPDGVQRGLIGEVISRFEKKGFYLKGLKLQNVEKSFAEQHYSDLSSKPFFAGLVEYIVSGPVVAMVWEGKSVVATGXARSLGATNPLASEPGTIRGDFAVXDIGRNVIHGTTRCQKNPCGP

SEQ ID NO: 80349 - protein, 158 aa, Prochlorococcus marinus subsp. marinus str. CCMP1375
MVSIEGRFTEASSLKIGIVAARFNDLITSKLLSGCIDCLTRHGIDTSESSSQLDIAWVPGSFELPLVSQTMAKSGRYQVLITLGAVIRGDTPHFEVVINESSKGIASVSRETGVPIIFGVLTTDTMQQALERAGVKNNLGWNYALQAIEMGSLMKALK

SEQ ID NO: 80350 - protein, 222 aa, Streptococcus mutans UA159
MTNKLLLNGRVWNKGDIMGWWKETIDIVKEKDPAARTALEVLLTYPGVKALAAHCLSHFLWTHHCKLLARMHSQFWRFWTQIEIHPGAEIAEGVFIDHGSGLVIGETAIVEKGVMLYHGVTLGGTGKETGKRHPTIRQGALISAHSQVIGPVEVGPGAKVGAGAVVVSDVPADVTVVGVPAKVVRIHGQKDETAIHEIEENREYYLKKLEEAKEASFHSSGL

SEQ ID NO: 80351 - protein, 263 aa, Vitis vinifera
MSQQQPQRPQDQQQPIKYGDVFNVQGDLGMKPVAPADASMMQAAETVVLGKTGKGAAASTMQSAAAKNERAGFVGHNQGTDVAGDQGVAIAEIQLPGRRTITESIGDQVVGEYSAAAPLTPPSAAGGRVGAITIGEALEAAALAAGGKPVEWSDAAAVQAAEVRAAGRTTTAPGGVGAAAQSAATLNARTSRNEDKTKLADVLTDASEKLPRDKAATRRDAEGVVRAEVRNDPNLTTYPGGVAAAVAAAARLNQSDNKRDSTN

SEQ ID NO: 80352 - protein, 323 aa, Vitis vinifera
MEEKCAIAKDVTELIGNTPMVYLNNVVDGCVARIAAKLEVMEPYSSVKDRIGYSMISDAEEKGLITPGKTVLIEVTSGNTGIGLAFIAAAKGYKLIFVMPSVATLEKKMVLLAFGAELHLIDMAKGVQALFDKADEILQNTPNGYFLNQFENPANPKIHYETTGPEVWKGTGGKVDILVAGIGTGGTITGAGQFLKEKNPEIKVYGVEPAESAVLNGGKPGSHQIQGIGAGIIPKILDTELLDEVIQISSDEAIETARLLALKEGLLVGISSGAAAAAAIKLAKRPGNAGKLITVIFPSFGERYLSSVLFNSIRVEAENMKFD

SEQ ID NO: 80353 - protein, 409 aa, Clostridium thermocellum ATCC 27405
MKQQRQYPKIMISRKAERSVKDGHPWIYGEEILKTEGELQNGGLVDVFAGNAFMGTGFYNSVSKITVRLISRNANDVFDARFWRRRVEYAVRYRKTVIPGADFACCRLIHGEADHMPGLTVDRYGSLLSVQITCLGMELVKDTVYRALWDVLTEMDETITGIYERNDIALRTREGLPEYKGWYLFDGIPRPESAVTEICENGIKYLVDVENGQKTGFFLDQKYNRAAVARIAKGKRVLDCFTHTGSFGLNAALGGAEHVTCVDISQSAIDMAKANAVRNGLDGKMDFVCEDVFDLLTKLAEQKCHDYDYIILDPPAFTKSRKTVQSAARGYKEINLKAMKLLPRGGYLATCSCSHFMTDDLFRKTLASAAKDASVSLRQIEARQQAPDHPILWNVPETDYLKFYIFQVV

SEQ ID NO: 80354 - protein, 585 aa, Prochlorococcus marinus subsp. marinus str. CCMP1375
MTLLVQKFGGTSVGNVERIQAVAKRIALCKEEGNQLVIVVSAMGNSTDELTKLALSISGNPPSREMDMLLSTGEQVTIALLSIALNKIGIPATSMTGAQVGIITESAHGRARILEIKTERIKELLNAGQIVVVAGFQGTSLSSGKTAEITTLGRGGSDTSAVALASALEADACEIYTDVPGVLTTDPRLVHDAKLMKTVSCDEMLELASLGAAVLHPRAVEIARTYGVNLIVRSSWKNEPGTTLTSQAKQSIVRGGLELSRPVNGIELIEHQAVIGLSHVPDQPGIAADLFETLSKGGVNVDLIIQSTHEGNSNDITFTVSEQNLPTAKLLCEKLIKKLGGELTTQKQMSKLSIRGAGIMGRPGIAAKFFETLSKSGINLRLIATSEVKVSCVINSEFGTKGLKVTSKAFDLKNNQIQINPTIDCINEPEVRGVALDPNQVQVSVVNVPDVPGSAGTLCRSFADSGIILDTIVQSERKGDANGKIISFTLNKSDRENADSALTPLLRKWPNAYMKDGAAIARISAVGAGMPASIGTAGRMFRALANKKINIKMIATSEIRTTCIIAEKDGNHALEAVHTFFKLNA

SEQ ID NO: 80355 - protein, 304 aa, Cytophaga hutchinsonii ATCC 33406
MNYQAILNQIQGDIQPYLGQGKVADYIPALAGINPSKFGMSIHTIDGITATIGDAQEQFSIQSISKILTLTMAVSLDDTNIWKRVGREPSGSKFNSLIQLELEQGIPRNPFINAGAHVITDLVYSHFDDPKEAILAFTRMVSMNDSISYDYVVAQSERETGNRNLAMGYFMKSFGNIENKVRDVLDVYFHQCSLAMSCTDLSKAFLYLANEGVLPTSEKTIITKKNSDRINALMLTCGMYDSVGDFAYRVGLPSKSGVGGGIVSIVPGEMVIAVWSPGLSESGNSLAGTKALELFVNYTGKTIF

SEQ ID NO: 80356 - protein, 354 aa, Ustilago maydis 521
MGNCLSSSDQKEAKDRSVAIDKQIEEDSRKFKKECKILLLGSGESGKSTIVKQMKIIHQNGYTKDELLLYRLTVIKNLVDSAQAMVLALRKFKMEPEMPENRENVDAILQYRVDADPGATLDHAMARKVDSLWKDPIVPAIMERSSEFYLMDSAAYFFDNVNRIGQSDYVPNENDVLRARSKTTGISETRFNMGQLSIHLFDVGGQRSERKKWIHCFEAVTSIIFCVALSEYDQVLLEESGQNRMAESLVLFESVVNSRWFLRTSVILFLNKIDIFKQKIPKQPLSKYFPEYSGGPDINKAAKYILWRFTQTNRARLSIYPHLTQATDTSNIRLVFAAVKETILTNALKDSGIL

SEQ ID NO: 80357 - protein, 259 aa, Nocardioides sp. JS614
MTGRIQGRVAVITGGCSGIGLATVQRFVQEGAKVVIGDIDDARGHQLVEQLGGADVATYVHVDVTSKEQVDALFQTAKDAYGSVDIAFNNAGISPPEDDSILDTDLDAWRKVQEVNLTSVYLCCKAALPHMLEQGRGSIINTASFVAVMGAATSQISYSASKGGVLSMTRELGVQFARQGVRVNALCPGPVNTPLLQELFAKDAERAARRLVHVPMGRFGEPEEMASAVLFLASDDSSFMTASTFLVDGGISGAYVTPL

SEQ ID NO: 80358 - protein, 675 aa, Candida albicans SC5314
MSNEYILVTGGAGYIGSHTVIELISNGYKVVIVDNLSNSSYDAVARIEFIVKQHVPFYDVDIRNYEQLNKVFQDYKISGVIHFAALKAVGESTKIPLAYYDNNVSGTVNLLEVCKANDVKTIVFSSSATVYGDVTRFGDNSMIPIPEHCPMDPTNPYGRTKFIIESILKDIYNSDDAWKVAILRYFNPIGAHPSGLLGEDPLGIPNNLLPYLAQVAIGRREKLSIFGNDYNSRDGTPIRDYIHVVDLAKGHIAALAYLKNLQSKGLYREWNLGTGKGSTVFEVYHAFSKVVGRELPHEVVGRRAGDVLDLTAKPDRANKELQWKTELTIDDACKDLWKWTTENPFGFNIENYSWKEFDGFNNRLHSFVAGDLKVNLANRGALIQAITLKDSNMVKAYNNAEDFKSETNPFFGTTVGRYANRISNGEFKLNGKVYKLTKNEGANNLHGGANGFDKQDFFGPVVKSRDGKFFVDFLLVDKDGNDGFPGELEAIVHYTIDDSSVEIEYECQLLSGEATIVNMTNHSYFNVSNSDTIEGTEVKLITDKMLEVDSQLLPTGKFIENEKAASPIVLNENDVFDNCFIVDEECGIDTRDKPLKQVFEATSFVTNNKLKISTTEPAFQFYTGDGVNTKGFGKRCGFCVEPSRFINAINHKEWSNQVILKKGDVYGSKIKYEFQ

SEQ ID NO: 80359 - protein, 168 aa, Candida albicans SC5314
MKVYSILILNKAGGLIYQNELVPGLSKLSANDYLVLAGTLHGVHAIGSKLSSTINNNNNPNGEELNAAHNAIILSSGKAGSANSNRTGLQKIETDMFNLYIFQTVSGLKFIMITAPNVANSETVTDELFRHLYILYSDYVMKDPFYSLDMPIKSSLFDGRVKQLFAQS

SEQ ID NO: 80360 - protein, 459 aa, Nocardioides sp. JS614
MTETRTDRHVVLNPATAAPVTEVPLASLADADAAIESAHAAFPAWRALPPGERAGLLRRFAAVVDAHVDELAELEVRNAGHTWGNARWEAGNVRDCLNYYAGAPERLFGRQIPVPGGVDVTFHEPLGVVGIIVPWNFPMPIAGWGFAPALAAGNTVVLKPAELTPLTALRIGELALEAGLPEHVLSVVAGKGSVVGERFVTHPLVRKVCFTGSTEVGKRIMAGCAEQVKRVTLELGGKSANIVFADADIDAAAASAPYAVFDNAGQDCCARSRILVERSAYDEFLSKLQPAVEGLRVLDPGDEASEMGPLISAQQKAAVTGYLDEVEVAFAGSVPGGPVAEGFWVPPSVVTVDDPATRIWREEVFGPVVAVMPFDDDADAVAKANDTEYGLSGSIFTSDLGRGLRVARAVEAGNLSVNSHSSVRYWTPFGGYKQSGLGRELGPDAPMAFTEEKNVFIAH

SEQ ID NO: 80361 - protein, 455 aa, Pseudomonas aeruginosa PAO1
MSSSPAPESALKPTLGVFDVVAITVSAVTPASSVFVIAPFAIQQAGTGAFWAFALAGVLALMFAWCYAELGRAHSTAGGEYVYAKRVFGGLAGYATFLTVLAMLLFIPPVLATGAATYLNAALGTHFDAQTVALAIVAFSYLLGILNIRVNAWVTGTCLLLEVAALLVIVGLGFGHAQQPASVLLQPQVVGDGGLLAIAPWALVIGAVGTALFSYNGFGGAVLLAEDMKDGGHSVHRAVLWSLALVVLIEIVPLAALLIGAPSLPAMLASPDPIGYLLNSHGNETLSRLVSAGIFLSVFNAIVAIVIQSARVIFSSGRDALWMPALNRAFTRIHPRWESPWLATLFLAIPSAALSFSSNLAELTSFTVLLIVMVYLIVALCALFSRVLRRDREHPYRMPLWPLPALLAVSGAGYLLLNLFLAASARDVMIIVGLLAVSVILYCTYGKLSPAFQKL

SEQ ID NO: 80362 - protein, 676 aa, Arabidopsis thaliana
MVPPELEFNKYLGKGSYGSVSLFKYSKPRTTLYTAVMTCNYKNAESLEKEFGILSEFKGCSRIVQCYENRVIENLDVEGNKEYMMLMEYAAGGSLRTFMKRSEDKKLPDPLIREFTRMILEGLATIHGQGYVHCDLKPDNILVFPRCVYKKRAWRSSYELKISDFGLSKRDGDSKWWHPHRPFVGTAIYMSPGSVSHGETGRGLDLWSLGCVVLEMYTGKKPWWHNNYDLKDLKNWYAPMIPSDLPCDAKHFIMACFALNTNERRDALTLLEHSFLRGVVNKITKPHVKNENPKEIALALGRVVRRPSKVLTSIFKRAGELMKIIKKQPRAPRSNLLPVLLKACCQIYQKNSIVVLFAMVALDLEFERYPGERSFGSVSLFKYKRQRDGETQYAAVKTSSDENAKSLYKEFQILSQFKGCSRIVQCYGNGVKEIFNDKGYVEYKIAMEYAFGGSLSDFMDRFKDRKLSDSMIREFTRMLLEGLATIHRHGYVHCDLKPENILVFPSSVYKNGAWIRSYELKISDFGMSKRDGDTQWWQPRKPYVGTPIYMSPESISHGEIGKGLDLWSLGCVVLEMYTRKKPWWHTNYELEELMKCYEPLFPRNLPCDAKLFLMTCFASEPDERKDALTLLRQSFLHGDVNKFTNRQMNVKIDSADDFTLQLEKVSQMLSEIRTMC

SEQ ID NO: 80363 - protein, 464 aa, Nocardioides sp. JS614
MAQNETQDESGLRNSRHLTMHQLVDRIESGVIDTVVVAMTDMQGRLQGKRLHGKYFVEHVARHGTEGCNYLLAVDVDMNTVDGYANSSWEKGYGDMEFRLDERTIRVLTHLPATAMIQCDLVWPDDSPVTQSPRGILRRQLDRCAEHGWTALAGTELEFIAFDTTYEQAHADGYRDLVPSNQYNVDYSILGTSRVEPLLRALRNHMYAAGLDVEGAKGECNLGQHEVGFLYADALTTADNHAVYKTAAKEIAAQQGKAITFMAKYNQREGSSCHIHLSLRGRDGSLVFWDRETGTRTPLYDRFVAGVLATIPDFTLLYAPNINSYKRFADGSFAPTTIAWGLDNRTCAVRLVGHGASARMENRIPGADVNPYLALAAMVAGGLHGIENELPLEDELVGNAYTSGRPQVPRTMTEARDRFAGSAVARAALGDDVVDHYVNMAEVELAAYNAAVTDWELRRGFERL

SEQ ID NO: 80364 - protein, 550 aa, Leptospira interrogans serovar Lai str. 56601
MQICRGKETCKAGRVLKMEKQKRVDQISKLQKESFDILVIGGGSTGAGAAFDAAKRGYKTALIERKDFASGTSSRSTKLIHGGVRYLAQFHFKLIHEALTERQRLLENAPHLVKPLKFVLPAYRFYERPYYGIGLTLYDILASKGKLPSHKTVSKSETISEFKAIKRDGLFGGITYYDAQFNDARLNVLLARSAQKEGAVVANRIELVSFIKKSGKIVGANLKDLETAKTFPVYTKVIANTTGIWVDHIRKLDDPRTFNVLSPSQGIHLVFSKERVPCTSAMIIPKTKDGRVVFIIPWEDHVILGTTDTPIENPGEEPLPIGNEVQFLLDTGNEYLENPVTEKDILSVFVGIRPLISPEGNQDTKNISREEVILVSNSGLVTMGGGKWSTYRKMAEDLVDKLIQIGNLEVREKCSTKFYVYPGAADYSESLYQEIEKTYKIDTIFAKRLQNYYGTEVFEVLGKKPKLLGKGIPYFEEEVLFAVNEEFALGVTDVLARRFRILFVDLSLAQKMVAPVAMVLSKQLKWKDKTKKAEESAAMELIESLRKSYR

SEQ ID NO: 80365 - protein, 411 aa, Neptuniibacter caesariensis
MALYVQKYGGTSVGTVDRIEAVADKVAGFKAEGHDIVVVVSAMSGETNRLIGLAKDIQSAPNPREMDVLVSTGEQVTIALLSMALDKRGISARSYTGSQVKILTDTAHMKARIQDIEVSSMQSDLEAGRVVVVAGFQGVDDQGNITTLGRGGSDTTGVALAAALKADECQIYTDVDGVYTTDPRVVEGAQRLEQITFEEMLEMASLGSKVLQIRAVEFAGKYKVPLRVLSSFEDGPGTLITTEDDSTMEKPVISGIAFNRDEAKLTVVGVPDVPGVASRILGSISRENIEVDVIVQNVAADNTTDFTFTVHRNDYDAAEKVLQKVAEELGAREVAGDNKIAKVSIVGVGMRSHAGVASKMFDALAAENINIQMISTSEIKVSVVIAEKYLELAVRALHSAFELDADDTVSE

SEQ ID NO: 80366 - protein, 450 aa, Glycine max
GNPRLNLASFVTTWMEPECDKLIMAAINKNYVDMDEYPVTTELQNRCVNMIAHLFNAPLEETEAAVGVGTVGSSEAIMLAGLAFKRKWQNRRKQEGKPYDKPNIVTGANVQVCWEKFARYFEVELKEVKLRDDYYVMDPEKAVELVDENTICVAAILGSTLNGEFEDVKRLNDLLIEKNKITGWDTPIHVDAASGGFIAPFIYPELEWDFRLQLVKSINVSGHKYGLVYAGIGWVIWRSKQDLPEELIFHINYLGADQPTFTLNFSKGSSQVIAQYYQLIRLGFEGYRNVMENCRDNMLVLKEGLEKTGRFSIVSKDNGVPLVAFTLKDHTHFDEFQISDFLRRFGWIVPAYTMPPDAQHVTVLRVVIREDFSRTLAERLVSDVEKVLHELDSLPARVISSTTVTLSAEENGKVVVAKKNPMETQREITAIWKKFVLERKKNNDKMNGVC

SEQ ID NO: 80367 - protein, 503 aa, Rubrobacter xylanophilus DSM 9941
MSAPASEVHPKLFIANEWRPSHTGQTFETVDPSTEEVIASIPRGGAEDVDEAVSAAREAFNGPWRRLTPEDRARFLYQVARSLESRLEEFARLETLDTGKPLQHSRNEIRNCVRYFDYYAGAADKIHGETIPLGPNYLDYTVREPLGVTAHIVPWNVPLGMVCRSLAPALAAGNAAVVKPAEQTPLTALKLAELFLELDAPPGVYNVVTGFGEEAGRALSEHPGIDSITFTGSVETGRAVLRAAAEHVRPVVLELGGKSPQVVFADCDLDFAADEVAKGIYSNSGQYCDAGSRLLIDGSIKEPFLEKVIERARAIKLGAGMDEPDMGPLVSEEHFKRVLGYIEVGNKEGARMLTGGRAEGFERGYFVAPTIFDEVESNMRIAQEEIFGPVLATLSFGSEVEAIEIANDSSYGLAAGIFTRDIDRALRFASEIQAGYVMINEYFSGGMGSPFGGYKQSGIGRERGLIALDNYTQIKNVVVKVGQRLPRRSAGIQDALAPITKPG

SEQ ID NO: 80368 - protein, 401 aa, Cryptococcus neoformans var. neoformans JEC21
MVIFNRKSKARFDGEPAPTEKEKVKWSKRPANTAFKQQRLKAWQPILTPKSVLPTLLIIGIIFAPIGALIVWGSGKVTTITLDYTECDVDAPTDGSYQAMPSSAYQYDLATSSSVSKSSIAAPTWTFSNDSSRAVGETARCEIEFEVPYDLGPGLFLYYKLTNYYQNHRRYSSSFDATQLIGDSRSLSQINGGNCKPITSRDGKPYYPCGLIANSLFNDTFPSVVLLNPTNGAQNQTYNFTESGIAWGGIKKNYASTLTYISPSDVLPPPNWALKYPNGYVDGFPNLREDEHFQVWMRVATLPTFRKLWARNDDEVMTQGRYRVIANMNYPVKQFSGTKSIVISTVSWIGGKQPFLGWAYIAAAILCVVLAVAGLIRHLVKPRKLGDMSLLSWNQPNPNGL

SEQ ID NO: 80369 - protein, 285 aa, Zea mays
  misc_feature (7)..(7): Xaa can be any naturally occurring amino acid
  misc_feature (46)..(46): Xaa can be any naturally occurring amino acid
  misc_feature (85)..(85): Xaa can be any naturally occurring amino acid
MFLLDSXVVRCFEDDDIVHVNGKVDPRSHIDVINLELIFSDLEQIXKRLDKLSMSKTKDTHVRVKEQAEKSRLEKIQQALMEGKXPARSIYLETSPSATVDLAQHEKEAIKHLYLLTMKPFIYVANVTESDLAEPDSNSHVKEVAKAASDLQSGMVTISAQVEAELAELPLEERVEYLKSLGVVESGLGNLVKATYNLLGLRTYFTTGDKETKAWAILSGMTAPQAAGVIHSDFQKGFIRAETVSYDDFVAAGSLGVAREKGLLRLEGKDYVVQEGDVMLFRFNV

SEQ ID NO: 80370 - protein, 286 aa, Thermoplasma acidophilum DSM 1728
MKIIGLQSSSSLARKVAEQLHSELVLPEERRFPDGELYVRYDADLNGEDVFIIGNTHTDAEIIEMILSLSAVRDYQVKSVNIIAPYYGYARQHQRYRRGEPISSQIFTEIFASYSTSIATVDIHDEQTLSYSKVRFTDLHADRSIIDFYRHVDIDYVVSPDDGGLQRVKHVAEALGKKYFYIEKKRIDDRTVEMKAPDIDLNGKKVLILDDIISTGGTIAKSSSILRQKGASKIYVSAIHGLFVNSSESKILENADEIHVTDTVAGKFSDISVYQVVCDYIAGKHA

SEQ ID NO: 80371 - protein, 465 aa, uncultured marine bacterium 105
MVTKETKAHSHTATSYTSDVLASVLERNTAEPEFHQAVEEVFTSLGPVLERRSDYRNARILERIVEPERVIMFRIPWQDDQGGIHVNRGFRIEMNSAIGPYKGGLRFHPSVNLGILKFLAFEQVFKNALTTLPMGGGKGGSDFDPKGKSDSEVMRFCQSFMTELARHIGPNTDIPAGDIGVGGREIGYMFGQYKRLRNEFTGVITGKGLNWGGSLIRPEATGYGSVYFAAEMLATKGKSLEDKVCLVSGSGNVAQYTVEKLIQLGAKVVTLSDSSGYVYDEAGIDKEKLEFIFDLKNVRRGRIKEYADKYKNVEYTASNPALDHNPLWNHQAQCAFPSATQNEINEKDAMAMLKNGVELVSEGANMPVTINGINQFLDAGIFYGPGKAANAGGVATSGLEMTQNAQRLVWTRAQVDERLQHIMKAVHKACYETAEHFGMPNNYLVGANIAGFVKVADSMLDQGIV

SEQ ID NO: 80372 - protein, 213 aa, Vibrio campbellii AND4
MSDNNQCVIVGIAGASASGKSLIASTIYNELREKVGDHQIGVITEDCYYNDQSQLSMEERVKTNYDHPSALDHDLLCEHLEQLVRGEAVEVPEYSYTEHSRTNNTTPMTPKKVIILEGILLLTDPRLRDLMHATVFMDTPLDICLLRRVKRDVEERGRTMESVLKQYQQTVRPMFMQFIEPSKQYADIIVPRGGKNRIAIDVLKAHIAKLLKA

SEQ ID NO: 80373 - protein, 559 aa, Prochlorococcus marinus subsp. marinus str. CCMP1375
MSKTYQPLHQKYRPKRFDDLVGQDSIVATLKQALISNRIAPAYLFCGPRGTGKTSSARILARSLNCQQSEKPTIAPCCQCNLCKEIGKGTALDIIEIDAASNTGVDNIRELIERSQFAPVQARWKVYVIDECHMLSTAAFNALLKTLEEPPSQTVFVLATTDPQRLLQTILSRCQRFDFRRIPITSLTSHLTTIASKEKIEIDQESINLIAQRSEGGLRDAESLLDQLSLLKPPINLQSIWELLGEVPENDLIILTSSLISQDPISLLKTCRKLFDNGKEPISILQGLTATLRDLVLIKSLPDQPSLCSLSKQSQETLTKISSELELDRILYWQKYLKGSESQIRFSLQPRLWLEVLLLGLLSNPNISEKKASKNIQEVKVNANNTLNNDHVIEKQILNTDESVRQEVTADNEQSKSGLLSQWEQILSQIELPSTRMLLSQQARLTNLTKNQAEISISENWLGMIQSRKNIIQKAIRKCLGENIELSLIQQSKLNTPSIEVDDKNLLTEKNIKDRNLKLDSNKLNNNNTSSKLNDVISEETENFANFFNGKIIDLEGNE

SEQ ID NO: 80374 - protein, 217 aa, Helicobacter pylori 26695
MKVAPSLLSADFMHLAKEIESVSNADFLHVDVMDGHYVPNLTMGPVVLENVTQMSQVPLDVHLMVENASFFAELFAPLKPQIISIHAENEKHPHRVLQLIKNLGITPGIVLNPHTHEESIKYLLESVGLVLLMSVNPGFGGQKFLDLVLEKCLKVKELIKRYNPSCLLEVDGGVNDKNIFELQQAGVDVVVSGSYIFKSKDRKLAIEGLQNVRQSLA

SEQ ID NO: 80375 - protein, 496 aa, Brassica napus
MAMIGLLEVFVAFLFFLVFKHFFLHKKSPGQPILKSWPVLGMLPGMLPHIPRIFDWTFEVLEATNLTFFFKGPWFSGTDMLFTADPRNIHHILSLNFGNYPKGPEFKKIFDVLGDGILSVDLELWEDLRKSNHAIFHHPDFLKLSASSNTIKLKEGLVPFLDNAAHENIVIDLQDVFKRFMFDTSSISLTGYDPMSLSIEMPEVEFGEAAETGEEAIYYRHFKPVILWRLQNWLGIGLERKMKSSLVTVNRMFAKIISTRREEISRGEGEQLMDALTYYINVDTTKYKLLKPSNDTFIRDVAFSLLLAGRDTTSSVLTWFFWLLSKHPHVLTKIRQEINTKFDPTYLEKLVYLHAALYETMRLYPPVPFNHKSPLKSDVLPSGHKVKAESKIVICIYALGRMRSVWGEDALDFKPERWISESGELKHEPSYKFMAFNAGPRACLGKHLALQQMKIVAVELIQNYDFKFTEGHKIEAVPSIVLRIKNGLSVTVTKKM
